United States Patent 9,328,346 (POLYCOMB-ASSOCIATED NON-CODING RNAS) - sequence listing, part 92

SEQ ID NO: 17200 - RNA, 31481 nt, Homo sapiens
cucagcaagguugagagugcagcuuugcccagacccaggaaaggaggaguaagguccagaaggggagcguaacccugguauuccagucuaacuccauguaagccacaaguaguaggaggaaagcagaggaaucuuacacaguaaauauacaucagcauuaauaggugaagcugugccucuuguaagguuuuacuucauaaauauuuucuguggauagaaaaacaauuguuucagauuuguguugguggaggugcauuggaggcaggguuaauugagaaacagaaugaggaaagcaagugaagcagaauaaugaugcgcuuuggagccaacucgaccuugaauucuagcaccaccacuugcaaaccaugugaccuuggagaagucaccgagccuuucucaaucuccuauuuauaaucuuaaaaagaaguuaguaauaucuuccuuuugugccugacauaauaagugacuaugaaguccaucauucagugcccggugcguggcugcuggcggugcaggccuugguacugcuaucucauggccgaguguucucagucagcaggcacuggcuacgcacuugcugugauccacauuggacugcaggucaugaucuggguuuauguugaaggaggaguacgggagaccuaagagaauggguggaggaauuaauuuucaaagcagcaaccacagagaaaugcaaugagcucuugaugucaacuaaaggaggaagccugcugcugggucagcugacuguggguuucagacgcucauuuggggccaacuaaaaaaagcucaugauggaagguguuauuuauccaaguuuuaccuuucucauauauaaaaugaggauguccauaaggccuaccuuccaggguuguuacaagaauagugcuuguagagcuguuggcaugccauauguacccaacgaauuaucuaguuaauuauuaaugaugucacuucccucuuuacccaagcaagaguaggacuugcaagucucagcuuuuucuggcuuucuuagcuccacucaucacauaaaaacuuuagggcauaaaguacacaaauaaucacacuagauccaaaaaugauacugugauaaugugauuaauaacaaauucuuagauggcaauaguguuuuaagguacagcugaagauuuguaaauuucauuggcuuuggugcuuauaaaagggagaccaaccgcucauugcccagggcagcaaaccacacagucugccaguguugaucuucugaguuucuuaaauagcuuuguaucgcaagucaaaacuucacauuugccaucucucugcuaguaacacaggcuggggugggaucacuuauauguuuuugcuucuaacuguugaaaugugaacaggcuggacuaggaauuaguguggaaaaaucacagaaaaacucacauuccuggaaacaguaggcaggugcaauauuuauugucaucaccaccacuucccuccauaucgguguuaacuuguauccuguccaaagcacuuugcccucaguuggcuuauuugaucugcuuugaagccaagggagaaggcagaggggacuucauuuccuauuuuuucuuuuuuucuguuuuuugggagacggaguuucgcucuugucgcccaggcuggagugcgguggugugaucucgguucacugcaaccuccagcuccuggauucaagcgauucuccugucucagccuccagaguagcugggacuacagcggcaugccaccaugcccagcuaauuuuuguguuuuuaguagagacaggauuucagcauguuggccaggcuggucuuucaaacuucugaccucagaugauccacccgccucggccucccaaagugcugggauuacaagugugagccacugugcccagcccuccauuuuuuuaguuaagaaaauugaagcucagaaagguaaaaugacuugcucuggauuggccugggcugcacuugaacccaaaucuucuguccccccaccccacccccggacucuuccuacaggacugugcauugcuccaggcccaugcccuuacuuuaucuggaggaaaacagcauuaccauaucuucaaaucggguugugcccuuuagaaauggugagcugugcaaauaaacaccacuuugcuguuguuuuaaacuguuaagaagucugaaauucacuguauucaugaagguugaggagagaagagguugguguguaauagcuugguagccguguauccuugaguguguuuccaugaggcuugaucaggguuuguucacugggggccugcucuauaggauucuaaguagauucgcugcucauccacauggcaggcaccagggcucuccccgagaacagaagcucucugcuauaagccugcucccaccccucccuccauccuguccuggacuuccagggccugaaacccuuccauucugagccuugaggaugaauugaccuuaaaagagauuccaacagcaaaugaaacaccuuguguucucacucagaagugggaguuaaacaaugagaacacagggacacagggaggggaacaacacacaccggggccaguuggggaguggggggacugggggauagagagcauuaggacaaauagcuaaugcauguggggcuuaaaacguaggugauggguugaugugcugcuguuuaaaagccugaaagucauccagcucucaugcaaaccaccauguuacauauauaccuauguaacaaaccugcacguucugcacuuguaucccagaaauuaaagugauauuuuuuuuaaaaaaagagauuccaaauaaaauagaaagacuuucacuguauguaacagcauauauauuuauuuuuuaaaaaccuuaggguauugguucugggggucacaaaccuuaguuccuugggcuccacaguauccucauccauaagauacgagugguaagaggaacuguaaagaucaaaugagguauaacuuacaaaagggcuauaaaaauguaagcuugacagaugggaugaugggaggggcugaggaggaggaggaggaggaggagaguagggaccagaccuaaaguuccgagcacuaggugugacccaaggaagcucuacaaugggggcuugaaggcaguuuuggcugauuuuaugauuuugcccaggacuggaccaguugccgccuucaaagcuauucagguugcuuugacuuccagccaucugugccuggaaauguaaaacaaaugguuaauggcaucagaugguuaaugaucucaaauguucccugcuuacugccaugagagagaaaagagccuccuggagaaauaaucauggaugcuguuuccaaaguugcaauuaaucguguauucaggaaaacccaucuucugccaguuauucugauaagaaagaggaaauugagggugacggaggagcugugccugagagggcaguuugaauaaucuguauaaggucaagaaggcagauauagggcucauaaucaacacagcaguuuuggaacaaagccaagagggucuuguccuggcauggguuagggacugacuuuuaugaguccaaaaauaugugucuaaggcuaggucugacuaucuggccuuaaacuuccgaguuguaugggggccauccuuugguugcuuuuuucaaaaauacuuuuucaccauuauugccugaaccaaagauaccuccgcuugucucccuuuggggcacauaccugugguuauguucucguguuucacuguuuuaaaacuuuuucucuuauuuuccaucucuuuccuccagcuagugagaccugcaacgacuuccacccgauguucuucacccacgacagauccuuugaggaguuuuucugcaucuguauccagcuccugaacaagacauggaaggaaaugagggcaacuucugaagacuucaacaagguaauguggaucucggauagaggcaggggauucccgcagcgcuaaaggggccugcugcauggucccuuggcugugugcagaaggcaauuggcaagguggggaaaugaggaagauugcaaugauaguugcuucaagaauggagaaagacaaacaucccuguguagacaugaaucugugugcuggggaugaccucaucccucuggggguacgcuuggagcagcuuuguuccuuugucuaaguuggagccaccagcagagaguuuuucuugggacacguuaucaaggcgaauguuuucuuucauagcauuaguuugggaugccuugucaauauugcaagaucugucggggaaggggccuucccuccaccuguccaggagauugguacagagcaaaugagaucaggaauacugcuccaccuaguccggugguuucuuuguggauuauggauguguugugaucaucugccccgagcuacgucaagaagaauuuuuauuaaaaugaaagaucccuuuccaagaacugagucauuaagguuauaugcaacauuucuugguuuacaguaagcauuugauccuuugaacugagauguccuuuaguuuucuauaucauaaugucucacaagagugugacuuucacauuuccauuugugugugaauaaccagcagagggaagagcauuggccaacuuagagcagaagcacuauccaugcuuucauagagaagcaaaaucuuuguccuuagauaaaggccugauuagcaauaauaacuauugcagccuuuaguacuuuuaauuugcugcuauauacagcugugacuguggucaggcccaucacccaugaccacucucacccagcacuaagggcugugacuguaagagucgaagggucuggcccucagucauacuguggggcuuucaugggcgugcuuggugcauaacauaaucucugaauuucaccugcacuuaauauacuuguuggucauugccucccugucaccuucucccuggauauacaucucauccuuguuucccacuauauuucucauuuguggcaucuugaaccaacaccaauugaaaagaaagaaaaucaggaaaaggaccuaagcuucagucagguccuaaccugaguuucuuccucagcacagugaucucacuugccauaucaucucugucaucccaacgaucuguccuuugcaucuuggucaucgauugaauuccuugaaauagaccccaguaaugcccuucuguggagagcacuggucuggaagcugcaauccagagcugucaugugucugagcagcuaugccggaggacaggcuugauucaagaagggaaguggagaaaagaagcccauuaauuuccuuaggauuauaacugcagccuccuaaguguacuucgcuugauugugagagacuuugcauuucaggugcaaaucaucccugggaaagagggaaggaggagcagggaggccuuuguucaaucaaaccaaaaaagagaauuaaaucaguagucuuugaaauuggcuaagggacuaaggccacuuugcccuggaucauuucagcucuuucaugugcugcugugugaaagccauccaguccucagcuuugcgagcuggggacaccuguuccuccaggagaaggagaccucaccaguuguuacggauuugggcaucagaugucugcuuucugagagaucucauuuauccugcuuuuccuaaauuauaaauucugcauuuugcagaauaauaucugcaaauaauaauguuucagauauuauuguuguugaucuaggcacagauaagcuguguagaaaauauuaugaaaguucugcagaggacugacucuggggaugagcauucagacacuuaaauccuauagaaguuacauuuuguaacaugaagcaccaagaguuccuuguuagcaaaggaagccggaggccccaggauggaggaggugggcacagcugguggagggaggugaccauagcucuagggucccuguggcuuaucauggccaugugcucagauugguggcagacauccugccuguucagggcccugccaggugacagcaagccccccagagugucacugugaaacuuuuaucauaauuagccuauauggcugugaaaucucuucagcaagaccuaagagccagguuuugggugcaguuucuuaccguagcucuaaugccauuuuuugcauuguuuacagaucauagacuaaugcugggggucacaccucuauugccaaguagggaugacaguuuauggcucaggacaggcagcuccaggccugagggccagagguuccugccucacauccaaauagccaucaggcaagagcagauaucagaggaaaauccaggaugggaaggacaaggaauuuuaauuuucuacauuaaauacuuucaucguguuugcuuuuuuucucuuuuuuucaguacuaugcaugccuuacuuauguaaccagaaaaauauaucagguauuuacauuuuugucaugcguauauaacuuuucuguugcugauacaacaaauuaccacaaauuuaguagcuuagacaaugcaaauuuaucuuacaguucauaguucagaagccagcaauggauuucacuaggacaaaaucaaggcggcagcagagcuguguuucuuuccagaggcucuaggagagaauuuguuuccuugccuuuuucacuuucugguggucaccugcauuccuuggcuuauguccuucuuguccaucuucaaagccagcaaagacagcuugaguccuucucagaugccaucccaucacccugaucccucuucugccuuggucuuccaccuuuaaggaccuugugauuacauugggugaccuggauaauccagcaucaucuucccaucuuaaaguuggcugauaauaaccuuaauucugucugcaaccccaauuccccugugcugcagaagguaacguauucucagguucugaggauuggaaugcaggcaccaaugggaagcuguuauucugccuauuuccaguguguauuugauuugcagcuauauuagguuuuuagauguguagaucaguuuaaauuaaugaaacacggacagaggagccuuuuguuugcuuuucuuuuugcugguagacaugauaccugucacagaguucugcuagugacagcucagaugcagauauaauuaugucccuuuucuuuuauggcccuguuccgccuccacuagccuuuuuaaaaaggaagccucuuugugacagcuucugguucauuuugaagacugccuuucugauuuuuuucugcugcccaucuaucagccacuguucugcuuuacuugauaauaaguuggagaagagagaagagcugaaaguuaaaucaguucacuuuucuucuuguuauuaacuugguagcagaggagauugaauuuaggaacaaaugugaguugugaguuacugauagauuuaauguuuuuuucuuauucucugacuguccaaauucaaauucagaaaugucuuuaaaaaagcccaacaugaaacauaauuucuuuucaacuuucuuggacacuaucucagguucuugccacuguaaacagagcauggaagguggguuuauuugucaacccugagacccagggcucugugagcagggcuuagcuaucugucuucuuuagcuccucacuggagaaggagugccccucaauuuaaaauuuugauuugcccaacaaacuaugcuggauucuaucagaggcaggaauagcuucugcagcccgccuuccuugggacaccaguuuauagauaucuagugcuugguaguuaaugccacugcuggaagaggguguuuggaaaagcagcugucgucugcucuuccgggcuugggaagcagcagauggaauguuuuuuauuuauauaagagaaguagaauugaagagugauuaaaauauuuaugcuuugaaaaguacuuucuuucaguuucucaauauagcacucugcagaauaauccauugauucaggccauugaguguguguucuaucauuaccaauauuuuagagcaugcauuauucauuuuuaugggcauuagagaagagcuaaacugcagcuggauaccucagcacacaaguagccccauaaucauuucauugaaauccucauuuuugagcgggauaagaaaggggacacaaguaacuuggauauuuuagguaugggaaucucauuuaaagcauguguggcuaacuacuccacuguaaaaaaaaaauguaaugagaguauacacuuuagaguauaugucuguguguagcaguguuucucagcuuuagcuguacgucagaaucaccugggggcuuuugaaaacccuguuaucccaccggccaaccgcaccacagauuaauuaaaucaucggggguggcgggggaagcuaugaaugaguauuuucauuaagguagauuugaucauuaaaggugauuuauguuaauagaaucgccaucauuaacacaugugauacuuaucacaagcuacuguaaauuucgugcauugauggaguaggaugcuuguugaccugugugacccagguuuucauccuggaucugcuauuccagagcucuaugucugagaaucuaaaaauaauaauaguuuuuaaaaggauacaucacccugucuuuugguggggugauaauaaauugaaguaauuacuguaaaaaugcucugaggaaguaaaaaugguauauguaguuguggaguguucuuuuguacugaauaagauaaagccugucuaugaaaaaugaguaaauugcccuuuucacaaacagacauuuuuuggcuauguuaaaaaaaaaaagugaagcuaugaauuucacaguaaauucugaacugaauuaguaacccauguaacuuugacaaaaauaggcuuuaagcugaaauuuucauggauuuuggaagugucuuccuccaaacaacuuuauuagguaccuuaguuucccgugugaaacacacgguagcaaccuaaaaaacagcaggucccaugauuuucacauauuuaauggcuggugagaauuaaguccuccccaacaauuacuaguugcccagaucucuucgcugaugauugacgcuuuuauaaaccaucaaaauauuuguuccuagcauuggcguuacuuuagacgcuaucaaaauugacauuauaagccaagaucagaugauugugccauacuuucagauuaccaaaauggaagaaacuaauuugaaaaaugaagucacucuagaguaaaagcacuaucuugaaacuuuaucuagcagcauaauaaacuaagcgcacacaauagagcuuagaaucucaggcuugcaaaugaaaaaccaucccuuaaaauagcagagacugugcacagggagaacccaggcccauuaaacaaagcugcagcugccccuggccaggcugugagcuucaaccgagucaaugggagaaaaucucaauuaggaagaacgggagagcaggacagaaggaaacauccugagaaaucuccuaugaagauuauucauaggaaauaaccaccagcuagucacaucuaguggauuauagugugggauagaaaagggauuguguuuaaaaccuuaaaggcagcuaacacaugaauaaaaaagggaaauguguuugcuucucaaacuguuugcagcuuacugacuuucugugcaugcuuuucaggggacaauuauauauucaggagucuccuuacuagggcaguucaacuucauaguggugcagacggcgcucuguugguuagcugagcuggccuagggaaugaaagguggucuguaagucucaucaugaauaaacaugagucuccucauuugcgugaggcaggugacuguaaaauaucuuggagcaagcugugaaaggaagcuuugugcauccaugcccaggggaagcugggaggacucagcguuguuuaucuucauuagaauuccaucuagugcugcuguuauugaucugaacugggccugguguggcuaauaaaguagguguauguuuuaauugaaacaugaauauuugaguagaggagaagucuuuuaaagagcccuaauguccuacacugagcuuuuccauuuuucaacugucuaggcgauuaacaagcauuuuuuuucaaaaggcuucugauguuucacaaaggucuuagguuugccacacaggcaguggaaccuccucuagaagcaaaugcauuauaugaauagauuuaauuauuauuucuuugauauucccuguugaauagguagcaaagaguuucauaugugugucuguguuuaagcuguucauguaagauaguguuaccuauuuccauggaguuugccgcuuucuguuggacagcaaucaagauauguccucuccaauccuuaccagugucaauuauacuauccagagacagcagaaagaccgggaaagugacuuugguaacuuaucuuuuucaauaaguguauguucaaauagaccccaaugucauacauaaacagauauguguuaauaacagguaacauaacccuggccaagucagggaagcacugugguacagagcaauauuucuccuucucuuuugcauuaucaccccgcuagagaguuuuauagguauuuuuccccaaucacccucccccugaaauuguaauuacagauauauuguauaugucuuuguguauguauaccugugccugcuguguaaaaagaguaauauuuacuccuccaagaaccauuuuugugcccucccuaaggaugauguccccacucccucaucaagaaugcauggugcaaaggcaagaaccaaggcugaauuagcaggaggaucugguggcagucccaguuggccccucacagcagugugaccuugagcuuguucuuuaaccaccaaguccuuucucaccuguaaaccgguaguggcaauaguaauaaauaauacuucccagagucacuguggggauuaagcucucauuagguuugcuuugcaaauuguccuauacaaauaggagguccuaaucucaacaggcaaaaccuaaagugucaguaauuugcacuuuaucaugcaguguaauugagcugccuugauuuccccagauaguuuguucaaauauccauaaauacagauuguuuuauaccucuguaugggggugcguugaacuuuaguuuggccacagaggggauuuugaccacuguggucacuccuccccagcccacccacaaacagauguacugcaggugaggcagggggcuggggacaguacauaaaaaugccaagggccucccuuccagcuggguaaccuugugcaagggacuugguucugcuggcuucagauuccucaucugugagaugggaauagguaauuacccacagcuaggauggcugugcgcccugaugacaucaggcagauaaacuggcaggcucagcacuggccuggagccaacaccaguccacaguaauggagagcagggagaagaccaggugacacgggauuccaaaugccucugaaaaggaaaaggaugcucauggcaacacugagagcaaacaucuucaggaaagguggacaagcugcucccucaaguuuagugauuaacuuaguagugacucuuuuuuuuuuuuuuuuuuuuuuuuuugagacagagucucgcucuugucacccaggcuggagugccauggcacagucucggcucacugcaaccucugcauccugaauucaagugauucuccugccucagccucccaaauagcugagauuacaggcgcccgccacgaggccugguuaauuuuuguaauuuuaguacagaugggguuucaccauguuggccaggcuggucuugaacuccugaccucaggugauucaccugccuuggccucccgaagugcugggauuacaguugugagccaccaugcccagccaguaguggcuuaacuucuaagugugcugccgugguggucucagcugcaugggguccauggcagcuuuuaugaagaacauagagaagaccuuagagggugaccaauuuucagggacuguccugggguugugcacuguacccugcaucucccaacccucuacccgcugaauuuacagcccuggcagcaucucuuuauaaggaaggagcaugcgaggaaucugagucauccagaaagaguuggauuuuguugacccuguucauguaauuuucuuuuuuucuuuuuuuuuuuuuuuuuuuuuuuuugagacagagccuugcucuguugccaggcuggagugcgguggcgugaucucggcucaccgcaaccuccaacucgcugguucaagcgauucuccugccuuggucuccugaguagcugggauuacaggcacgcaccaccaugcccagcuaauuuuuguauuuuuaguagagacgagguuucaccuuguuggccagaauggucucgcuauccugaccucaugauccacccgucucagccucccaaagugcugggauuauaggcaugagccaccgcgcccggcccauguaauuuucauaaaaaugguuaaacuauuuaaaaaccuguuuaaagguugacugcuaucuuuagcugaaggcauuuuuaauauguuuugcuuucuggacauuuucuauaacaggagcauuuauaaaaauggucuugaccaagagugaaucuuaccauuuugaauaagccugacaguaguaaauauacuucuuggguauuccuuuguguucaagauuuugcaugaggugcuucucauuucugaagucuuucuagagccagugucuauguuucuuugcauguguagcacgugcuaacuugagauuugccaauuaggaggagaaaauaauugauuuguucuucugcuggacagcagugagauauaucagucccuugguucaauuucugaccaucccugagcaugagaauaaugaugacuuuagguuaacugcuuuccauaacucuguucaguaacuucugaaacuucuuucauuuuauuaacuauacauuggggcuguguagaaaccaguuguuaacugguuucuaugaccugaauuccagauuccguuguggauuauaugaaagguuugauaaugucacagaaaccauuuuauuaguauaugucccauuaaaaggaaauuaccuacauuuuaaguaaggcaugaugagauuuaggcauuuuaaauuaaagggcagauaggaaccagaguuggauagcuaagaaggguaccauuaggugggaaucucucaugaaauacaaggccucauugauuuaaaaaaaauauuuaucuuguaauugcaaaguaaaugauguuacaugggagguuaagaacacauuuccaaaaagagaugagucuccuaaggcagaacagaagagcacauaggugcugucauauaggugcccccuauugccaacugaggguaccagauguugugaugaauggaggguugagggcaacaaggggcccuagacaagauaaaccaagcagucagagugagagagugggaucagaagcuauuugcaaagacgccaaaacaagagcuagaagaaguuaggagauccuaagugagauuuccaaauguuuucugcggaauaccagauccaggugcuugguaguuaaaauauauauuuaaugacuaaaucauaaaacaugcauauucaacuucauaugcauauucaaccucuaauuuacauugguuguaugucugcaaauuuuucagaacugugcucuuuuaucugagcaacagugacuuaugggucaagauuaucugccuucauuuuuccaaguaggagcugaacacugaucuuccuuguucaacccacacacugacccuccugcucugucaccagcauagagccaagucauuaagucagacagguccgaagcaaggacagagguugagaggccagaagaagauaucaaaguaaggcuacauuuggcagugguucccuccuucuuuucucuuuucuuuucuuuucuuucuuguauuugagacguugucucauuauguugcccaugcucaucucaaacuccuggccucacacaauccucccaccccagccucccgaguacccgggauuaaaggugugagcuaccacucccagcauuccagccccuuuuuggcaauuauuacagggagaaaaaugaacauuagaacuugaauuugagagaugauaauuccaaaccgaauuucuucuucugcccgccuccuucuucccuuuauuuucugguuucuauguguuuucuuccuauucuaguaaaguuaaaauaauagaugaucaggccaacuguguaggaggaagucauuuaggcagguaaucagcucagauaucaaucggaccaccaccuuccucaggaaagugcucaagccugcagcuaucacuuuuggcaacaacucacucagaugccccugaguugucccucuugcuuugucccuaggaauaccuauacccuagaacuuaugucagugaacugcaauugccuaucuggcuuccuaagagcagagccuugcucuuucuguauucuaaguaucuagcaccaugccuaggaucuagaagguacucaaaguuacuaucucaccaccaucauacauacagcacagccacaucagcauuccacaucuugguuaauagggucaauauccaacuuacucuucaaaugcuauucauucuuucaacagauauuuauuugugucuacaacacagugcuugugguagacacugggaguacagaggugagcaagacaggaugguuccugcugucauagagcuggcagucuaguaaguuucuacuuagaaauuuaugggcuagucccucuuugugaaacugauuaguggccaaagucgguacaaucaccacaugguccuuuaccuuuucaucauugccucaguuucugucuuccucuucucucaccccaaugugauagauugaauggcuggucacaguucugcacugcuucgugguaguagcauacuuccaaauccuugccaugaccucaugaugggugaagugaauuuccuucacccuuugacuuuugucuuggccaagugaacuugcuugggccaguugagaugugcauggaugugaaacgagcagaagcuugacuguugcucaagugauugagcugggcuuuugcacuuuuaccaucaucaugagaacuacauaccuugguagccacugcuccuucaguguaggucccaaaaugagauauauggagcgcaguuuuuccagucagcccacagagcuugaaagagccaccucagcugaccuguagaucugugaaugugagaauaacuucuuaccuguuggaguuguuuguuacacagcauuaacaugacaauagcugacuaagacagcaacuguuacaccaacuuaucucccagcuuggaaaccuuuccauuuuccgaaucuccuccaacacagaucugaccauaucauucuugcuuuuaaaacuucuguggcuguucauugccugacucauuaaauuuuguggccucagcaagauguucagauuuaucuuuaauucaccuaaaguaauuuuucugcuuuaucuccauaucuucacccugcaccuacccuaggcucuaccugaacugcucuuguacgugcaauugcauuuucaugucucauucccucuaccagaaacgucuucccccauuuaccuguugaaauuucacuuauccuuuaggauuuugcacaagugccaccuuagcaagauaguuaccaucucccuuuuauuuauucagaaugaaauuuuguaugucuacucccacagcauggaauucaaaauuuuuuggaaaauaucuucuaguucuauagcaguuguuuauuuuuaagucugucuucccaaauaaaucauauauuucaauauaucauuggaagcaagagcuagauuuuaugucuuaauauccuccaggugcuuuuaaguaguaucugcucaaauacuuuguguugaguguugaauuaauuaauggccagaaauguuuaauucaaugaucauuaaaaaugguccaccugaccaguaagcugaauucauauacaccgucuuaauaugggguggccaccguuguucaauuccugaaggccauggguauuuugaaauuccacacaauaaagaauuuucuugccccaaaugccaacaggccuuauugagaaacacuucuagaccccuccaucagaaucucuucagaugcuaauacucugaggaaguuaugaaaugauuuugccaucuguuucuuaauaaaaauggcaguugucauuauuuuucugccuauguagcuuuauauaaggugaauagaaagcuucaaagacauugaacuuuugcaaaagaaacugaauuguucuuuuuccaagaagauugguuggaacuccuuguuaaaaaacguguguguguguguguguguguguguauacacauauacauauauauauguauauaucccucuguuucauuuucaccuucacucauuuauuauauugcccuuaagccugcuuaacccacauacccuggccauuccaggagcacuguuuuucccacuagccuuguuuccaggccagugggaaaaauaacaucaguaauggcgcuuguucuuucccaggauggcugccgagagaccuuccagugcaaaggacaaaugugacugucaaccuuccaucccauguaggggacugguacuuagccaagcaugccuaggaaauacgugcuugugcagcaggaauguugaaucacaugugugaacacaucaugccguucacaaaaauuaucuuuuguauuuuaccuuuaccucccgaaguuaucuuaaauuggggggaaaaaaugcaucccccuuagaaugucauaagagugggaagacccaguucuugccacagugagaguuuuaagugcuggaggcaaucagcuccccagaacucuucugguccuauuuuccuucuuucucuuucacauauuuguuugcguggcuuggcuggauccgagguguauggcauauggcuuuuugccgcuugagcugccacagaaguaaaugucauuggcauauaaugccagauuuccauuuugugaaucacagagcacgggauucuguccgaaagcucccuggccacuauguguucuuaaagcagaaguagaaaaggaaaagacccacgcaucacacagagaugcuuuuccuauuaaaauguauuuauugccacaacaaguauauauaaaauggacauacuuuugccccaacguguguuugaaaaagguucuuggcuuguuuuauugugguuuuggcacugggcaagccuggacauuugcuuccaagccucagcugagcagaugcuggucggucagggaaucagaugaauaaaaauuugcuugugcauguaccagaaaaaaaaggcugugaguaaaagauaaucaauguuuuuuggaugcaguuuaccagaauuuuuuauucauuaaauuuucaaguuauaaaagcuuuuaggcugauaauggagaccugaagcugccacagaugcagccucagccuuugcuccccugcauggcugagaaaucaagagagagauuugcagauucaaacacacacacacacacaaagaugacauggagccauaugcaacugccaguauuggacuguuuuugucugacaaauacagcaauuucaaauggcucaaccaaaaauuauuguacauucguggaaucaguuguauuuacccauaagcauuuacuguugguuucugacacagucuucuucuauuauucacaguaccuauuucucuuucuuuauucugugaucauuuaacucaccauaauaaguuguaguaaagucuaagucaggagcauuggcccuggacccaaggagugggauucacacccuagcuccuucguuuccuugcugggugagcuugagcagguuaauugcccugcccuguaucccggucucuucgucuagagacugaucgucauggaguuguuuugaggaugaaaugaaccaagauuagguggaaccacaugaaauggccaauauuggaccacgucugaauggcaaaauuuguaguucuguucugcucaucuuaaucaaugaaaagcauuuggggccauucccaugagggaaaugacacgaagaucacacagcacacauggcgcuccagaugaggcauggagaggcauggauucuaguccagcucugccugugaccuccugcgugacccggggcuuuucuccuauccugcacucaccacccucccuccuagacaaugcuguggccccggggauggccuccuucugugcuuugaauuucauccccucucaccugcucuggggcucuguccguuaucauuucuaaucuuugcaucauuagucucuuccucucacaugcugucuucucaccagaauauaaacacacacaaaucucccacauucuuaauaauaaauaaaugauuuucucaacccccuauucaccugugccccugcagcucgguuucugaagucauugccucaguuucccagcucgccuuuucauguauuaauccacugcagccugccuucugcccacaccgagaauauaacugagcaaaagaagagaaauaggacucuaaaaagcacuaaaauauagugucaguccuugaaaaccucuuuagccacaaaagucacugauuuugacaaagaauggccuccgguggacaguuuuaaaucucaaucuuguuugccaccuuuguagcccuugacccugugaaccacucucuccuuaaaaauuuuuuuuacugugacuuuggaaaugaacauacaugcaagauagauauagauauacagauauagauacagacauauauauauuuauauauguauacaaugcaccuaagauauauguacaaauggcacauugaauauacguggaagaaauaaaauaacuauuauuguuccaguuacuagcaacauuuuuagaaaaaaaauuaaaggauaacuaaaaauauaacugagcucaagagaagaaauacgacuccaaagugcauuaauauauauuuugaauacuugaaaaccucuguagccacaaaagacaugauuucuaagaggcaagugggaauugagaggagucguugaguuguucuaaauuuaagacuggaaagaagucacauuguucugaaucccugcucugaugaagaagagagacaucaaaaaauuuauaaaaauacaucuuuuaucccuuacaccuucaugcuauucgcauccucccccacccccaucucuucucuucagccuaaaaauauaccaaaaucauuccuuuccuuaaacaauauuuuccaacccuguuccucuuucaaguucuuauccaaucucuguccgucucugcacugccaaauuuuccgggagagaaugacaucuccacuuucccaccuccucaccucgacguggucugauguucacccacacccaccugcugcaauugcuucauuuagcucaaggucaucuucugauuguucuuguucauccuguucccuggcucugaggcauugacuuguguugccuccugugcuuccugggauccucuccauuccucauucccauggcacugaccccuuuagcacaggcauucccugaggcccuccucuuuuccucuccuaccacugccuccuccccaccuucaaccagcaccugaggcagacagaauuccacccucaucgucuucugagcuccaccccuguggauggucugcagacuccucaaacucgggauguccaaagcuaaacucuccauucucauggcuccguuccugcugcugcuucugugggcucuaacuccaggagugacaccacaaucaccccauaucuuggacuugaaauccaggagagaucucuggcuucccuaccuuuucucucuaguagguccccaaguccuacugauucaccacucuaugagaagggccaccugccuuuuaaugcugugacuccacuuuccugcaccauuaucucagccccagucucugugcaggaacacaugccagcaugaaaaaucaauuggcuuuugucaggccauaaauaccaccaaaagaaaaucuaaagguguuguuaagacagaaaaaaacaaaaucauuuuccuucucuccuggaaauagcuuaaauuuuuuuucuggucuuaaaagaaaucauuccucucaagaaucacuuucuccugucauagcuuagccacccugugccuuucacuuauggacucaguuuguucuguauccugccuucccgccaccaucaucucuuguguagacgauguguuuguuuuuuaauuggucuuccuaaaucuggacuugacccaagccuaaguucucucuccccuagcugccagaaacaccuuucuaggacacagcucuucucaugagacaucugucuucaaaaaccucuggcucucucuucuuccagcaggauagaaaaacuccacauucuguccuaaaccacucuuccaaacaacaugucuauuacgucuagcagcacaccuccuacuaaccuaucguuagucauacugagugcccagcaugccuugcacuucccaguaucugucccugauuguguucccucagcaaggaggaaccuucacucuuuccggugaaaaaucugccuguccuucaaggcccaacucaugggcccugcaaagucccuccauggggacaggaggaauuuucccucuuauguucacuuuucuuccccucucuuguagcacuuaacuuacucagcuauaugcuaaguucggaaacuuauuuuagccaauuaucuuugauuuaaauggguucccauucauucucugucccaccucauggcuaccuugaggcaaugcugcagaauuccaaaggcuugaaaaucauaucuacucucucuguuucuugacucuaccccuaagaaccaggacugauucucacucaccuuucuaccccagagugccuaccaaaaagaaagaaauauauaugagcuuaacaaauguuacuuaaauugaauuuuuauccuauuguugaaaaaaauagcuaauaauguuuauuuuuaaaucagcugauaaggucuuaaaaggaaaaagcacacucuaggacaaacuuugcaaucuacagaacaaacagucuuauggacucaguuuggcauugaagggcauuguguggcuaugacaggaaaaagagugauucuucuaguggcgauuucuuuuaagaccaagaugaaaaaaauuaagcuauuuccaaaagaaaaggaaagggaauauuuuuuucugucuuaaaaacgucuuuggauuuucuuuuggugauauuuauugucugacaaaagccaauugauuuuucaugcuggaaugugcucccacacagacagggcugagaugauggcaaagacuucccuucccaaaccacgcugggcugagucuggagaucccuggcuuccagcuguuugugaggucaauuacaccccucugcauggggaggagacaagguuccuuuggcucaucauccuuuggcucaauguuggaaauucaccaacauugauuaucucauuuguagauuaucucauuuguauaauacagccauuuagaaucauagucauucaaggggggaaaacaaagaugugcauauagauguucauuucauuguuacuuacgagugagaaauugaaaauagcccaacuauucaacaguggggauugauaaauuaauuuauggauacauuuauuuaucuguuaaaauuuuuuuuacucauucagaaugauauucaugaauaguaucuaaauaucagaaacauguuuuguaguauauuaaaugugaguagagcagccugcaaaauuauaucucaacuaaauaaaacuacaaacuaaaaaggauugaaugauuuuuuuuuuuuuugagacagagucucacucugucaccaggguagagugcaguggcgugaucuuggcucacugcaaccuccacauccuggguucaagcgauucuccugccucagccucccaaguagcugggacuaaaggugugcaccaccaugcccagcuaauuuuuguacuucuaguagaaacgggguuucacaauguuggccaggauggucuugaucuccugaccucaugaucugcucacugcggucucccaaagugcugggauugcaagcgugagccacggcacccagccagguugaaugauuuuaacaauggcuucuaugauguuggguuguggguuugaaagaaaaaugguuucuucugcauagugugauuaauuauauuuuucuuuuuuacuaugucuuuaauguuccccaucuuugcuaccuaacauguauuaucuuacaaucauuuuuuuaaagaaacacuuuaaauuuuguggguguggaacuggcaccaagcuccagguguggucugagcaguggugucagucuaggaggaauuucuuuaucuugacauuccauguuauaacuucaggcuaaguuuguuuauucuuccuugaaauagagccuggguuugggccagcuuugccagcccagcuagugcccagcaucuuagccugaaguugauugguacugagaucaaaagcccuucaggcuugauucaagaaagacucauuaacuggaaggaaguucuaagcagaugugauacacuuaagaaaguaagccacauugcagacagagcuggacccagcaccuagaaugcuuguaaaauggauuucugaaagggguaguguucaggagugcuucuacacagagcacccuagucccucucagacugagauugcaggagugggaggaggaaggaaugggagacaacaggggaugagucauugagauguuuucagauauccucauccccauggcuguaccuacgaugcuggauagaaugacagaaguacucagaagaaggcuuguauaaccucucuaaguuuaagguuugcaguaggauuuugucuucuuggcuaaguuaacagauacaucuagagaugguauuccugguguuguauuaguaaaaccagcccuagaggguucccaguauuggugagagcugugaaaagagcuaagugugcaauagccauagcacauauauuguauggaaagaaugcaaaggaaaaauuacauagaggaagaacuuuauuuaagggagcaucauaugaauagaagcucuccaggugagcagaauagagucugcuuggaaaagauauuaaauauaaugaaauucaugaacagaaaauguaauaaauggaacuuuauuguuuucaagacauuaaggcuguauucuuggguucccaagacuugaaggaaacacagggcgacauguuaaauugcauuaucucaggcacuuccuaaauauuacuugaauaaaugcaccaacuccucacuucccacugggauuuuuuugugugugaaauauguuuucucaguguauguucagaauagcugagagguccaacacaauagacucucacaaaacauaagcaagagcacuuauucaagguucaguguaugugauuguuucaaagauuugcuucgucguucucaugcuuuucauuguguggagagaauuguaggcaaugcauuuuggaaaccauguucuaaauuuagcuugagaugacuugguggggguagggauacauuuuuccauuguauauacauggauugguuauugcccuucagggccaauuuuuauuuuuaauaucaaauuaacucuuuucugcaauuaguagcuucaaguugcaggcaaguacuggacaauaaaauaaaauuauauuuuuuucuaaauuuaauuucuccacaaauuauguuauagagcuuauucuugaugaagauugagaauagccugucaaauaucauuugcuuaggggucaugguucacauuucaaagcuuccuuugauuggaaguauucauagauagagaacaguuugaagcgaucuggcucuuacaugcuguugcuauugaaagauggguuuaagaacagcaauccuguuuuugugauggcagugcugguucacuaagacuaggcacacacuuaguugguuuguuuagagagguuauguguuguugcugauauucauugugugacugguuucugauaaagccaacuuacuaccaagauccaaaguuaaaacaacuggguuuaaacaggacucacccuagaauuucauauggugacucauugggccuauggguacccucccccugugguuccauaucuggcucuguacagaccucuuggaucccccuuuaagcuucucugcuuuguccacccccuucagaacaugaccucccuggaauugacugccuucaucucuaguuucuucuucuucuuccuugcuugccaggguaagcugagucugcuuguguucuugaccuuguugguuucugucuugcucaucagacccuauauucuuccccgcaucccugaugcacucuuuucugauguaguguaaucccuguugucacaggagaccggaaugcauagguuaucugugagccuuuucauuugauaaaauaccugugaaugugugagaagaaaaagcagaaaaaguaagggcaugaaaugucuaaccauuugaaaaaacauggugagccguggguuuaaucucuacacacugcaaugaaauuuguccucuaaugagaauaucagaaacuaguuuuuuucucaaaagguagaauuauuugcaugugaaauggguguguuuuggaauuggaagagguuuacuuauucauuagaucugaaaaccaaggaggaugugaugaagcuuuccuuuuccgauggugaagaagcuguuucucauuuugcaccaucuaaaggauauccuaccauuggcccagucgcuuuuugucaccauauugccaguggaugcgcuuggcaagacucagcugagaauuuuggcauuuucauuuuuccuucuggcuugauuuuucaucagccugcaauucuggaguucauuuccaugguauauuuggaaaauucaaauuggcaagugauaaacacagaauuucaccaacuaucccuuugaaggcuuucagcaugaucagagaugcaucauguuggcccuuguucuucaggcccaugcucuucugggucagcccauucacuuauuaggucugugaugccccaagaacuuccagaccuugacucuccaguccugugaaugcaaaucauggucacuucuccaagccuggugcucuggaagaggcaggaagaaaugcauggguuggggaucuguuuauagauggguaugcauuuuguggauccugguguuauuucuuacuguucguagguaucacuuacauguuaggcauuuuguggguaauaaaaaauagcaaagcccagggaaauaaaauucauauuaaugacucauauuuuauaacucagccuuaggaugcuugggaauaaucccaccugcuccagcugcuugcuuggggagcugugaggccacaguggggcgugcugcucagggugcuccacagauggacaccugaguuugaauccugagugucccacuuuacuagauggcaacuggagacauguuaucugaaugucuugagccuucguuucuccauuuggaaauggggccuuuuauagcauaggcccaugguaagcacugcaucugcauuuuuuguuacucuccuaagcuuccacagauguccaggcuuaucacagagagcucagcauccugggaucaaaagauaaagugacagugugacaggguuugcacauucugcucaggaucaucucuccaugaaaaugaggaaaagagaugcaggugccuacguaugggaauguuuccauggaauauuauugauaucucccuuugaggauaaaaagagcuguaaaaaggucuucugacuauguucaguucagguuuugcauauguuuuggucuuaaaaaugcaccauguaaaaugauuagagauaacuguauacuggucagcccaaauacuagagaaauaucucuccaaagucucuugaaugaaauaaaguaguuucacugagccaguaguggcuacaccucugacccauuggggaagaguccccacuucugaucucacauccuugggagauauggucugauucagucugcacugggccuguugcuguuauggaaacgauaucaguguguuuuaugugugugggcucaugcaugugcacguguguguaugagggcauuccauaagagggcugagauguagguggagaagagccuacugcauauacacccuaacuguuuggaauuuucaugaggcuaaguacccugaugaccucccucauaagaaugaauuaaucaaacaaaacugguugcagcguagccaugucguaaacuguagagaccauuaccaucaccuucauugccagcaaagaacaugaauccuaaugaaauggauacucaguggaagcauccaguuugggaccaggagcuggaaaaugaaaggaauggguauaagugccaccucucuuagugcccgguaaauggaaucccuucaucugccuuuuaaaggcucaauauaaauggugcucauuucaguuaagaccuauaggugaacuaaggagaauuuggacagccaguuuagaaauuauucuauaauagucaccauauuuuuuauucaaaaauacauguauaccgccuaacauucuuuuuugauuuguggauuuauuuaaaaaguauuacaaagguauaagaauuacaucagauuuaguaauaauacauuuaauaaaucaugcuuauggaaaggaauaaaauuucaugagauugaaucugccccaagacaauaugggauaaaugguacugacagugccugcuccaagcagaacaaagaguacagguugaacgugugagcgaaauagaaagggauuucuuaugaccuuuauucagaugcccagcagugauucccaccccacccccugaauuuucugaguauuugauacugugauucccuucuccuuuuguggacagcacauaguaaaucugaauguguucagaagcuggaugauaggcuaccuaucauccauguggagccuguggaguacaaguccauuagguguaugcagaacaacuucaugccaguucuugggaacuugacaagcagucauccaaauaugaugcuaacaaaaucuagguuucccucuuuuugaggcucaccagcagcucuguaagcuuuauguacuuuuuucaucacagucuagaaggcgaaaaaaucgccagaaaguccagguuaacuaaauagagcacccagucugggaucuccauaacaaaaccgcuggacaagaucccaugcaaaaauucuuuggaaguuuccucgaagaugcuauagcuauuuuuuucuugaaguggacccucugaaaauaucgaucaagucacuuauuuucuagaacuaaaaccaugacuagcuagguggacgaaagagcuuauuugcuagcuuucaaauagaugaaggggagaaggauugaaggcuaauauaaaauuaucuguuuaccuugcaauuuugucuuaaaaaugaguuuuucaggauaaaaauuaccuuaaaaaacuuaugacguuucacauagugucaacaauaauaauacauagucuuccuaccuuauugcugaugguucuaauaacaucuguauuacccuagugaauguguucuuugugaacuugcaugcucucucuucauaaaccucccuaguaggauaacuaccaagcaccagacugugcugucuacccacccuccacuuuaacuuuggauuauaugauacaaccaggauuugcagucauucaaaagaaagaugaucuuacucucauauagauggucuuuuguaauggcuugaaauagugagacccucugucccauucuccaaaaacugccuuuuuccauuuuauaugugggagauuaauuuugagguagucuucuccuccuuuacaaaaacaucucuuagcagugguuccuaaacuguggugugcguaagaauuccuggagugcuugggaaaauauucgugauucugcccccugaaauucugauuggggagagaugcacuuggaccccaggaaucugcauuuaaugagaauuucuaauguaggugauccuuguggaucacacuuaaagaaucuagagcuugaaucccuugauucaaauccuggcucugcuacuuuuuuguuguuguuguuauuucagucaaguugcuuaaccuccuuaugccucaauuuccucauuuguguaaauaguguaauaacaucucacagagcuuuugggagaauuaaauugguuaaucuagacaaagugcuuagaaugcacuggauuaugaacugcuagguuaauuccugaauuauuaauugcugaauuaauucuuaauugcuggauuaauuccuggauuauuaauugcucaauaaauguuagcuagaucaacccaacaaaucacagaugucuugaaauagauuguuucaaucagguuuguauucuguuaaucugucauucauaucagcugaggaauauauaucuuggguuauguugguguguuaggaugggcaaggagucauuuaacuggagcacugcaaugcauugucauugcuuguaggauaagaaccagacuccuuaacuuggucucuaagcaucugcuggucuggucuuacaccauccucccagucauucucacugugauccauucacauuuggcuucuuucagauuuucaaagaugccauguugccuccuagcacacauguguuuuguuugggucacucuuccccucacucucaauuuauuaacuuuuacucuuccuuuagaucauggcuugaugucacuuucucugaaaugcuuuuccugaucucacuaagugauuauuugugcuaagagaacacagaguucauagcucuguuuuuauacuccauaucacaguuaugcuuaauauuuuugccuccucuauuagagucugcagguuguaaggcagaaaccuugucaguuuguuguaucacuagcacaagugccuggcauagauacuugcuaaauauuuguugagaaaauuauuaaauuuugauugaggaagacuuggauggaaugaugguuuuggcauaaacugaggauuuggacagccuucaagaggaugggaaggcaaaggguggguguccccauggcagaggagacuaggcaggacaguuaagaggagauguuccagaaagaugguagagaaaaccugagccauccaccacccugagggugaauguugucugggcagagcugagaaagauugacaguguuggcuuugggugcuguaccugggugagacuuucuuccuacacuuaguggcauaaagagacaaaauggaaagccaggauucauauucuugaagguacaaauccaacaucaagaccaaugggcggccaggcgucguggcucccgccuguaaucccagcacuuugggaggccaagguggauggaucaccugaggucaggaguuugagaccagccuguccaacauggugaaaccccaucuuuaauaaauauacaaaaauuagccaggcaugauggcacaugccuguaaucucagcuacucaggaggcugaggcaggagaaucgcuugaaccugggaggaagagguugcagugagccgagaucacaccauugcacuccagcaagacugucaaaacaaaacaaaacaccagugggcuauagcugagcauuuggaguuggauggauaugggguuuauacugagcuucauuuaggaagaaaggaggcugagggcgacuguugcuguuuagacaguggauguguuguagauggauaguucagcuuggcuucaagaaucagaaacacacaaagagcaggucccagucuccucagaagccucaucugggucauuacgggcugagggucccaggcuugcagagaccuuuaaggaagagaagguucuccuugagguuguuaugaugccaaggcagaugacgauagggcagagaguaauucuuuucucucuaacauaagcccaaaucggugccuucugugacacuuaccauuuuccaucaaucucuguggaacugagggcuuccgcagaccccugagugagauugccaccuuaugagcccccucgagucugaccaggaugugcagccauucacugcucaguggcgaccccugcugcuaaggagagagauggcagcacauucagaguuggugacauuaauucuagucaugcaacccggggaauuuggagcaagcaggggaggagucugaggggaugaaaaugggcugaggaaauccagggagaucccuaguguucagggcgccuugaugaggugcuaaugcagaaaagagcugggccugaacacuccguacuuacaaaaucuuccacaagccgccaguguaaucgcuucauuccaaagguuggcuaggaaccaccgcagugcccucugaggaauaccauugcaaacuuuaacuuuuauuugcggagcucucagggcuguuaggcaacaaauauuuuuaaagauaccccucuaauucucuagguuaaaaguugcaguaauuuuaauuagggguagaggcuguuuauguuuguuuacauccuggguaggaauuagaguauaaauccucccagugggaccccugcugggaugcucuggaaugcuugcauuccugaguaugugagcaccccuggugugcaugccuuguguguacauggcaagguaucgcgaggugguucuaugacauuucuggacaaaaacugugugugaagagaagguaggagaaagcaaacucacaaucaaauaaaaguagagagaggggaagagaugagauugcaguugauuaugggucuggcagcagauguucugcacgaauccaacucgcugcagccagucuguuucuauggcaacagaaucgguaauuauugagcccaggcacucccccacuucucccaacaagguggaggcugaugaauaugaacuaucuccagcccaucaccagcuuuuucuuuuucuucuuguccuuauuuguuuuuuaguucuuuauaagaaaaagugggggauauauugagaaguaccaagacggggagcuauggguuuauugacaaaagagcauaggacacuaaaauagaaacgaaguuauuauuuuucucuugugauacucuaagagaaaagcucuuccuggaaaagccgaugaucucugaagaugcuaaauaaaugagcaggaguuucccugaaauggaggcgcccuuugauuggcugaucuuuccccgacuccugccaaucggagcaucccugggcuccagcuccauaaacauaagcaaagcuacaugcuuauucuucuggacuuggaguguauaccauuuaaaggugugcggcgggucucuguucacauggcucaacuggaaaccuguuucaugaacaagcuuacucaggaaccaucuggugguauuccagcacauuguucuucagggggacgacucuaagucgcuuugugguggcagcagcuuagaaucaguauuugugguugggaaagauggacuuacgggagcuuggugaguaaaccuccgucucacacauguguccaccgguauuaucagccugagcuaaauguagcuuuguccuauugucugccgagaaaacugaauuggaacaagcacauggaggagcgggcauucaaggguucccaugauguaggagacucugaauucaaaagacugcaugcuuugcuugggucugauccgauuuguagcugacugua

SEQ ID NO: 17201 - RNA, 783 nt, Homo sapiens
auuacuuuuguucucuuccuggugauacaaaaagacaagaagccuccucauugccccuuuuaugucccuguugcucaaaguguagauaaaaggguuaagcauaggagucaccaaacuguagaacagggacaugaauuuguuuuuguccugggaguuggcagagggcuguacauacaugcuaauuacaggcccauagaggagagauacaauaugagaaccacauguguugaagaccuccuucuuucccccugaggacugaauccucagcacaguagcuacaaugaauccacaguaagcaaagauaauugauuagagaacgagggacuaaaauauccucacaauggagagcauagauacauugaauguggugucaaaacgugauaucuugaucaucgcugagaccucacacagaaagucguccaccuuguuaccgccuaguggcagcuggacggcaagggaugacugaaguagaguuggccaaacugcuuagccaugccauggccacuaggaggacacagaguugcugaugcaugauagcuggguaccucaaguguuugcagauggcaauguaaggauccaaagacgucacagcuaaaaugaugcauuuggugcuccccuaaaauauccccuggguaccacaauaauugagauguuguccaccaguaugcagagauaagcaacaagccccauuaugaagagaaacauuuccggcuagggguggucaaagaaaccccagagaaugaagaucuuucgagcaauugcauugcccagauuccugucauu

SEQ ID NO: 17202 - RNA, 515 nt, Homo sapiens
gauucagugaaguacuugaaugaaaguuucccagaggauuucauucucaugggcuuugucaaauauccauggcuggauuuucuucucuucuguguccucuugaccuucuacauguucacauuguugggaaauagugcuauuauucuggucucucaacuagauucccaacuucauaguccuauguauuuccuucucaccagucuuuccgucuuauaucucuguuucaccaccacaacaguaccucaaaugcuguucaauuuagggggcccaacaagaacaucacuuaaauaggcuguauggcccaggccuauguauuucacuggcuagccuguauugaauguguccuucuuggcaucguggccuuagacugcuauguggcugucuguaagccuccaagguacacuauaaucauagaccauaaggucugccugcaccuguccagcacugcuuggcuaauuggucuggccaauucacugcugcagucaacaaucacaauucaguugccccuguagagg

SEQ ID NO: 17203 - RNA, 515 nt, Homo sapiens
ccucuacaggggcaacugaauugugauuguugacugcagcagugaauuggccagaccaauuagccaagcagugcuggacaggugcaggcagaccuuauggucuaugauuauaguguaccuuggaggcuuacagacagccacauagcagucuaaggccacgaugccaagaaggacacauucaauacaggcuagccagugaaauacauaggccugggccauacagccuauuuaagugauguucuuguugggcccccuaaauugaacagcauuugagguacuguugugguggugaaacagagauauaagacggaaagacuggugagaaggaaauacauaggacuaugaaguugggaaucuaguugagagaccagaauaauagcacuauuucccaacaaugugaacauguagaaggucaagaggacacagaagagaagaaaauccagccauggauauuugacaaagcccaugagaaugaaauccucugggaaacuuucauucaaguacuucacugaauc

SEQ ID NO: 17204 - RNA, 18889 nt, Homo sapiens
uuccagaacaauauuuguugauauuuuuguuggaauacuacaguugcauacguauuuagggaggacugaccucuuugagucuuuccaagaaccucauaucgcuuucuguuuguuuaaauguauacuuggccuuuuaggaauguuuuaaagcuuuccccauagaaguuuuguucauuucuuguuaaguuuauuccuaguuucacuuuuuugcugcucuuguaaauauggucuucucuuccauuauaucucguaacucguuaucauugauuauucacauauaugaaggucguugauuuuaguguguuaacuuuauaucuugcuauuuuacuaaauuauccuuuuuuuauaguuuuuccauugaaccggguuuucugacauauaaucauacaucagcacauaaaagagaacaucaaaagaaucguggauggcgaaagagccggcagaaaccagccggcuggcccuugagaagucuguguggaagaagucccuucgccaccgcuaagcgcggauuugggaaggucccccggagaacaucccuuugaggcaucucuaaccucagagacacagaaucccaaagugaauggagacgcaagggauuucccugucuuaagaucaguucuacaagccucgaccacccaucgggucgggggaaguguggacaauggcuggguaaagaagaggagaagauaaacccguuccauuuaccagcgggccugaaagccaucaaccuuccucucacguagacgcgcggaaacacuaccgaguugaaagccccuuucgcucccuuccuagagcggccgcggaagugcgccccgcgcgggcugguucuuagaccccccguggccgcuuccggccuuugugggucacuuuugauggguuccgggucccaaaaggguucgaggccucuugccuucgcuccguaggagggaguucucuucuggcccugggggccgcaggugagcgauguugugcucuguacgcugcgagcaggugggcgggagauugcuguauuccagcugcugggccccucaggcccuggccggugcagaguggaccccgguccucccaaacccaggcggauccgcgggaagcucucccuccccaaagugcguugggacauuaggaugaggguuuggcucccagucucugcagcaauuccaggcuguaaggcccauaccuuccgcguuugcuucgggcuguguauccuuggguucagcgcuuaccgacauuucuggacaguggugggucacagacgcucgccggcguccuagggacccuuuccugggccuuccucacuucagauuauaaucacagaccacgagguuagagggaagccuuaaagaguaaccucuucagccuucucacuuuauaaaugaagaaugaggagcagaaagauuaagucccugaagaaauaaauuuacaugacuguagcuuuugugauuucaugguuuccaccagacaucuggacauucaaaagauaaaaguaacuaaucaaggauguccuaaccuuuuguuauuauuauuuacuugaucuaaauguuaguuuuauuccauuugucuuucauuuaggaccaaaugagaauaaguuuaccaacaagucuuacucuuaaguccugaaacaacuuggcaccuuuccucagucuuucucuuuaaauuagucuaaucuuuuuuuuuuuuuuugagacggagucucgcucugucgcccaggcuggagugcaguggcgcgaucucggcucacugcaagcuccgccucccggguucacgccauuccccugccucagccuccugaguagcugggacuacaggcgcccgccgucacgcccggcuaauuuuuuuuuuuuuuuuuuuuuuguauuuuuaguagagacgggguuucaccauguuagccaggauggucucgaucuccugaccucgugauccgcccgacucggccucccaaagugcugggauuacaggcgugagccacugugcccggccuaaaucggucuaaucuuaagucuuuucuaucagaguauuuuucugaguaaguauuguacauuaauccggaggucagauuucaaaggucauaguuaaguucucagaauuugcaguuuuacuuuaugguggaguuuguauuaauaaugauggcuuauucuucaggacuguccaggaauacaguuuccaggugagaucuuacuugaaacaccgguaguucuagcacagcuaaaauggcaucuacuugggcuauccaggcccacauggaccaggaugaaccuuuggaaguaaagauagaggaagagaaauauaccaccagacaggauugggaccugcguaaaaacaacacccauagcagagaggucuuccgucaguacuucagacaguucugcuaccaggagacaucugguccccgugaggcuuugagccgacuccgagaacuuugccaucaguggcugaggccagagacccacaccaaagaacagauucuggagcugcuggugcuggagcaguuccugaccauccuaccugaggagcuccaggccugggugcaggagcagcauccagagaguggggaggagguggugacugugcuggaggauuuagagagagaacuggaugaaccaggagagcaggugagaaaaaagaugugacuucugcuugagaaaacauaaauuguggauuucuaggccagagugaagaacagccauuuuuucacaaagcauguuuuugacaguuuggugcaucagaaaggggcaugaguuucacggaaaguuggcuaauguggucccaacuuauuuauaacuuuucuguggaaggauuuuauauuucucuauuaagcuacaaaauucuguuugauaaacaugcugcucaucuuagaaaacuucuaagacaagagaaaguaucaaagagaugacaguagcaggaugggaagcagucucuuggaggggcaucacucuguugcacaauacaaauaauuaagaauuaagguuuugcagauauauccauugcucugacuccauuacaggguuuuaaaaugaagacauuaacuauuucaggggaaugagaugugggaguacaauggaaaguuagugaggagagcaggguggggaaucuguguuucuuugaguagcagaaagcccaguuagguuggaaaggugaauuccaaauagcagaguugagauaguguccaggaccuugaaucucaaccucuggaauugagauuuuauucuguaggacagaugccccuaaccuuuucuccuugagucuaaaugagcuuuacuaauuguaagauguaaaagagaaccaaauuauguagaacguuuuuguuuuguuuuuaauacuaaaaugagacagugguucucaaccagugccaauuuugugcaccagagggcauuuggcaaugucuugggacauuuuugguuguuauaacuuggggaggugcugcuaguaucuaguggaucacucggggaggugcugcuaguaucuaguggguagagagggcaaggcuaaugcuaaaccucuuaaaacacacaggacagccccagacaacaaagucaguagagccaaugcuaggaacaugucaguagagccaaugcugggaaaccccgguauaaagaguuugaaacuuagggaaauaaugaaacagaaguauaaucuagcacugugauacaaaaugcaauagagaggguaggaacauguggcaaaaauaucuaaguuugaaauaggaucaugaggccaggcacggugacucaugccuguaauccuagcgcuugggaggccaagggagguggaucaccugaggucaggaguucaacgccagccugggcaacauggugaaaccccgucucuacuaaaaauacaaaagucagccggguguggcaggacaugccuguaaucccagguacuugguaggcugaagcaggagaaucacuugaaccuaggaggcagagguugcagugagccgagauugugccacuguaccccagccugggcaacagagugagacuccguuuaaaaaacaaaacaaacaaacaaacagaaaaaagaaauaggaucgugaaagugugauuaccaaggaugaggcaugucuuagguaagaacuguuuggaagugaugacagauuagcucuauuaaauaaagaaggaagaaccaauggagaacucuuuacagagcaauguauucuaagcuaaacacuagggauuuuaagcuugaaagacuaguauaauggagacacuccuaacaaaguuaaagacugcaggaaacaauuaagcacauauuuaccgaaugucuguuuggacuagguacuguuuuaggcacugugaaugcaacagcgaacaaaacacagggguugcugcucucauguagguucugguccacugagacagauaguaaauuaaaaaucaacaaaccagccugggcaacauagugagacccccaucucuauaaaaaauacaaaaauuagccaggcagguguguguaguccuagcuacuugagaggcuaaagugggaggauugcuugagcccaggagaucgaggcugcagugaaccacgaucauaccacugcacuccagccugggcgacacagugagacccuaucuccaaaaaaaaaaaaaaaaaucaacaaacaccuacaagauguaggugguaauaaauucuguucaaacaacaacaacaauaaaagcagagaaaaggaauagugaaauaaguggggauugugcuguuuucuguagacuugucagagaagguuuuucagauaggugacauuuacaggagaaaucugaaugaaaagagcaagccauaagcuaucagggauaacagcauucaggcagagggucuuaaagugagaauguacuuaucaugguggagaugugguugucaaggaggagaugaaauaaaaugcuuauaagauuauauuaugucagaacuuguaggccauuauaagaauuucgaauuguauucugagauggaaagucauuggagaauuuugaacagaagcgagauauaaucugacuugaauuuuaaaauagucacucuggcuacugugagaaaguuccacaauggggcugggguagccauaggaguaaaagguagaggcaacgaaaccauuuuaggagcaauaauaauaagcaauaauccaggcaagagauauuggugacuuggacuagaauaguagcagugggagugguaaaaugugauuggauucuggauauauuuuggagcuagagcuugacaggguuuguuuuuauauagaauguggaauaugagagaaaguaaguuaaggauuaugccgaaguauuuggucugaacaucagauagaguggauuugucauucauagagaugguaaagacugggagagaaguggguuugggguggaaagacaggaaucaaaacuuaggguuugggccaggcacgguggcucaagccugcaauccuagcacuuugggaggccaaugugggcagaucaccugaggucaggaguucaagaccagccuggccaacaugaugaaagccugucucuacuaaaaauacaaaaauuagcugggugugguggcaggcaccuauaaucccagcuacucaggaggcugaggcaggagaaucgcuugaacccaggagucggaaguugcagugaaccaagaucuugccacugcacuccagccuggacgacagagugagacucugccucaaaaaaacaaaaaaaacaggguuuggacauguuaauuuugagauuccuauuagaauccaagcagaaaaguugagcaaacaacuagauauaauaaacuggaauucaguggaagggucugugcuagaacuacagaauuggggcuuuucagaauacgcauaguauuuaaagccacgagauaggaugagaucaugaagggaguaaugagcaguagaaacagaguagcuagggagguacaaagaaugggauucuuagaugcagacaaaaguaauuugguuuuaaaugugcugaauuuguauugccaaccaguucuuucucugaaagcacugcaggggcauauaauggaguuuacagcuugauuucugaggccugaccagagaucccagaauagaaggcacagcucgcaguacuggccuuuucccccggcuuucuuuuuucaaaauaugagauaucaaaacaccguuuucuauacaucugagauagcauuuugcugacucucgcuuuuauucugaagacugaggcuacaaaaugaaaauguaucagggaaauagaggcaguauauggugauuucuuaguuauaaaauuuaaccuuugaagagaaugggggaguaauuugagaaccuguuguaugccaaucccugugcaaggugguuuauacaaauguuauuuauaaucucagagagaguaaguaacuagcccaaggucacagagcuacuagacuaagagagagaguaaguaauccaugugauuccaaaucccugcuuuuuacaauaccuugcugaagaaaccuguuauuuuuaaaugcaagaggaaauaagcccauggaagaaugggagccacccaguggcugaaauugaauaaaugaguuaacugagggagcaagggucagagagaagccaaaagugaugggauugaaggcaaaaguagagacguaagccuugaaaaagagaagacaucauccuaagauagaagaaauggagaggaguaugaggguggagauagauaaaaugaagaguagaugauuuuugagaugauugugaucuuggauaaauagaaaauaagauaaucuucccagagagaagugggacgggcaccucagaagagcagagacuauugggaacagcuuagggaaugaauauggaagagauuucucuccuucccuucuuuucccuuucuuucuccucauuuguucccuucaaccuuuuuuuuuuuuuuuuuuggagcuacagugucucugucacccaggcuggaguucaguaguguaaucauaguucacuauaaccuugaacugggcucaagcaguccuccugccuuaguccccugaguaguuaggacuacagaugugcaccaccaugcccagaucauuuuuaauuuuuuuggagagauggggucuugcuauauugccuaggcuggucucaaacuccuggccucaagcaauccucccaccauggcaucccaagggugccuuuuuuuuuuuuuuuuuaucauuucucuacauuauuuaccuuuacauauccccuuuccuuuuccucuuucucucuuaauguuuuauuuuacccuaaguucuaucuuauuuccuccuuucugccucuuuucaccuuuuucuucucuccuuuguuuugucuuucucccuuuccuuucuccacuucuuuaagcauaagauaaagagguaacaguggcacaaccaacauacuuuagcgguaacaacaggagaaauuacaucuggguggagaagggaagauuccccagaggaggcgacauuuauauuggccuugaagaauggguaggguuauggcaggcuuauaucugggaaaaaggucauuucaggguucagccacugccacaaauaguauacuuuuuguuuucuguuaucagagugagucugucagcuacaucucauuuuccucaggucucaguccacacuggggaacaggaaauguucuugcaggagacgguacgucuacgaaaagaaggagaacccaguaugucccuccaguccaugaaagcccagccaaaguaugaaucuccagaacuugaaucccaacaggagcaagguaaagaagaaagacccaucuugggaggaaggggaagauggguaacauaggacauuggggcuuuuuuguacuugcuacuguuucugaucauuaaagucaaaaaggccgucucagaaucugauggcucauauauagacucucagacagccuaguuugucacucuucaacccuuacuuuuuuguauauucauauucuucuaaauucuggcuuuaccacuuaauuuaguccuucugauauuuaucucucuuuauacugaccuccuugcuauuuuuagccuuuauccuaucagacaauaccucuaucuuccacuugcacuauauccuuucugcuucacuaaauaagccuuugcuccauuaugucugcaacuaacuuucagaugguucaagaaaaaaaaaauuuguauacuuacaaagaaaaggaguaacaggcugggugcgguggcucacgccuauaaucccaacacuuugggaggccaagguggguggaucacgaggucaggaguucgagaccagccugaccaacauggugaaaccccgugucuacuaaaaauacaaaaauuagcugggcaugguggcgcgugccuguaaucccagcuacucaggaggcugaggcaggagaaucgcuugaaccuaggaggcggagguugcagugagcugacaucaccccacugcacuccagccugagcaacagagcaagacugucucaaaaaaaaaaaaaagaaaaagaaaaaauaauaaaacaaauguugcaaaauauuaaaaguuggugaaugugugaaagauccgcuaccuuauuucuacuuucucugcauccuuuucauuuucauuuaauuuuuuaaguagguaaaaauguacauggcucaaaaacaaaaauuuuuuaaguuauuuaaugaaaaguuucuauucuacucgauuuucccagccaccuagucucuuccuccuacucugaaauagguuguaacuguuacuaauuuuucguguguccuuccagauauuuuuuugaugcauauguuuuccauauugaaacaaauauauuuugcucucuuuaucacuaagaugguagacucuugcauuuuuuauuucuaaacagcugcuuaauauuaaaauguauggauacauuuuaaagguagaaagagguaacauuuaugaucccuucuuaguuuuagauguugagacuggaaaugaguaugggaauuuaaagcaagaaguuucugaagaaauggaaccacaugggaagacauccaguaaauuugaaaaugauauguccaagucugcuagguguggagaaacucgugaaccugaagaaauaacagaagagcccucugcuugcuccagagaagauaaacaaccuaccugugaugaaaauggaguaagccugacugagaacucugaccauacugaacaucagagaaucuguccaggagaagaaucuuacggaugugaugacuguggaaaagcuuuuagucagcacucacaccucauagaacaucagaggauccauacuggagauagacccuacaaaugcgaagaauguggaaaagcuuuccgugggagaacugugcuuauucgacacaaaauaauacacacuggagagaaaccguauaaguguaaugaauguggcaaagccuuuggccgguggucagcucuuaaccaacaucagagacuucacacaggagaaaaacacuaucacuguaaugacuguggcaaagccuuuagucagaaagcaggccucuuucaccauaucaagauccacacaagagacaaaccuuaucagugcacucaguguaauaaaaguuuuagucggcguuccauacuuacucagcaucaaggaguucauaccggcgccaagccguaugagugcaacgaguguggaaaagccuuuguuuauaacucaucccuuguuucccaucaggaaauccaccacaaagaaaaaugcuaucaguguaaggaaugugggaaauccuucagucagaguggccuuauucagcaucagagaauucacacuggggaaaaacccuacaaaugugacguaugugaaaaagccuuuauucaaaggacaagucuuacagaacaucagcgaauucacacuggagaaagacccuauaaaugugauaagugugggaaggcguuuacucaaagaucaguccucacggaacaucagagaauccacacuggagagaggcccuacaagugugaugagugugggaaugccuuccgaggaaucaccagccucauucagcaucagagaauccacacuggggagaagcccuaccaaugugaugaguguggaaaagccuucagacagaggucagaucuuaguaaacaccagagaauccauaauagacgugguaccuauguauguaaagagugugggaaaucauucaggcagaacucagcucuuacucaacaucagacuauccacaaaggagaaaaaucuguuucugugugaugacuacagggaaguuaucucacagaguucaggccggugagaaauacuauuuagcuuuacaauuauuggggcaaaacuucagucaccauuguuauaaggaaaccucagauauuuaauaagaauucacugugugcugcccauuguacuacgugcuguggagaacaagaagauaaccccaaacucuuuucucagagaguuuguagccuaguuugggauagauaagauccacauauuuagucauauaagacuacaggagaguagaauugaugcaccagauggugucgaaugaaagugguacuuuguaacagacuauaagugcuguaaauucuaaaggacagguuacuuuugccuggaguggucaagaaagauuuuauuuaaaauaaggauuugacgggcagacuuagcagucaaaagggagaaagcggguaaaacaaauguaagccaucauaagagugcaugugguuuggaagcaucagggaaaagacuagccaaccugaaguaaaagguucgugcaaauugggcaaucaauagcauuaaguuggaaacagcuuggggacagacacauaagagggccagagugugaauaauuucaucuaauacuuuauagcacuuggacauuuacagagcacuuuucucaauuccuaaaauaccuugguaaaucaaaagcauucuccauuuuaaaaaugagaauacucuugccuauggagauggcaacauagcuauaaucccacacaaagaaaaagaccaguaaccuaagugcaggucuuuugacuucuaguccuggccauuacucuagugauccuccaacuuugaugaacaucaaaaucauguuuggagcuuguuuaacaucccugaaucccacucacauucugcuucauuaggccuaggaugggaguugagaaucuucauuuuuauagcuccacaguuacuuaauauacuuuaaaauuugagaagcguugaguugaaugacagcugacuucauggcugucugcgaaguggggaagccugaacacaguccuauaaacuaaaggccacugcagacuuuuagcacaaggagauccuuacagggaacaugugccaucagcucuuuggagugaacaaggaauuagacccccaucaugccaaaaaacuaggauuuuuagguggucuuuccaucccuucagauuuaaguauucaaagaaagagagacagaccuacauuccaagggucuucugagugcaaggccuuguguuguuuguuuauuuaggggagggccuggugcucuucucuguuuuaugcuuuaccuucuuuuauuucucagaucucauguuagcacuauguucugaauucccuaauaauggcucuugagaacugauuuacauuuuguugguuuguuuacuucuugagcacauaaaaggaccccaaauuagagauacuaucccuugggcuucugaaaaaugaaucaaccaaaacugguugacucuaaccuugccuugcugaguaaaaauucugcuuuggaugagaaccugucuugauuauuuuaguggacaacagauaagccacauggaaguacacauggcuccugaucugucuuuuuauuuacagaaaucauucuuaaucucuacugagauggccuguuauuuccuuccuuuucuacccugccacagcaaacuccacaguuucugggacuaacuuccuacuacaccccaacacaacuccaguccucucuucucuucacacuucuagcugguuaguggguuugaaguggugagacagugacaaaaggggaaggggaaaaauaaaagaaggguaaucugcauucuuccuuaguaagucccacuccuaauuaccuuucuacacagcccugugucuuugucccaucuucucuucacuccuguaauauacuccccagccccauuuucuuagugccccugucucuugccucucuagccauaaacccuguauagaauuucaucccuggguuggaacuagaagcgucucugguccuauaggaauauuauguuucuagcuaaguuguaaauaugaacacauauucccauagaagucauaaugguauaaguauuauaauucagguauauuaggugucaaauuggcuucugggauuggaacuuacaugacuuucuguguggaaaaaccuucuugaguucacaagagagaaaggcaaaugaacaguugaaaaacaacuuacucauaaguugaggacugcuuaguuaggcuuuuuucauaaccccagcauuggaguugcacacaugaggcacugaggcaacugggauuggaaaccuaguuuuuuuccuccaggaaacaaggaacccagagugagucugggagcucuguagcucuaaguaugugaggccugugcucuaccuaaguuuacccugccucccauuucucacauaaugagaaugcaaacuuguaaccaaaccaagguucagcugcuugcggcuccaaagccaaaacucgggagagaagaaaauuggugcgaggaaaagcagauuuauucggagagccagcaaacugagacgaugguagacuacuguccuaaaguaccaucuuaagucaguacaaauguugggcucggcucuuuuuauguuaagggcaaagggaagaggacagaguugggaugaagaggugaccuaugaccacagacaucugggcgccagcaagaguccaaggagguugggaacuucuuugucauugguugggucacaaugcuccugcaaaucuucaacaaaacauaauuguuauacauacuucuuuaaucccagaguuaguuuuuaaaacuacaugauugcuguuuuugcauauuaucucugcucuaaaauuagccuacauggaggaauagguaaaggguccuuaaacaaaaauggaguuaguuaugguaguucuuuugcuguuucacuguuagaaacucuucucaguggaggggacuuuacuuagugaugagaaccugugugagaauguucuccuuaccaaacaugcuaugcauacuccuuaucuaaucugauuuuauagacuuguuauccaaacugaaauuacuguucauaguaacuucagagccucucuuuuaaucugacugcucgcuggaaugcaaucguuguuuuaaacuugccuucuacuccucugagugccuuuacuuggggucuuuccaguucauuuucugcuuaauauguucugucauugcgcacauuccuccauuugccuuucugcacacuacuuaaucuuucuuauauaccuaauauuauaaagggaccauaaacaaagacucagaacaauggaauaugccuauuauaggaggguacaguucauacuuguuuaaaaauaaauguggaggcugggugcaguggcucacacuuauaaucccagcacuuugggaggccgaggugggcggaucacgaggucaggagguugagaccaucuugacaauguggugaaaccccaucuccacuaaaaauacaaaaauuaaccaggcgugguggcacaugccuguaaucccagcuacucgagaggcugaggcaggagaaucgcuugaauccgggagguggagguugcagugagcugagauggcaccacugcucucccgccuggugacagagcaagacuccaucucaacaaaaauuaaaauaaaaauaaaaauacacguggggguuuuguucugguuauuucucaugcuuaaauacaguuguaguaccaaaaaaagguggagugacauggaauuuccagguaggcaucaaagaggauuaaacuagcuuuccaggauaaagaggaaauauaguagaauaaggcuacuaauuggagcuaaauuggcaauauaggcaaauugaaggcccugaggggcaaauggaggaugugacauguuagauauggaauaggagugcuacauuagggaaugcagugaagagagaaugcuuugugaugaagucaggaguacauuuuguggauaacauauagauguggugugacagugacaagauccuaggaaaccagaaaccucugaagcauuuuauguauguggauuuugaaauaacaauaacggggugggauggaaacgaagaauauaaaagcgaagcagguccaagguagaaauaacggucaucaauuguaguaacaauggccagauagaaguaucuguuguaaaacuugaaugaaucauaaagcuugcaaauaauauuaagaauaagaauaagauugacuggcuugucuuuucuaauugauucaagguaaacaagacauuaaguguuuaaggcaaaaagcauggagagguuggggaagagccaaguuucuaaaguaaugaaaagugaggugaguuucaacacgggcuaugaaugaaaacguaaccugacaaucaaacugauuccagagagugcagugggaagugacugcagaggaaaaaagaauggggcccuccuuccaaaaauaaauuguauuaagagguugccagaguuugagguacgagaugaagcuaaugaggaaagacagugggauugagcagggcuccaaauugagacaucucaacuguauaaugagguugguuguagagaccucuaagauagaagaacuuagacaagucugcauuccuguauucaguacagaaguagccacuuuuguuaauauacagauuauuuguagaguuguuauagucaaaacaaagcuguucuuauuggccaucuuuuggaauugagaaaaggauuuauuaaugacaauaccgcacacuuauuagcugcuuacuaagggccagacauuacuaaaugcuuuacuuacaacauuucacuuucagcuggggaaacugaaauagauaaucuaaagcugcucaaggucccgaaguuaguauguggucaggccaagauuugaacccaagcagcccaguuccagaguucacacuuuuaaccucugugauacacuuccucucuuuauuucaguugaacaaaccauguguugcagugguaauucagugucuugaguaauuaucuguaaaaacuuuuuaucuccagucauuauucugaaaaaugauucagaaaguccuggaguccaaacaccucagguaauaauauuaucacccccucugcauaccaaaucuuggaugagguuuggccagcauaaacagcucuacuucuuguugccugcacagugagggugucacaggagacauuccacuuuaaaaaugggcucuuuauaugaaaagaucacccuucuuagaaugauaaaucacucugcauuauucucacagaauaaggaauauuuggcugucuaauuuaauacagaaagauuuaaagauuuguccccaaguguugauaacccauuauggaucuaucuuuaaugccaguuuucaaaagugauuuuauauuagaagauacuucuuggauuuaaaaaugcacacacacacauauaugugauauaugauauuuuucuuugcuuaagacuuaccaauuuuacaguucaaauggugacccuccuaacuccacaaggccagaauuugagcaaaugcuuguuguucaaccuagacauaaucauucgauagccuuuaauugaaucucuucccaacuuuuauccuuuaaaccgaaaaguuauauaccacagucacuacagcagcucauuuuauuggaauuucuuuggauccucucccucucaaacguucugugugcguuugguaaggaguccucacacauuauuuuuuacuuguauaguauuucuacauauauauauaaauguguaaaaaguauguaugaauauuuuuguguuguaauuuguauuuuacauauauaugaccucauguauauaauuugauguugacaaagccaacuaugauaaguguuuuaaacuuuucaguugauuagcccccuagcuuacauuguaagaccaucauuuagagccagcaguuuucccuugauuucaucucuugaagagacaguugauucucuucauacacguuaaaaacaccauuuaggugucagaaacccaucagucaaggcucccagagcuuucaccuaucauaguucaaguuaaucucuaggguauaugucuguuugcuccugccagucauuuuccuaagcccaguuggccugcuccuggaagucccaagaagggcuccauaguggaagccauuuguuacuuuugauuuaugauuacaucaucauuacuccucuucaagcuuagugggcauaucuuaguguuuugaucuagugccuuaguucugccuacuucaguaacgaauuuaggaguagaugucuccucauuucaucccugauaaagauugaggcaguuuagggacucugcagcuuccucuggccaaauucccuacuuauuccugagauaggguuuaagaaccuggauucuagagacggauugccaugguucgaaucucaguuuacuagcuaagugacuuugggcaagggauuuaaccucucgucccucaguuuccuccuauguaaaaugacaaggauaauaguaccaacccaauguagauuaaaugaguuuacgaaguguuagaauagugcuuggcacauuagugcuuuacaacugcuauuuugauuguuguugugggcucucucaaaugcauugucucuagaugccagugacccaggucaaaauuuaccuuuaaccaagcugcauguuucccagacugcugcacaguccuccuagcccugagauaaaagcucccacccagguauacuuuuacuuuccugcuggagaacugaugagcaguggccagcaggggacacuuaucgcccaagcuggaaaggagagauuucuucccuuuugucuccgccccuguuaguuaucagagguaccuagcggccccugcuauccgaaguuugccuuccgagcugcucuuccgacguucugcagcuggaaggccggccucgcacgggucugacgcgccccggccugggagcaugggccccugggguuaccugacugcucagcuggaacuugcgcugcucagcuggggcgggguucggccgggcaaccacagagaggagaaagccuccagaauccuagagaagcugaaugcugagacagccguugacggcagcggcacgugaaaguaccgaccuuucuggccuuugugacggaccuuuggaggcgggugguuucagauucgugcgcuccggccuuucagugucucuggugagguugggccugauagguugagagcugccaggggaaguuaaggaugacuuccaaguuuugagguaucaggaaaacuggcuguugagaaaaaggagucuggguuccccguuuggugaaaggaaaguuggguucauuuggggaaauuaugugauucaugauuuucccaagaucgacgcugaguacaagaaaagacagaauccaccuagcuguugugugacuuugagcaaauuacuuaaucucucugugccucaguuuuauuccucugucagugagauuauaagugucuacuuaaauggcugcaugcauggugcauuuuaaauaaauauuagcuguuguuauuuuucauuucugauguucuuaucucugccguuuauacaggauauugcauguauggugcauuuuaaauaaauauuagccguuguuauuuuucauuucugauguucuuaucucugccguuuauauggguauuuugaagugggggggagccaagggaagagggucaugaucuuuaaaguuuuauuaauaaaaacuuuuagagaguaaaaggcuagcagauggggcuagcuaauaauuugcagucacuuuugcuuuccuaauuuauuuaccuuccugacagaguuccguuuucuuucagugccuuguucagauaagugaguucuuggcuaaagaaguaaacaaaauuuagcuucuguuaacauuguuauuuuaugccucaggaagaagaccagcuacaaggaaauacuucugaaaaaucacucugaaccccaagcuggagugaaucuucuccugagcucucucauuccagaauggcaaucuuguuucaggagagaucucuaauagugacugaugguaaaggaagaaggcugugccuagaacaaagaaucaggcuggcaaagaaaucacaggucuuuccucaaacuuuaaauugcuacucucuggagauagcuaccuggacuuuacagagcugucagaagacuugggaagguuugccagcauuggaaaaagccacuuggacuucacagagcugucagaagacuuaggaagcuuugccaguaguuccugagaccagaaauacauauuaugaagcaggugcuggaacaggcccuggccccuacuugugaagcugcagauauagguaagauaauaucauccagaauguggagacgaggcaaucgaugaugcuggaaaaguugaagagagaguuugaaugaaggacaaaccaccgaugggaaagcuugggaggaucacuuauagcuugacuagcaaaaggcuuugggaauaggauagaaagcagcaaaccugaacuuuaggauccaccagaugucucuggagccauaacccaacauuucccauaaauaguagguuuuaauucuccuguuauuuaggugcaucucugggaccuccucuuucuauauuggguuuuuuguuuguuggguguuuuaacuuaggauuuagcuucaaauuccauuucccaagaccaauuuuaucacauugccuuuaggucucaggcuaaaugauauaacaagauaugcuuuuggcaaagauaguaccuuggaaugaaagguuucagaucaaaccuaagauccuaccuuaguuuaccuc

SEQ ID NO: 17205 - RNA, 6432 nt, Homo sapiens
ggcgggagauugcuguauuccagcugcugggccccucaggcccuggccggugcagaguggaccccgguccucccaaacccaggcggauccgcgggaagcucucccuccccaaagugcguugggacauuaggaugaggguuuggcucccagucucugcagcaauuccaggcuguaaggcccauaccuuccgcguuugcuucgggcuguguauccuuggguucagcgcuuaccgacauuucuggacaguggugggucacagacgcucgccggcguccuagggacccuuuccugggccuuccucacuucagauuauaaucacagaccacgagguuagagggaagccuuaaagaguaaccucuucagccuucucacuuuauaaaugaagaaugaggagcagaaagauuaagucccugaagaaauaaauuuacaugacuguagcuuuugugauuucaugguuuccaccagacaucuggacauucaaaagauaaaaguaacuaaucaaggauguccuaaccuuuuguuauuauuauuuacuugaucuaaauguuaguuuuauuccauuugucuuucauuuaggaccaaaugagaauaaguuuaccaacaagucuuacucuuaaguccugaaacaacuuggcaccuuuccucagucuuucucuuuaaauuagucuaaucuuuuuuuuuuuuuuugagacggagucucgcucugucgcccaggcuggagugcaguggcgcgaucucggcucacugcaagcuccgccucccggguucacgccauuccccugccucagccuccugaguagcugggacuacaggcgcccgccgucacgcccggcuaauuuuuuuuuuuuuuuuuuuuuuguauuuuuaguagagacgggguuucaccauguuagccaggauggucucgaucuccugaccucgugauccgcccgacucggccucccaaagugcugggauuacaggcgugagccacugugcccggccuaaaucggucuaaucuuaagucuuuucuaucagaguauuuuucugaguaaguauuguacauuaauccggaggucagauuucaaaggucauaguuaaguucucagaauuugcaguuuuacuuuaugguggaguuuguauuaauaaugauggcuuauucuucaggacuguccaggaauacaguuuccaggugagaucuuacuugaaacaccgguaguucuagcacagcuaaaauggcaucuacuugggcuauccaggcccacauggaccaggaugaaccuuuggaaguaaagauagaggaagagaaauauaccaccagacaggauugggaccugcguaaaaacaacacccauagcagagaggucuuccgucaguacuucagacaguucugcuaccaggagacaucugguccccgugaggcuuugagccgacuccgagaacuuugccaucaguggcugaggccagagacccacaccaaagaacagauucuggagcugcuggugcuggagcaguuccugaccauccuaccugaggagcuccaggccugggugcaggagcagcauccagagaguggggaggagguggugacugugcuggaggauuuagagagagaacuggaugaaccaggagagcaggugagaaaaaagaugugacuucugcuugagaaaacauaaauuguggauuucuaggccagagugaagaacagccauuuuuucacaaagcauguuuuugacaguuuggugcaucagaaaggggcaugaguuucacggaaaguuggcuaauguggucccaacuuauuuauaacuuuucuguggaaggauuuuauauuucucuauuaagcuacaaaauucuguuugauaaacaugcugcucaucuuagaaaacuucuaagacaagagaaaguaucaaagagaugacaguagcaggaugggaagcagucucuuggaggggcaucacucuguugcacaauacaaauaauuaagaauuaagguuuugcagauauauccauugcucugacuccauuacaggguuuuaaaaugaagacauuaacuauuucaggggaaugagaugugggaguacaauggaaaguuagugaggagagcaggguggggaaucuguguuucuuugaguagcagaaagcccaguuagguuggaaaggugaauuccaaauagcagaguugagauaguguccaggaccuugaaucucaaccucuggaauugagauuuuauucuguaggacagaugccccuaaccuuuucuccuugagucuaaaugagcuuuacuaauuguaagauguaaaagagaaccaaauuauguagaacguuuuuguuuuguuuuuaauacuaaaaugagacagugguucucaaccagugccaauuuugugcaccagagggcauuuggcaaugucuugggacauuuuugguuguuauaacuuggggaggugcugcuaguaucuaguggaucacucggggaggugcugcuaguaucuaguggguagagagggcaaggcuaaugcuaaaccucuuaaaacacacaggacagccccagacaacaaagucaguagagccaaugcuaggaacaugucaguagagccaaugcugggaaaccccgguauaaagaguuugaaacuuagggaaauaaugaaacagaaguauaaucuagcacugugauacaaaaugcaauagagaggguaggaacauguggcaaaaauaucuaaguuugaaauaggaucaugaggccaggcacggugacucaugccuguaauccuagcgcuugggaggccaagggagguggaucaccugaggucaggaguucaacgccagccugggcaacauggugaaaccccgucucuacuaaaaauacaaaagucagccggguguggcaggacaugccuguaaucccagguacuugguaggcugaagcaggagaaucacuugaaccuaggaggcagagguugcagugagccgagauugugccacuguaccccagccugggcaacagagugagacuccguuuaaaaaacaaaacaaacaaacaaacagaaaaaagaaauaggaucgugaaagugugauuaccaaggaugaggcaugucuuagguaagaacuguuuggaagugaugacagauuagcucuauuaaauaaagaaggaagaaccaauggagaacucuuuacagagcaauguauucuaagcuaaacacuagggauuuuaagcuugaaagacuaguauaauggagacacuccuaacaaaguuaaagacugcaggaaacaauuaagcacauauuuaccgaaugucuguuuggacuagguacuguuuuaggcacugugaaugcaacagcgaacaaaacacagggguugcugcucucauguagguucugguccacugagacagauaguaaauuaaaaaucaacaaaccagccugggcaacauagugagacccccaucucuauaaaaaauacaaaaauuagccaggcagguguguguaguccuagcuacuugagaggcuaaagugggaggauugcuugagcccaggagaucgaggcugcagugaaccacgaucauaccacugcacuccagccugggcgacacagugagacccuaucuccaaaaaaaaaaaaaaaaaucaacaaacaccuacaagauguaggugguaauaaauucuguucaaacaacaacaacaauaaaagcagagaaaaggaauagugaaauaaguggggauugugcuguuuucuguagacuugucagagaagguuuuucagauaggugacauuuacaggagaaaucugaaugaaaagagcaagccauaagcuaucagggauaacagcauucaggcagagggucuuaaagugagaauguacuuaucaugguggagaugugguugucaaggaggagaugaaauaaaaugcuuauaagauuauauuaugucagaacuuguaggccauuauaagaauuucgaauuguauucugagauggaaagucauuggagaauuuugaacagaagcgagauauaaucugacuugaauuuuaaaauagucacucuggcuacugugagaaaguuccacaauggggcugggguagccauaggaguaaaagguagaggcaacgaaaccauuuuaggagcaauaauaauaagcaauaauccaggcaagagauauuggugacuuggacuagaauaguagcagugggagugguaaaaugugauuggauucuggauauauuuuggagcuagagcuugacaggguuuguuuuuauauagaauguggaauaugagagaaaguaaguuaaggauuaugccgaaguauuuggucugaacaucagauagaguggauuugucauucauagagaugguaaagacugggagagaaguggguuugggguggaaagacaggaaucaaaacuuaggguuugggccaggcacgguggcucaagccugcaauccuagcacuuugggaggccaaugugggcagaucaccugaggucaggaguucaagaccagccuggccaacaugaugaaagccugucucuacuaaaaauacaaaaauuagcugggugugguggcaggcaccuauaaucccagcuacucaggaggcugaggcaggagaaucgcuugaacccaggagucggaaguugcagugaaccaagaucuugccacugcacuccagccuggacgacagagugagacucugccucaaaaaaacaaaaaaaacaggguuuggacauguuaauuuugagauuccuauuagaauccaagcagaaaaguugagcaaacaacuagauauaauaaacuggaauucaguggaagggucugugcuagaacuacagaauuggggcuuuucagaauacgcauaguauuuaaagccacgagauaggaugagaucaugaagggaguaaugagcaguagaaacagaguagcuagggagguacaaagaaugggauucuuagaugcagacaaaaguaauuugguuuuaaaugugcugaauuuguauugccaaccaguucuuucucugaaagcacugcaggggcauauaauggaguuuacagcuugauuucugaggccugaccagagaucccagaauagaaggcacagcucgcaguacuggccuuuucccccggcuuucuuuuuucaaaauaugagauaucaaaacaccguuuucuauacaucugagauagcauuuugcugacucucgcuuuuauucugaagacugaggcuacaaaaugaaaauguaucagggaaauagaggcaguauauggugauuucuuaguuauaaaauuuaaccuuugaagagaaugggggaguaauuugagaaccuguuguaugccaaucccugugcaaggugguuuauacaaauguuauuuauaaucucagagagaguaaguaacuagcccaaggucacagagcuacuagacuaagagagagaguaaguaauccaugugauuccaaaucccugcuuuuuacaauaccuugcugaagaaaccuguuauuuuuaaaugcaagaggaaauaagcccauggaagaaugggagccacccaguggcugaaauugaauaaaugaguuaacugagggagcaagggucagagagaagccaaaagugaugggauugaaggcaaaaguagagacguaagccuugaaaaagagaagacaucauccuaagauagaagaaauggagaggaguaugaggguggagauagauaaaaugaagaguagaugauuuuugagaugauugugaucuuggauaaauagaaaauaagauaaucuucccagagagaagugggacgggcaccucagaagagcagagacuauugggaacagcuuagggaaugaauauggaagagauuucucuccuucccuucuuuucccuuucuuucuccucauuuguucccuucaaccuuuuuuuuuuuuuuuuuuggagcuacagugucucugucacccaggcuggaguucaguaguguaaucauaguucacuauaaccuugaacugggcucaagcaguccuccugccuuaguccccugaguaguuaggacuacagaugugcaccaccaugcccagaucauuuuuaauuuuuuuggagagauggggucuugcuauauugccuaggcuggucucaaacuccuggccucaagcaauccucccaccauggcaucccaagggugccuuuuuuuuuuuuuuuuuaucauuucucuacauuauuuaccuuuacauauccccuuuccuuuuccucuuucucucuuaauguuuuauuuuacccuaaguucuaucuuauuuccuccuuucugccucuuuucaccuuuuucuucucuccuuuguuuugucuuucucccuuuccuuucuccacuucuuuaagcauaagauaaagagguaacaguggcacaaccaacauacuuuagcgguaacaacaggagaaauuacaucuggguggagaagggaagauuccccagaggaggcgacauuuauauu

SEQ ID NO: 17206 - RNA, 6155 nt, Homo sapiens
uacuuugcacacauggcuucauuauauuuuuuuuuccuuuuaguugcagauuccuuuccccaagcaucaaaagacaaguaauuggugguauauauuuaauauugcaggugaggagacaaggauugagaaugggaagcuuauuguaguaacagacucuuguggaagaguagagucaucugggaaaauaucugaacccauggaggcucauaaugagggcucuaacuuggaaaggcaucaggccaagcccaaagagaagauugaguauaaaugcucagaacgugagcagagauucauccagcacuuggaccugauugaacaugcgaguacacacacgggaaagaaacucugcgagucugaugugugucagaguuccagucuuacaggacauaagaaaguccucucuagagagaaaggucaucagugucaugagugugggaaagccuuucagaggaguucacaccucgucagacaucagaaaauccaucuuggugagaagccuuaucagugcaaugaguguggcaaagucuuuagccagaaugcaggccuuuuggaacaucucagaauucauacuggagagaaaccuuaucuauguauccauuguggaaaaaauuuuaggcgcagcucucaccuuaaucgacaucagagaauucacagucaggaggagcccugugagugcaaggaguguggaaaaaccuuuagucaggccuuacuccucacccaccaucagagaauccauagucacuccaaaagccaucaauguaacgaguguggaaaagcuuucaguuugaccucagaccuuauucgacaccacagaauucauacuggagaaaaaccuuucaaguguaacauaugccagaaagccuuccgacuaaacucacaccuugcucagcauguaagaauccacaaugaagaaaaacccuaucaguguagugaauguggagaagccuucaggcaaaggucaggucuuuuucaacaucagagauaucaccacaaagacaaacuggcuugaugagguguucucuccuuguagaacaucagagaaggcacauugacuagcaaacagcacuuuaggaaaagucaccguagcccacuguggcaucagaaaauucuugggggcugaguuggaggcucccugccucuauucucucuccuuugcuuuccuugaagucagcuuuggaccacaauaauuucacuguagaugauaugcuaggaucaaaguuaaacagcauucuucacugcaggacaucucagagcauguaacauaacugcaugauuauauacucuaagcaauagagagcuucaugacugaguaagaguuuugaagucagcagugaaucaagugcccacagauuugcaggcuuaagcagaacaagggaagauugauauuuuuggauaugcuauagcagcuuucuccuaugaaauaaaacugaugauguuuggaaguauacuacucucaaaggugucuuuaaaguacagguuaauggugaacauuuucccccaguggcuucaccucauuccucccacuggccuuaccccuuccuuccccaguggaagcauuuucaaaagcaaagauaauuuucgcuggugaacuucagaacuugccuucaggguuagcuucauguaauuuuaccauuucccauccccauuccccaccacauuaugucaagauucaaguuauaaauuaacguuuuacuuagacuuugaaagagauuucaugaguaauuugaaugaaccuugcugaauuaaucugaauagcaacugucugacuugauaacuccagugccaguauaguggcugcugcauagacacuauucaguaaaugucugaugaaagaaauuggacuuuuucccuuuaauacugaugaugcaauuuugaaauguugcuuguucuggaauacuucggaaguuaaacaauaaagucagcuuggagaggagaucaugaucuuuauacugugaauagcagaaugucacagaugaagaauauuaaaauuaggggcguccacuccaaaacauaucaccagagugacaacuucagcccucagccucugcaauccauauauauccuggucuugggaguccauagaauacuguuuccuucuaauaaagguuucaaacaaaucccugcagauuuauuuaaaguguuuguggaagauaauuuuccauauaagcugugcaguauucuaugguauauguccccauuguucaucauuuacgucauuuacaguuugaucaccauaaacaauuuuucagugaacauccuuguauauacaacuuugccuacuuacagaauuuuuuucuuuguucaguucccauaaugagaaucaaugaggcagaagguaggcauauuuucuaaggcuuuugaugcauuuuccagaaugcccuccagaaaaguuacacuaauuuguacacccuguuagcagccuaugauaaugcccaauuuucuauacccacguaaacugggaauuauucuuuugaauauuugacaaucugauguguacaaaaugguuugcuuuuuuuaauaaaccauuuuuuagagcaguuuuaaguucucagcaaaauugagaggaagauacaaagauuucucauauacccacugcucccauucauguauagccuccccuauuaucaacauccccucccagggugacauuuguuacaauugaugaaccuacauugacauauuaucacccaaagaccauaguuuacauuaggguucacucuugguauuguucauuuuaugggucuggacaaauacauaauaucguguccaccauuauaguuucacugcccuaaaaauccucugugccuuaccuauuauucaucccucccuuuuuccagccccuagcaaccacugaccuuucuacagucuuuauaguuuugccuuuuccaggaugucauguauacagguugaguacagcuaaucugaaaacccaaaauccaaaaugcauuaaaaugugaaacuucagcaccaacaugaugcuacaagugaaaaauuucauaccugaccucgugacaggucauagacaaaauccagucaauacuuuguuucggcugggugcaguggcucaagccuguaaucccagcacuuugggaggccaagguggguggaucaccugaggucaggcguuugagaccagccuggccaacauggcgaaaccccgucuuugcuaaaaauauaaaaauuagccgggugugguagcaugcaccuguaguuccagcuacuugggaggcugaggcacgagaaucgcuugaacccaggaggcggagguuguggugagccaacauugugccacugcacuccagucugggcaacagagcaagacucaaucucaaaaaaaaagacuauguuucaugcacgaaaguauuuaaacuguauaaaauuagcucuaugugaguaagguauauaugaaacaaaugaauuucauguuuagacuugggccucaucccuaagauauuucauaauguauguauauauuccaaaauccgaaauuggaaacacuucuggccccaagcauuucagauaagggauacucaacuuguaguugaaaucauacaguauguagcuuuucagacaggauucuuucacuuuguaauaugcuuuuaaauuuucucaauaucuuuucaugccuugauagcucauuucuuuuuuuuuucuuuuuuuuuuuugacauaaggucucacucuguuggccaggcuggagugcugugguacgaucuuggcucacuacaaccuuugcuuccuggguuuaagcaauucuccagccucagccuucugaguagcugggaccacaggcgcacaccaccacggccggcuaauuuuuuguauuuuuaguagagaugggguuucacuguguugcccaggcuagucuccagcuccugagcucaaagugauccaccugccucagccucccaaagugcugggaucacaggcuugagccaccgugucuggccagcuuauuucuuuuuagcacugaauaauauuccauugucugcauauaccacagcaaaagaaauaucuguuaaaggacuguuauccaaaauacagaaagaacucuuaaaacucagaaauaaggaaacaacccgauucaaacaugagccaaagaccuugacagacaccucauuaaagaagauauacagauggaaaauaagcauaugaaaagaugcuccacaccauaucccaucagggaaauugcaaauuaaaacaacugugagaugccacuacacaucuauuagaaugaccaaaauccagaacacugacacaucaaauucugguauggauguggaacaacaggagcucucauucauugcuggugggaaugcaaaaugauacagccacuuuggaugacaguuagguaguuucguacaaaauuaaacauacucuuaccaugugauacagcaaucgcccuccuuaguguuuacccaaaggagcugaaaaccagugucuacacagaaguuugcacacagauguuuauagcggcuuuauucauaauugccaaaacucaguagguaaaugaauaaauaaugggucuguuuuuuaaagaguuuuuuauauuuuuacuauugaacaucuuuucacauguuaauuugucacuuaucuuguguguaguaauguucauauccuuuacuaauuuuucuacuaaagucuccuuuuacucuuaaacagaagugcccuuaaaaaucaaauagggaacuugcauaucagcauuuuaaaugcacguguccuuuggcugaacaguucuaauauguggcauuuauccuagaaauauauucuuaaaagaauguaaagguauugaaugguguucccucuagcauugcuuuuaaagaaaaaauauaaccuaaguaugcaucaauaggauaguuaaguaaauuauggaacacucauacaguauuacuuagcuguuaaagaauaagcugaucugugaagaucuccaaguugucuuaaccgaaaagagcuaaggugcaaaauuacauuaugauaccauaaguguuuuaaaauguauaaauacuuauucacuaaacaaaauguucauuaagugcuacuguguggcagguaguguccuagauaaauaugaacaaaauacaaugguuaacucuaaagaggggacacuuuucguuuuaugguccuuuugcaacuugacuuuuuuauuguacauauauuauguauacuuaaagaaaauaauuuguacagcuuacuauaauggucuuuuuauugaucugucucuccuaccagccagugaugaccccgaagacagacauuuaccacuguguugguuuucaaucgaaaugauguacauaaauuuggggcgugcuugcaccguccgaaugggccugggguccggcggcggagagugaccugggcggggcaggagguggcagcggggguccucccggcucaccagagagacgagcggccgugcuccuagagaggcagggaacccgccagacuccgccacuccgcugcgggcgcggcgcagggagaagcuuuuguacccgcccagcugcuggaggcgccggcagcgcccgccagacccgccagcccagcggcccgggcucuggggaaaccggcgcucccgacaggggagcaccgggccucugagcucccucgggagccuuucacgaggucagcuacgucuuuguugugcgcguuccugaacuuuugguccauuaaccaacaauuagacacgccgguauucagugccuggcgcggugcuagaugcuggguguaaucucagaaaaauacauucaggggcgcgccugagggugcuggcugcuggcaucucaggugcuuuacgugcauucgugaagaagcccaucaguauuucuugaauaccagguacgugccgggcauguagagucuaugcagagauaaacuccuguccucaagaacccggguggggaugggguuggugaucuguaauacgagauggagaugaggguugggugcaguuuucuaugggaauaccccaucucaaccuguguggcuuacuuuuccugucuauauguuaggguuagggguugccagggaagguuuuacaauagaacauuuacgcugggccuugggaauuuacccuuagaagggcgguccugacuguauagaguggguggaaaaaaauugaguacuuagcauggcagugacauaagaaauuugggaagacca

SEQ ID NO: 17207 - RNA, 1730 nt, Homo sapiens
uagugcgccugcguggccgcgaaucaccagccagccucugggucuguagcaaccgcccagcguugaggcgcggcucaugcccccaguaucccgguccagcuauuccgaggacaucgugggcucucggagaaggcgacgcagcuccucggggagcccaccauccccgcagagcagauguuccucuugggauggcuguucccgcucucacucccgcggccgugagggccucaggccuccuuggagugaguuggacgugggcgcucuuuaccccuuuagucgcucugggucgcgagggcggcucccaagauuccgcaacuacgccuucgcguccuccuggucgaccucguauaguggauaucgcuaccaucgucacugcuaugcagaagaacggcagucagcggaagacuacgagaaggaagagagccaucggcagaggaggcugaaggagagagagaggauuggggaauugggagcgccugaagugugggggccgucuccaaaguucccucagcuagauucugacgaacauaccccaguugaggaugaagaagagguaacgcaucagaaaagcagcaguucagauuccaacucggaagaacauaggaaaaagaagaccagucguucaagaaacaagaaaaaaagaaagaauaagucgucuaaaagaaagcauaggaaauauucugauagugacaguaacucagagucugacacaaauucugacucugaugaugauaaaaagagaguuaaagccaagaagaaaaagaagaaaaagaaacacaaaacaaagaaaaagaagaauaagaaaaccaaaaaagaauccagugacucaagcuguaaagacucagaagaggacuugucagaagcuaccuggauggagcagccaaauguggcagauacuauggauuuaauagggccagaagcaccuauaauacauaccucucaagaugaaaaaccuuugaaguauggccaugcuuugcuucccggugaaggugcagcuauggcugaguauguaaaagcuggaaagcgaaucccacgaagaggugaaauuggguugacaagugaagagaucgguucuuuugaaugcucagguuaugucaugagugguagcaggcaucgcagaauggaggcuguacgacugcguaaggagaaccagaucuacagugcugaugagaagagagcucuugcauccuuuaaccaagaagagagacgaaagagagaaaguaagauuuuagccaguuuccgagagauggugcacaaaaagacaaaagagaaagaugacaaguaaggacuuacuuguugcacagcaggaauuuuaacaacaaaaauuuuaugugaccaaaaguguuaaaaggcuuuacagugcuacuguacuuaccauauuaguaagucccucaggaaaaagcuucuuuugagauaucuuuagcagcuuauuuuuuguuauuuuaacuuuaaaaaguaauaugugcacaugguuuuaaaaauauucaaccauuauaggaggagaguuaguaaaaagugaaucuuucacuuuagccccugacaccuuucccccaaaaauauauauuuuggugucuuauauacagaauauacauucugugcauauacaagaguauauguugcagcauaaagauuaaaagcuauuaaaguuuuuuuucgcucguuacucuuuugccauucauuugccccggggggaccaaaagaagcccagaaagaacaaaggauucaaucaa

SEQ ID NO: 17208 - RNA, 745 nt, Homo sapiens
caacgcaaaaccugcucuuuagauuucgagcuuauucucuucuagcaguuucuugccaccaugucggaaaccgcuccugccgagacagccaccccagcgccgguggagaaauccccggcuaagaagaaggcaacuaagaaggcugccggcgccggcgcugcuaagcgcaaagcgacggggcccccagucucagagcugaucaccaaggcuguggcugcuucuaaggagcgcaauggccuuucuuuggcagcccuuaagaaggccuuagcggccgguggcuacgacguggagaagaauaacagccgcauuaagcugggccucaagagcuuggugagcaagggcacccuggugcagaccaagggcacuggugcuucuggcuccuuuaaacucaacaagaaggcggccuccggggaagccaagcccaaagccaagaaggcaggcgccgcuaaagcuaagaagcccgcgggggccacgccuaagaaggccaagaaggcugcaggggcgaaaaaggcagugaagaagacuccgaagaaggcgaagaagcccgcggcggcuggcgucaaaaagguggcgaagagcccuaagaaggccaaggccgcugccaaaccgaaaaaggcaaccaagaguccugccaagcccaaggcaguuaagccgaaggcggcaaagcccaaagccgcuaagcccaaagcagcaaaaccuaaagcugcaaaggccaagaaggcggcugccaaaaagaaguaggaag

SEQ ID NO: 17209 - RNA, 589 nt, Homo sapiens
agguggcucugaaaagaaccuuuuugguuuggaccgagguaugaguaaugaacugcuccagccccgcuacuugcccuuggccuugugguggcucucaguuuucuuaggcagcagcacggccuggauauugggcaggacaccacccugggcgauggucacuuuaccaagcagcuuguugagcuccucgucguugcggauggccagcugcaaguggcgcgggaugaugcgggucuucuuguugucgcgggccgcguugccagccaguuccaggaucucggcgguuagguacuccaacaccgccgccagguacaccggcgcuccggcaccgacccgcucagcguaguugcccuugcggagcagucggugcacucggcccacugggaacugaagacccgcccuugaagaacgggucuuagccuuggcgcgagcuuugccgcccugcuugccacgucccgacaugacguaaaaaauucaaucaguaacguuccugagacugacguaacgcuaaagcuccgcuacuuauagucaacagaggcacgaaaacuaagcugugcuauuggcuaacauuacaguuucgcuuuaaccaaug

SEQ ID NO: 17210 - RNA, 591 nt, Homo sapiens
agguggcucugaaaagagccuuugguuccuuugggauugaguugcugcaaacuaauccaggcuucuacuugcccuucgccuugugguggcucucggucuucuugggcaguagcacggccuggauguugggcaggacgccacccugugcgauggugacuuugcccagaagcuuguugagcuccucaucguugcggauggccagcuggaggugacgcgggaugaugcgagucuucuuguugucgcgggccgcguugccagccagcuccaggaucucggcggucagguacuccagcaccgccgccagguacaccggcgcuccagcaccgacccgcuccgcauaguugccuuugcggagcaggcgaugcacucggccuacgggaaacugaagcccggcccgagaagagcgggucuuggccuuggcgcgagcuuugccucccugcuugccacgcccagacauggcaaaaggccuauuaucuauacggucaagaaagacugaagugaaacuagaaaaacguacauuuuauagccucuacugggcgcgaaaaggaagcugugcgauuggcuuacguuuuauuuuuauuuagaccaaua

SEQ ID NO: 17211 - RNA, 8023 nt, Homo sapiens
gagagaaacugagaagcaaggacagguucaggaucuaaaguccagaaaaagaaacuuacagcaaagccccuaacccaggagcuggaguggcagaauuugaaccagaaucugaucagcagggcgagggcaccagcauaagucacauuuguuugacauuuaacauucaaaauaccaauauuuacaaugagaauaaucauccacuuauauuuccauaacucucugcaauaaagcacuuuaaguugggaauaaggauguuugcagacacaugccaauuacgugcggaacaggugcugaauuccaauuccugggaguuucuucuuucaaaacaagcugcuuucuuuuguucagugaacaaguauguccaggacugaggugaccaugcagggaguggaaaggguaugagauucagacuucacccuuaaucuggcucuccuuugccagcuugagccaggucuguagcugcuggaagauguucuguggggaggugggaagaauuugaaagucagauuucagcaccagcagaaggagggaacaugcaagugauuauucaaaugagaaugcaaaugauucagagccuuuuuucucuuaccuggcgcccuaggcggaggcugggggagucugagggccucucaggugccauguccaagcagugggagccagugcggauaagaagaguugauucugaggauccuaaagccuguguuacacuuagcacaugccaggggucuguguccccuggaaagaaaggauaggauggggcuagguagaugggugcugggagaggaugaggcuauguugagcuggggcuagguggaggcuuagcagccagguuuugauagcaugcucaccauuaacaaacagcacuuuguuagccccaggggucuggccaccguaguaggaguucgucugagccacagccugggcuacugacaaggcugagagcccaaacaccugcucacauaggucuagcugggagggcagugcugggagcugggagaaaggacaucugggauucucacaggugacaucuguguagggagauaccuguaaguguggguauacaggcagcccaccacucuccuucaauaaucauuuucaaagcuuuccucagugaugaccagaacauuucuaauacucccuucgaggaguuuacaguccuggcagacagacucacacaguccccugacagugauagcccacagugaucagggcugugauggaaaaaggccacaaggcagggaucccagaggaaacaugaugggcucagggaaagcauccugcaaaggauaagaccuugagaaauuaguagaacugagccaaacaaagauagagaaggaaggcauaguaaauagaagaaauagcacgugcaaaggucuggaaugcucggagcucaaauuguauuaugucugcccugcuuaaaacccauagcucacugugcuuucaggguaaagauaacuucuguaacaucagauuaauucaucccuucccucccuauuuguugaccaccuaccaggugcucagauaaauguuguacaauguugggcacaugguggcaaccaagacagcuccaggcucugcugucacaggacucaguccagaggggaagacaggcaauaaaaaauguauuaugacaggcuguguaaaaugcuaaggagaacacagagcuaucgaagucggagguggcaaggcugacuuaucuugagggaucauggcuuccugagggaggccacccuauugagacuugaagaugaauaauccaagcaaagugaacagcauguacaaaguuccuaagauguuaggaagacuaauguauuaagaggguuaaaauauguaaagccuuauaauaauaacaauagcaagagguuuauggaauacuuacuguagaccugcauuauucuuagaaugcuacaaauauuaccuccuuuaguccuugaaacaacccuaugagagaaauauugcuuguauucccauuuuauagauguggaaacaggcauagagaaguaagucacuugcccaaguuugcccaagauuacgaguagaaaauggagcuggaauuugaacauuuaauuuaccauauguaguauuugggacaugcuuauacuaaaaaaaaaucuguuguauaucugaaauucaaauuuaacugggcauccuguauuguaucuggcaacacuacccuggggucuuugaggagcugugguuuugaguacaggagggacaagguuauauuuacaaggaucucuguggaugcuaugaaaaaguuggauuguacagaggaagugaaaaccaugagaccagagaagcggcugggaagggaucccggcaagaaagaauggagguucccagcaggacagcagagguaggcauagaaagcacaagggauggacuacagaguuguccaugcagagugaggaggacucaguaauugacaggcuagcuagaaaaugggaaggaagcaacuaaaacaaggcucaaguuucuagucugguggauggggaaagggggccaucccuggaauggggacacagagaaagaauaggcugaagggaagaucacucaaguggagaccucagugugugcgugaggaggcaugugagggccaagcacaugcauacacuaguauggcuuccaccuucuccagcccaacaucugcagguuacacagugccugagagcugggucgaaaugaguccagaccaccuguaagaugacuucucugggcauaguaaaaagguuguuugaggggacaaaguuaggguuaggccagucacuuacagaagccgaacucgguacaugucugauacaaccacugccggucacccacaccagacaguugagguucugugcuccucagcugugccacugucucugcucgggaaaagcuuaaacacuucuggcccaggcugugcaagacaaucuagggaacaauguacauacauaagacauaaauuccuccucucuucccagcaagccagggugcagaggccuauguccccagaggucaaaagucagaaauagaagggugaguuccugaguucuccugggagucaguggucagaggggguggaugccuggguccuugugaguuagagaucaaugcacuagaagacugagaccuuauuaccugugagagcuugggcaagugauaaucuuucagacuucaguuuccuuuucuguaaguggcgauaauaauagugccuaucucuugagaacuuaaugaaauaauauaugugaagcacuuuauacagcacuugguccagacagugcuggaaaagcgacagcuggauugcaguuguggauuuagaggcugcagucccagguaccuaggagaacccuauccccagagauaacauuuuuucauucauucuaaaaauacuaagugagaauuugccaugugccaggcacuccugcaggccccccaaaagagaacaggacaggauaggcaaaauagguaauaaucgcagucucuaacauucgcacacugugugccaggcucccagcugauugcucuacaugacccgccucauuucaucuucccaucggcccugugaaguguuauccccauuuuacagaugagaaaacgaaguuucagagaagguucucgcuugcccaagaucacacaacggaaguggggcaggaaucuuuguccgcuaacuccucccagcugugccagggagugcucaccugcaccgcccgacgaagcccgcaguagggcguggaguggcugcgguugcccccgcccccgaggagaaguccgcagagcugucgcacgcuuagcggcgcucccgucugcccaucauacugcacuacaccucccaccagugccugcagcgcccccaacagcuccgccugguuuucagcgcggcccaggggcccgcaagcgcucagcuccguccgcaaugcugcuugagccgccccacccgagcgcagccgccgcuccacuucagcgaaggcgacggacaccgccgcccggcacugugggaagcaagaggcgauguccgccaagacuuaggcugggccucggcuuucccuacccaggaccugcguccuccuuggguuccccacuuuccccuagcgggacucagagggugcagaccuagcucuuggcccaggcccccgcccccaggcccccgcccccaauccccugccucgcagcccuccuucucgggucuucccugcaggccccguccuccauuguggccccgccccaccuugagccucaccuccggauaggauugucccugcccaaaccccgcccucucuggggagcgccucuuuuccuggugccccuccucuucgucagcucccgccuucuuccaaaaccugcguauucccccgagcuccgaccuuccuuagaccccgccacguugcagguuucgcccuucucuggccuccucuucccuggcauccgaggccucuuuucccucccagucccccucggacuaggccccaccuccuaccuccagggacccgccgaucgcggugcucauuaggcuucgggauaccaccugugggcggaccgcagaggaagguauccggaagugucaagggacuccgcccgcugggaccccuccccgucccgcaccugcugcccgccauccuuacgucauuauacucggagaaauccagcacggcccgcaccggggcggaggaggcgaccgacgcgaaaaugagaugggggaacuaagggaggagacgccgucagccugcgggcugagggguuggaaucgcauaucuuucugccucugugucacuuacucgcuguguaaucucgggcucuugugaggacagcuugugcaaaauucuuugggcgcgggaggaagguaggggcguggugggaggguauuccuauuaucugagacuggggcccuggaguccgaguucccuccccccagcccacccggaggagucgcaggaccuucagccgggcccaggcggccaaggagccggcauaggagccuccgaagcagauccaggggcuggaggaggagauguuaaagaggcgggaaagugccaggcgggcagagaccacaucagccagccuagggucaaaggggggacucggucgguccucaucgcugggaaucccugaagauuuccccauucugggggaaacccggauccagagacaugaaugggugaaucuggccagaaaccagggccguuuucucaugacguguuuccaaguguucuccaagccacauacacuucccagaacaugugugccuaggccaagggagacccuguccucguccacuuucuagaaagccaccacccucuuucccuucucguuuuagguaggagaggaaaaauuuccaagucaguuuagaugaaaaccugacaaauguagggaaggguugagggcacucaaggagggcuacuaagaggagaaggagggguccuaaccugaugaguugcaagguauugggagagagaacagacacaaagagaaauggagagugaaguuuggauaugucuaacauccucuuucuccucccaagggcuuucuuucuucccuaaccuuucugaauggcuugcaguugguaccauccuguugcaguuagaaaaccguuucgcuuguagaaaagauuaagaugcagagagacagagauggagacaaagaggcacagauguagauacagagacggagaaaaugagacaggcaaacagacuguuacagacacagacagagauaccaaugaggaaagaaaaagcuaaguucuguaagaauaaagcagaugaaagaaacaaaaagcaggugaaguaaaguuggaaaaaugguggcggucguuaauaggagugagaugcacugaaggaggcuggggugagaggcauaaaaacaucuaggggaaggccacgccaugcagagggaugaguucaaaggcucaaggcaggaaugugcguguaagucuggaggacagugaggacuucaauguagcuggagcccagugaaagugagagaguauaggucagaguuaacuagaggccaaaacccacuggacuccauggcgacuguaaaagcuuugacuuuacucugaagucaaauacagucaaaauugcuuuacuucugaagcaauacagaagaugucugagggacuuaagccagggaggaucauguccugguuuaugcucuaacagaauuacucugauuuccaccuggaagucaagggcagagcaggaaaaauggugagaaugcuguggccguaauccagguaaggaaugcugguggucugcacagugauacaguggcuuacuucagacagagacgcagaaauagaaagaacacaggauaagagaaagacagauagggagagucagagacccagaaauggaaagagaaaaaacaagacccuaugaaacacagaagaaaacagagggaaccagagacucagagguugacuucagacaguggaggagagagacacagaugcagagaugccaaagcacagacauuccuguccuuugaccauaaacacuuucccuuccuccacucacgcaaggcggcuggacaagaagcggagcugggccauuuccaggccuccagcagguauacucaggccauaaaaucuguguuccaggcuuaucaccagggcgccccaggcuggggccaaggcugcgggauggccugugaagaguguaugggugggggguggggaggugagaugcaaguugaguuuaagcccuuucacuccucaggucucacagcauugcaauaugcagcuccccuuccugguccccaccagcaucccaacuccuuucccccaacauugccucuuaccucucaucacugagccaggcccaaggcugcccucacccccuagaugcaggaauauggguccauccuggccaacccaauguuggucauucacccaguaacgcugagaggugggauggggaagaagaaauggcacugugagaguccugacuuauucucaauuccucauuuguuccagucucucuuccuaauggaucuuuccuuauguacuuaacagugucugaaaugagcuuguuuauuuacuugcucacuuuuccccuguucaucuccucaucuagaaugcaaaauauacaaaagcaaauuuuugaccugguuuuucacucuuauauccccagaacugagggaguggcucucacauugaaggaacuugcuauuucuugaaguaauaauuguaaaauaagaaauaaaugcagauggauuuaggaauaagauccaagugggaugauauuuggagacuaaauacagaggaagcacugaaaaauggcgaauuuguuccuucuuucgauagauaucuuugagugccuguugugagcuaggucugauuccaaagcugguucaaauuucugcuaccuacugagaccuggugguagguuuuguguccagucuggacagggacaaggggguagggaggagcagugaaugugaaugacagagagaaagaaauggugaagggcaagaucugagggacaaaacgagugggaccccgaggagaggagagaguaaggccaaaucuacaaagggcaggaaaagggauacugacagcaagcauaacaugagauucaagcagagggauggggagaacugagguguggagagagaaaaaagugcagacugaggaagagaugagggagacugaggagagggcaggaugguuaguggacuccccgucucccggccucaccuguaggaaggaucgucugucggacacguugaagggguccagcaguugcuccagccaccccacuuuugggagggcugcagcaccuggccccaggcucaggcccaggcccugggcagagcucuccugaaacugcugaaugugcucacccaggcgccuaagaagggaggcugugggacauggagggaaggaagucaggcuggcccccuuaggaugcccugcuugacccucagccuccucuuaccuggagccaagaguccccagagggaaaccaagagcagagggcccagccacugggcaagccagacggccaugguguucgggacucuguucucccccaggaggaccuuuauc

SEQ ID NO: 17212 - RNA, 8023 nt, Homo sapiens
gauaaagguccuccugggggagaacagagucccgaacaccauggccgucuggcuugcccaguggcugggcccucugcucuugguuucccucuggggacucuuggcuccagguaagaggaggcugagggucaagcagggcauccuaagggggccagccugacuuccuucccuccaugucccacagccucccuucuuaggcgccugggugagcacauucagcaguuucaggagagcucugcccagggccugggccugagccuggggccaggugcugcagcccucccaaaagugggguggcuggagcaacugcuggaccccuucaacguguccgacagacgauccuuccuacaggugaggccgggagacggggaguccacuaaccauccugcccucuccucagucucccucaucucuuccucagucugcacuuuuuucucucuccacaccucaguucuccccaucccucugcuugaaucucauguuaugcuugcugucaguaucccuuuuccugcccuuuguagauuuggccuuacucucuccucuccucggggucccacucguuuugucccucagaucuugcccuucaccauuucuuucucucugucauucacauucacugcuccucccuacccccuugucccuguccagacuggacacaaaaccuaccaccaggucucaguagguagcagaaauuugaaccagcuuuggaaucagaccuagcucacaacaggcacucaaagauaucuaucgaaagaaggaacaaauucgccauuuuucagugcuuccucuguauuuagucuccaaauaucaucccacuuggaucuuauuccuaaauccaucugcauuuauuucuuauuuuacaauuauuacuucaagaaauagcaaguuccuucaaugugagagccacucccucaguucuggggauauaagagugaaaaaccaggucaaaaauuugcuuuuguauauuuugcauucuagaugaggagaugaacaggggaaaagugagcaaguaaauaaacaagcucauuucagacacuguuaaguacauaaggaaagauccauuaggaagagagacuggaacaaaugaggaauugagaauaagucaggacucucacagugccauuucuucuuccccaucccaccucucagcguuacugggugaaugaccaacauuggguuggccaggauggacccauauuccugcaucuagggggugagggcagccuugggccuggcucagugaugagagguaagaggcaauguugggggaaaggaguugggaugcugguggggaccaggaaggggagcugcauauugcaaugcugugagaccugaggagugaaagggcuuaaacucaacuugcaucucaccuccccaccccccacccauacacucuucacaggccaucccgcagccuuggccccagccuggggcgcccuggugauaagccuggaacacagauuuuauggccugaguauaccugcuggaggccuggaaauggcccagcuccgcuucuuguccagccgccuugcgugaguggaggaagggaaaguguuuauggucaaaggacaggaaugucugugcuuuggcaucucugcaucugugucucucuccuccacugucugaagucaaccucugagucucugguucccucuguuuucuucuguguuucauagggucuuguuuuuucucuuuccauuucugggucucugacucucccuaucugucuuucucuuauccuguguucuuucuauuucugcgucucugucugaaguaagccacuguaucacugugcagaccaccagcauuccuuaccuggauuacggccacagcauucucaccauuuuuccugcucugcccuugacuuccagguggaaaucagaguaauucuguuagagcauaaaccaggacaugauccucccuggcuuaagucccucagacaucuucuguauugcuucagaaguaaagcaauuuugacuguauuugacuucagaguaaagucaaagcuuuuacagucgccauggaguccaguggguuuuggccucuaguuaacucugaccuauacucucucacuuucacugggcuccagcuacauugaaguccucacuguccuccagacuuacacgcacauuccugccuugagccuuugaacucaucccucugcauggcguggccuuccccuagauguuuuuaugccucucaccccagccuccuucagugcaucucacuccuauuaacgaccgccaccauuuuuccaacuuuacuucaccugcuuuuuguuucuuucaucugcuuuauucuuacagaacuuagcuuuuucuuuccucauugguaucucugucugugucuguaacagucuguuugccugucucauuuucuccgucucuguaucuacaucugugccucuuugucuccaucucugucucucugcaucuuaaucuuuucuacaagcgaaacgguuuucuaacugcaacaggaugguaccaacugcaagccauucagaaagguuagggaagaaagaaagcccuugggaggagaaagaggauguuagacauauccaaacuucacucuccauuucucuuugugucuguucucucucccaauaccuugcaacucaucagguuaggaccccuccuucuccucuuaguagcccuccuugagugcccucaacccuucccuacauuugucagguuuucaucuaaacugacuuggaaauuuuuccucuccuaccuaaaacgagaagggaaagagggugguggcuuucuagaaaguggacgaggacagggucucccuuggccuaggcacacauguucugggaaguguauguggcuuggagaacacuuggaaacacgucaugagaaaacggcccugguuucuggccagauucacccauucaugucucuggauccggguuucccccagaauggggaaaucuucagggauucccagcgaugaggaccgaccgaguccccccuuugacccuaggcuggcugauguggucucugcccgccuggcacuuucccgccucuuuaacaucuccuccuccagccccuggaucugcuucggaggcuccuaugccggcuccuuggccgccugggcccggcugaagguccugcgacuccuccgggugggcuggggggagggaacucggacuccagggccccagucucagauaauaggaauacccucccaccacgccccuaccuuccucccgcgcccaaagaauuuugcacaagcuguccucacaagagcccgagauuacacagcgaguaagugacacagaggcagaaagauaugcgauuccaaccccucagcccgcaggcugacggcgucuccucccuuaguucccccaucucauuuucgcgucggucgccuccuccgccccggugcgggccgugcuggauuucuccgaguauaaugacguaaggauggcgggcagcaggugcgggacggggaggggucccagcgggcggagucccuugacacuuccggauaccuuccucugcgguccgcccacaggugguaucccgaagccuaaugagcaccgcgaucggcgggucccuggagguaggagguggggccuaguccgagggggacugggagggaaaagaggccucggaugccagggaagaggaggccagagaagggcgaaaccugcaacguggcggggucuaaggaaggucggagcucgggggaauacgcagguuuuggaagaaggcgggagcugacgaagaggaggggcaccaggaaaagaggcgcuccccagagagggcgggguuugggcagggacaauccuauccggaggugaggcucaagguggggcggggccacaauggaggacggggccugcagggaagacccgagaaggagggcugcgaggcaggggauugggggcgggggccugggggcgggggccugggccaagagcuaggucugcacccucugagucccgcuaggggaaaguggggaacccaaggaggacgcagguccuggguagggaaagccgaggcccagccuaagucuuggcggacaucgccucuugcuucccacagugccgggcggcgguguccgucgccuucgcugaaguggagcggcggcugcgcucggguggggcggcucaagcagcauugcggacggagcugagcgcuugcgggccccugggccgcgcugaaaaccaggcggagcuguugggggcgcugcaggcacuggugggagguguagugcaguaugaugggcagacgggagcgccgcuaagcgugcgacagcucugcggacuucuccucgggggcgggggcaaccgcagccacuccacgcccuacugcgggcuucgucgggcggugcaggugagcacucccuggcacagcugggaggaguuagcggacaaagauuccugccccacuuccguugugugaucuugggcaagcgagaaccuucucugaaacuucguuuucucaucuguaaaauggggauaacacuucacagggccgaugggaagaugaaaugaggcgggucauguagagcaaucagcugggagccuggcacacagugugcgaauguuagagacugcgauuauuaccuauuuugccuauccuguccuguucucuuuuggggggccugcaggagugccuggcacauggcaaauucucacuuaguauuuuuagaaugaaugaaaaaauguuaucucuggggauaggguucuccuagguaccugggacugcagccucuaaauccacaacugcaauccagcugucgcuuuuccagcacugucuggaccaagugcuguauaaagugcuucacauauauuauuucauuaaguucucaagagauaggcacuauuauuaucgccacuuacagaaaaggaaacugaagucugaaagauuaucacuugcccaagcucucacagguaauaaggucucagucuucuagugcauugaucucuaacucacaaggacccaggcauccacccccucugaccacugacucccaggagaacucaggaacucacccuucuauuucugacuuuugaccucuggggacauaggccucugcacccuggcuugcugggaagagaggaggaauuuaugucuuauguauguacauuguucccuagauugucuugcacagccugggccagaaguguuuaagcuuuucccgagcagagacaguggcacagcugaggagcacagaaccucaacugucuggugugggugaccggcagugguuguaucagacauguaccgaguucggcuucuguaagugacuggccuaacccuaacuuuguccccucaaacaaccuuuuuacuaugcccagagaagucaucuuacagguggucuggacucauuucgacccagcucucaggcacuguguaaccugcagauguugggcuggagaagguggaagccauacuaguguaugcaugugcuuggcccucacaugccuccucacgcacacacugaggucuccacuugagugaucuucccuucagccuauucuuucucuguguccccauuccagggauggcccccuuuccccauccaccagacuagaaacuugagccuuguuuuaguugcuuccuucccauuuucuagcuagccugucaauuacugaguccuccucacucugcauggacaacucuguaguccaucccuugugcuuucuaugccuaccucugcuguccugcugggaaccuccauucuuucuugccgggaucccuucccagccgcuucucuggucucaugguuuucacuuccucuguacaauccaacuuuuucauagcauccacagagauccuuguaaauauaaccuugucccuccuguacucaaaaccacagcuccucaaagaccccaggguaguguugccagauacaauacaggaugcccaguuaaauuugaauuucagauauacaacagauuuuuuuuuaguauaagcaugucccaaauacuacauaugguaaauuaaauguucaaauuccagcuccauuuucuacucguaaucuugggcaaacuugggcaagugacuuacuucucuaugccuguuuccacaucuauaaaaugggaauacaagcaauauuucucucauaggguuguuucaaggacuaaaggagguaauauuuguagcauucuaagaauaaugcaggucuacaguaaguauuccauaaaccucuugcuauuguuauuauuauaaggcuuuacauauuuuaacccucuuaauacauuagucuuccuaacaucuuaggaacuuuguacaugcuguucacuuugcuuggauuauucaucuucaagucucaauaggguggccucccucaggaagccaugaucccucaagauaagucagccuugccaccuccgacuucgauagcucuguguucuccuuagcauuuuacacagccugucauaauacauuuuuuauugccugucuuccccucuggacugaguccugugacagcagagccuggagcugucuugguugccaccaugugcccaacauuguacaacauuuaucugagcaccugguagguggucaacaaauagggagggaagggaugaauuaaucugauguuacagaaguuaucuuuacccugaaagcacagugagcuauggguuuuaagcagggcagacauaauacaauuugagcuccgagcauuccagaccuuugcacgugcuauuucuucuauuuacuaugccuuccuucucuaucuuuguuuggcucaguucuacuaauuucucaaggucuuauccuuugcaggaugcuuucccugagcccaucauguuuccucugggaucccugccuuguggccuuuuuccaucacagcccugaucacugugggcuaucacugucaggggacugugugagucugucugccaggacuguaaacuccucgaagggaguauuagaaauguucuggucaucacugaggaaagcuuugaaaaugauuauugaaggagaguggugggcugccuguauacccacacuuacagguaucucccuacacagaugucaccugugagaaucccagauguccuuucucccagcucccagcacugcccucccagcuagaccuaugugagcagguguuugggcucucagccuugucaguagcccaggcuguggcucagacgaacuccuacuacgguggccagaccccuggggcuaacaaagugcuguuuguuaauggugagcaugcuaucaaaaccuggcugcuaagccuccaccuagccccagcucaacauagccucauccucucccagcacccaucuaccuagccccauccuauccuuucuuuccaggggacacagaccccuggcaugugcuaaguguaacacaggcuuuaggauccucagaaucaacucuucuuauccgcacuggcucccacugcuuggacauggcaccugagaggcccucagacucccccagccuccgccuagggcgccagguaagagaaaaaaggcucugaaucauuugcauucucauuugaauaaucacuugcauguucccuccuucugcuggugcugaaaucugacuuucaaauucuucccaccuccccacagaacaucuuccagcagcuacagaccuggcucaagcuggcaaaggagagccagauuaagggugaagucugaaucucauacccuuuccacucccugcauggucaccucaguccuggacauacuuguucacugaacaaaagaaagcagcuuguuuugaaagaagaaacucccaggaauuggaauucagcaccuguuccgcacguaauuggcaugugucugcaaacauccuuauucccaacuuaaagugcuuuauugcagagaguuauggaaauauaaguggaugauuauucucauuguaaauauugguauuuugaauguuaaaugucaaacaaaugugacuuaugcuggugcccucgcccugcugaucagauucugguucaaauucugccacuccagcuccuggguuaggggcuuugcuguaaguuucuuuuucuggacuuuagauccugaaccuguccuugcuucucaguuucucuc

SEQ ID NO: 17213 - RNA, 1129 nt, Homo sapiens
aggagccuccgaagcagauccaggggcuggaggaggagauguuaaagaggcgggaaagugccaggcgggcagagaccacaucagccagccuagggucaaaggggggacucggucgguccucaucgcugggaaucccugaagauuuccccauucugggggaaacccggauccagagacaugaaugggugaaucuggccagaaaccagggccguuuucucaugacguguuuccaaguguucuccaagccacauacacuucccagaacaugugugccuaggccaagggagacccuguccucguccacuuucuagaaagccaccacccucuuucccuucucguuuuagguaggagaggaaaaauuuccaagucaguuuagaugaaaaccugacaaauguagggaaggguugagggcacucaaggagggcuacuaagaggagaaggagggguccuaaccugaugaguugcaagguauugggagagagaacagacacaaagagaaauggagagugaaguuuggauaugucuaacauccucuuucuccucccaagggcuuucuuucuucccuaaccuuucugaauggcuugcaguugguaccauccuguugcaguuagaaaaccguuucgcuuguagaaaagauuaagaugcagagagacagagauggagacaaagaggcacagauguagauacagagacggagaaaaugagacaggcaaacagacuguuacagacacagacagagauaccaaugaggaaagaaaaagcuaaguucuguaagaauaaagcagaugaaagaaacaaaaagcaggugaaguaaaguuggaaaaaugguggcggucguuaauaggagugagaugcacugaaggaggcuggggugagaggcauaaaaacaucuaggggaaggccacgccaugcagagggaugaguucaaaggcucaaggcaggaaugugcguguaagucuggaggacagugaggacuucaauguagcuggagcccagugaaagugagagaguauaggucagaguuaacuagaggccaaaacccacuggacuccauggcgacuguaaaagcuuugacuuuacucugaagucaaauacagucaaaauugcuuuacuucugaagcaauacaga

SEQ ID NO: 17214 - RNA, 1129 nt, Homo sapiens
ucuguauugcuucagaaguaaagcaauuuugacuguauuugacuucagaguaaagucaaagcuuuuacagucgccauggaguccaguggguuuuggccucuaguuaacucugaccuauacucucucacuuucacugggcuccagcuacauugaaguccucacuguccuccagacuuacacgcacauuccugccuugagccuuugaacucaucccucugcauggcguggccuuccccuagauguuuuuaugccucucaccccagccuccuucagugcaucucacuccuauuaacgaccgccaccauuuuuccaacuuuacuucaccugcuuuuuguuucuuucaucugcuuuauucuuacagaacuuagcuuuuucuuuccucauugguaucucugucugugucuguaacagucuguuugccugucucauuuucuccgucucuguaucuacaucugugccucuuugucuccaucucugucucucugcaucuuaaucuuuucuacaagcgaaacgguuuucuaacugcaacaggaugguaccaacugcaagccauucagaaagguuagggaagaaagaaagcccuugggaggagaaagaggauguuagacauauccaaacuucacucuccauuucucuuugugucuguucucucucccaauaccuugcaacucaucagguuaggaccccuccuucuccucuuaguagcccuccuugagugcccucaacccuucccuacauuugucagguuuucaucuaaacugacuuggaaauuuuuccucuccuaccuaaaacgagaagggaaagagggugguggcuuucuagaaaguggacgaggacagggucucccuuggccuaggcacacauguucugggaaguguauguggcuuggagaacacuuggaaacacgucaugagaaaacggcccugguuucuggccagauucacccauucaugucucuggauccggguuucccccagaauggggaaaucuucagggauucccagcgaugaggaccgaccgaguccccccuuugacccuaggcuggcugauguggucucugcccgccuggcacuuucccgccucuuuaacaucuccuccuccagccccuggaucugcuucggaggcuccu

SEQ ID NO: 17215 - RNA, 449 nt, Homo sapiens
ggcccuauuaagagacucaguuugcagucauuucaacucuuuuguugaaagcuuaggggcccuaaaaagggccuuuuuagagaaugacugggcuucaaaaugccauuuagccgccgaagccauagagggugcggcccuggcgcuugagcgcguagaccacguccauggcggugaccgucuugcgcuuggcgugcuccguguaggucacggcgucccggaucacguucuccaggaacaccuucaacacuccgcgggucuccucauagaugaggccagaaaugcgcuucacgccgccgcggcgagcaaggcgccgaauggcuggcuuggugauacccuggauguugucgcgcagcaccuugcgguggcgcuuggcacccccuuuccccaggcccuuaccuccuuugccgcguccugacauuaucaaguggucagagaacaaaggucugcug

SEQ ID NO: 17216 - RNA, 437 nt, Homo sapiens
ggcccuauuaagagacucaguuugcagucauuucaacucuuuuguugaaagcuuaggggcccuaaaaagggccuuuuuagagaaugacugggcuucaaaaugccauuuagccgccgaagccauagagggugcggcccuggcgcuugagcgcguagaccacguccauggcggugaccgucuugcgcuuggcgugcuccguguaggucacggcgucccggaucacguucuccaggaacaccuucaacacuccgcgggucuccucauagaugaggccagaaaugcgcuucacgccgccgcggcgagcaaggcgccgaauggcuggcuuggugauacccuggauguugucgcgcagcaccuugcgguggcgcuuggcacccccuuuccccaggcccuuaccuccuuugccgcguccugacauuaucaaguggucagagaac

SEQ ID NO: 17217 - RNA, 501 nt, Homo sapiens
cguggguggcccugaaaagagccguugguuuggacucgauuuuacuugagcugccacaaacuaguacagauaguuacuugcccuucgccuugugguggcucucagucuuuuugggcaguagcacggccugaauguugggcaggacaccgcccugugcgauggugacuuugcccagcagcuuguugagcuccucgucguugcggauggccaguuggagaugacgcgggaugaugcgggucuucuuguugucgcgggccgcguugcccgccaguuccaggaucucggcggucagguacuccagcaccgcugccagauacaccggcgcgccggccccgacccgcucggcauaguugccuuugcggagcaggcggugcacucggcccacggggaacuggagaccggcccuagaagagcgagucuuggccuuagcgcgggcuuugccucccugcuugccacguccagacauagcgagcgcaacucacuacgagcaaccacaaagug

SEQ ID NO: 17218 - RNA, 652 nt, Homo sapiens
auggccaaaugcaccaagaaaguuggaaugaggcuggacacgguggcucacgucuguaaucccagcacuuugggaggccaagguggcuggaucacuugagaucaggagcucgagaccagccuggccaacauggcgaaaccccaucucuaaucaaaauacaaaaauuagccaggcaugauggcacacgccuguagucccagcuacuggggaggcagaggcaggagaauagcuugaaccugggaugcagagguugcagugagccgagaucgugccacugaacuccagccugggcgacagaguaagacucaaucucagaaaaaaaaaaaaaaaagaaagucggaauagucaguaaauacaggacccaccauggggccucccucuggaaaauggugaaggaaauugaaaucagccagcacaccaaguacacuugcucuuucuguggcaaaaccaagaugaagagacgagcugugaaaaucaggcacuguaauuccugcaugaagacaguggcuggcagugccuggaccuacaacaccacuucggcugucauggugaagucugccaucagaagacugaaggaauugaaagaccaguagaugcuccucuacucuuugagacaucucuggccuauaacaaauggguuaauuuauguuaa

SEQ ID NO: 17219 - RNA, 1004 nt, Homo sapiens
auacacccuuaguuccuggaggaaucauugcagaaaguaauuucccccaguuuccuaggugagcacuccagcauuuagcaaugcagacaucucugcugaucagcacaaaggggcugagacuggcauaaccaaacauuagaaaugguuuaauaauuaauacagcagaaucauuugucaagauggaaccuauauagaaggagaaaauaaaaucagcccaauaaaagaaaaggaaacaggucaugagaaugaaaguacuuuaaguagcucugaccucugggcuggaauuauuugcaaaccuggagcucugaagguaggagacacaauugugauauuuauacagaugauaagccacguacccacugcuccagcccaugagacucugaaagaugauaucccaaagagccauaagagugagaaaaaccaccuaacuauuugcuuagaugguagcauauagcaacaacuaauauguggucuaauuucagaccuauucaugcuauuaacugcucuaauguaguagagcaaguuggagcuuaucagaacauuaaagauccaaaagaggaagagauaaggaagaacuugccaugcaauccguaguuugagcuuucuccacaaggugguccugggacugauggugauggccuggaccaugcugaggagacagguggugcagauggaaaggccccaagcaacccucccuaaauaaacugaaguuuuacaaccaacauuaccuaggaaguuucugaaauuaaaaacugcaguuauauuucugcuacuuaugcuauaaauaaugauuacauuugagaaaaccaaaugaagaaggauaaguucuaugugcuuuuucucagaacucaugacaaaagaauauacaugucuuauaaauauaaggaaguuucccacaaauccagguccaguaaggaaaaggaagacuauucccuggaugagguuacucuaaaucauuuucugacaucacggacagagccagaaaaaaaacuuuugagaagcac

SEQ ID NO: 17220 - RNA, 1101 nt, Homo sapiens
ccaggagauacaauauucauuauucugaggaagcagaagcugaucuuccugcacugguaucaccacaucacugugcuccuguacucuugguacuccuacaaagacaugguugccgggggagguugguucaugacuaugaacuauggcgugcacgccgugauguacucuuacuaugccuugcgggcggcagguuuccgagucucccggaaguuugccauguucaucaccuugucccagaucacucagaugcugaugggcugugugguuaacuaccuggucuucugcuggaugcagcaugaccagugucacucucacuuucagaacaucuucugguccucacucauguaccucagcuaccuugugcucuucugccauuucuucuuugaggccuacaucggcaaaaugaggaaaacaacgaaagcugaauaguguuggaacugaggaggaagccauagcucagggucaucaagaaaaauaauagacaaaagaaaauggcacaaggaaucacacguggugcagcuaaaacaaaacaaaacaugagcaaacacaaaacccaaggcagcuuagggauaauuagguugauuuaacccaguaaguuuaugauccuuuuagggugaggacucacugagugcaccuccaucuccaagcacugcugcuggaagaccccauucccucuuuaucuaucaacucuaggacaagggagaacaaaagcaagccagaagcagaggagacuaaucaaaggcaaacaaaggcuauuaacacauaggaaaaaauguauuuacuaagugucacauuucucuaagaugaaagauuuuuacucuagaaacugugcgagcacaacacacacaauccuuucuaacuuuauggacacuaaacuggagccaauagaaaagacaaaaaugaaagagacacaggguguauaucuagaacgauaaugcuuuugcagaaacuaaagccuuuuuaagaaaugccagcugcuguagaccccaugagaaaagaugucuuaaucauccuuaugaaaacagauguaaacaacuauauuucaacuaacuucaucuucacugcauagccucaggcuagugaguuugccaaaaccaaagg

SEQ ID NO: 17221 - RNA, 1101 nt, Homo sapiens
ccuuugguuuuggcaaacucacuagccugaggcuaugcagugaagaugaaguuaguugaaauauaguuguuuacaucuguuuucauaaggaugauuaagacaucuuuucucauggggucuacagcagcuggcauuucuuaaaaaggcuuuaguuucugcaaaagcauuaucguucuagauauacacccugugucucuuucauuuuugucuuuucuauuggcuccaguuuaguguccauaaaguuagaaaggauuguguguguugugcucgcacaguuucuagaguaaaaaucuuucaucuuagagaaaugugacacuuaguaaauacauuuuuuccuauguguuaauagccuuuguuugccuuugauuagucuccucugcuucuggcuugcuuuuguucucccuuguccuagaguugauagauaaagagggaauggggucuuccagcagcagugcuuggagauggaggugcacucagugaguccucacccuaaaaggaucauaaacuuacuggguuaaaucaaccuaauuaucccuaagcugccuuggguuuuguguuugcucauguuuuguuuuguuuuagcugcaccacgugugauuccuugugccauuuucuuuugucuauuauuuuucuugaugacccugagcuauggcuuccuccucaguuccaacacuauucagcuuucguuguuuuccucauuuugccgauguaggccucaaagaagaaauggcagaagagcacaagguagcugagguacaugagugaggaccagaagauguucugaaagugagagugacacuggucaugcugcauccagcagaagaccagguaguuaaccacacagcccaucagcaucugagugaucugggacaaggugaugaacauggcaaacuuccgggagacucggaaaccugccgcccgcaaggcauaguaagaguacaucacggcgugcacgccauaguucauagucaugaaccaaccucccccggcaaccaugucuuuguaggaguaccaagaguacaggagcacagugauguggugauaccagugcaggaagaucagcuucugcuuccucagaauaaugaauauuguaucuccugg

SEQ ID NO: 17222 - RNA, 894 nt, Homo sapiens
augauuuccuuuauccacuagaaaugugcuaugauaugauuuuuuugcagauacauauauaucaucauaacugguacuuucuucauacaguguuuccuugaucuaaauauuuucugcccaugaaguuagaaauggcuuugaauauuaucaagggaacaauauuccuguuucuaacuggacuuggcauuguggggaauguuuugguuuugguaaacuauaugugcauuuucuuuugggggacugagaagaagucuuuacacuuuauucuuauucacuuagcuuuuacaaauaucauacuucuauuuuccaaaggaaugcccaagacaauagcagcuuuugguuugaaaaacuuccuagaugauacaggcuguaaaauuguugcuuaucuggagaggguggcucgaggccuuuccaucugcaccagcagucuccucacugugguccaggccaucaccaucagucccagagccugcaugagggggaggcucaagcugaggucugcaugacaaguccuucccuuguuucucuuuuuuuuggacauucaguuccuugauaaccauaaacuuacuucauuccaucacaaauagcaacaugaacagaucacaaauuagugaaaaggauaacuacuguuauuuucuagcagggagaucgguaauaagacggauuuuucucacacugauagucuugcaagaugcccuguuucagggucuaaugggcugggccagcagcuacauaguauuucuucuccaccagcaucacaagcauguucuucacauucagaacuccaaauuucuguacaaaacucccccugagauaagagcugcucaaaguguucuccuucugaugaucuguuuuguuuucuuuuauuggauagauuguauuauuucuuuauau

SEQ ID NO: 17223 - RNA, 918 nt, Homo sapiens
ccuaggugagcacuccagcauuuagcaaugcagacaucucugcugaucagcacaaaggggcugagacuggcauaaccaaacauuagaaaugguuuaauaauuaauacagcagaaucauuugucaagauggaaccuauauagaaggagaaaauaaaaucagcccaauaaaagaaaaggaaacaggucaugagaaugaaaguacuuuaaguagcucugaccucugggcuggaauuauuugcaaaccuggagcucugaagguaggagacacaauugugauauuuauacagaugauaagccacguacccacugcuccagcccaugagacucugaaagaugauaucccaaagagccauaagagugagaaaaaccaccuaacuauuugcuuagaugguagcauauagcaacaacuaauauguggucuaauuucagaccuauucaugcuauuaacugcucuaauguaguagagcaaguuggagcuuaucagaacauuaaagauccaaaagaggaagagauaaggaagaacuugccaugcaauccguaguuugagcuuucuccacaaggugguccugggacugauggugauggccuggaccaugcugaggagacagguggugcagauggaaaggccccaagcaacccucccuaaauaaacugaaguuuuacaaccaacauuaccuaggaaguuucugaaauuaaaaacugcaguuauauuucugcuacuuaugcuauaaauaaugauuacauuugagaaaaccaaaugaagaaggauaaguucuaugugcuuuuucucagaacucaugacaaaagaauauacaugucuuauaaauauaaggaaguuucccacaaauccagguccaguaaggaaaaggaagacuauucccuggaugagguuacucuaaaucauuuucugacaucacg

SEQ ID NO: 17224 - RNA, 746 nt, Homo sapiens
gaugggguuuguuaaaguuguuaagaauaaggccuacuuuaacagauaccaagugaaauuuagaagacgacgagaggguaaaacugauuacuaugcucggaaacgcuuggugauacaggauaaaaauaaauacaacacacccaaguauaggaugauuguucguguaacugacagagauaucauuugucagauugcuuaugcccguauagagggggauaugauagucugcgcggcauaugcacacgaacugccaaaauacggugugaagguuggcccgacaaauuaugcugcugcauauuguacuggccugcugcuggcccgcaggcuucuugauagguuuggcauggacaagaucuaugacggccaaguggaggugacuggcgauaaauacaauguggaaaguacugauggucagccaggugccuucaccugcuguauggaugcaggucuugccagaacuaccacuggcaauaaaguuuuuggcgcccugaagggaguuguggauggaggcuugucugucccucacagcaccaaaugauucccugguuaugauucugaaagcaaggaauuuaaugcaggaguacaccagaagcacuucaugggccagaauguugcagauuacaugcgcuacuuaauggaagaagaugacgaugcuuacaagaaacaguucucucaauacauaaagaacagcguaacuccagacaugauggaggagauguauaagaaagcucaugcugcuauacgag

SEQ ID NO: 17225 - RNA, 475 nt, Homo sapiens
cgaauucccggcauauaagggcguugcuuugccuuggcguuuagguuucuuaaguugguuuuagaaguugcuuagucaugucuggccgugguaaagguggaaaagguuuggguaagggaggagcuaagcgucaucgcaagguuuugcgcgauaacauccagggcaucacuaagccagcuauccggcgccuugcucgucgcggcggugucaagcgaauuucuggccuuaucuaugaggagacucgugguguucugaagguguuccuggagaacgugauucgugacgcugucacuuacacagagcacgccaaacgcaagaccgugacagcaauggauguggucuacgcgcugaagcgacagggacgcacucuuuacggcuucgguggcuaaggcuccugcuugcugcacucuuauuuucauuuucaaccaaaggcccuuuucagggccgcccacuuuuuucauaaaagagcagacau

SEQ ID NO: 17226 - RNA, 3712 nt, Homo sapiens
uuuaauauuuauucuauauaguuucuuuuuuuuuuuuuggaaaucuuuaaaaucugaauugugugaugcuuaagcacagugucacuggauugaucuauugaauacuaccuacaacucucauagucauuuacuaugguggugguggggaugggggaguuaacacaaaaugaagagaacacugggccuuaaguuagauagcuaucacuuaucuaacuaguuuuuccuagcuacuuuuugcaucuauaaaauaaaugguuccaaccucaguguaaugggaaaucuacuguuuuagauuauauucagauuuaggauuccaaagcaacacagaacucuuuuugagggcuaccaaaguaauaggugaaacuuugcaggacuucaaguuuacaguccauggggugauccagcuuucaggaaccuuguccuugcuacaauuacagagaagauaaguaccaggucccaacuuauguagccuagccccuuuccucuuugaacaucuggcgaacuuuguuggugaaacugagucucaguuauugcccuccagaaagagcagagauuaguuagcccaaugccuuuuuacuuacugagauccuaaguagcuaugggaaccagucaguguugcacaagaaugaaaugguggcaucuguuaauugacuauaucuaacacggugaacaauuccaacaauuauucaacaacuauuaagacuacaauaaugaucaaaauaauaaacaguaaacaaucugaauuuuaauuguaccuuuacgucuaggcaauauaaagcuauggucccaaaaaaaaauacuuagaguaugcuugugacuaucacuguugaaaaugauauccauaaugaugcaccgccccugccuccagaaaccuauaaaaugcuucccuacuggaauugugggguccuacuaauccaauucuauaaguuuagcuuuuuuauaaaccacauuuguauuucagugguguauaacacggucuuaagucccagagacuuguuucuaauacaugcaagagaguaaauaauuacuuaagacaagcuuaguaauuuuuuuuuuugagauggaauuucacucuuguugcccaggcuggagugcaauggcacuaucuuggcucacugcaaccuccgccuuccggguucaagcgauucuccuaccucagccucccaaguagcugggauuacaggcgugugccaccaugcccgccuaauuuuuguauuuuuaguauagacaggguuucaccauguuggucaggcuggucuugaacuccugacucagguggucugcccagcauggccucacaaagugcugggauuacaggcgugagccacugcgccuggccaagacaagcuaaguaauuuuuaugaaauuaguugaaugaggagagaugacaucuuuaaaguugauuauuuuaucuaggauuuauaugaaaaaauccucuaaucacuauugaguguaggccagaauaacuugauuuuuugaaaugaguauuuuuguuagaagaaacauaacaucaaacuacuucucuuguuucuucaacauaggaguucauuucagcaucugauuacuugauggagaauaucaauuuugugcuuaauuauuuaauaauaaccuaauuccaucagcuguauugcaaacuaacagauaaagaauacugaaguuacucauguuugcuuugaaauguuuguucagcuccuuagguggacauauucaaccaauuaauuuagggugugacagcuuaguucauauuuuguguguaaaaagccaaguagaaugaugaaaauuuacagugauuuaaaucagauauuuuucuuucuaacccuugaugcccacacuugcaauguugaaaauuuguauuuuauuuuuuuaaagugacuuuuaccaguuauucaaacagguuguacagagaaagaggaagggaaauuuguauuauaaauaugauuuuaaaauauaaaaaauguacaaaauucuaugaugaauauuagcaaaaaaauaguguauuucauuaaauuauuuauaaagugaugggacacaaacauguacacaagcucucaaugcucacaguugccaaaaugauguuggccugccauucuauuauuuguugguucaguuuucuuuuuuggggaugugguaguugaucuuuaaugcccauucuagaucggaaaaauccaugauccuaacuuuuaagagaagguugguaacucuacuuaggacuuuuuuuucuguaagaggaauaauguagccucacccuuaucuuucuggaaauguuuaaaccacugaaauauggagaucaaauccagcuuacacacugguaacucaaauacuauuuuuuuuuuuaaacuaucuuuucuaaacuaaucaccccucuuguacauagaacuuucuaccucagugccaauuccuagagguugaugcaaacagcucgccagagagccugugcuauuguuccugcgaaaaaacccaauuucccugcacauuuggauaaaaaugaguuuaucuauauaaaguugagacgguaagaauucacagaacaaugcccuggaagagagauuugcaaaugaaagagggagaaauaguauuuuuaaggaaaacaugaaaguugucucgauuugaccgaaguuugaaagagaguugggggaauaagaaaaguuucaagaugccgguuuuaaaacuaugcauagaaacaaaggcaggaaugaagcccgaacucucucggaucaguuucccccaagucucuaauuauuucaugcccagauuucuuauauuuuuacucuuuuuuaaggggcaacaaacacagcagcgcgguagauacgaggaguccuuuuccagcagcgccgcgcauggagcaaggaaccaaucaucacucagcgucucucuauauaaacccucagccucccucguagaggacaugcuguucugacaguuugagauuacuuauugucuuuucugggaagacaaaaacaugucggagacugcuccacuugcuccuaccauuccugcacccgcagaaaaaacaccugugaagaaaaaggcgaagaaggcaggcgcaacugcugggaaacgcaaagcauccggacccccaguaucugagcuuaucaccaaggcaguggcagcuucuaaggagcgcagcggcguuucucuggccgcgcuuaagaaagcgcuugcggcugcuggcuacgauguagaaaaaaacaacagccguaucaagcuuggccucaagagcuuggugagcaaagguacucuggugcagaccaaagguaccggugcuucuggcuccuucaaacucaacaagaaagcggcuuccggggaaggcaaacccaaggccaaaaaggcuggcgcagccaagccuaggaagccugcuggggcagccaagaagcccaagaagguggcuggcgccgcuaccccgaagaaaagcaucaaaaagacuccuaagaagguaaagaagccagcaaccgcugcugggaccaagaaaguggccaagagugcgaaaaaggugaaaacaccucagccaaaaaaagcugccaagaguccagcuaaggccaaagccccuaagcccaaggcggccaagccuaagucggggaagccgaagguuacaaaggcaaagaaggcagcuccgaagaaaaagugaaacuggcgggacguuccccuuugaaaauuuuaaacggcucuuuucagagccacccacaggucucagucaaaagagcugaagcuuuuu

SEQ ID NO: 17227 - RNA, 3712 nt, Homo sapiens
aaaaagcuucagcucuuuugacugagaccuguggguggcucugaaaagagccguuuaaaauuuucaaaggggaacgucccgccaguuucacuuuuucuucggagcugccuucuuugccuuuguaaccuucggcuuccccgacuuaggcuuggccgccuugggcuuaggggcuuuggccuuagcuggacucuuggcagcuuuuuuuggcugagguguuuucaccuuuuucgcacucuuggccacuuucuuggucccagcagcgguugcuggcuucuuuaccuucuuaggagucuuuuugaugcuuuucuucgggguagcggcgccagccaccuucuugggcuucuuggcugccccagcaggcuuccuaggcuuggcugcgccagccuuuuuggccuuggguuugccuuccccggaagccgcuuucuuguugaguuugaaggagccagaagcaccgguaccuuuggucugcaccagaguaccuuugcucaccaagcucuugaggccaagcuugauacggcuguuguuuuuuucuacaucguagccagcagccgcaagcgcuuucuuaagcgcggccagagaaacgccgcugcgcuccuuagaagcugccacugccuuggugauaagcucagauacuggggguccggaugcuuugcguuucccagcaguugcgccugccuucuucgccuuuuucuucacagguguuuuuucugcgggugcaggaaugguaggagcaaguggagcagucuccgacauguuuuugucuucccagaaaagacaauaaguaaucucaaacugucagaacagcauguccucuacgagggaggcugaggguuuauauagagagacgcugagugaugauugguuccuugcuccaugcgcggcgcugcuggaaaaggacuccucguaucuaccgcgcugcuguguuuguugccccuuaaaaaagaguaaaaauauaagaaaucugggcaugaaauaauuagagacuugggggaaacugauccgagagaguucgggcuucauuccugccuuuguuucuaugcauaguuuuaaaaccggcaucuugaaacuuuucuuauucccccaacucucuuucaaacuucggucaaaucgagacaacuuucauguuuuccuuaaaaauacuauuucucccucuuucauuugcaaaucucucuuccagggcauuguucugugaauucuuaccgucucaacuuuauauagauaaacucauuuuuauccaaaugugcagggaaauuggguuuuuucgcaggaacaauagcacaggcucucuggcgagcuguuugcaucaaccucuaggaauuggcacugagguagaaaguucuauguacaagaggggugauuaguuuagaaaagauaguuuaaaaaaaaaaauaguauuugaguuaccaguguguaagcuggauuugaucuccauauuucagugguuuaaacauuuccagaaagauaagggugaggcuacauuauuccucuuacagaaaaaaaaguccuaaguagaguuaccaaccuucucuuaaaaguuaggaucauggauuuuuccgaucuagaaugggcauuaaagaucaacuaccacauccccaaaaaagaaaacugaaccaacaaauaauagaauggcaggccaacaucauuuuggcaacugugagcauugagagcuuguguacauguuugugucccaucacuuuauaaauaauuuaaugaaauacacuauuuuuuugcuaauauucaucauagaauuuuguacauuuuuuauauuuuaaaaucauauuuauaauacaaauuucccuuccucuuucucuguacaaccuguuugaauaacugguaaaagucacuuuaaaaaaauaaaauacaaauuuucaacauugcaagugugggcaucaaggguuagaaagaaaaauaucugauuuaaaucacuguaaauuuucaucauucuacuuggcuuuuuacacacaaaauaugaacuaagcugucacacccuaaauuaauugguugaauauguccaccuaaggagcugaacaaacauuucaaagcaaacaugaguaacuucaguauucuuuaucuguuaguuugcaauacagcugauggaauuagguuauuauuaaauaauuaagcacaaaauugauauucuccaucaaguaaucagaugcugaaaugaacuccuauguugaagaaacaagagaaguaguuugauguuauguuucuucuaacaaaaauacucauuucaaaaaaucaaguuauucuggccuacacucaauagugauuagaggauuuuuucauauaaauccuagauaaaauaaucaacuuuaaagaugucaucucuccucauucaacuaauuucauaaaaauuacuuagcuugucuuggccaggcgcaguggcucacgccuguaaucccagcacuuugugaggccaugcugggcagaccaccugagucaggaguucaagaccagccugaccaacauggugaaacccugucuauacuaaaaauacaaaaauuaggcgggcaugguggcacacgccuguaaucccagcuacuugggaggcugagguaggagaaucgcuugaacccggaaggcggagguugcagugagccaagauagugccauugcacuccagccugggcaacaagagugaaauuccaucucaaaaaaaaaaauuacuaagcuugucuuaaguaauuauuuacucucuugcauguauuagaaacaagucucugggacuuaagaccguguuauacaccacugaaauacaaaugugguuuauaaaaaagcuaaacuuauagaauuggauuaguaggaccccacaauuccaguagggaagcauuuuauagguuucuggaggcaggggcggugcaucauuauggauaucauuuucaacagugauagucacaagcauacucuaaguauuuuuuuuugggaccauagcuuuauauugccuagacguaaagguacaauuaaaauucagauuguuuacuguuuauuauuuugaucauuauuguagucuuaauaguuguugaauaauuguuggaauuguucaccguguuagauauagucaauuaacagaugccaccauuucauucuugugcaacacugacugguucccauagcuacuuaggaucucaguaaguaaaaaggcauugggcuaacuaaucucugcucuuucuggagggcaauaacugagacucaguuucaccaacaaaguucgccagauguucaaagaggaaaggggcuaggcuacauaaguugggaccugguacuuaucuucucuguaauuguagcaaggacaagguuccugaaagcuggaucaccccauggacuguaaacuugaaguccugcaaaguuucaccuauuacuuugguagcccucaaaaagaguucuguguugcuuuggaauccuaaaucugaauauaaucuaaaacaguagauuucccauuacacugagguuggaaccauuuauuuuauagaugcaaaaaguagcuaggaaaaacuaguuagauaagugauagcuaucuaacuuaaggcccaguguucucuucauuuuguguuaacucccccauccccaccaccaccauaguaaaugacuaugagaguuguagguaguauucaauagaucaauccagugacacugugcuuaagcaucacacaauucagauuuuaaagauuuccaaaaaaaaaaaaagaaacuauauagaauaaauauuaaa

SEQ ID NO: 17228 - RNA, 606 nt, Homo sapiens
guauuccagcacuuuacagaaaagguggguggcucugaaaagagccuuugguuucugggacucgggaucacugacggauuugacuaguaaucauuucacuugcccuuggccuuaugguggcucuccgucuucuuaggcagcaauacggccuggauguugggcaggacaccgcccugcgcgauggucacgcgaccuagaagcuuauuuagcuccucgucguugcggauggcuagcugcagguggcgcgggaugaugcgggucuucuuauugucgcgagccgcguugccagcuagcucuaagaucucggccgucagauauuccagcaccgcugccagguacacuggagcgccggccccgacucguucggaguaguugccuuugcggaggaggcggugcacacggccaacuggaaacugaagaccggcccuggaagaacgcguuuuagcuuuugcccgagcuuugccgccuugcuuuccacguccagacauaguggcuuccuaacagcagaagaacuaacaauccacugaauaaagaaaaagaaugggcucgauggaggaauaagaagcuaguuauagucaucgguagaauugugaaaggcgcaauuug

SEQ ID NO: 17229 - RNA, 13278 nt, Homo sapiens
caucccucauuagcauaaaagcccuauaaguagcagaaauccgcucuuuacuuucgacacauuucugguguuuuaagaugccugagccagccaagucugcucccgccccgaagaagggcuccaagaaggcagugaccaaagcgcagaagaaagauggcaagaagcgcaagcgcagccgcaaggagaguuacucuguguacguguacaaggugcugaaacagguccaucccgacacuggcaucucuuccaaggccaugggcaucaugaauucuuucguuaacgacauauuugagcgcaucgcgggcgaggcuucccgccuggcgcauuacaacaagcgcucgaccaucaccuccagggagauccagacggccgugcgccugcugcuucccggagagcuggccaagcacgccgugucggagggcaccaaggccgucaccaaguacaccagcuccaaguaaacauuccaaguaagcgucuuaacaccuaaccccaaaggcucuuuuaagagccacccagauacccacuaaaagagcuguggccagacgccaaauuuuauuuggcggcggagggguauuagaauauaggaacuggagagggguggggacaaguguugcagcuuagagagggacaaaggguccugaacccgaaagaagccagccauuaaaaauggcuuuggggucaauucguugugcuuaaauuuaaaauggagacaagcggccauuuugcuaacucggcguucccggaagaaaccgcaggcucgcuuagguuucagacccagcugucugucccugucuacgucgccaggaucaacgguugccguaaugucauaauuucgccaccagcuucuagccaauaggcuguccugucauuuuaaauauuaaccaaucgagggaaagcuguuuugagacucugauuuacauagcggaccggagugggaaccugggcaguaacugccuaaggaaggacucccccucuguuuucguggcgcacaccuucguaguauacugaagggugugucuccuggguuuccaacugccccgguaauagucuuuuaaccuaauaugcgucaguuuugauaacaacacuaaggcaguacagaacuaaagauguaagcacugcgccagauguugcuucauacaucuuauucuauucaacugguuuauucaagauucaaaucaaaucaaauuuugcuugaaucccagugcucagucagccauaaaugguguguugccugauugaaacuuaaaaucuccguagggggcuuguaacaugcagacaaguuugaaaguugcuuuaggagaagccaacucuuaacugcuggguaaauugacaagccuucgaacacugaacugaaggccaguaaggacuaggcgcugggugggggagaaugaagaggagacgucauuaaacuuagcacauacacuguaucuccuagaggacucucccuuccuagacaacugcaggccgcuuuguggccugggaaauuccacauucccuuaaguauuuuacucauggucuuuuccagguaaagauuuuaagaugaaggguuagacguagucuaccuaucuuuuuauucaagucuagaacacguuuuuagcaccuagaaguuugcuuucuccauuaaaaaccgggaauauacaauaaauaaaauuaguguuaaagcagauuuuuacaaacuuaaauaccauguaauuuagguuacaguuauuuaacauaaggacugugugaucuuaaaucugcaauuucuuucacaccugggaaauaaacuaaggccugucuuuggugccagacaaggccuuauacuugaacacugcugugcaaucacaggcugccuugccuagauaacuuaucugagaaauucugaugagaaaugaaauuuccagagucccucacaaguaaauuuuuuuuucuuuuuuuuuuuuuuuuuugagacgaaguuucucucuuguuucccaggcuggagugcaauggcgcgaucuuggcucacagcaaccuccgccucccggguucaagccauucuccugccucagccuccggaguagcugggauuacaggcaugcgccacgacacccuggcuaauuuuguauuuuuaguagagacgagguuucuccaugucggucaggcuggucucgaacuccggacaucaggugaucugcccgccuuggccucccaaaguccuggauuacaggcuugagccaccgcgccgggccuaaaugguuuuuuuuuuuucuaugccucuaauggaccuggucacuuauucccauucagacugaccgcucuccuaccugccaacuaacuaaucaguguaaccaaaaucugcaaacaaaauucaguauucuuuccccgccuuuuccccuuucucuuacauagauuauguuuuugccuguguuagaugaaauaauucuauugcuuguucucucuucuguacaaguacccaguaagcaaauuauuaacuucuuggucauuuauuucugaauuuuccaccaagacaguguuuaugugagucauacaauaagaaccaacagaaaugugugucuuggaaacagguugucuaucccuggacccuuugaguuuucuguucacuuuccuuuggcuuuugcaugcuaaaaguuuaucguccgcguuuguuuguuuugguuauucuaauuggacuuggcugauugguugcauauugguggcaguaguagaauuugaauucugguuuucuggucacaucauuaagugauuagucaguggagaggacaggaaaucugguuuauuuauuaaccuuuuuuugggguguuuuuguuugaagauguugauauucucugugaggacacaggguuagaguugguguuuuucuuucugacuuuacaugggauuugauguuuugugcuuguaugccucuuuccaccuuccaaaacuugucuuuuuugaguccaaauaguugucgauaucugcaaaaccaguauuccuguguuaagaugauaugaauauaaaauggcugcccuguuauaacuuuugacuuuaagaaaguguuaggacuaacaggagacaaaaaggaaaucaaggaaaccgaaugucuggucucaauaacugcuauggcagaggcucuacagcuuauuauuaauuuuaguaauuucacauuauugccccuucacguucuuuaaguaagguuagaggacagaagaaacauaauguuguuacaaauuggacuauugagucagggaaaaaaaagagugcuuucaauaucugaauaaaacaaagauuuaauauuuucuaaaccuuaacgaguuuauuguaagggaugugaugcuggaaacuaggaaacuagaauuuucuucuaaacugagaaucagaauuauucauauucucagcaguggugccaccugagggacuucugaucuuaauuacauacuuuuauuucuuuaacugaucaacaugcuaaauagauaaccuauggcucuguuuuuacccacuuuaaauucuguucuauuagcacgguuagcuuuccuaauuggcaauaagauugagacuaucuuuuuuuuuuuuuugagacagaauuuugcucuguggcccaggcuggggugcaguggcacaaucucggcucacugcaaccucugccuccaggguucuagcaauuuuccugccucagccuccccaguagcugggauuacaggugcaccaccacgccuggcuaauuugugcauuuuuaguagagaugggguuucgccauguuggccaaacuggucucgaacucaggugauccaccucggccucccaaagugaugagauuacaggcgugagccaccgugcccagaaaagacuaucuuauuuuaugaauuuaaauaauugugaaauuauccacuuaagggaauuaauaaauuauaauguaaucuuaaauuuuaguuggcuuacauaaagacuuaaaauacaucaauuuaaauaaaaacucauuugucuaaaaaaaaaucaaaaauuuuccuugugcuuuaaaugugcuaccucuuuaaguucuaauuaagagaaaaaaaguuuaacugugaguuucauuaguggucuuaguuaacagcuuaaaguauuuuguaaaaaaaauacuucacaauuuuuaaauaacuuaaaaauauuaauaccucuuuuauuagguuuuuuuaauaaggaaaauauauaauacaucuaaucaagauuuuuuuuggacaaauuggcuuaauaauuucauuuuaaaaauggcuucuuuauucuuauacuguaaaaauaauauuagcagaauauuauaguauacacaaguuuaggguucauauucuaaaaaacaaaaacaaaagcuaauuuaacuugcauuuacuaaauuucuuccacuaguuguacugguuacaugaguuaacaucacuuuauuuauuauucuaaaauuguaaauuauucauugaaccaaauuaaaugauaauagauaaugucauuuuuaaaaauggaauuaaauuuuauguuacuaauuauaaggauucaaugugugagcuuaaguacugaguucacaguguaugauaacuuuaagaauuuaggugaauauuauuaaauugaguaaauuaauucucaaucuuuggauaccuggacaauuucuaaauuggaggguacaaaauacaaaucacaagaaacaguguaguuuuaugcaaauaacauuuuuacacaguuuagaauaaccauugauaaacagauaagagaacauaugauugccuuagaauagauacuguugcuuucgccacuuuagauuuguaaaucacguacuguauacgugugggcguagaggaccaugcagguuuuggaugacugccucuguuuucgucaugccuaugcgggaacacaauugccugcuuuguuuaagggcuaugguuaauccaaacagcucugacucuaucaaguacuauagcuacagagaaacacaaguaagcauucgagauaaugacuaccuugagccuuuacuuauuuaaaaaguuguuacuguuuguuaaugugguacauucaauuuacuauggauugucacucuaaaauaagacuucaaucuuuuucuuauuuuuauauagccaugauuuauauucauaucuuaauguaauaaccaaucuucucugacaacauuauaacaaugcuggaaccuccauuuucaguacuucaaacaacaaauacugcuuuuauacuucagagcagauggauaugugcuucccaguguaaacacauuuggaaucucacugagaaauacacuaucacuaaaaauacaguucugagauucauuaaaagaccuccagaauucuggaaguaggaaguuuccucuucaaagucuacagaggaagaugaggucugaaauagacagcuucuuccuucuuuuaccugugguauuauucuguuuuguccuuuucuccauuaucugucuuuccagugaugaaauuuugaucuggcccucccaaguauuaaaaaacaagcaaauaaacaaaucucaguuauauuuuacuaagauauuggcaugcuaacuuuuugcagguuuguaacaaggaccuuuauaacuugacuaaaaguuccuaaauaagaauauuuacuagaaaauuuauuucugccuguggcccacauuugagucaaaauaaucaauuaggaaaaaugaacuuguuuaacuaaaguugaccaaacugaucuuugaccaaacugaucuuugagaccuauucaucuaagacaagccaauuaaauucuuggagacaauuuguacuuuaaggaauucuuauaauauuuguaauuacccucauaacuuuuuuuuuugcccuacuucugugcuucucuaauaugcagauuauuaaauguuguuacaaagccauugucaaaaaaacaaaaaacaaaaaacuaaacaaacucacaugguuagacuugcuccuuuaugagauauuuuuaccaaaaauggaggaguugaaaaacucuggugccagaaaucgugaagacauggccuaccuaacauggaaauguugguugucaguggaaaauacuacacagagauagccauagugcugcacagccaaucuuaaguguuucuagagaaucacuaauuguuucuagagaaucacuaauuguuuucuuuuaacauucuugguuuauacaagaagagaguauccauacuaaacucuuuucuacugaaaauaaugugcaaacauaacauccuauuccuagacaguuuguaguuuuuuucucccauuucuauuuuauaaaucaucuuuuuaaaauacuuuguugagugaaaucaguccauugcuugauauaccuugagcacaaguaaauaguaugccaaaaauuaaaugucuuucagucacaguuugacaaacucaacuacccugagccuauagagugguaauaauugcccuacucauaaagauggggugaagauuaaaugaaauagcaccuauagaacacuaguuccagacgugguaucaugcuaguaaaauggcugcacagcacugcucaaugaugacaaaaagugaagcuucuggagacagacuccaaguuugacucccagaucaccacauauaagaugugggacucugaggcaggucauuuaaucucucugugcauuaguauccuucucuauaccuuuacagugaugguaauagcaccuaccuucuagaaguaugugaagauuaaagauccuuaaugcauauaaaccacuguguuuacugcuguuugacaaauuuuauuuauaaccaucuuuacgcuccuaaaaggacuugaagcagcuuaugacugaagacuuugguaggaguuggccuucuauaaauuauaagaauuucauaaauuauuugauaugaaaaugccaguugaucauaguauguuuaccgggguccaacagguugagaaaaaauacacuuuuuuucccugaacauaugaaauuagcucucuaggcauauuccuaaggacuuaaagaaugauaacuaucauuucucuuaaaucuuccagauuuggaaggauauauauauucagcacauugacagacaaucccaguaguccuaaauuaaaagacauuaaaaauuagugaaacuuuuccuaccuuuagccuguguaauccuggaugaccaagcauaaaauuaaauugaguagaguauaccacuguaacauuuccugaaagguauucuaggcucugaguaauuucuuuggggucugaagaucaguuugacauauccucaaguaucaugaguucauuauaauuaagaaaaagagaguaaaucuggagaaugagccacuuucuuacuacuccuugaccucaguucuuuuuuucagagacagggucucacuuuguugcccaggcugccaggcuggaguguaguggcgcaaucgcaucucauuguaaccuccaccuucugggcugaagccauccuccugccucagcauccugaguaucuggaaccacagcaggugcacaccaccaugccaagcuaauuuuuuaaaaaguuuuuuguagagauggggucuuacuauguugcccaggcuggucucaaacuccugggcuuaagugauccuccugccucagccucccaaauuguugggauuacuagugugagucacuguaccccgccccacuucaguucugaggaggaaaaaauauguaauaauaaugggacuuugguuugcugauuuaaagauucauguaaccuuaucauccaaugcgcaauuuguagaauaauuaauagagacaucuggucucauguuucuacaguugcucaugccuugauaguagaucuccuugcugcuggcucagaaggguaaaagagcagaaaugauggggcuucucucauucuaugaggaaauagaccuauguagaggaggcuaccugugguaaaaccuuauccucaucacuuaaaauucuaggcuuauucucugaccauaucaaguuuucaaaugguaaaagaauuggauucaagagaaauaugaauaaacuuuuguuuucacuuuucucccuccucuccccccauucucccuuccuuuauuuucuuguccuuaguuuucuuuucacuuuuuugucuacuauuauuugcccaaacucaacuguaggcuagaacaaaaaaaaauugaaaauuaaaaugugccccuuuuguuguuagacuugcuuaaacaauugggguaaugaaccuuggacacuagauuuuaaaacacacacauuugagcuucagugcacugaaauaaauauauuuuuaacaauuaaaaaauaaaauugcauguuuaaaaaaucugcagagaacaauacacguugugagaucuugaauggaaggaaaacugcuagccucaagaguggaucaaagaugcucagcaggcaacagaguaagagcauguuggaggguuuagagagugugcucaggguucuaggcucuaaaaaucagacaguccccacggccuggccuucgucgcuguaucuucuuuaugaaaaacacuaagucuuuuuccucacuggauaaauuuuuauccuucaaguuuagaucaaauggaacuuuaggacacugacuagguuacauucaucuuuuaagagcguacagacauucaagggcuagaggauguggguuuacugcacaggcucauuauccaacagcugugcuaccugggaaacuuaaccucucugugccuuaauuuccucaucuauaacgcagggagaaugacaguagguaucucauaagguuguuggaacaacuaaaugcauugguaucuauuguguaaagugcuuaaaacacugccuggcacagagcaaacauccagugaacuuuagccaucaucauuaucauuguucucagagucaaauacaauaucucauaucugauaaauuacagaagugaaucaaucacucucucucuuuucuccagggggagacaacagcuuuuagacauaucuuuuccaacagucgucacugcuggacacuguuucaucuugcaaauaaaccaaugaaaaugagugauccuagaagaagauaaauggagguauuuugaacaaucaaagaaggacaaaugaacaccuggcugagaaaaauuagcucuuuuuucuaugcauaaaacuauuaaaauauucuucauagaaauuuaugacacaggaaacauaaagacaaaauuaaaauaacuccuaguaucuccuauucuuuuuauauguauauuauauauacucauauucauauauacauauaucucacaucauguaucauauauaaaauaaauuuaggugucaugauauauauuuagauaaauauacuuagaaacuuuuuuauggauguauaauuuauggauauauugauaauuauguauuuguuauugacuacuucaauugauucccauuuuuaugcauuauauuauagauuauauagcucacacaucuuuguacauaaaucuuuguucaaauauuauuuccuaaggauagacuucaugaaguggaaauacuaaaucaaaagugaaaaacauuuucuaagguucuuaacauauacauugccaaauugcuauucaggaucauaccaauuuauaaucccaaaauaauauggaaauuccuguuuuauagcacucauauuuacaauaaauuuuaaaaaucacuguuaaccuaauaguccuucaaaagaaaaaaaaauugaaauuacauuauuuuaaugacucuauuagugagggucauucuucccauguuucuuguuagccaugacccuauaagaaauaaacugcacugcaaaaugauaaacaugacaucaaucauuacaugggaaggcacuauauaaagaauaauaccuuagguuaaggccacauaaauauuuaucaggugccuuuucugcggaggacucugaagggauacuaaacugcauuuagcugcaugcaacugaaacuacuuuuaccuacauugucucuuauaaacauuauaacuacucuuugagaaaguguuuacuauggacugaauugucuccccauccccccaaauucauauauugaagccauaaaccccaauaugacucuauuccuagacaggacuuauaagagguaauuaagguuaaaugaggucauuaggauggguuccuaacuggauaggauugguggccuuauaagaagaggaagauucugcacuuggucuuccaaauuaaauaauuuauuuaaaagaaaaaaaaaaaagaggaagagagggagcucugcacauauacugaggaaaggcuaugugagcucucacagugagaagguagcacucuacaagccagcaagagagcccucaacagaauccagccaugcuauacccugcucugagacuuccagccuccagaacugugauaaaauuuuguuguuuaaaccacacaaucuaugguauuuuuuuauggcagcccaagccaacaaagacagcaucauugcugucacuuacagacaagaaaacuaagacuaggagagagaaaaguuaaacuuguccaaggucacaaaagccagaaacaagugaggugagaaguugaccuuguucuccucaauccaaggccaggacuccuccacuccacauguagauagccaccucacagucaacagccaaauguccacaccccagagucagcauuagaccaagaugucuuaccaggagacaaaugccucaucuugaauaaauaugaucuaacaacuuacccauguaaaacauugaaucucaugagaaacaaaaaugcaaaguauguagaaaacuauguuuaccacuuaacugacagugauaaaaagcuuaaugauauccuuauagucuuggagggguuuguauauguggugaaacaggugcucacgcacugcugauagacuguaaauugguccuagagagaaaaauaaauaaacuggaaggagauaugcuguauguuuacuuuuuuuauggaaacauaugauauaccuggaaauucgauugaccaugcaucuauuucuucaauggguaugcacaguugagcuguucccaugcaccaggcacuguaaugggacaacugcacaugacagucaaaaaucucagucucaugaagucgacaugcucauggagaggugcuacccacuaaacuaauauuuguauaucaauuauggauacauugggccacauuuacagaaauucacuuacaguggguuaccagaagggauuuuuuuucuugauuggcaagaaggcuaggcuguuuuguugggggcuggcaggagcugucuaggcugcccaaguaugcaggucucuucuaucauccuguguuaaccaucuuccauguaucuuucaaccucauggucaucugcagcaugucuaggggucauaucuauguuccaugcaggaaaaaaggguaaagggaaagggaaguaggcauguaccauuuuaaugcacaccuugguuuucagaaaauuuaagaagaaagacuuucugcuuuucucugacuauucuguauucuggauuacaacgcaacagaaacgucaccuuaaauucuaauguuuuucucuccuugcuuucaaaaacugacucauuaaccuccacguggcuuggaaaaauuauuucagucauccaguaaugagcuguucauagaaauguuuuggacaucaagucuguguuguuagcauuauacauguuaagcauugaauaaaaaacaacaugauguggguaaauuucuuuacuuacauauaaguacuuauauacuuauagcugaaaagagagguugaaaugucagguggaacagaaauaagauuaccuagauguuucuccuaugggugauuuucagcuaugcugaucuuucuucugggucagguacucccagaacuuccuaauuaaaugguggcccugaucuuaguuccucucuccucuuagacauuuuccaggacuacagaagaugugcaguuuauaaaugaguagcagaaaccuacugaacaaauuauucaggcucaucugaacagagaggacaccuucucugcuauacucucucagugauuucccugccuuggggucaauuauugucuuggacauugauuuaagcacauaauaauuguugucauugcuuauguuuggauuucaucucccaaaauagaugguaaauucuuuaguuuagagaccaaguaauacuuaaaaaaaaauuuuguguguguguguguguuuuuucugugucucucagcccuguaauagcaucguacuuacacuuguuagauuuuuagagacaacuuuuacaaaacauggaauuaucuacauacccuuucuacaaaacagacaaauuaaauacucaguaguugaaccaaaaaaagcaguucaaauaaaauacuugaaaaugaagaaaucauuugaacagaguuaaaguuaaucguaaaauaaugucuguaaaaauuauugccaaucaaauauaaaguucaaaaauagugcuugaaaaaggaagaaucauaugaaaagggacuacucauuuuaaaaauguuagauaucaggaaaagccaagaagugaguaugguaagagugcugucaagugaaacccugcuaaucucacugaacauguaaaaaucuguagaugccuuuauuuuauucacucacacacauauguagaaagagaaauauaugguaaacauuaaaaaaaccaaauuagaauguaaaauuaauacuuuaaaaaaugggcuguauacuuuucuuaucaccggagauaagaauuuauuauuuuuaaaauaaaguuauuuucucugugacuguuuccaugacuuugcuacuuagaaguuagagaugccaaaguuuaucuaagaaaauguuuauggaaauauuauuucaauaaugaauguuuagaagacugaauuuccugacugggcgcaguggcucaugccuguaaucccagcacuuugagaggcugaagaaggaggaucgcuugaguccgggaguucaagagcauccugggcaacacagcgagacccugcagcaaaguaaaaagaaaaaagaauugaaaaaggaagacugaauuuccuuugggcaagucaugugacauuccugugccucaguuucuucaucuauaaaguuaauuccuacauuuuuggggaagggagagaaaaacuuaggauagugacuggcacagaagaagcacuauauacuauauauauguggauaucauuuguuuuuaugguaccauuuuagcuaucuaaugcaaaauaugaaucuuuuuuuucugggucuuaaauuauggaauguaagaauuuucuaaauucucuaauucuguguuaguuuuaaagcaauggaguaacguaucugucaacuuguaaauauaaggaucaaccugauccacaauuugaccccuagccacuaauauuuaauaguacaacacucagaaauuau

SEQ ID NO: 17230 - RNA, 774 nt, Homo sapiens
gcuuuucgcugguuauuacaucuugcguuucucuguuguuaugucugaaaccgugccugcagcuucugccagugcugguguagccgcuauggagaaacuuccaaccaagaagcgagggaggaagccggcuggcuugauaagugcaagucgcaaagugccgaaccucucuguguccaaguugaucaccgaggcccuuucagugucacaggaacgaguagguaugucuuugguugcgcucaagaaggcauuggccgcugcuggcuacgacguagagaagaauaacagccgcaucaaacugucccucaagagcuuagugaacaagggaauccuggugcaaaccagggguacuggugcuuccgguuccuuuaagcuuaguaagaaggugauuccuaaaucuaccagaagcaaggcuaaaaagucaguuucugccaagaccaagaagcugguuuuauccagggacuccaagucaccaaagacugcuaaaaccaauaagagagccaagaagccgagagcgacaacuccuaaaacuguuaggagcgggagaaaggcuaaaggagccaaggguaagcaacagcagaagagcccagugaaggcaagggcuucgaagucaaaauugacccaacaucaugaaguuaauguuagaaaggccacaucuaagaaguaaagagcuuuccgggaggccaauuuggaaagaacccaaaggcucuuuuaagagccacccacauuauuuuaagauggcguaacacuggaaacaaguuucugugacaguuaucu

SEQ ID NO: 17231 - RNA, 1121 nt, Homo sapiens
cauccaauuaaauacagaaugaaagucauguacuagaagaacggaccaacccgggagcagggcgggacuuuugaaaauuuuuuaguccaauccggacaucccuuuagacuaagaaacuggcucuuguuuugcggucuuuucugccguucacaggccuggggcgggacugccaucccaaaaccauccgccagcgagaaaagccuccggucagggaccuagaagccgcaauaaagguuuaaaugcuguaaccucaccacggccacucuccaaccccgucacccaauucgucugauaccucaguaacucccauacgacuaaccuuaaguaacagggcagaacaagaaaaggcagauaguaaagaaauuauccagcucuuuuauugagaucagugguggcucugaaaagagccuuuuggguuuuagaaguaggcguucgccuauuucuucuugggcgccgccuucuuaggcuugacaaccuugggcuuagcggccuugggcuucacagccuuagcagcacuuuuggcagcuuucuugggcuucgcaaccuuggccuucuuugggcucuuagccacuuucuugguuacaguggccgcggccggcuucuucgcuuucuucgguguuuucuuagcgcucuucuucggaguugcgccgccagccgccuucuugggcuucuuggcugccccaacuggcuucuuagguuugguuccgcccgccuuuuuaaccuugggcuuggcuuccccggaggcugccuucuuguugaguuuaaaggagccagaagcaccggugccuuucguuugcaccagagugcccuugcucaccaggcucuugagaccaaguuugauacggcuguuguuuuucuccacaucauagccggcggcagccaacgcuuuuuucagagcagccagagaaacuccgcuacgcucuuuagaggcggccacagccuuggugaugagcucugacaccgggggaccagacgccuuacgaggcguacccccagccuuuuuggccgccuucuucuuuacaggggccuucuccgcaggaggcgcggcagcgggagcggcaggagcagucucggacauguugagaaucaaaaacucggguacaaguggcaaagcgccgaug

SEQ ID NO: 17232 - RNA, 758 nt, Homo sapiens
cauccugcuucgucagguuuauaccacuuuauuuggugugcuguguuagucaccaugucugaaacagugccucccgcccccgccgcuucugcugcuccugagaaaccuuuagcuggcaagaaggcaaagaaaccugcuaaggcugcagcagccuccaagaaaaaacccgcuggcccuuccgugucagagcugaucgugcaggcugcuuccuccucuaaggagcgugguggugugucguuggcagcucuuaaaaaggcgcuggcggccgcaggcuacgacguggagaagaacaacagccgcauuaagcugggcauuaagagccugguaagcaagggaacguuggugcagacaaaggguaccggagccucggguuccuucaagcucaacaagaaggcguccuccguggaaaccaagcccggcgccucaaagguggcuacaaaaacuaaggcaacgggugcaucuaaaaagcucaaaaaggccacgggggcuagcaaaaagagcgucaagacuccgaaaaaggcuaaaaagccugcggcaacaaggaaauccuccaagaauccaaaaaaacccaaaacuguaaagcccaagaaaguagcuaaaagcccugcuaaagcuaaggcuguaaaacccaaggcggccaaggcuagggugacgaagccaaagacugccaaacccaagaaagcggcacccaagaaaaaguaaauucaguuagaaguuucuucuaguaacccaacggcucuuuuaagagccaccuacgc

SEQ ID NO: 17233 - RNA, 758 nt, Homo sapiens
gcguagguggcucuuaaaagagccguuggguuacuagaagaaacuucuaacugaauuuacuuuuucuugggugccgcuuucuuggguuuggcagucuuuggcuucgucacccuagccuuggccgccuuggguuuuacagccuuagcuuuagcagggcuuuuagcuacuuucuugggcuuuacaguuuuggguuuuuuuggauucuuggaggauuuccuuguugccgcaggcuuuuuagccuuuuucggagucuugacgcucuuuuugcuagcccccguggccuuuuugagcuuuuuagaugcacccguugccuuaguuuuuguagccaccuuugaggcgccgggcuugguuuccacggaggacgccuucuuguugagcuugaaggaacccgaggcuccgguacccuuugucugcaccaacguucccuugcuuaccaggcucuuaaugcccagcuuaaugcggcuguuguucuucuccacgucguagccugcggccgccagcgccuuuuuaagagcugccaacgacacaccaccacgcuccuuagaggaggaagcagccugcacgaucagcucugacacggaagggccagcggguuuuuucuuggaggcugcugcagccuuagcagguuucuuugccuucuugccagcuaaagguuucucaggagcagcagaagcggcgggggcgggaggcacuguuucagacauggugacuaacacagcacaccaaauaaagugguauaaaccugacgaagcaggaug

SEQ ID NO: 17234 - RNA, 397 nt, Homo sapiens
augucuggacgagggaagcagggaggaaaagcacgcgccaagucuaagucucgcucuucuagagcggguuugcaguuucccguaggccggauccaucgucugcuucguaagggaaacuaugcagagcggauaggggcaggcgcaccaguguauuuggcggcaguguuagaguaucucacagcagaaauccuugagcuggcaggcaaugcgucucgcgauaacaaaaaaacucgcauuauuccccgccaccugcagcuagcgauccgcaaugaugaggaacucaauaagcuuuugggcggcgugaccauugcccagggcggaguccugccuaacauucaggcagugcugcugcccaagaagacugagagucaccaccauaaagcccaaagcaaguaac

SEQ ID NO: 17235 - RNA, 397 nt, Homo sapiens
guuacuugcuuugggcuuuaugguggugacucucagucuucuugggcagcagcacugccugaauguuaggcaggacuccgcccugggcaauggucacgccgcccaaaagcuuauugaguuccucaucauugcggaucgcuagcugcagguggcggggaauaaugcgaguuuuuuuguuaucgcgagacgcauugccugccagcucaaggauuucugcugugagauacucuaacacugccgccaaauacacuggugcgccugccccuauccgcucugcauaguuucccuuacgaagcagacgauggauccggccuacgggaaacugcaaacccgcucuagaagagcgagacuuagacuuggcgcgugcuuuuccucccugcuucccucguccagacau

SEQ ID NO: 17236 - RNA, 11144 nt, Homo sapiens
acacaauguucaacaggaguuugaaguuuauuuaguaauaaacauaagucauggcugacaacugagaaaauccuauucacauaaaccaucauagauuaaaaauacauaguauuuguacuuuaaugcaauagggucccaggauucaaacaaggaaauuugauuccagaguuggcauuauguaguuauguacucugcuacaaagaacuaguggagguaaacuucggcaguaaaauucucaacagucaaauauuaaugcauuucauauacauggcuuugcauccguagaggaagauacaguuccuucagcacacgugccaauuucugagucuuccacuagagaauccucaacaguuucuucuucagaaucaaauuccugauuauccagugauucaaaauuauccagagguucaccauucagucucuuuuaaagaauaaaccaauaauuuauuguaaaaauguuaaaaccuaagcugaucagcauacugauauagcugacccguauagcauacugauauagcuaugagauuuuuuucaucuugccccucaauaaauucauuuauaaacaguauuauaucaaagucucuaccaugcuagaucauagucagcaaagucaaaguguuuaauaauuugucuuuuuuuuuuaaaaagcacugaaauuauuucagaguauaaacagguacuuccccaaucagcugcaaggacaaguagguguucuacauuuccaaucagcuguggacuaauucuuuuaaggcaguuaagacagcuaccacaguaucuccaaaugaaaacuucaaauauuaauucuaucauggaucucaaauguaaaaggucacaauucaguuacaugaaguuuugauuugaaaaacuuucuuccuaucagcaagaaaaacuuuuugcaaacaugaauaaauaaaucuuaaaaccuuuuuaaggucaagucugauaaagcaacaccaggcuaauucuuacaaacauauuagcuacuuacaaaauguuuuaaagucagauaaaaccacaaaacucauuuauuguacaaauuaucaauuuuauaaaugacaguaaugucaagcugguauuaaaauuaaaacuaucuaaaaugugucaacuaugaaauaauuugcuauacauauuuuccagggauaauuccuuuuaauaacucuaccaaaaaauauggucuuuugcuucauaacaauaauuaaguuacugaacuuucacucugugcaaguacuccuugcaauuguccaucuauuguaacucauuuaauucucauaacaagucuauaagguaggcaucauuacucucauuuuguggaugaggaagaugaagcccugaccggauaaacccacucuacccagcaaacuuaaugguguuaggaaggaaguuaagucuuaaauccaggaaaucugauuccagagcccuaacacuucaaagugaucacacuacacuaccucaacuuuauagaaaaauacauaaauuugaaccagauaacuauuaaauuaccuaccucuauuagcucugccauauacuguacauguucugcuacuucugccaguucuuuauucuccuuuuucaggcgggcaauuucauuguccuuuuguucaauuucuuuaugaagcuguauuacauaaauaaaguucaguauuccauagauuugcuaugcuauaaaucaaauuacauaccuccaaguauauaacauggaggacaugcagcauagaauugacucucaacacaacgggauucauuuuguauaauugucaagagcugccuuuuuacuuaaacuuuucuuaagccaauacuaaagcuagcccauauugcucuaauaaaauaugcuaagcagcaaaacaauccuggaauuuuuaaaaaugguacaaauuauacucaauacauacuuucucauuuuccuuaagugcuucauacagcgccuuucuccguuuuucugccacuuccuuccaauacugagaggauggauuuucuaaaauaauauuuuaaauauaacuuuaaaaaucauuacugucaaaacccaguaauuuguuucaaaaaaauuuccaaucuuaguacccccauauuguuuaguaauacucauuuuuaaaagauuaaaguuaaaaaauaaaaucaauauuauucuauuuuccccaacauuuccaagauuucaauccuucagaauuacaacaaaaguacaauacguauauaucuuccaccuagauuauuaaagauuuuugcaauacauuuguuuugugaggucgugucuuuuuauguaacacugacauuuuuacaaaguccagaucaauuauuuuguacacuguccuuaauuuuuuauuucugucuccaugauuagauucaaacuaaacauuuuuggcaggaauacuauauaaguauaguauaagaauacuauauaaguauguauccucaguauaucaucaagaagcacacgccaauuugucaugauacuggagauguuaaauuugaucauuugauuaagaugcuaucuaucagauuucugccuuguaaagauaacuuuuucccuuaguaauuaacuaaugaucuguagagcaaaauauuugagacugugucaauacccuguccuccaacaacuuuuuaccuaaguuuaauuccauugaugauugauguuuccggcuuauaucuauuacuucuacgguggauggaaaaccaauuuuuuuucacuuauguaauuccuucuacaaguaguaguuagcauuauucuguaaauaaaaacuuuuccuaccccaauuuaaaagaaaauuuaucaguauagacucauauauccuuuuuuauucaauguauuauaauccauucuugacguuauucauuuugaugcucaaauuuucccaacuguagucugugagaauccuuccaagaugacauguguucuuucaacauguccacccguuuuugaguacuuccuuauuuucugucaaaagauaauccaugaucacccaaaguuucccugccccugaccuggaaucagcaauuucuccauggaacuuuagugaagaauaguguuuauaaaccaagaacuggauacacggugugcuccuuucuacagagguguaguuuguuucuaccuguuuaggggcagugcuaggaaauguaauacuucaacauguuauucauuugcucaguccuaaaauauacacaacuuuuuuuuuuuuuucaaaauuacacuaauaccacugucaacaaauauaauaaaguucaaacaacaaauguaauaaaguuugggauuucuucgcaguuauuuuaauuuuuaccauguaucgcagaggguuacaaggauaauguguuccaccugugguuauauuaccaacaugauauauaguuauuugucuugauauuuaacuuuagcaguuuauuuuaacuaauccuugauuuaauuuuuaaccuaaucagauaugagugucacaaauccugcucuucaaucuacaauauuuuuaaagagcugcuuuauuucuauccagucaaccuuuccuaauuuugccuaauaaaaauccuaccaucuauuucucuucuuccugucuucaaggcaauucaaaaugaguccaaauguuacugugaccuucagcaagucaauuaacuucucuaggccucaauuuuaucaucaguacuuaacauucaaugacccauaauucauacagaaauaauaaucuuccauaaugcuuacaaaacaucaguugcuucuucuucugauguauacuaccauucuauuaaaaacuaguacuuauuauaggcauaauucuucucauucaucuuuacucuucauccauauuuuuauugguuuccuuaugccauacucuccuggaauauucaaauuccuuucauaccucgaacucauuaucuaaacauuuuucuucuaaaaagccuauuuccaagucuuguaaaccccuacaaggcaauccaauuaucagagcugucauauuaauaacuauccuuucccccuacccuuuuuuuuuccuucagagaccgggucuugcccuguaucccaggcuggagugcaguggugcuaucauacauagcuuauugcggccacaaacuccuaggcucaagugauccuccugacucagccuccugaguagcugggaauacaggcacaagccaccaugcucagcuaauuuuuucauacagagagagccucacuguguuguccaggcuagucucaaacuucuagacucaagccauccuccugcuucaaccuccuaagcuacugggauuacaggugugagccacugcacugggccuccuuuuccuaacauuucauccacacauggaucuugucaaacaaauggucacauacaaaaacauuuauagugcuguuauacuauccccagauuacaguaauuggcagaauucauaauaguauuaacaaauuuuuccuuauaucauaauuuaaaauuaagacaaaaguuaucuauuuuuucauaccuuuaaucauaagaucaaaugacuccugggugacuccuccaagauuuuuauuuucacuagauucugggacaauaaccccagggcuggaaguuguagauguuaaguggucauuccgauguuuccuuuuggacaagccugcggacagcuauaaugaaaacacuuaucaacuguauuuacuuugauuuaauuaacaagaaauuaggugguuuuucauuuauguauuaaaaaaagaguacgcauaucuaacuuuuucacaucucuggaucuuuaaaaaaguuauacaauuaaaaauucuaccaaaacauauaguaacauuuuaggaauuuuauuugcaacaauuauuuuggauuagacuggggucaagagcuuagcugaaauuauuuauuuauuuuuuaaaaaauuuuuuauuuuuauuuuuauuuuagagucucgcucugucacccaagcuggagugcaguggugugaccucggcucacugcaaccuccaccucccagguuuaagugauucuccugccucaagccucccaagcagcugagauuauaggugugugccaccacgcccggcuaauuuuuuuguacuuuuaguagagaugggguuucaccacguuggccaggcuugucucaagcuccugaccucaggcgauccacccaccucggccucccuaagugcugggauaacaggcgugagccacugcacccgacgaacuucuuaaauugaacaauuaaaaccaaaaucacuucuuugggaaauauauaauugugauucccaaauuauuuccaaauuucaacaauuuacguguuucugaccaagaaaauaguagaaauguuuucgauguagacacuguaucaccaguaccccauuuuagccauauagugcauaccucauuuucucuuccaacaagagauccagaugcagaaggcugaaucaucuucagaguucuucuugggacagaacuauucuaaaaagucagcauaauucauuaucuuguuacugaguugcaauaugguuauuuaguuacugaguuucuguauggaguguuacucuuaguccuucuauaauuuagggguggaaaaggaacacuaacaacacaaacauuuggucugcuauauaauugcguaaggucgccuaugaacaagacacugguuuaaucaacugacaaacuuguuauuuccaaaaauuauaauaaaguuugaagaauucuuaagaaugaaucauauuacccaaacuagacacaaacacacguaacuucucucauuucaaugcaugcucuugcuauggucauuuuguuaaucauaucuaguuaaaacaaacguaacaaaauuccucagcuccaaugaacaguuucaaaccacauaugacaaaauucuaauacaagaaggcuaucuguauucucucugaaaaaaucuuccacacagaaacuaaaaacuuacagguacucuuuuauaaaaccaaacaucguaacauuuaugguaugaacucaccaaacagguaaacuggaagaaaugguuaaucauuuacacugcaaaauauuucuuucccuaaucaaaaagauucauuucaggccuccuuaaaucaugaauaucccucaaauacuuacauguacucaccaaaagaauguaacuuuccagaacauacuuuacacaaaacaaaguacauguguaauagacauccccccucaaccauuaccugauaguagaagcaguucugcuucaagcccauucauuagaagguggcuaaaaugucagugccugaggcauacuaaaauacucuaaaaugcccaagcuauuguuuuggugaaaauauugccuuccuuguaauauguaaacaacuuccuguauauuucaugaucugaaaguucucuccuauuuuugcaaaauaucauuaguuauacugccaccaugggauagcaaacaauggugaauacucaaacaagguuagcaagaacaugauaccauaccagcgugagaaaguuacugauuccacacuguacuucacaugauaagaguucaccuuucccacgguaaaguuucuacugcugauuauuaucucaccauuuaacugaaggacaaaugccagcuacugugaggacaaauauuacaucaacauuucagauauaauuuagauuauagauuagucaacagucuccagacaaauaaaagaaaauguaacguuggaaccuuacuaacaagagguguuauuuaaaugcuuucuguuaauaauggucaaagaagccagcuaaguaacugucaccaaaaaaaaagaccauuuccaagauuuaacuuuuauuuauauaagcuauauagacuuuugccuaaaacaauguaacauuacuauuauuauuuucuguauauagaguaugcauuggaauaauagacucuuaaagccagaaaguuucuuguauauuaaugggucuuaaccuuuuuggaaaacuauuuaauacucugugaauccucuccccaaaaaaauucacauaaaagcacauucacacagaauuuugcaugcaacucacaaggaucuaguucuaguccaguucucccaauuuacagaugaguaaacuaaggcugaaaugcuaacuaacccacccaaggucucaguuuuggagguagaaccaaaaccaaacagaaccuaguauccuuuauauucaagauaguuucacuguagcuaguaaacacaagacuuucuuuaaaauguaaucugcuggaaauauauaaauuauuuggcugugauuugcuucaaauuaauccacugaaggaaaaguggaguaaauaaggacauagaugaaaccagauuggccauauagcgguaauugcugaagcuggggaaguaaauuauuaaaauacuuuuaaauauuucaaaaauuucauaacaaaaauuuuaaauaaucacacacaaagcacagugggaagaugccaucauccuaaauggaagcuaauggaaucaaauucacaaauugucaaugcgaauauaaugucaauugacauucuuauucaagaaaaauauuguaagaauccuaagaaaagcaaggcaaacaaaaaacccaucaaaagguacuugcuuauacuuaucaauggcuuuuagguacucaauuuaauuuacuuaauauaaaaaaaauuuuuuuagguacagggucuuacucugucacccaggcuggagugcagugaagcaaucauaauucaccaaagcccaaacuccuaggcucaagcaauuccucccacaccucagccucccaguagcugggauuaccagugggugccaccacacccagcuaauuaugguuuuuuagaaacagggucucccuuuguugcccaggcuguucucaaaguccagagcucaaucaauccuccuacuucagccucccaaguagcugggaucacaggcaugagccaccaugggcaccuggcucuuuauuuauuuaaaaccgcaaauugauaguuuaccugaagaugugauccaauucccaagguauucauauaauuuaaguuguguggaaggaccuagcuaaauuguaaauuaacuuagaaccauaaauaugaaucuagucagaaguauaaacucaaaacuaaacaaacucuguccugcugucauaagaguaaauacuuggaauaagauuuccagugaaaguaucauauagggauugaaaaaguaucacaaaucaaauagguuagaugguaaugaauaugguauacucuagaaaaauguguaauauaaugcaaaacaugucuguggucaaagacucuuaauucugaagauauacacaauggauuuuaauaacauuucaugaaauauaagaguagaaacaaagcaguaauaaucucauacauagaaaauccuaaagauacuucuggaaucuucacagagaaaauacaaaaagaaaagaaaauccugaagaaucuacuaaaaaacaauuagaacuauuaaguucagcaagguuucaggacacaaaaucaagacacaaaagucaauuauuuuccuauacaguagcaaugaccaaaugagaaugaaauuaaggaaacaauuccauucacaguaaccucaaaaagaauacuuaggaaaaaauuuaacauaaauaguguaaaauucaugcucugaaaacuacaaaauacuguugaaagaccaaaauaagagagacaacccauauucuugggucagacuuaauauucaaccguaauuaguuuuuuaaaaauguucucuauuguuacucauccucugacuaacucaaggcuuacagaaauuauagccaggcuaaauuuggauaaauuaugucaaaauacuuuuagccccaugcuuucuacaaaaaaaaauuaaaguuauucaaucacauaccuuuauauucucuuugauuucuucuuguuucugcuucauacugggauucauuauguagauggugaagcacagaagacuaguaauuaaaaaacaauaugguuugcacccccgaagguggagucuagguuuaaaauacuuacaaucauaaaaauuauacuauuguacaguagaacuauuauuuuuucucucuuaauccaaacucagcccugucaaugacuaaggugacuaaaguuaaugacucuugauaucuauauuuuacauauauacacacauaauaauuauagcugaaaaaaugaaauuaauguauuuuaaaccaauuucuaaaacugguuuaaaauuucuaaacauauuguccuggauuaaauagucaccagaaaaagcaaaauaaacagauacuaggguaugcccagguccauccuaaagagcagcaucuuaacuuuccugauucaaagacagauuuaagguauaauaaacugggcucugacaauaacuuaacacagacuuaauaucuggucaaaugagaucaugcauuuacauuuguaggaaauguuuaaccaguaacaugaacugaaggacuaacaagcaagaaagagggaaaagguagaaagggaucuauguaaugcgguugacuagaccacugggccaaacucagcaucugaacugcugcuccacugcccacugcccacugcccacuacccauuggccccugccgugucugcgccugugccucgucgauagaugucccuaauuuuuguggccaugccuuuacucagugcaguggcuucuaacauuaauacauuuuaccuuguguccuggcgcgugcacacacaugugcaaacaaaaaagcuuaggaaaggccgggcgugguggcucacaucuguaaucccagcacuuugggaggucgaggcaggcggaucaccugcaugaucaccaaagugcuggaaggucgaggcaagcggaucaccugaggucagaaguucgaaaccagccuggccaauauggugaaacuccaucucuaccaaaaauacaaaaauuagccggacgugguggugcucgucuguagucccagcuacucgggaggcugaggcaggaguaucgcuugaacccgacagguggagguggcagugagccgagauccugccacugcacuccagccugggcaacagagcgagacuccgucucaaaaaaaaaaaaagcuuagaaaacaaaacaaucuaauuugugcgggcauccugcuauuuucuacucuauuucauguuaagaaaaugguguucgggccccaguaaacagacccuacgcaauguucuucaaacugcgggucgcgggccgugaucucgaaauuagugagucaugagcaacacugcuuagaaaaaugcaacugaacagaauggaauugaagagacgagaaacauugcuuccaucacgucucauuugguuagauagcuguguccuagguugcgacguaaaacguaccuuagugugaaaaaagcugaaagccacuuagcauucuaauccuucacaaguuucccacgccugucagcgaccuugcaacccuuacuuguuauucuccaguuccuuuaauagcuagauuaaaaacccuggcacaggacaggguccaugcgaaacccguaucaacaacgccaguauccguuuaaugggagacgcagaauucagccaccucuuuccaugagccaaauuugcagaucccucagaucaggaccagccacuuaacugccaagaggauggaugcuucgccucauccccacagcuggcaagcccaggcugagucccuuacccgcguugcaguccccaagcccggacccagccaacuugucccggaggcccagcgccaggcuagggggcgggcaguguggccccgcgcguccgagccuaccaaccgcggcgcgcgccucgggaacugcgccagccagccaauaggaagcgcggaagugagagcgcgccaaaaccgacccagccaauggggcagucccucgacucaccucccaaccccgccccggcucccgcgaccguucaacaaccccuucgcccuuacccaggccgcggcccugcagcugucaaaguaggacgcggcuucagagguuggccggagggaaagcgagucgucuagaggcugugcgccuugcgccccugcguacccacuuccugccgccucuugcccacuuacuggguggagacgcucaauccucguagcgaacgcacguagcuauggcugcagcaccucgcaaaaggccacagcucaccuacgcugauccccacggucgcuggagugcccggcgcgcucugcaguaaagcccugcuaacuccgcucgcccgcuccgaacaaccacgugaccaacugacgcagacgaggggcggggccucu

SEQ ID NO: 17237 - RNA, 16963 nt, Homo sapiens
cuaaaacaaaccauaaacaaauaaaauucuuuauuuaaauuucucuuguggggaaaauauuuuucuuuaaagcacacuuaaaaguaauuugcauuuacuuccuguaaagcauuuccauuucacaauuagcaaaacuaaaaggcuaugucucuucaugcauuuauuuuuguuagaaaaaugucccauggugcuaucaaaccgauuuuaaccaucaucaagcuuaacuuugccucuguugacaacaugacuacaaacaugaaucaaaaaggaguuaaggaauuuuaagccauaagguuucaauuauagcuuaccaauuauguaauuagcugacaaaaaucaagucugauguagaauagcugucaucuacuuaacugcagauaaucauggcauuuucauuuaagaugaucugaacuuaugaaauaaaggauccagucccaagaacucaauaaucucuuauguuuucuuuugaagacuuauuucaaauauuaacuauuucggugccugaauggaaaaauauaaacauuagcucagagacaaugugguaccuguuuggaauccagcuggcagcuauaagcaccguugaaaacucugacaggcuuugugcccuuuuuauuaaauggccucacauccugaaugcaggaauguguucguuuaaauaaacauuaaucuuuaauguugaauucugaaaacacaaccauaaaucauaguugguuuuucugugacaaugaucuaguacauuauuuccuccacagcaaaccuaccuuuccagaagguggaaauuguauuugcaacaaucagggcaaaacccacacuugaaaagcauuuuacaauauuauaucuaaguugcacagaagaccccagugaucacuaggaaaucuaccacaguccaguuuuucuaauccaagaagguccaaacuucggggaauaaugugucccucuucugcugcugcucugaaaaauauucgaucaaaacgaaguuuacaagcagcaguuauuccaagauuagaguucauuuguguaucccauguauacuggcaauguuuagguuugcccaaaaacucccagacauccacaauguuguuggguaaaccaccacaucugguaaccugaaaagaagaagaauacucucuaagauacacauagccuuuugcccacuaacuuaaaaaaaaaaaaaaaaagguguuuuugcuauuaccgugcaagaaauuauuaaugcagaaaugcaaaacaaugagauacauuauaaaaaguacuaugcugcauagugguauguaauauaaaaauaucaagacagccagagggguuuggaauuugccccuucucuucugccauaaauagguuccuaacuuuggguuucagauaaaacuuagaaggcugaauauacauggccuguuacugcuguuaucuguuuucaaaaacugaacucaagugaaaagaaggcagaacugccacucuacuuuagucuacaacuucagaaguauagcauucauaugauccaaaaauuucaacugccuucaguuuuauuugaaguuuauuaauaauauuaauucuguuugcucauucacacuccaggauuuaaaaaaauuguuugcgguaaaauauacacaauacaagauuuaucauuuuaacaauuuuuuuuuuuuuugaggugggagucucacucuguugcccaggauggaguggugcaaucucgguucacugcaacuuccaccucccagguucaagcaauucuagugccucagccuucugcauagcugggaucacaggcaugugccacaaugcccggcuaauuucuguauuuuuaguagagaugggguuucaccgugccggccaggcuggucucgaacuccuggccucaagugaucugcccaccucggccucccaaagugcugggauuacaggcaugagccacugugcccagccauuuuaacaauuuuuaaguguacagugauguagcauuaaguauauucacauaguugugcaaccaugacuaccauccaucuccagaaccuuuuaaucuuccccaacugaaacucuguacccauuaaacaccaauucaccauucccuuauacccccagucccuggcaaacaccauucuacuuucugucucuaugaauuugaccaguuuaggaaauucauaagaggaaucauauaguaucuuuuccuuuuuggauuggcuucauucacucagcauaaugucuuuaagauucgcccauauuguagcaugugucaaaguuucuucauuuuaagggugaauaauauuccacuguauacauauagcacauuuuguuuauucaucugucagugauauuugggcugcuuccaccuuuuagcuacugugaauaacacagcugugaacauccauggguagacaaaauacauucaaaucccugcuuucacuucuuuuggguauuuacaccuagaaguguaauugaugcaucacauuaguaauuccauguuuaauuuuuuaagguccugaaaaaucccacugugucucaacugagcuauaggcagggagaaagagacuuuguuucagaccuggagaucuggacauggugguggcaggaaaaguggguaaaaaaggcuaauaaaagccaaaaaagaaaaaagaaaaggaaaccucagaaaaaaagagagucaggaacaauuaucacgguccaaucuuuccauuguucucauauugcaccuaggaauacugcaaagaaacaaccuuuucuaaacucuucuacaaucauuuucucuaccuuucuuucuaauccuauauauauauauauacacacacacauauaguuuaguguugucuauuucucaugcacauuuuuauuuuccuccaaaaagagccccuucuuccccuaggcauacagcauaggcuaaacaaauauucgcugaauugcaaggucacuuaagacauuuugagugacuaaagguccuaguuuuaacagcuuuggucaaaggaaccuaaauuagucuccauagcaauaaucuguccucaaacaucaaacugacuuugucacucaccucucgaucccuuagauuuguaucuccugcaaauauaacuguagcugacucuggagccucuugcauuuucuuuaaaaccauuuuuaacugauucauucguuccgcagcaugcccucuggugcucuccaaaugggaugucauaaggcaaagcucauuuccugacacguucaccugcagcaggacaaacagucauuaaaacuguccacugacuauuaauacugaacuuuaauaauaaaaucagcagauuguucugucaaaugguauauauuuacuaaacugaaacuguaaaaucagcacuaugccuaucccuccggaucaaaagaaguauuaaagcaguaacccuguccccaaagacgacgguuuagcaagcacgaccuacccccagaugucaccuccacugugaaccuuuccccaguguccccaggccaucagcggcucccuccucaauacaccaaaggcaugcugaacagacuguuucaaagcccccuaggcuaaauuaaaaggacaauuauuucccuccuacaaagccauaagucauuugcaaagcagagaugauucuuauuuauugcuguauuauuaagggccuggcauacagguauuccaaaaaagucaguuaacugaaugaaugagaaucauuuaccauuugcaauuaagacaccaacaauguacaaucuaucauuauacuaagugucugcagaaucaagucuaauucuuucauauuggucauucaugcucuucuauaaucaggagccuaccuacuucucaaccugucacauuugccucuccauggccccuacacucaacugaauagaaugcucauucauacucauacauguacaccucuugcaacuugcaaaaguuugcucauggugguuucucuacuuggacucuuuuuaauauguaugucuuacauauuuuucaggguucauuucaaauaccaucuccucuauaaaacucucacuaaacaaucuggcuaaaagucaucucuccuuucucuaaacuuccacacaucauuuauaccucuccuguggcacuuaugccuuucuuauguuuuaguuacuauauacacacucucccuuacuaaucuauauacuauaucagagcaagaucuauuuuucauuuuuguaagucucauagaguaaaauauagcagcauguauagaguagaaaguaaaaacauuacuuuaggaagcaaauguggaaugucagcaaacucaaauauucuuaagaaaacaauagacugagaauucuaucugcauuuaaaauuuauguaaaaaauuaauuuuagagaguguuaaagacuaucuaaaagaaucuacaugugugaagcaaauuuuucucuaaaggcaaugguuuuaaaaagaauaauaacacaaaacuaugaaaaaaucuuuuuuuuauaaaacacucaauuuuuaaaaauuacucacaugcacacauaaaagguuucucaucauuuugguacuuggaaaaggaauaaucucuuggcuuuuuaauuucacucuugauuucuucaacauuauagcugugaaauauccuucuucaugaccuacaaauguuuguggaaaagaauuuaggcugagaaggugagaguuauuuucaguuuaccacaaguuugccuauugaagaauuuuauagcaaacagguaacagauauuuacauggaucuaaaucuuuaaacuauuauuucaaaauaguucaucauggccaaacaagucuaccuccucccucccaaauuuuagcuagaagcuuagaagaaauaaaauaaaauaaaaaaagaccaggcacaguggcucaugccuguaaucccagcacuuugggaggucgaggugggcggaucaccugaggucaggaguuugagaccaaccugaccaaaauggagaaacccugccucuacaaaacacaaaauuagucgggcgugguggcacaugccuguaaucccagcuacucgggaggcugaauuaggcaaaucacuugaaccugggaggcagagguugcggugagcugagaucgugccaucgcacucuagcuuaggcaacaauagugaaauuccgucucaaaauaaaugaauaaauaaaaaugaaaaaaaauguaaacaagugccaaaaaauaaugcugccaauaucagaugagaaaauuugagaaauuucugaaagacacagaguagaugagaugaacuguggccagcugauagccacuuacuacuucucauacuagaaguuucagaaaaauuauaguaaaugaauaaaaaucuagaaagauauaaaccugcaagaacagaaaauaggaguagaggccaugaaugaaagcuuccaacaguuuuucagaaaacagaaaacagauggagaagugguaaccgguuuaucagaagagaaggaaaccacuugagugacuguagcagagaaccauagacaggaagcaagcagauuuguuccaccaaaaucuggaaacacuuagugcuugaacauaaagguaccacaaaagguaaggugcugagcuaagaagaggagggccaguucaaggucuggauaugggguuaaacaacccccagguuuccucaacuccuuagagcuaagugacugucccucuauuaacaggagacuacaguuuuacauagaacuaaauuuuagaggcuccagagucaccagccacagggaggggcaugcauguuagcccacggcugauaggugaauagguugaacacugauuaaguaaagugugccuacucagcucccuuccccucaccugcuuccagaagguaggcaaaacaagcacaccaccccagucccaacacccagaaggcagaaagcuaaauaacucuuuuuuggagaaacaaaauggucucagauuaaaggccuguauauaccaacacacugacaauugugggucucccucaaaugaauaagcaguuugcucuacaaucaaucccucaccccuguccaguaagguaaacuacuuagccuugcucaggcauacuaaacuguaaucaacauuuuaguguuugguguuuaaaugugaaccaaaagccaaggaucccuacauauuuaaggaacaggucuaacaugacaugauggauacugacauaacauaaucaaaauaaacaaaaagaaggaaauaaaaacaaugcagggaaagagauuaaaaccuaaaacaaacaaaaaacuaacaaaaaagauacuguauccauaaaccaagaaaagugugccauaaaaaagauauucagugaauaggaggccuaggaaauuaaaauaaugcuaucuaaaagucaagauaguugccaagaaaguagaacagucaauagagauaggagaauaagagaaaguuaagaaaauucaaggaucaacccaggagauccaccguuuaacagagggaauucagaaaaaugggagaguaaaaaaacuuaagggaggaaagaagagacagggagaaaaggaaagagaaauaacaaagauaaugaaaggagaggcgaggggaauggugggagggagggagagggaaaaggauuuuccaacuaagguuuuccacauauuaaaauuccacagaauaaaaguucccaccaagcauucaguacaauagauuuuaaaaagacccaaagaacacgaggguuaaaaagaagacccucaaagcuuccagagaguagggaaaaagaaaagaauaaaaauuagaauggcaucagccuuaucacccaucaucaauaauggaaacuagaagacauugaagaaugccuucagaauucugaaggaaaacaucuauuuacccagauaccuaucuucagccaaacuaucaagaacuacaaagcuacgacacagacauuuucaaauaugcugggauucaaaaacuucacuauccaugcacuauuuccuagaaauuaauuagagaaggugcuccaauaaaauaaggaaguaaaccaagaaggaagcaugggaaucagaaauccuaaaagaauccccaagagaauacaaaauaguuccauaaagagagacacacacagacugagagagaacccucuccuuagaaauucucgauuaaggagucgauugaaacuaaaaaucacauacuauauaaaaaugaaagucaaagaaagcacuauacaguugacacuugaacaacacaagugaacuucaagguccacuuauacagauauuuuuucaguaaauacgguugguccucuguaucugcauccacaaccaaaugcagguugaaaauacagucuucccaggacaugaaaccugcagaaauggagugcgcacauauagauggguucugcagagcacacugaggaaacugaguaugugcgaauuuugguauccauugaggaacccuagaaccaauccucugagaauaccaaggaaagacuguauaugaaaaucacgagauguggccaaaguaguauuuuaaauauauuuagcaaaaacaaauuagauggaaaauuuaaaaacuaaauuacucagggcaaaaaaaguacaaaaagaacaacaaaauaaauaaggaauuauaaaauaaagacuuuuugaaaaagcauaauaaccacaaugugauuauuucaguuaaaacuuuuaacaacugaauuucaccaaaaagguguuguuucucaaauuuuaguaauuuauauuuuccugaaaaaucauccauuuccuuuucacacuauuaauauuaaguuguauaaaauauucuccuauaauucuuguaguauucugugucuugcuuauuuuucucaaacuuauuuauuugugcuuuuuccucucuaugucccaauagaccaacuuugauuuaucucuuucacugaucuguuuuucaaagaaaagacaaguugaauaacaaaaauuguuaccuguaauaaucucauaauuacuugaucucuucuuuagguagcuauaauaugggggaauaacuuccuguagaaauaucacaucugggcuguaccuaaugaaaaacaucaauuuaugacaaauaccaaguauaccauuucauuuucagcuaccuaaaugaaggaaaucccacaacauaccaaaaacaaaaaacccucuagggcaccuaauauugaguguuuaugcugaucuuugauaacuauaaaaugagaaagaugugugcuauuuauuaauguaguacuguaacaaauauaucaaaaagaacuagaaaaacugacaauagaaaccgccauauugagagacuucaaugguccuacacacuaagagaugcuuucaauguuucuuucaauccucuugaagcaguuauuaaccacaaugaagaaaacuguccagagaacuuaagugauuuggccaaggucacagagccagcauggggcacaaauagaucuuuuugguaguuuuaauuucacguaguuacgauaaacaaaguugaagaagaaaacaguacuaaaaggcuucuaacgaaaauuaguguucccucuuugcugcagccugcaauccugcucucagaggcaaucaucuuaauucuucagauguuucuucucagagcuggacauugaacuuagguuuaauucuaaagcccacaaccuugaacuguuacuuuguauauacauaagacacauuacuauuaaauagaagugauaauacuuacaaagcuaaguaggaacacaccccucgagcccucucugacagauuguuuagaucuaauccaucaauauuccagguaaugagagagaacaugcugccauuuucuugcugaguaucuucagaugggcugauuuuagaagugguggaaucaguuguuucuucauugguuaggucaacacuggcaagaucagaauaaaacauggcuuugcaaauaaucuauaaauugauuaagaauuauuuuguauuuguagcccucauuuuacagacaaauuuuaaaagagcccuaaaagugacacuguccuuacaggguuaacaagaauugcaugccagguucuagacagaaauauaauugagcauuaaucacgcugcacuuuggcccacuucuuuguacggaaagucaucccauagcccuauauacugaugacuugcauccccauugcuccuauggguaggaucucugacaucagaaucauaaggcuuuuguuuaagcauugcuuaagauguuuuucagacgcugaauuccagcagaaagcugacaccaaccaguuugaagacaccccgacaggaaccgaaucagcaugagaaugcaguuucuucaucucuagaucccaugacuucaucauugcacucugaccaaucaacaauccucacaccuugguccacuccaaaccucuuuaagucucaagcuccaaacuucucaaggagaaucugaaguuuccuccaguccccugguuuggcggccuuacaauuaaaauuuuuuuucugcugcaaccuuuggugucucaggguauugacuugcaagcuguaccucaacaaccuagggcacauguccacaagguagucaggacuuccugagggugugucaugggugcguccuuaaccuuggcaaaauaaaccuucuaaauugauuuagaccugacucagauacuuuuggguucguagauagauucuuacuguacuguccaaauguuugcucacuuaggcaguuauaaacaacuuaauauccuucaaugacaugugucacuagaauaauuguauaaacuaugaucccaaauuagacucagaaacguaggauuucuaaaucuuuuuggaauuuuuuaaaaucauauguuaaauaagaucucauuguggcagauaaauaggaacugcaaauucuuugcuacuccccuuugaaugaugaaaccuaaugccccuccccuuugaauccagaccuuaguagcuugcuuacuacagggaaagaauauucugggacuuuugagguuuggccuuaagauaaucugccacuuccauucaaggcuuuuggaacacucccuccaggaacccuggaacugccauguaaaaaguccaaccacccugagacugccaugcuggaaaggacauauguauguguuccaguccauagucuugacuccaccaucugcucccccaaccaauaccccagacauaugaguggagggacaaacuuuauuaaaagguuaacuccuaagcauuuauaaacuauucaugaauuuuaaaaauaggugucugaauuuauaauuuuaaugccaacauuuuaacuuuucuccuauacaccauucacccagguuccucaaauauuaacauuuuacuuaacauuuacuugcuuuauucuuuuuauucugaaccauuuguuuaaauauuuuuguauuauuuccuaaacacgaagacaugcuuacauauacaguuaugcaccacauuuggagaagcgugucauuaggugauuucaucauuaugcaaacaucauagagagaauuuacacaaaccuagaugguacaacagccuccuacacaccuaggcuauauggucuagccuacugcuccuaggcuacaaaccuguacagcaugcuacuauacuggauacuguaggcaacuguaacacaauggcacuuacuuguguucuaaaaauaccuaauauagaaaagguauagcaaaaauacaguaauauaaucuuaugggaucaucuucauuuaugcaguuuguugucaauagagaugugguuauguggugcauaacaguauacucuaguaugaucaacaagucagaagauuaucauugauauaaguuuuucuuuuucuuauugccuccuauggcuagauuuaauaucuaaagaccuagaccaaucuugccaauugugcuacuaguguccuaaucuaggaucacauguuauauuuagauggcaugucucuuuuaauuuucuucaauccagaaaaguuuuucagucuuugucucucaugacucugacauuuuugaagaguacaggccauuuaucuuacagaauguccuucagauugggcuuauguuuuccuauuauuugauucagauuaugcauuuuuuggcaggaaugucacagaagugauaguauguccuccgcaaugcaccauaucaagcaucugauauggagcuuucccauuccuggugauguuagcuuugaucacuugguuaaaguguuguuaaccagauuucucuaguacgaaguuauaauuuuccccaucauaguaaguauuuugugggaaaguacuuugugauuauguaaauaugcuguuguucacugaacuuuccuacuaguuuuaguaucuguugauaucuaccugaaauaauuaucaauacggcaguucccaaaugaagauuuuuuucuaauuccucaugucuuccacauuuaauagauggaguucuacuguaaggaaaaauguucccuucucucuuggacaaugguauuuauaucaguauggguucuuuuuuuauggauuguaaucuauuccuaccaagcauccuguugcuuggguuauaccagauuucacggggaaaggguaggcagcuuuuaagcuaggucuugugcccuucuggcauguccccaacauuuucugggcaccuccuuacuuucuaacaccacagauaccauuggcucaucuuguacuuuuuuugccccugcucuggaaucagucauuucuuuuuaacuucuuuuuuaauuuuuacauuaagccccuuucauucuaugaaaucagucauuucugaaaagcccuuguuccuuucagugaagaauuguauuuaaaggccaugaucugggugcuagaugaacuuaaugucaauuuuguagcauaaaauauuuugaauugucucccuuuuacauaaaaauaaccuucaagagcauaaaaaaaaagugcaaaacuuucuuuugugaauuucauccuacccaaaaguucucuuauucaacaaugagcuauuagacuuuuuuucaacgucuuacugugggggaaagagagaucagacuguuacugugucuauguagaaagaggaagacauaagaaacuccauuuugaucuguacuaagaaaaauucuucugccuugaggugcuguuaaucuguaacucuagccucaacccugugcucgcagaaacaugugcuguauugacucaagguuuaauggauuuagggcugugcaggaugugcuuuguuaaaauuguguuugcaagcaguaugcuugguaaaagucaucgccauucuccagucucgaguacccagggacacaaugcacugcggaaggccacauggaccucugcccaagaaagccuggguauuguccaaggauuccccccacugagacagccugagauaauggccucaugagaagagaaagaucugaccgucccccagcccgacacccaaaaagggucuguguugaggaggauuagugaaagaaggccucuuugcaguugagaaaagaggaaggcaucugucuccugcucgucccugggaauggaaugucucgguauaaaacccgaucguacauucuauuuacuuggaugggagaaaaccgccuuauagcuggaggugagacaugcuggcggcaauacuacucuuuauugcacugagauguuuguguaaagucaaacauaaaccuggccuacgugcauauccagacauagcaccuuuccuuaaacuuauuuaugacacagaguccuuugcucacguuuuccugcugacuccaccauuacccucuaguccugucgcaucccccucaccgagauggggauagugaucaauaaauacugagggaacucagagaccagugcccaugcagauccuccguaugcuaagcgccgguccccugggcccacuuuucuuccucuauacuuugucucuccgucuuauuuauuuucucagucucucgucccaccugaagagaaauacccacagguguggaggggcuggcccccuucaucuuaccaccagagagaaaaagccaagugauuccaugccugaucaaagauguuauuuccuuuuuaugaaaagcauuaaaaccagaaaggagaaauuauuagcucuuuauuucugucaaaucuucuguuucauagcugaauuuaaaaauauauauacuaucauagacaaagguguuugcucaucacaucaggccccuuaccuauccggcacacacaccuuuuuuuccaaguuuaaagauauccaacuauaacucaaucuaccucauaaaacuguaaacacaaccccuacuuuccucaacagguggacugucaugggugauguauggggagagcaugauggugucauuaaucauagcuuauacuuacugagcucuauaugccaggcacaauuccaaguguuuuacaucuauuagcucacuuaauccuuacaacaaccccaugaggaagggguugcacagauaaagaaacugaggcagagagagguuacacaguuacuaaauagcacagguagacucagaaccauauuacuauccccacugcacaaagaaauugaggcagagagaaguuacacaguuacuaaauagcacagguggacuuauaaccuuugcauuuuggcuccagaguccaugcucuuauucacuaugccauccuuuccuccucuguuucauuguaauccaauuccauauugauauaguuuggauguuuguccccuccaaaucucauguugagauauaauccguaauguugguagugggguccagugggagguguuugggucauggaggcagaucccucauuaaugucuuggugcuaucuucacgauacugaguucuucuugcaagaucugguuguuuaaaaguauguggcaccaccccacccccuugcuccugcgcucuccaugugauaccugggcuccccuuucccuucugccaugauugaaaucuuccugaggcccagcagaggcuggggccaugcuuccaguagagccugcagaacuguuagccaauuaaaucucuuuucuuuauaaauuacccagucucagguauuuauagcaacacaagaaccuaauacaaauaucucugcaauuuaugcaacacccacaauauuuaauauuuaaugcagcaagaaaaaccaggcaacuguauuaaaaauuuccuuuuggaaaaaugaaaagggaaauaaacucuaaaacguugcuguacagaaauacuaagggaacagaaagggacuggcaaacuuuaggggcaugauuuguugacuucauuccuaagcagaggaggaagugcuuuugucaguauaucuggugucuuagguuuuauguguuaggccagugcuccucaauuuuaaaucaccuggagaucuugucaaaauacagauucugauucaguaggucugggugagaccuaagauucugcaugucuaacaaauucccgaguagcaguggcacgcugcugguccagaguccacacucuaaauaacaaggcucugggacacgggcuuucaaugcuggcucugcauuagaauuaccugcacagcuaauaaaaaaaaaaaaaaaagccaauaaggaauaaugggccccacucaagacuaaugaaauuagaaucucugguuuuuuuuuuaaauuccccagauaauuccaauaugcagcuaagauucagcauagcuguuuuaagaggauuucccuugucucucaucagagacacugaagauagauucuaauguaggggacuaaaucacuuuaguguucaauuucaauuuuuguugauaucccaggaauucacuccagaauugagauuccugcgccauucauuuaagacagccaaugcccuugcucagcaggguugaguuuuucuggucauaaaaucuuccaaucaauuuuuuuuucccuuucauuuuugcuaaagccaacaucaaaaaucuaaucaggucacaggccuuagaaacacgcugaaguuugccccuuccccauuuuucucucuugagcaaacuaaacuuuaaaaccucacucucauucauacuugaccugaguucugagagacaagagaccacagccuaaucaacaccuuugcuuguuuuugccaauuuaccauuccgggguaagagaauccuaauagccaugacaccauugaucagcuugauccgcaucuuuucugagggccuauuacaggaaauccacuuauuuuguuacuauuuauugguuacaauauagucuguugcaaccaacagacauuaacucagguugguuugaccaaaacaggagaauuuauaaggaaacaaacaugucacagagccugguacagaaauacagccauguuuaaggaagggcaguuaagggcuuucucucaauccuacacuucaacuucccucugcuucauugucucucugcagaccucuguucucagcuucucuguacacaaaaaaagauauguaugaauccucacaggugcuaaguuaacauguuacaguuccagcuccauaggaagacucagacuugacucucuugguccuaauucugaaaccaaggagaggaucugacuggccaguuugagcuaggcaaacaccuccuaguccaacuugcucugguuaguaaaacgggagccagagacaaaucacugugggugaguaaacaauuccccaacaagaggcaagacagagaaaggaaccuaaagaaaauaucuuaucacaucuguaagccaguguagcugaaaagaccaaagggaaaauaaagucuccacuaugaacagucaauuuuacagguuguacauauagcugggagaauuuuauacauucaguaaauauuuauugggagcuuauuaugugucaaauguugugucagacuuugggaaauuaacaauguacaaaacagauacuccuuacuagaugugcagucuaguaggagacauaaaauaaugaacagcaauuauaauacggacuaagguauuguaacaggggucaugcaggaugcuauaagaguaccuaaaaggggacucuuacccagacuuaggacaucaggaaaagcuuccuagagauaaaucaugucucagcuuggggcuuuaagacaaauauuagcaaggaagggaaaagaaaaaaauuccaggcacagguaauaaagaucuuuacgaaguuucaaagacaggagaaaaugacccguuggaaaaaaguaaaaguuugauaggccuggaaccuggaaaggcagguucuaaguuauggagccaaauaguagagggccuuguaaggcagcuacacuuuuuaagugcaggaacuggagaggggcacugaaauaacaggaguaggugugcauuaaaaaaaaauaacaacaacaacaaaccuguuauucuggccggucagccuagggccuagaauaaauaaacaauacaggaagcaaggagacuuccaaguugccauuuuucgauagaagguuuagccuucguucauuuguuucaaaccucucgcuuacuuauuuccuuucauuugaguuaaacauuacauuuccaucuuuuccucccuggaccccaaaucacguucgaagcgacagucuggugcaguguuagauccgcugcuggggcgcaacuccgcgcagcagcagcaacgcaagcccugcuccucuggcuacgcagcuuggagaucugccucagcaucguccgcccagcuccacggcaggucccaggacgcgcagggcuaccugguaucaaacugccuccgugcggacuggcucccgcuccccucaucacuuacuaggucuugggcucagagaugguuucaggucggcguuccaaggcgcucuccuccaccggaggcucgaaguaggaguucagagcccucugaaaaacaaaggcacaagggaugagguuugugcgcuccaccgaccuagguaauggagccggaagcgaggacagcgaaagcguacuuccaucucccagucguucucggccaggaagcacugagccacugcggcaucgcagcuugcgaccgaggcaaacuccacacacagaagucgccgcuuuuucaccucaggcucgcccucuuccuccgccgccucccucccgcccuccaggcaacuccccaacuccaucuuccugccgccucugcaccgccccuuuaagcggaacaggaggccaacgcgcggcucugcgcag

SEQ ID NO: 17238 - RNA, 8010 nt, Homo sapiens
uguuaagccucccaaaguagugugcauggaagauucuagaguguccagcucuugcacuacaaauguaauaauaacagaauaaauacacuuacccugaugauauugaggguacaugauuagccuaaugugaugucauaugaggaaguuuaggaguccauuuuucaggugguuuggugauaggaauaaaaauguuacucccgucgcugauuuggaagaaaaccgaugaaguacaaguaagguuuccccacuccuguguguggucaugggaagccauuagagggaagcugcagaacagaauggaacaggacaggcugggcuagacucgagcacgcaguggccccugugccaccacacugugggucaggaacacgcgucaugguguucuugucggaaugugaacauacagcacccucuagcauuacgaaucucuuaggauuuuuaagauuguauuugauaauacuuauauuucacagggcacacuuuuggcacaccucagagcacacugcugcuauuuugggucguaucacuguaaaauacauaauaaguacuacuuaacugugacaugaagaauuggaaucccagagggcaacauuugauuugacuaagaucaggcauaagauagaauuuuugucauuuuuccuugcaguuuuauugacuuaguuuaugagcuuggauaaaauaauuuuuugaugaaucaugucaauaaaaggaaaaauaauguaacuaccucauaagucugauaaaaggaaguugcuaguguuuuauagaauuucugaaggugguuaaaucaaguaugauuucaaaauaucaacuaguuccacuuuugugauugcaggaugcuucuuauacuaaaguucucauaaauaauaaaucagcuuaugccaaaaauauaugaaguuccuugguuuuaaauuuugaacuaaaauggacugagcacauuaauuacuguuugaaaguagguaccaaacacuggguuaugugagugaguaagcaaucauaucgccugucaaacacaucaagugucgaacacgucaaggugugauacugucuuuggaaggcuccuaaacaaaugugagcacaauuauuaacaccuuauucuucaugaacacagacuguuaagcagcacuaaccaauuuuauauuaaaaagcuauuuauuuuggugaguuauuccaagaguuguauacagcuuuauuuuuuggaauugcaauauuaaaguugcacguuggauuuaacucucaugacuuuaguaauaccuacagaggugagcuaauggaugguacauggaguagggacugcagagacccuaguuuuguccccacuccaucuucaaauaauuuuggucucuuaggucugugauacaaaggcauaaaacaauuccuaucuugaagccuugagaaaagcuguuacauauacgcagauaguagcaagacagaaaaugcaaauauguaaaugucuucugauaucuugaaauaaagauaaauuucaguuaaacuuguauaaguucagauuucuguuaaugagaaauuacaacccuacaagguaaggucuuuacauuuuaguuauuaagcagaaucaaugcuuaaaacuauaguuaauacuuaguggaaagaaaauuuaauccauguaucaggauaauauauuagacugucaugcauuaauuuuuuccuguaugccagguuuuuuacauacgugccauaucaguugaccuuuuacaguaggaguauaauuuacauuguuuuugacauugggguuaguaugguuaaauguccuauaaacuugaagcuugcuuccauuuuugugggucuuaaccuccaccuggugcuugcuauuggguguauucaggcauugagaaaaauauaaaucgugagguaaauaauggucauguuuaaacagaggccuuaucauuuagugaagcauaaaaacugacacuauauaaaugcauccgucuaaugaaaagacccaguacugagaaaaacaucccuuuacucaagugucagaugucagagugcucuaacugcucaacucauaagugaauacaacuaaguaauuucugguccccuaaaaauaaccauccuuuuaauuaaaaguaauucuucagauagguugggcuaccaauaauugucccuaaacaaaaccaaauggcgcuuccuugugcuuuugcugugccauagguuacuaugcagcuagcacauguaccucuuccagaaaaaugaggucauccugggagugacccagagaugcucucuagggauguaccucuugauguucuuguuaacuuuccacucuucagcuggauuccucuuccuguccccuuuucaccagucucuacucuugagagaagcugagaagagaagggcucuucucauuuguuauuuucuccugcuuuuaguaucaucucacccguggcagaagaaagagguucuucccaauuuaacacaaaauaaacuaguuacuguuuacagauaaugcccgcuaauguuuacugaaacugaaacccuaugauacauuccauucccuuaagugugccacgcugcaggacugacaaaugaaauccauccuacgaaaaacagcccaggaacaagcgaggccaaggccugcuuuccucuccggcccuuacaguagcguguggcucaggccacaucuuuucccucuaguucuuuuggcacaaguuguaaccuaaugcgacaaaggucccucaugagauggcuuaaaacuagcagugucgcuaggcucuuuagguguuagaacagccaacucuacaaaaguauuggagggcacagaagggugauagucuugguuuuuauauuuguccuucacuauauaaacauugaaaagguauuaauccucauuaagaaaggauuaucggccagguccuguggcucacacauguaaucccagcacuuugggaggucaagguggguggaucaccugagaucaggaguucgagaccagccuggccaacauggugaaacccugucucuacuaaaaauacaaaaauuagccgggcguaguauugugcaccuguagucccagcugccugggaggcugagacaggagaaucacuugaaccugggaggcggagguugcagugagcugagaucacaucacugcacuccagccugggcaacagagcaagacuccgucucaaaaaaaaaaaaaaaaaaaaaggacuaucauccuuagcaaacuaacacacgaccaggaacagaaaaccaaauaccaaguauagcauguucucacaagugggugcuaaguuaaaagaacuuaugaacacaaaacaacacacacuggggucuacuugaguggggaaggugggaggaacagaaaagauaaaaccuucacauguaccacugaaccuaaaauaaaaguuaaaaaggacuaagucacaagugauuuggaaugugagguuaucccucacccccaugcuuuacucuguacuauuuuuccucccucaguuucuuuuuuuuuuuuuuuucuguauacuaugcuuucuauuauacuuugauuggcaugggccaaucuguuauuuuuaaguucaacuuuuuuuuaacuuuuaaguucagggguacaugcgcaggaagugcugguuuguuacauacauaaaggugugucauggggguuuguuacacagauuauuucaucacccuaaguauccauuaguuauuuuuccugaucucucccuccucccaccuuccgcccucucauaggccccaguguguguuguuucccucuauguguccacguguucucauuuagcucccacuuacaagugagaauauggaguguuugguuuucuguuccugcaauaguuuaugaaggauaauggccuccagcuccauccaugucccugcaaagggcaugaucuuguucuuucuuuauggcugaacaauucuuuuuuuaaaaaaggauguuuuuaggaggaauuguguacagagacuguucuaacagauaaccacagagggaccuuuccagccauuggaaagacauucaagaggaagaggaaauagguuguacagcaggucugacuacaggcaauaaguugggaaagaagaaagguuuagaugcaaagggagcgaggaaguaaacuguggaaggagacaugaguaagcagaaugucugcuauuucacauauuucuggugcagucauauauuuacuguaucagauuuccagaggguguggcuguuagugugucucucuacucccaggagccccaugucuaucaggaucuaccaccgcuccacuggaugugccacuuuguccaucaaaaugcucaccauggaugugauucagcaugagagaggugggcagaguggggaaaugcagugaaaucuucaaucugagccaaggcuauagacgugaagugccccggagagucgggcucccaaagaacuccuuccagcagcaaugacgacuugguucuguaagggacacaagacagaauucauggcucauucauaacaucuauugaguuccuaugguaguccaggcaucaugcuaugcucuagaaauauaaagaugaauaagacacuggccagauccccuggcuugaacucaaaugccacuuucccuuuguuuacagaccgcuuucucacaucuauaaguucugaaaaccgcagcuaaggaugcucaccccaaucccuauucuggcacauaaaucauaaaggagaaguagggcagugcaugcuuaguucugguacaauguggaaaacauaucuugaauaguaaggacuuccccuagaagcuggcuuugucaauguguuuagcguaccucccaccuacccugcugcuuaaaacauuuuaggacccaucuuucagaauugccuucaaaaccugcugcaaguuuuuaaaacauuuucuucuuuuuugaaacagagucuugcccugucacccaggcuggagugcagugaugugaucucagcucacugcaacuucugcuuccuaguuucaagugauucucaugucucagccucccgaguagcggagauuacaggcaugugccaccacaucuggcuaauuuuuguauuuuuaguagagacgagcucucaccauguuggccaggcuggucucgaacucccgaccucaagugauccacccgccucggcuucccaaagugcugaaauuacagaugugagccaccaugccuggucuuuaaauauuuucagugguggcaaaucuucauacuccgaggucggauuugauuuguggaaacugacaaaaguuauucugaaccaaagcuggcacaugagguacgggugaucaaacuggcugacaguauuuuggucagagcaggauaugacaguuucuuauuuaauuuugaaaacuacugaugaaaucuagaaauaauaauaauagcuaaaauuuguggagguuguaucaugggucagacacuaugcuuagcccugugcuuaucuuaucccuuaauacccagugucaauuaauagggaaaaucuacacuuaagaaaacagcaucaaaugguacuuuauucucccucucuuucccaauuuauggaauuacucauuuacuaaauuugccuggccuucggcuucacucuguuuugucagagucuagucaucuuuccagaugcagcuccgggcccaugaucucugcaggcccuucccugacuccaccagcagagacuucugcugcaguugcugucugaccucguuuggcucuuggucaucauacaccaaacuggauggucuugugggccugcuguauuuucccaccuagacuacaagcaccuggggcugggaccaugucucagguuucuuugucuaucucacaggugcuugauacaacacugcucacuauacacuaaguuacugcucugcugaggcuccugagcugauggaaggcagccccaugagaaguuucugaaauacagagacagugagagcacuacuuacuuaaguagacgccggauccuaauucuaguuuguuacgacuaauuucauuacugaaugcucuuaugccacagaaaggaaggaaucuucagaacauaacuuguacccaaaucucagaaaaaggccacucugaucauccucugauugucaaugcccauuuuugaaacauaacaucugauuuaucuuuacacccagagcguucaaugcccccaagcucagguaugugcuggaaaagugaaguaauuuuaacacuaacccagguaaacaauaauuaggaagguacauuugcaguguuuuacaaaaaggaauaaaauauaaguuacuuuuagauuauauauaccacuacucucaacugauguaagcuauaguugauauauguauaguuuuauauaauacauggguucuugacaaugccuaauuuuugaaacaaauaaaauuuuagauauaagccaagcuugucauauaaaggaucccugugaucagaccuuccgagaaucuucccauaaaguuaauaaccauauuuuuguuaugugguuaauccuacauuuuuagaccugccuguaaaugggucacuuaaauuauuggccacuagagggcaguuucaccacaauuuuuccuaauccucuuccuccucccaccuuccacccugguccacaggaaccugguccacagcacuuaacaagucuuacagaccugguuauauauauaaaucuaugaaggcuucugcagcccuucaacccacuguaaagacuuauucuucagacuacucauuagcauuuaauccuauacuaauuugcauuuuauuugacuuuccauguauaugaaucuuauuuucaagaacagggacucugcccucucuguuuuuauuucuuauagccuauacaguggaugaaugcaaucagugguuuacagguauauuuuaagguuaaacuuuuuuuuuuuuuuuuugagacagagucuugcuccaucacccaggcuggaguacaguggcaccaucuaggcucacggcaaccuccaccucccagguucaagcgauucuccugccucagucucccgaauagcugagacuauaggcaugcaccaccacgccgggcuauuuuuuguauuuuuaguagagccgggguuucaccauguugaccaggcuggucuugaacuccugaccucaggcgauccaccaaccucggcuucucaaagugcugggauuacaggugugacccacugcacccagccaagguuaaacuuuuuaaucugccauaucgaaauuuaaacuguguacacuuuuagaucuagcaauccuacuuuuaagauucucaccuguggggauacuugcucaauuauaaaaagcuacacauacguacaagaaugcucacuauggccuugucuguaauagccaaaaaaaauggggggccaagguggguggaucucuugagcccaggaguucaagaccagccugggcaacauggugaaacucuugucuccuaaaaauacaaaaacuagcauggaauggugucacacaccuguggucucagcuacucaggaggcugagguuggaggaucacuugaguccaggagacagagguugcagugagccaagaccacaccauugcacuccggccuaggugacaagagccagacucugucuuaaaaaaaaaaaaaaaaaaaaagguguguguguguaucucugaagccauagaaaaacagaaaaacucugggccgggugcaguggugcaugcuuauaaucccagcacuuuggaaggcagaggcaggcagaucauuugaggccaggaguuugagaccagccuugacaacguggcaaaaccccaugucuacaaaaaguuuuugaaaaaauagcugggccugguggugggcaccuguaaucccagcuacuugggaggcugaggcaggaaaaucacuugaaccugggagguggagguugcggugagccaaauuugcaccacugcacuccagcaugggcgacagagcaagguucuguauaaaaaauaauaaagaaagaaaaaacucugaaagucuggaagaaaauagcaaaauacuaauaaugguuauuuucuaaggcaagggccagcaaacaauuuuggagaacagg

SEQ ID NO: 17239 - RNA, 13605 nt, Homo sapiens
cacuagguacucugauauuccguacuaaacacgucugcaagucaagaugucgcacccguccccccaagccaagcccuccaaccccaguaacccucgagucuucuuugacguggacaucggaggggagcgaggugagcggagucugacgcucgcggaaaagccccgaggaggcggggguucccgggauuugggggauuccaagggcggaaugcggcuccggccggugacugcucaguuucgcggaggggauggcugccuaggcugguccgccggagcaggcccggagaucuagggcuagaucgauccagcgcccuuguaucaaugccaucgguggugcggaaguuucuggaaauuucuaguucgggaauuguggcguccuuuagguuugccuccugauuugguggcacuuccacgccaccuuugcacuaccaaguuagcaugaaauauuuuauguuugcaaugggacaguucggaaagcauauccugggauaugcgucugcugggccccaggaaacuauauuugccacaugagauaauauaucagcacgugcuguguuauuuauacguuaaagggacuuguuugcucauugcuuuugccuuauuacugauucuuaauuuagagguccguucagaugagcaaacauuuucucuuaauuugccauugggaaaaugcgcucaacguagugaugguguugccuagguuacauagccgcucagaaguuccuaaggccuggugaauuagggagcguguugcuuuguaacuggauuggccuuguucuggaacacguuggaauugcuggccaggcaauguguuugaaugcauguacaggacacacacacguuuacacguacauucaguuuguugcaacuagcuagggcuagguuuaaucucaccugucuuagcugcuaucuagaggaggaauuuuuacagcuuuugcuucagagguugcaugaggcaguuugcucagagcacaaaggcugcagguauacguaacacguggcaaguccgcccacccaaagacuguuuaauuuucucccguugguugcuuggugauuggaaauucucaguaccucuugaagaaauuacucaggauuuaaaacuauuuguauuuaaugauaucucuuacauggugcuaaucuuuuggcuacuauaauugguuaugauccuuaguguaauguuucaaaucuguuuauauacauacaugacaguagguagacuaaauuugaauauuagaauaaaauaagauucacuaauucuagugaguauauucaaaggaaaugaaguuuguaugucaaagagguaucugcacucccauguucauugcagcauuauucaugauagccaagauaauggaaucaaacuagguuuccaucuacagauggauuuuuuuuaaaauuugauauaugugcacaguggaguacuauucacccauaaaaaauaaugaaaucuugucacuucugacaacaugaauuaauauggaggacauuauguuacaugaaauaagcugggcacaggaagacaaggcaugaucucacuuacaugugguuucuaaaaaguugaccuugaaguagagaauggaaugguggauuucagggguuggguagauguugaucacgagagaccuaauuucaguuagaaagggggaauaaauuuaagagaucuauuguauaacauaaugacuauaguuaguagcaauguguuguguucuugaaauugcaaaaaagaaaaauuacaguaaaggggaacuugguaauucaugauugaucugcuaccauaauuauaccaaccuucuuuuuaucauuugucuauuugguuguuuugcauacugacaagauuuucuuuucuuuuaguuggucgaauugucuuagaauuguuugcagauaucguacccaaaacugcggaaaauuuucgugcacuguguacaggagaaaaaggcauuggacacacgacugggaaaccucuccauuucaaaggaugcccuuuucaucgaaguauguguaaauuuucuuaaucuuguuauucuucauacagacaaguccuguucuuuaggauuuggggaagaaaacacuaaguaggaagugaagcuuaaaaaguacuauuagcguccaugucugaggcaguaacgcaguuucguaaagguuaggcugugcgagguggaauuacuuaugguacuaagguuuaucuauagagaaauggacuccccuagcuuuacccauccucucauucuccuucacucuaagaugauuugauugagaaaggaaggccguagucaaccaaccuuagguagcuucauugccuggugacaaaaaaguuaugcauagaccgggcgcaguggcucacgccuguaaucccagcacuuugggaggcugaggcgggugaaucacgagaucaggagaucgagaccaucuuggcuaacgcggugaaaccccgucucuacuaaaaauacaaaaaauaagccgggugugauggugggcgccuguagucccagcuacucgggaggcugaggcaguagaauggcaugaacucagaagguggagcuugcagugagccgagaucacgccacugcacuccauccugggcgacagagugagacucugccucaaacaaacaaacaaacaaacaaacaaacaaaaaaaugcauaauuuuugggccugagugcuugggaaggcagcagauuugaagauucaguguuuugggcacaugggugauaguguggucaaaauaugccauuucauacugcuuauuacacuuuguaaugaaucauacuuuuguuuagugauaaugguucucccaauagacugcaggcucuaugaguucaagaacuguauguuuucaccauuuuguuuuuggcaucuaauacaguuauugaguaagaacucaguaaguauuuguuuaauaaauaggcaaauaagcaauaaucacaagagcaacauuuuuuaaacgauuuauuaagaaaaaauuaacuuuuuaaaaaauauuuaaaauguuuacuuucauguuuaauaaaaacuugaaauaugcuaauaaacuauaugcagaaaauauuuaacauagcaagugugagacugcuaucuuuagaaaggucugccugcaagaguagcacuuguuuggagucugggaacuugacacuuguaccauuuccuaaauaguaauggugauuuacuaugccuagccuauuuguacaaacaugaaugugugcucucuuuuggggagucuggaauuuugguacaugcuagguagagugugcccaauaaauaccuugggugcugagucucuaauuggcucuccugggcagaaauacuguguacauguugcugcauuuuuguugcugggggaaguguguguucuguagcacuucaugggacggagaaagcauaaggaagccugcacauggauuuuuccagacucugccugugucuuucccgucaucucgcuguguauccuuaccacugugauccaaccacauacugauuugugugagcucuaggguucucugaacaugaaagcaaucuugguaaccuuugacacaaagugauauauuugcugaaaauuuuccauuaggguagaacaaaucuacugggaaucauuggucuguauucagcagacauuauugaguaacuaauauguacuauguguacaugcacauaguuauaaggauguaaaacaauacaguugguguacuuaaggagaucauugcuggaaggggcagaucauaaugccauauguuauguaggcagagucaagauacuaugggagaaaaauuaggacauacagcuuagggauuucagugacaguuuuauaggggagguaucauuugaaccgauuuucugaauguuagcagggaucaggcagugaaaauagguuggauucagauggugaaaagccugaagcguuuggaguugcggagacggguggggagcgacaaacaggagagagacaugacuagagucaugcacuacaaaguugucuuacguacguauccauuaguaagcauugcuaaaggcauccaugucucagucacuaauagccauuuuccuuuuuuguaguuauuaagaaauuuaugauucaggguggagacuucucaaaucagaaugggacagguggagaaaguauuuauggugaaaaauuugaagaugaaaauuuccauuacaagguaaaguagagaaaaugcauguuauugcugauaaaaagauuguuauauaucuggaauacuuguuggauuaagacaccaaaaaauguuucaagugugcuuagauucuccauuucuuguaauaggaaucacuuuuguaaauaaugguucuuuaauauggaaaaguuuucauucaguaaugauuaauucagcauuauuucauugugauccaguuuuuauaugcuucaguuaagccagugaguuuuuaaaugcgaccagcaucuggcaaaauuguuuccaggaaaaauguuuccauuguuggaaggaugguaacuugugcauccuuauccuugaauuugaagagcaacaaaaccaucacuaauauccaggaugucaggggauuugcacacuagcagauauaguuaaauguccaagcuccuaaaggacuucaguggugccugugccuucuugucuucguugucccaagauguaauugggguauauugcaucauucaaguuauaagaauggacauguaaguacaaaaguaaagugauauuuuuggaaauaaggaauaugagcaaggguauuaggauaauuugaaaaaaugucgucagucuuccagucaguguuuauugagccacuaucacuggcaccaaaggguuuauaaaaaugaaaggccuugaugacaaggaauuuauaauccuaccucagagacaagauuaagauacaugggacuacuggagaauaauaguauauaaauaaaugcuaaauugauugaauauccuugcuuguauaacauugcuaauacugucuauauacugcaggagaaagaugugauuuaugcagucugaauuauuauggaagucauugaggaggaauggcuacuugggcugugcagacugggucuugcaaggcggcaacaugucugagauuugguuaggcaggaacuguaguauugaugcagaauuuaaaaagggacgucggugaggaaagacaaaggcaagagacguugaggaaauaaaguucuaguuacuguuguaccaaaggaagcuaccagaaggaugaaaacuaaaggugaugugaugaucacauugacauagagaaaaggggccuauagacaagacacaugauucuugcuuucuauaaacgugguggccuuaaaaucugaauuugauuuagacugaggggaguaaaaggcauuuuggugggguggggggugucaugaaacauuauauaacaugagaguuacggugcaugcaccaacaaggaauacauuuagaaagccuaggagauaaagugaaaagguuaagaaauuggguuucauagauccuuugacaggauuaugccaagguagaauuuugauuucaagauguaugcagcaguuucuuuugagcacucuccgaagaggugauucaucugggaugaaaaccuaauccaaauccuguaugauuuggauucuuuugagauuaggaaaguaccaaacugaaugucuuggguaaauucaguaucccauuauuguuccaguuuauugauguuuuguaaaggaagacuuauacuguaggcauauuuaugaauuuggaagaccguucaggucuucccagaaaaaaagagcauucaucauaaagagggcaaaauauauuacaagaguuucauaaugcugcaucuucauuuuaaaggugaaguguaaguauuuucucauggccaauuuagaaauaacccuccccccgacuauuguuucuguuaccuauuuacuuugauaagguuuuuuaaaguuuaaagugauuaagugccccauguuuugugaauuaaagguugcaguuuauaaaaaaauaaaaaguaauuaaaaaauuuuauaagugaaaaguaaaaaaaaguaguuugaucuaaaugguaguauagugcaccccaguuuuauguucaguaaaagaacaguucagacuaacacacaauucagaaaagaacacaucuaaccuugguuuucuuuuaauuuuuauuucuacagcaugaucgggaggguuuacugagcauggcaaaugcaggccgcaacacaaacgguucucaguuuuuuaucacaacaguuccaacuccucauuuggaugggaaacaugugguguuuggccaaguaauuaaaggaauaggaguggcaaggauauuggaaaauguggaagugaaaggugaaaaaccugcuaaaguaaguaaaaaguuacagugaaauacacuuauuaucuuaguugcuaucuuuuugagacggagucucgaucuguuccaggcuggagugcaguggugcggucucggcucacugcagccucugucucccagguucaagcuauucuccugccucagccuucugaguagcagggauuacaggcgcgcgcuacaacacccggcuaauuuuuucuguauuuuuaauagagacgggguuucaccauguuggccaggcuggucucaaacuccugaccuugugauccgcccaccucggccucccaaagugcugggauuacaggcaugagccaccgcacccagccuguuaguugcuaucuuaaagaaauauaaguaaaaggaucaggugauuauuagcuggaaaaauguuauaauaauuuuggguauaggagccaggaucugccacuuuuuuuuuuuuuuuuuaacuuuucuacaaugggaaagacaauuaggguaguuuuaaaggagauuuuuauuauuucaacuuucauuuggugaucuuugcuaguuuacguuaagucuuccuauaccugcaaaacuguucaguugguauguauaguaguacauaguggaaugaggauaauaagcccaaaaucuugucuggauuguagcauuaacuagaggcuuggccuugacuuuguuacuuaacuuuuccacacguguuuucuccugucuaaauuacuuauggguuuagacuagauuaucucugaagacccuuguguacuuaaugucugugaaucaaaaugaccuuaauauuggcugggcaugguagcucaugcuuguaaucccagcacuuugggaggcugaggugggaggaucacuugagaccaggaguuggaaaccagcuuuggcaacauagugagaugcugucucuauuaaaaaaaaaagaaaaaaagaaaaaccccuaaacgaccauaauacuacccagccuaagugacaggguugugagugggaguuggaagcucaguuacuuguaggagguaggcugucacucaguguaugacaagaauaguaguaaaccggaagcucaugccccaccuaaugccacuuacauagacaaugauaaaauugccaacuuauucuguguuuauugagcuccugaauagcaauaaaaugcuuauguaaauacuaacauugucguauuaguuggaauguauaaaaacagcauuauaguacauaaaugagccuucucacauaaaucugugaauuggacagugcugcacaugacuucagcuguauagcuuuuaucucucauuauuacgauagugcacuucuacaauuuaggguuauuuuuacaguugugcguuauugcagaauguggagaauugaaggaaggagaugacgggggaauauucccaaaagauggcucuggcgacagucauccagauuucccugaggaugcggauauagauuuaaaagaugugaguacuuucagauuagucaaacuuuaauuaauuuaguaagugaaaauauuuaguacuaaaaguuugagcuuuuguuucagucucucauaugauagaaucuagcauuaaaccacauuacuuacuaaaauccaacauauuuguauuuuuuuauacagguagauaaaauuuuauuaauaacagaagacuuaaaaaacauuggaaauacuuuuuucaaaucccagaacugggagauggcuauuaaaaaauaugcagaaguuuuaagguaauauuauuucuaacaaauuauuuuuaagaaauuauaaauugaauuauaaacuaaaauuaagaauugcucauuauauuuuugcaaauuacuuguggaauaaccagguguguugaaauaguugcauuuccuuuuuuuuccccucagcuuguuuugagaaauuucaaaagacagaaguugaacgaguaguacauaauuacucauaaguuuuacuuacauucaccaauuuuuaacuuuugcuguuuacguuuuuacagaacuauuuugauaggaaguuguugauacugugauacuuuacccuaaguauuucagcacguauuuccuaagaaacaaagacauucugcauaaguucaauaccguuaaaacaccccaaaguaauauugauagauaauaucaauccauauuuaggcugggcauaguggcucaugccuauaaucccagcacuuugggaggccaagcugggcggaucaccugaggucgggaguucgagaccagccuggccaauauggugaaaccccaucucuacuaaaaauacaaaaauuagcugggcugguggcgcacgccuguaaucccagcuacuugggaggcugaggcacaagaauuacuugaacccaggagguggagguugcagcaagccgagauuaugccacugcacuccagccugggcgacagagugagauucugucucaaaaaaaaaaaaaaaaguaauccauauuccaacuuccccaguuguuucaauuucuuagaaaaaucaaggguccaaacuaagauuauguguuauauuuagugguaguaucucuuacguuuccuaccuccccugguuuuuuauucauuugcauuuuuguggaguccaagucaguuguuuuuauagacuuucaucuguauguguuuguuuccuuaagauuaguuugaggugaaauauuuuggcaagaagacuuagguguuguuuuguauuaccuaugauaucacauccugaagacacauuucgcuuuggccuguuugaguucacacacaugguuaaaguagugucagccacaagcauuuguuagucugaggugguaucgugaaauuguaugaauuucuaguccccaacaacuuuucacacaguggaucuuagcaucauugaaaauccaugccugaaucuguuauacugaacuucuaaguuuaucaucguacaguuauuaacuagcauucuucuguuugcaagagccucccgcauauuuuuuaaguaucacuauagaccuguggauauuuuucuuuucuuuuuuuuuccuuuuauagaaacaaggccuccuuuauauugcccaggcuggucuggaacuuuugggcccaagcaauccucccuccucaccuucccaaguagcagggacuagaggauaucuuauggguaguuuucaauuccguuuguuaguacgcuauuauugucauucuuuuucaugcccaaaggguuccaaauuuguucaguggaaggccccuuuccuuuggcauguuccuauuagucugcgagcacuugcuugcucuaagcucaucuuaccuuacuuucacaucugauauggcaguuucuccaaggaccucugauuucuuuuagagaaagaaaacuuuagaaaccaaauucugggggccaggugugcucaguuuuggggcccuuuucagggacaaugcaaaaucaacacaauagaguucuccuucaucuuuccucuacugaauucccuucuccuauuaugagaauccugguuccaaacauaauuauguuggaaaguacauaguggggaccugaguuuuaaaaauagaaaaguguuacuagugcauaauuagauuugggaauugcucuuaaauuggccucuuugaacacuuuggggaacaaaaacaauuuuuuuuaagccuucuuaaaaauuuuaaaaagugugaucauuaagauuauuaauagcauuuuuagagcuuuuuauaucagaaaugacauaacacuucuggacauagagaagaguaauuccuguuuauguggucuuucauacugcuuuuauuaaugcauucugcagauacguggacaguucaaaggcuguuauugagacagcagauagagccaagcugcaaccuauagcuuuaagcuguguacugaauauuggugcuuguaaacugaagaugucaaauuggcagggagcaauugacaguuguuuagagguaagucuguuugauuuugaacuuuuugaauaaguuggauuaagacuuaguuugaauaguagcaacuuuuauauacauuaauauaucuuauugcauaggaccuaaugaggcuuaagaaaacauuuuguuucuaaauauuuuggacccucaguucuuucucuacauucauuuugcuuauaacucugugucacuuaacagcuaugaagauccuugccuuuuuuucucaaagcacauauaucagcucauguauucacuuaagagcaccuauuguguguuaggcauuagaagacaaagucagaaaugauuaagauguggguuauggagucagucaggcauggcuuuuuucuucuucuuuuuuuuuugagacggagucuuacucuguugcccaggcuggagugcaguggcgcaaucucggcuuacugcaaccucugccucccggguucaagugauucuccugccucauccucccaaguagcugggauuacaggcaugugccaccaugcccagauaauuuuuguauuuuuaguagagacaggguuucaccauguuggccaggcuggucucaaacuccugaucucaggugauccacccgccuuggccucccaaagugcuaggauuacaggugugagccaccgugaaguaguuauagagaguuauauaacacaauguaaggcauuuaguguagugccuggcacauuuuaagcaccuaacagagacgaguuauuuuaauuaaaagauccauacccucaagaagcuuaauaagugauucaggauaggagggggucaguuucaauuuagguucaucaggacuuguguauggagaauggguucuauuggaacaggucauuuaucuuuaggaggucauccagguaugcuaacugauaaagcuagaaagguggcaguuuuaccuuccucaaauagagcaauuaugacucucuucccuguuguauaguuugaaaaguuuuccaaaugaaacuuuaagaauuuuacauauuaagccaggcaccuagacuagcuaugcucagagcaaguagaacuaaaaugagauccuaauuuuguaggguagauggaauaagggauaggaauauauuuagaagggaucauacaacagaggaaaaaacuuaucaaaagaaaagaugggucuucacucuggguuuuuuuuuguucucugucacccaugcuggagugcagugaugcaaucaaagcucacugcagccucaaccuccugggcucgggugauccuccuaccucagccuccuaaguagcugggacuacaggcccuugccaccauacccagcugauuuuuaaauuuuuuguagagauggguuuuugacauguugcccaggcuggucucuuaacuccugggcucaagcuguccacccgccuuggccucacaaagugcugguauuauaguuaagagccucucugcccagccucgaucucuuuuugaccugugaggcagguaaaaucugaguauuggccauuaaaagauguuacauaaacaaaagauaauuuuaaaauguuuguucuaggggagagaccugaugcauaaagucucuuagguuaaaagaccuguuguagguaagaaccuagguuggguauggugguucaugccuguaauuccagcacuuagggaggccacggcggcgggcagaucgcuuaauuccaggaguuugaaaccagccugggcaacauggugaaacccugucucuaaaaaaaaaaaaaaauuagucuggugugguggcacauaccuguagucccagcuacuuggaggcugaggugggaggagcacuugagccugggggguugaggcagcagugagcugugaucaggccacugcacuccagccugggccacagagugagaccuugucuuaaaaaaacaaaaaacaaaaacuuaagaguuuauaacuuaagaguuauuaaguuauuaauguuccuaaaaaacuuauaauucaaguaaaaaguguauacaaauguuucuucaaaaugauuuuaucuuaaaaguguuaguucaggcccauucgggagauugaaaccacaguggggagcauauuggaaacuagagaaaugucuuucuccuccauguccauucagugcccucugcugacaaaacuuagugcccacuggcagaggagagcuauuugcauguuucagcuccauuuucacagagcagugaaggauggguuuggaguugauaggcaaugaauugaaaucuggcauauaagcuuaauacuuugauauaaauacuagcuuuauacuuuuuuguaggcucuugaacuagacccaucaaauaccaaagcauuguaccgcagagcucaaggauggcaaggauuaaaagaauaugaucaagcauugguaaauuuuguuccaaauguuuaauuuuuuaaaauagacaacuaccuuuauaaaucauacaccuaacuuaaauguuuuuuuccaauuaaaggcugaucuuaagaaagcucaggggauagcaccagaagauaaagguaaguuggcagcuuuuguagugaaaguuaauuuuguuauuuaaauacuuauccucaggaaccauuguucacuuugccagauuuuagauguuuguucaacagacacuacagaaugccugcuguugggccaggcauuaucauauagcaaugaacaagacagucaaagucccugcccucaaagagcuuacauucuacucccauucaagaauauaguaguuuuucacguuauuuauucuucaaguuaucaucucuguaguuuuuuauaugucuaaauacuguuugucuuaugguauccuuugagacuguguuccuauucugguuagucuagucgagagcucagcauuguaagacacaguauucaugguaaauuuaacauuugggaccauucaaguugaauguggcuauaaccuuaguauugauguacugguuauauguuuuaggaaacuaugacaaaaauaagcuuguuuuucaaauaaaccaacuaugaauagugacacuagaucuggguauuacaaaaugucuuuggucucuuauuacuaaaaugaaacaagggaagcaauuacuguucucuaauguagaggcagaaggcaaaucuugauguacuugaguucucucaguugacauccucuaaaauuacguuucauuucuguguuugugugauugcucagauuuucuguuacuagggcuuaguuacuuuguagagaaguuuuuucaagggguaguuaacauuaaaauaguuuguuagucaccauaauuuuuuggauauuuugagaaauaacucacauugcauauuuauuuuacagcuauccaggcagaauugcugaaagucaaacaaaagauaaaggcacagaaagauaaagagaaggcaguauaugcaaaaauguuugcuuagaaagga

SEQ ID NO: 17240 - RNA, 707 nt, Homo sapiens
gcgguuucucuuuccagccagcgccgagcgaugggcaucucucgggacaacuggcaccagcgccgcaaaaccgggggcaagagaaagcccuaccacaagaagcggaaguaugaguuggagcgcccagcugccaacaccaagauuggcccccgccgcauccacacaguccgugugcagggaaguaacaagaaauaccgugcccugagguuggacgugggggaauuucuccuggggcucagaguguuguacucguaaaacaaggaucaucgauguugucuacaaugcaucuaauaaugagcugguucguaccaagacccuggugaagaauugcaucgugcucaucgacagcacaccgugccgacagugguaagaugucccacuacgugcugccccugggccgcaagaagggagccaagcugacuccugaggaagaagagauuuuaaacaaaaaacgauuuaaacaaauucagaagaaauaugaugaaaggaaaaagaaugccaaaaucagcagucuccuggaagagcaguuccagcagggcaagcuucuugcaugcaucgcuucaaggccgggacaguguggccgagcagauggcuaugugcuagagggcaaaggguuggaguucuaucuuaggaaaaucaaggcccggaaaggcaaauaaauccuuguuuugucuucacccauguaauaaagguguuuauuguuuugu

SEQ ID NO: 17241 - RNA, 707 nt, Homo sapiens
acaaaacaauaaacaccuuuauuacaugggugaagacaaaacaaggauuuauuugccuuuccgggccuugauuuuccuaagauagaacuccaacccuuugcccucuagcacauagccaucugcucggccacacugucccggccuugaagcgaugcaugcaagaagcuugcccugcuggaacugcucuuccaggagacugcugauuuuggcauucuuuuuccuuucaucauauuucuucugaauuuguuuaaaucguuuuuuguuuaaaaucucuucuuccucaggagucagcuuggcucccuucuugcggcccaggggcagcacguagugggacaucuuaccacugucggcacggugugcugucgaugagcacgaugcaauucuucaccagggucuugguacgaaccagcucauuauuagaugcauuguagacaacaucgaugauccuuguuuuacgaguacaacacucugagccccaggagaaauucccccacguccaaccucagggcacgguauuucuuguuacuucccugcacacggacuguguggaugcggcgggggccaaucuugguguuggcagcugggcgcuccaacucauacuuccgcuucuugugguagggcuuucucuugcccccgguuuugcggcgcuggugccaguugucccgagagaugcccaucgcucggcgcuggcuggaaagagaaaccgc

SEQ ID NO: 17242 - RNA, 1782 nt, Homo sapiens
aguaagaaauaaaaaggguuaauauuuaauacuuugguaacauguccuauggguuuaaaaagucuuuuuuauuucacuuauuaucaguuauuaaacaauacuacugacuaaaaauuaugaaagauuauguuugucacucuuagagcaaacaauaagggaagaaaaaaacaagagccuuuuuuucucugcuguuauauaaacacacacaccaagaauaaguagaaugucuuucaaaccaaaacaauaggaaaucacucuuggcugaaagaacagacuuagaucauguugauuuuuucuuuaauccugcuaaagcaaguuucugcaugcuuucuggagccuccaccuacagaguuguuaggacaacagccaacacauauauuuaauuauguaaguauuucaaugcuaucagccagcuguugccagcacauaauacacugcccucuuucacucacucucuugcuuaaaauggcaaaaacaaagcaacuguugauguaacauuaaucauaaaauaugcaaaauacuagucuucaaaaagauuuuggauaucuacaaaacucaguuuugcauuuuaaaauggccuaccaccucugaacugcuuuuucuguugcugauuugcaaauuaacuuacuaaucuuuuaacuguaaguuuacaguuucauuugguuuuuuuuuauguaaaccaggaauuaaacacuaaaauagacuuucuuuuguauuuccaauaaaacugcucacuggcauacaucacaugauaauauucugucuuuccucucacucaucuccauguuuuuccagaguuagaagacaacuugaagccuccaauaggaaauggucagaagcugcucugaacauacauaacucucacccccuacuuuacaaaaaacucuucaucuauguuucuagaaaacuugcuccucaaauaccauuaucaacuccaaacaaacucaugaggaaaaaauuacaaaauccucgcaacaacagaaaauagacuaaacaaaacugugacauaagaugaauaaaaugaauucauucacauaugauagauaauaagaccuaauccauaaacaagaauguauuuagagaaauuuggccuucaucaaaucuuucaauucaauucagugaauaaguaacucaaugcuguucaucaggcacuauucuagagaccaaggauaccucagucaauaacagagacaucacuguccuuuuagaucuuuuucacucaucuuacaaaauccucuaucaagucaaccuuuccaacauuacuacuucuuccccaacagcaagcaguugauuuuuuuuucaauuuuggugguauaucugguguauuuugcucacucucaaaucuggacaauuugaaacucaaauguaagacaaguguucugauauuaaugcaauuauauuacuuauacaacuuacaauguacuuaacauaaauauauuaacgaugacuugaugcaaugacagcauaacgauacuaaacccuuuucccaaaaagaggaaaaaccaguucaaccuaauuauacaaacauguauugaguaauuauaauugugugccaaacucaaggccaaacacuaaccagguuuuuauccaccuuuccuacucucucacucaagacaugaugcuuuaacuaaucuaauggccacagcccugaagcuggcccggagcucauuuaggauagugaggagcacaagauccugccagcaugaccaggugacuacuccaagaagggagauacuccuuuuacaacuucccucaggaauacaauauuagaaguuagaaauu

SEQ ID NO: 17243 - RNA, 1782 nt, Homo sapiens
aauuucuaacuucuaauauuguauuccugagggaaguuguaaaaggaguaucucccuucuuggaguagucaccuggucaugcuggcaggaucuugugcuccucacuauccuaaaugagcuccgggccagcuucagggcuguggccauuagauuaguuaaagcaucaugucuugagugagagaguaggaaagguggauaaaaaccugguuaguguuuggccuugaguuuggcacacaauuauaauuacucaauacauguuuguauaauuagguugaacugguuuuuccucuuuuugggaaaaggguuuaguaucguuaugcugucauugcaucaagucaucguuaauauauuuauguuaaguacauuguaaguuguauaaguaauauaauugcauuaauaucagaacacuugucuuacauuugaguuucaaauuguccagauuugagagugagcaaaauacaccagauauaccaccaaaauugaaaaaaaaaucaacugcuugcuguuggggaagaaguaguaauguuggaaagguugacuugauagaggauuuuguaagaugagugaaaaagaucuaaaaggacagugaugucucuguuauugacugagguauccuuggucucuagaauagugccugaugaacagcauugaguuacuuauucacugaauugaauugaaagauuugaugaaggccaaauuucucuaaauacauucuuguuuauggauuaggucuuauuaucuaucauaugugaaugaauucauuuuauucaucuuaugucacaguuuuguuuagucuauuuucuguuguugcgaggauuuuguaauuuuuuccucaugaguuuguuuggaguugauaaugguauuugaggagcaaguuuucuagaaacauagaugaagaguuuuuuguaaaguagggggugagaguuauguauguucagagcagcuucugaccauuuccuauuggaggcuucaaguugucuucuaacucuggaaaaacauggagaugagugagaggaaagacagaauauuaucaugugauguaugccagugagcaguuuuauuggaaauacaaaagaaagucuauuuuaguguuuaauuccugguuuacauaaaaaaaaaccaaaugaaacuguaaacuuacaguuaaaagauuaguaaguuaauuugcaaaucagcaacagaaaaagcaguucagaggugguaggccauuuuaaaaugcaaaacugaguuuuguagauauccaaaaucuuuuugaagacuaguauuuugcauauuuuaugauuaauguuacaucaacaguugcuuuguuuuugccauuuuaagcaagagagugagugaaagagggcaguguauuaugugcuggcaacagcuggcugauagcauugaaauacuuacauaauuaaauauauguguuggcuguuguccuaacaacucuguagguggaggcuccagaaagcaugcagaaacuugcuuuagcaggauuaaagaaaaaaucaacaugaucuaagucuguucuuucagccaagagugauuuccuauuguuuugguuugaaagacauucuacuuauucuugguguguguguuuauauaacagcagagaaaaaaaggcucuuguuuuuuucuucccuuauuguuugcucuaagagugacaaacauaaucuuucauaauuuuuagucaguaguauuguuuaauaacugauaauaagugaaauaaaaaagacuuuuuaaacccauaggacauguuaccaaaguauuaaauauuaacccuuuuuauuucuuacu

SEQ ID NO: 17244 - RNA, 91882 nt, Homo sapiens
cgaguuucgcgggaggaccuuggcgcguaaaccguaucccuucauucauugucagcagcagcuuccuggagccauuuuucagcugccggccgcagcacccgggcugccgccgccgccucgcaauccguugcaucggccgcccccgacgccuccauccccgcuuggggcccgauauccgugcggccgggacccuccucucuccagagccccgauuauuuuuggcccccggggccugugcggugcggaaaaauaaaaagaaaagagagagagggggcucggaagcgccgggcggggaggagagaaggaggagagacuuggaaacuccgacugcaaauaauaaagaaauugaaaacaauacauuaauauaccauaacacuaaaaagagcaggagcgagagaugagaaagggaauccagcccgcucuggagcaguaccuggugaccgccggggguggggagggggcggcugucgucgccgccgccgcugcagccuccauggacaaaagggcacugcuagccagccccggcuucgccgccgccgccgccgcugccgccgccccgggcgcguacauccagauccucaccacgaacacuuccaccaccuccuguuccuccucccuccaaagcggcgccguagccgccggcccccuccuccccagugcccccggcgcggagcagaccgccggcagccuccucuacaccacgccgcacggacccuccagcagagccgggcugcugcagcagccaccagcgcugggacgcggcggcagcggcggcggcggcggcccuccgguaauacccucccuccccaccguccccagccccggcgggaggugggcucgcaccgcgcggggucgugggcgcgcugcgggccgcucggggagagcacugggccgagcaucgugggccucgggggcugccccuccaacgaggguucauuguuagaccugagugcucuucccggcgccaggagggucggggggcucggccaggcgcgcggggcggcggggauugccuuggcgcgaaccacaucaaacacuccaaaacuuuucgcggcccccccuucuuuuccugcacuuuucccuacccccacucucccuuccccuccaacucgaagcuuccucuuucucgggcguaggaaggggucacgccccggauggagaagggggugggggagggaguagugaacugggguguggggggcucugagggguugaaaccgggggacuguuggggugcuagcccccagucggccuuggaggcucguuggcggccgggggucccugcggcgugcucggagcgcaggggaucggcggggcugcgcuugacacauuuuaggaucuguaacucccggcaacaaaggggcugggggagguggaggggagucgggcgugggggagguggggcuggaagccgggugcggacuggggcgugggcugucuggggugaggggcucgcgggcuggcgcucuggccugggcgcauccuggcaguggcagcggcggcgcccgcguggcccaagcgcccaggccuuccucgccgggccccgggccugcccuugacccgccucuccccuugccccuuccuuccccgcccugucccccucuccgccccccggcgacggagggcgggggcagcuggguucccgucccgccgccugggucugucccucucuccgggacccgccggugacguuucgcacacgugcgcgcaggacgcgccugugacuggggaggaggcggcggcgggagggggcgcuggagggggagaggggggcacccacuuccuccugcucgccggcucccuggccugggacggucccggcgcccucgcacccgcccccggcaccgccacccucccucuccucuccccacccccccaccggcgcccgcccucgcccugcgccgccggucuguucggcccuccgggcccccucuccagccggccccccaccuccccccggagccaggcugguuucggaaaugcccuuacagcagcagguuagugaccgggacggcucgggggccgccgacgccgcgggggcaccggauucuguugggggcugaagcggugaggguaggcgguugagcgggguuuuggagugggaacgggggguugggugcucgagggaaaugaguaagcaagaaaaaucuaacuaaguaaaugccccggccuccgguucuaggaaccucggggcgggagugucugccccaggggguggguaugguguuuacguggauuuuuuuucuagggggcggauggaugggcgauagaaaaccggagggggcuucucgccaauggccgaguugagcucuguuuucugucuuccuucccuugugcuggagggggaggggggugggucagaggguagggugucuguaggauucccaggccacccgccacccccucccuuugucccuguaauuuauaaagcgccuuugagagaugauuuaggucaguaugcggcuucucuuuuuguugguacuagaaagaaguguggcccggaggucuccccuuucuccuuuucucuccuucauucccuuccuccaugccuccgggucuucacccucguggugaggcuuggccuccacggggcuagaaccgaaccagacucaguuagauccaugguagccugauuauaccaggcguggaccucaccuugucucagcuccaaauggguuuaauuuuuggagaaucaagauuuugcgggagucuuuaagaaagucagcacauaggcagcacuuugggaaaugggauggguuugggaauaaugaggcguuuuuuauuucuuuccuguucccaguuucuccccggguucggucuuaacugcuuuccagccccagagauacuugcugggcaugugugauguagucuuagucaaagaagcucaucguuuuuuagugacuagggucugccagcaggggggaaacggagcacaguaccugcuuagacauagcaguauccggugugcuggguuuucagucgcaagaauauuccaugcuuuuauuagcuucagauacucuuacugacuugaccuaagcauguuuggacauauuuuaagcauauuugaccccugcacaguucuguuacuauuucauaaaccuaaccuuaaacaaccagcuauugacauacuucuuggauuagauucacagauuugcaggggguaguuuugauaaugggaaauuaugagagcuucaaguugauuuuuaaaaaauuuuaacaguguuuguugggccaggucccuaagacuaucuuucaagccagguuuauuauaucuaguucauuguauuuaaguauuuaaaguauacuaaauuacccucaccaucuuccaaguuauuucaaaacuuuauucuccuugacaugaaauuauuauuccaggaauaauaauauccuuuugaguuuaugugcacacaaaagguuuuucauuacaggaauauaaauguuacucauauacauauucagaagcauuuuuuauaugauugcaauguaugcugaaucauugguuaucugcauuuuuuuuuuuuuuuuuuuugagacggagucucauucugucgcccaggcuggagugcaauggcacgaucucggcucacugcaaccuccgccucccgaguucaagcauucuccugccucagccuccugaguagcugagauuacaggcgugagccaccacgccuggccgguuaucuacacuuuuaagagcuauuucuacuggccgggcgcuguggcucaugccuguaaucccgguacuuugggaagccgaggggggcggaucacgcggucaagagauccagaccauccuggccaacauggugaaaccccgucucuacuaaaaauacaaaaauuagcugggugugguggugcgcgccuguaaucccagcuacucaggaggcugaggcaggaaaaucgcuugacccugggaagcggagguugcagugagcugagaucccgccacugcacucuagccuggcggcagagcgagauuccgucucaaaaaaggagcuguuucuucugggaggguguaggaaauuuaucuagucaaugcauacaaagucuuaagcacugaauauaaaguuugauuuauuguuuuucuuaucgaaauuauauuagacuuccauguaagucuucgaauuuugaauuuuguugauauucuuucccuaagcaggaaagacaggauggggaaagcuaagugauuggcugaacaaagaccaccuaaacacucuguguccaagaagagguugaaaagucuucagguggccagaguugcagaccuaucugguucugaucccaaguucugucucaagaauaucuaaggacuuaaccagaagcaacuucuucaccuuuuuuucaauggggguaaaaauaugaguacuaccuuaccagcuguaaagcaucuauuauuuacaaauuguauguucauuggcaaauaacuuaaucucucaacucaguuucuuccucuguaacauagggacaaaaacagugucaccuuuaagguucuuuugaagaguuaaauaugauaaugcaugugaacuauuuagcacagugccuggcaaaaaguagacacccaguacaauucauauuuauuauacaaauguuaauuuuuuucugacuuagugaaauaguguaaggccaggugcacauugucccuuuguuuacauauaugaagagaacuguuaaaagucuuuaagugaucuguaauuaauuauuuaugcccaauuaauuugggcuuuuaaauauauaaaacauggccauccuagggguaaaauagggacauuucaguaagacacgccuauauagagauagugguguugaacugccaagcauaugccuugaauugugacaauucaaggccacaucauccucacuuuuuugccugaguuccacuccguccaugauuccacagaccugccaacuuuugggugcaguuuaugcuuagcggcuuuuguuagaccugaacucucaaucuucaccaugucagagacaugcauuagacaaauuccaucuuaguuggugaacuguuggaaauguaagaacuccagagaaaccauagucagaagugcuacucaauggagcagacaaggcuucaucauuuucugcugcugcuucuaaaaagaagcugaaauuauuuuauucuagaaaauuugggauuuaauaauguaagagacuauguccugucacagucauagcaaccuacugauucuacuuugggaaagagcccucagugcuugaaauuuucaucuaagaauggagaaccauaggugcuauuucagcagggucucuuuuccuguacaauuauaaaaagaaaagugccggguuccugugguucuauacucaauaaucuugcuucugcugagauauaugguugaugccaaguuuaagcugggagacaauuuuuagucacuacauaccccaaaauggaaguuuuaauauaaugcagugcccagacuugggcacuacagguagcuccacuauaaucaguaccaagggcgccacucuaaucauccucugaaacaaagcacccuuaaauauggcacugugggcugaagaacuccaccuugugaacaggaaaggauuuuuuguuuuucuauaaaucgccaccuuguguauuacuuggaagaauggauucugagauuaauguuauacuguguaaagcuaacuugaaaacagaaaauaauacucuaagccuagacgugcauaaauaacauuaccuggagauugacagacggggugaaagcuuuuauugugguuucucagaaauauauaaagcaguaguuuuccuuuaacucuucugucuuuaaugccaucugcaaagauauaucauccauaccuuuaaccucuuuccuagggauuuggacccauuuggcaaauagcuucaaguacucauaguuaauuuucuggcugguuuuccuaaguuaaccugauuuuacaaauauuccauuuguaggaccaguuuacaucuacuuucccaagcuagccaacuucaauucccuuuuagucaucuacuuccuacuaacagcuguaacuaggaugagucaaaaucaauugccuaugcucaccagaucccugauaaauucccaugaagccaccugaaaggugguaaaagcaagguaaaacguggugaaagcaagguaaagaagguagauuucacaauuuuguuuuuuaaaaaggggaaucuucccugaauucuuugagguacuaaguacgugguuuaaugcauauuuucauucuuguuagcaguuuaaaaauaauguuucagagacuguauucacgauugcuaaaaagcauuuuuucuacuaaucauuguucaugggacuuaacaauggaagauaacugggaaagcaguaaauauaggaaaccacuaauagugucuccuucuuccuacccugacccucucuuuggcuucagaaagugacgaggaaaauguaucuuucacaaagaaaaguuauaccacagaagguacuaaaaagcaacaacugccuuuggggacaggaaacuuacagaguggggauuauuauagagggauaacauaccgaguuucuauuucaauaagagggaaauugguuuauauucuguucacacuuguuucaaacccucuccucuaaaagcaauguguuuuuggaauucaaggaauguacguucuuuccccaaccuuaacugggggucagucuuauggccaccauauuugucuacaauauaacuuuuaaaaaauauaauuuuugcccucaaauacucuccuauccaaugcaauguaacuuugaaggagaagugaugaaggccacugguugccagauuguaucacacagccagaugcacuuugcuuugaugaagaaucuaagugaugcaggcccccacuuagcuuuguaaacuaaggcagggguuuaugucagcucgagguagaaagcagugagaauuggcagcugauggaauagaaaggggacaaaaagaauaaaaaauaauugacuuuagucugcuuuccauuaccguagcccaacucucuggggccauuuguguggucuagacaacauucuuagaacuugacagucccugagaacgauauucuagguuggcaugggcaauaguuggcauuuacacuggucuuggaaucauaacauuugagaaguguaaggcacaagaguccucaucugcccaauccccuucauguugcaggugaggaaauucaggcccagugcuguuaaauuacuugcccaaggucacaggucuuugcuaguggcaaagccaaaaccgaaacgggagacucuugaauucuuagaagccucauucaccaagagaagguuaacugugucucaugaacccuauaugggaaaauugggguguguaggacacauuuuagauuuccuucaggagugguuaccuuuuuuaaaaaugcgcacauaaagaaguguccuuuaaacaguuggcuguggggguaaugacuuauucccaaagauacaaaauaagcaaggcuacuuuggauguuaaaugaaagggaauuauuuaaaaaaggaaagaaugacucuucaaaacgugauaguaauauuuuuaaagauuuauuugauauucgcaaauuugucuucugugguuauaucaauucuguugcucaaaaagugacacaugcuucauagagaauagaaucuaaaaggauuuuugagacuuucuuggggagaaggacacacagugccccucugguaguaacggaguuuuguccugggccaccaacauccugagugacugucaugcuuucagagguccccagcccuugcccaguaacauugaacaagguguucuuccucugugguuagcuccaagauuucugguuuagcaaaguggcuaaucaguuaacucuuuaagaggaaauugucauuccuuuagccaacgcuaauuuccuuaaaaugccuucuuuuccuuuuuggaacugagaaagcuuaaaaauagaauugcuucaagcccugaggccugaaagugaaacauaaucuaacguggcuguagugcacugacucguuaggggcagcgauauauggcuuaucuguaauccacaaaccagaaaggugcccaguguagauacggucuaacagccagugagcauuaaguaccaacugaugagaguaguaaucagugaagcugauuuccucuggaaaguuuuuuggcgaguagaguuugucuuagagaguggaggauuugaaugccucuugacuuucugcugaggagagcuucugccugcucuaguuuuuaugauccugaagggugguagcucuggacucugagaaugaugggcagugaacucagggucuguauauuucguuccacucugcucuuccccauuucugaugcuuugggggcuccauuucugauacauaaccagagcagcaucccugaggcccacacuaucuccugugugccuuucugcaucuggcagucccuuggagagaaggaggcucauguguuuauaaccugcacccuguccuaaaaggcauagugaggggcagcugaguauaaggucaggccacuuagccuggagccagagugccuguguucuuguucuggcucugcucacuagcccugugacuuugggcaagaaacuuggccucuauguuuucauuuccucaucuguaaauugggaggaaugauaguaccuaccuuaugggguuaggaaguugcaaugaguucuuauuuguaaagugcuuagaccagugucuggcacguaggaaggauuauguguuaaguagaaacaugguauaauugcccuuccuuccacaggcaucucaugggcuguccuuuugugauccauuuucuugguuuguuuuuguuuugagaccaagucuuguuccguugcccaggcugaaaugcaauggugcaaucuuggcucaccgcaaccucugccuccuggguucagccgauucuccugccucagccucccccguaacugggauuacaggugugcgccaccacgcccagcuaauuuuauuuguauuuuuaguagggacgggguuucaccauguuggucaggcuggucucgaacuccugaccucaggugaucugcccgccucggccucacaacgugcugggauuguaggcaugagccacuguuccuggccugaucuauuuucuuaacuagcccuuaguguucauuucaccccauugcaccucucuaaaaauggugaugaugggaaggagaaguaaaccguggaauggcucucgccuaaugcagucuuuagggucuagggucuuuguauuucuuuauaagcugcccauugacuugggaaaaagaacugaagaauaagcuucuuguaguagugcuaucaguagugauagugucaugaauaaaaccuuuauuucugugauuaaauguauuaauaaagugacacuacuagcaugaaugacacuauuaacauaauuucaauccuguacaguaaaccauggcuuaagacugaauggcaagaaucagggugucugagcugcugggcccugccagacucggagccccugccaguguguguauaucaaggcagggcgggggguugucuugcucuccagaggcaauggaaccugccucuaggccucccuuuucccuucucaucuccucaccccuccuuuuuuauguuagaucuauuccuaccccuuccccuucgccuugcccucugccuggcucuuagaaggaagcagacuugccaccuucaguggcugcuucccggacuuaccaaauuaauuaccaccuuuuccugccaucaagggauggugaaaucuugccuuuucggucuugcuucccauuccucugcacucggcugcugcgacaguguggugcugcaggcaccgcagauuucccucugguguguuugcucguagcuucucccucuccaccuuacuccuuuuguugcccuccucccacuggcccauugaggcccacaucaagggaaggcguaggcacagccucccccaguuucccaggggcuugggccucucccuucccuuggguuacugcuucuuuccuguaacaccucauggucugccucguagccuaaucuugcauguucaugacuuacuccuccuccaaaccuguaagcuccaagaaaucggucuggcuugcuuuuucaucauguggucccugcagugcccacuacacuauaggcucagcuaccugagaagaggcauuuucauuagacaccuuccaugugcuugguaccccauuaguccuauuggggauacaaaagaaguaugaggugugauccgcccacucuugaguuuacagucuguugaggagacaagcuuuaaacacaaguugaucugcaagcaagacuaaacaggcgguagggagaaaacaagacucaucuaguccucaguuguguggugucgacagaaagugccagaggaacaggugagagucaccagacuccagcugggccgugagauggggaggccacgguugucaaucuuggaguacauuagggcacacaugugaaucucccagggcgcuuuuuaaaaauacugauaccuaggccccacccagaccaaucagaaugucuagaggugagauuaagacauggauuuuuuuucuuuuuuuaaugugcucaguuggaaccacugggcuugguggaaagggaagauuggggaggcccuuucuggcggggagacauaagucaaaggcaggcaggcagaaagauuggcgucaggaggcagcauuuggacuagagucaucaguauggggagauaacaggaccgaagguuggauguguuggcaaaacugaucuagaauuggaguugccuuucuacaagggcugggcggggaguagauugggggugggaaguuugagugguguggggauuguucacgaauaaagaagaaacguacuaucaaaagggggccuugggaccuggucacaggcagugggugccagaggggauggcaggccuuguguuuugccaggucuucaaccuucucaaaaugccagaaaucuaccaguuuuaaaauguuggcugaauuuaaaaggaaauugcgcaggccaaacaaaauaggucucuaggccagauuuggcuuaagggcugccacucagcagucucuggucuaugggauaauaauagcuaauguuuaucgagugcccgcauguaucgagggcacuaaacuaagugcuuuacucgcauuagcacauuauccacauaacaaccuaugaaguggguauuauuaucauccuuguucuacacagggaagcagacagccagggguuaauggccuggcucugggccccauuaauaaguggggcaacugaaauuaaacccaaggagccuggcuccauagucucagcuuauuccuaguauuuauccucuguggucucuggcauuguauuaaguaguaaaaauccaagauaccugucaaaaagaaauaauccaguguuuuucaaguuuaccugauugccuguagcacuuguuacagauucagauucccaggcuccaucccuauccucugucagaagcccuaagaucuucugaugaaacauucuggaagcacggcuaguugagcacagggaaaaguuacugaaacuagauuguccaggugaaggcaggagccuucugccacauccauucacauaaugcuuaucucagcucuuccucguuuggaaagaccccagggccccaagccucauaccugcucucgugguuccaaaacuugcagacucccagguuguagcccaggcaaaccauacaaagaugggucucccaaaacuuaaaagaugugaaacaagaagugguuucuuggauucucaagcgguugagaauccgagcucaggaggucaaagugggcuugguggcuagacgccaggcaccagcaccagcuggguacccuugagugguuuuucugccuuaacaguaggaaggcuuuucauucugucuggucuggaccugccugaaacacagcuaaccaaguggacagagcgagaaaugugaauacgaggaccagagcacaccauuuagaguacgggcgcuauugaguugaugagucuggaagcaggauggcaacaaugauggugugaaaaggcagguggaagugaagggcagauuaagggagaaaagaaauacaagaccuuugacucccaaauauuuaacuccaggggcuggaagaaugggugaggccaagcuucuccucugucuggggugugcacuguguggaaggcaugauuagucagaauggauggggugguugugagugacuccaugggccaucccguuuucugaggggcuaaggcugagcaccggaagugggacuuuggcauagagguuauaguggaagucuugaugaacaauagcaggccaagaccuggucucccuagcuuacaaauaaaagaaauuuaacauggugccacaaaaaccuuucaucauuuucacuucuuccucuguaauaugaaaacgagacaaauucaucagguugauuuuuggggaucgaugcugucagggcucgcagagacgagccaucagauguuauuuauuacaugcuuuaccccgucuccuagcugcugugagaaagcccacaguuugcaaccucacaaagcaaagagccagcuggaaaguacugugcauccagacaggucacauagucauguccugaaccaagauagcucuuuuugccaugauuuccuacacucucugauuuuucucauuaaaaaaaaaaaaucuugaauuuauuuucuuaagcucuagcauucuaaaguuuaaacauaugagccuuugaauacuccugucuaggaaagagccguguaaauucuaaguaucucuauaauugacuuuugauauguuacuuguguuuaaacccaauuugcaacaccccuuuuguuggcuaauuuugucgcuauguuggguagcagaacuugugacgaucacacuaauaacauaaaguuucccaccuuucuuguugcuguuuuccuuguuagcaucucagacuucccaauucugggaauagucucuaggaggcaagguuuucagcuuuggaaaugcaugcgugacacaguagugugguauggaaggcguguggacuugaagauccggcuccagaaacacgcucugccaauuaccgugugugaccuuuuauaaauuacauccaugagcuguaguuaccuaaaauagugauccucucuccuucacuggcuggaaggauuaaaugagauaguguuuauaggaaauguacuuuguguuccuuaguugccuccccccgccacuccccgugguaggaacucuugaguacuugucaaaucugaacucucggcauuuuuaccuccuucagggaaaacuauuggacaggcucuuacugaacacccgcuuuugugcagaaugcacuuccugauacucugggaguuucagaggcuacuaagguguccuucuggcccucaaggaguucaucuggagacagggagacgacacauuuucuucaauaacuaagaaaagaaagggcaaugaagaccauaaggaaauaacagugaaguuucuuaggcauccaaacuugauggaggggacaaaggaggcuucaggaaguuuuaaacuagaacaggacuucagcgcucuuaacauuuuggucagauacuucuccguggugauaguuugugggcaguuaacagugguggagggcuguccugugcauuguagcaaguuuagcaggaucccuggccuccgcccacuuagaugccauuagcaccacuaguuaacaacaaucgaaauuaucuucacacugucaaauguccccgggaagcaaaaucacccccagcugagaaccaccgaacuagaccuugaagaaaggguagaagaggauaucauguuugccucuucuauauauaguacauauuuaaauuuuaaaauaugauauacauuuuaaaagcaacggauuucucauagcuggauuaacuuuggaaugccuaaccaccccauggcaccccagaacugggauccacugccccuacucuugguagugcucugugcaggccaccuaagcccugucuuuuuuaugaugaggcaugauauuaauuggcugcuggaagccucucuaacuugcagaagaaaggaucaaagucugcaguucagggaaggaaguuuugcauuuaucauugacccaacuggguaauuuaagagcgacuuucugcucagggucaacuucucagugugguuuuuaaucccacuucauaguuagaugauuuggucacaucacuuucccuccaaaccccauuuccucgucuguuaaaugaggaaaaucaugguucuuaccucacagaguuacuguaaggauugaaugcaauaaugccuguaaagugcuggcuccgucccuggccaugugcuaaacacucugacauuuguugucuuccucauguauaucauuauugugguugucauuaaguugggcuuccguuucaggacaguucaacaguaagcagccauucccuuuguugcuggugcuucugcagcuauuuuccuugcucaccuauacccacgcuggccccaguuucaaccacagggccggcugacccauuuauuuagcagauagguguuaagcaccuagcauaugccagccaccauucuagguaccaggaauacagcagugucagaacagacaaaauucccugccucugugugguuugugucauaguuggugaagauuuugccacaucauaaauacccuggucuugucuuugauggguucuuuuucuuuuauuuuuuaaaugguucuaaguauguggugcuggaccagcagcauuacuugggaacuuguuagaaaugaaaguuuucagguuguacuccagacccacugucagaaacucaggaaguggaagugggggugagcagcacugguguauggcuuaacaaguccccaacgucauuccaaugcaccaaguuugugugugaaucaguguuugggaaaagaaaggaguagggggaaacccaggccguaacugggcugcaauguuauaugguaacaucaaauaagguguugcucauaucaugagauucuaguaacaucagaguuuacaaaggauagucuuagguacaccaagacacuuaaaacuagcaguacccuuugaucucuuuccugggccuggccaccccuccuuuaaaugggagggcuuugggaggccuccuaagucaccacagcacacgggacucagcaacagaaauucuuagccuucccuaggcuuuuccuugccugauauacaaggaaguugcuuuccccacuuuucuccagacuucuggcauguuugacaauuauuuuuucuuuuaauuccuucaguuuuuauuggcuucuuaccuggcaucauuaaaaaauuuuuauagcugcaaucaaauugccaacuggauggacaaggcuuaucugaaaaugaaaugguagcucuccuuuguaugucugguaauuuggguauuuaaagauacagugaaaaguaaaugaaaugagagacuaugggaaaguguccaguguggagcugggcacagggugaccguuugauaaaugcugguacagucuuccccccaaucccaacucauuauaaaaaccaauaaaggcauuaaauagacaccacgguucuuugugugaaaagcuuuggauuacauacagucugaaugagugaauaccauaauguaaauuguaaccaaaauaauagaauccaaaaucuuaaguaaugacuuugaauaaaaauaaguguuuuaaaaguuaguaacuuuuuaaaaaauaaguguaauuaaauaaacuuuuaaauuuaaaaagauguuacuugauuuuuauuuccugauaauggauuuaaaaaaaaaaaaaaaggcccagaucagacuggcagaaauacuuuuauuucugcacuagcccaaagccuggauaugcuuauaaggcauauaaccuguccauuuaacagcugucauuuaauucacaaacacuaauuaauuacagccauguuaaaagggguguuugggacgguuugguaguuccuuuugaagaaaaccugugucuugaaaaugcauaugaaagauuaccagguucuguuauauauaguccagguucgucuuggugguucuauucgaaaaauaucucucugaccaucggugggcauuuccucucucuuucugucuaccuacagccaaaacaaguucugguuacagugacaguuuuaaguuugccauuugugguugguucuauuauagaggcugggggaggaaggcaagcaguccucacuucuugcuuccugccuugcucuagaguguaaggaucagcuucucuaaucccuugacuuuucacugcucuauguagucaggguagacaagggguggcccucaaacaacagccaccucuggaggucuagcgugacuaaaccacugucuucuuuuccaaauccagcacuggggaccgacgugugggccucccaucugacuuguggagugaaagaaaugggaauagagcagcgcuguccauauagucgaguuuuguaaauauuugucagauggaacuagagaugcauuaucacauucgacaguaacaaguggcaaguguugagcucuuuuaagucuugcuuuuuauuucuuauaauaugcaaauaacuguuaaaauggccagccaguuggcugucuguuuuagcuaagguaggucucuugcaauuuuugcacccuagggagaucucaauaggaguaggucuagcccuaaacugugcaggauuaggaauucugauuuacugaucuggagggcggcuuuguguuaaucagaguucuaaaggcggacaaacuagacugugaacuuaauacuuacccugagaaguauaacugccaaguggacaguugcagaaauugguuauugccuguguucucgaucagaagguuauuagcugugucagaguaaaggcauugaaugaucccauuaguaccuuccagcuguggucuccucucuagagcguaccugcaggggagggaguacugcuagccacuuauggagcauauggacacugucauucacccacccagguguccaguuccaugacucuggugugaaacacugaauuuguuuguuaccuuuuuuuuuuuguaagaaaauacuuguuuuuaguaccugcuuauuauuuuuuuaaaauaaaaaauauauaaggaaguggagugaaaaugaaaauacuuucuucauucccucuugaucuugcuuccuucccagagauaaccacaaucacagcuuggccuuuccuuuuuauaaucauuugcaaaucuauauuuuauuuauauaaaaguaaaaaugauucaaaaauacaaaagugcacaucguggcuugcccuuuugcuuaguauuuccagagacguaauucccuaucuguauauauuguugcucauuauucuuuguaauagcugcgcugccacucguuauauagauaugccagaauguguuuaguuauucccauuugauggucauuucugucauuuuucauuuuaacuauugcuauuaugaacagugcuacauuggauaucuauguacauaaguuuuugugcuuguguguauuucuguaggcugcauuucuaagcguugaauuuuuauaucacagggcauguauauuaaaaugcugauagauuagauagguccaaauuacccuccaaaaaggcugaacaaauuuauauucccaccacaaguguagagaguugccuguuuucucauacuuuuuccaacacuagguaacauuagucuuuuugcaguugcugcucaugcuagauaguaccuccuuuuauuuauuuauuuauuuauuuauuuacuuacuuacuuacuuacuuauuuugagauggagucuugcucuguugcccaggcuggagugcaguggcaugaucugggcucacugcaaccuccauuucccagguguucaagcaauucuccugccucagccuccccaguagcuggacuacaggcgcacgccaccauggcuggcuacuuuuuucauauuuuaguagaguugggguuucaccguguugcccaggcuggucucaaacucuugagcucagucaaucugcccgccucagccucccaaagugcugggauuacaggcgcaagcuacugugcccagccaauuuuuauuuauuuauugagacagagucucauucuguugcccaggcuggagugcaguggugcagucuuggcucucugcgaccucugcuucccgggcucaagugauucuuccuccucagccuacugaguagcugggacuaguggcgcaugccaucacacccggcuacuuuuuguauuuuuuguagagaugagguuuuaccauguugcccagccugccuccuuauuuuacuuguauguuuuuuaaauuauugcugcugcuaccaccaccaccgcuacuauuacugcuacugacuaauguuuauugaauguuuuuaugugucagggauaguuuuaagcacguuauaugaaaucacuaauuuaaaccuuaacaucucuauaaagugggugugauuauuguccacauuuuacagaugaugaaaaagacgaauuaguaaauuuaaguaucugcccuaauuugcauuucugugaguagccucuuugaauucuuuaucauuuuugugcccaaggcuauuuauaguuuucuuacugaauuauuggaacuuuuaaugaacuauagauaaugggcuuucucugguguguguguguguguguguguguguauaguaaauacaggcauaccucagagauauugcaggucugauuccagagcacagcaauaaagcaaaugucacaauaaagcaagucauauggagucuuugguuucccagugcauauaaaguuuacacuguacuguagucuauucagugggcaacagcauuauaucaaaaaccaacguacauauucuuaacuuaaaaauacuauauugcuacaaaaugccaacaauccccugagccuucagcgagucaucuuuuugcugguggaggguuuugccuucacacugaagacuguugcuguuuagggaagaagucauugaaugcuggggcagcuguggcaauuucuucacauaagaaaaaaucaaguuuuccacauugauugacucuuccuuucauaaaagauuucucuguaguaugugauacuauuugauagcauuuuucccacacuagaccuucuuucaaaaucagaguaauccuucccaaacuguccugcugcuuuaucaacuaaauuuaugcaauaucccaaauccuuuguugucauuucaacauuguucacagucaucuuccaucucaagaaaucgcuuuauuugcuuauccguaagaagcaacuccucaucuauucaaguuugaacaugagauuguagcaguucaaucaccuauuaacgcuccauuuucauucuaguucucuugcuacuuccaccacaucggcaguuucuccacuaagucuugaaccccugucauccauaaggguugggaucaacuucuuccgaacuucuguuaauauugauauuuuggcuuccucccauuaaccaugaguguugauauuggcaucuagaauggagacuccuuuccagaaaguuuguaauuuacuuuauccagauccuuuggaggaaucacuauuuauggcagcuauaaccuuacaaaauguacuucuuaaauaauaagacuagaaauucaaaauuacuccuugauuuaugggcugcagaauggauguuguguuaccagccaugaaaacauuaaucuccuuguacaucuccaucagaguuuuugugugaccaggucuauugucaaugagugguaauauugugaaaggaaucuuuuuuucugagcaguaguuaucaacaaugggcuuaaaauagucaguaaaccaugcuguaaacagaugugcugucauucaagcuuuauuacuucacugauagaucacagaguagauuuaacauaguucuuuuuucugaccugggcugguucaccccuccuuaggcaaccugguggucccccacucccaggaggucgccauauugaugccgaacuuagugcggacacccgaucggcauagcgcacuacagcccagaacuccugggcucaagcuauccucccaccucagccuccugaguagcugggacuacaggcaugugccaccgcgcucggcgaucuagcauaguucuuaagggcccuaggguuuuugaaaugguaaacgaucauuggcuucaacuuaaugucaccaauugcauuagccccuaaccaaagagucagccugucuuuugaugcuuugaagccagauauugacuucuccucucuagcuaugcaaguacuaagugguaucaucuuccaauagaaagcuguuucaucuacauugaagaucuguuguuuaggguagccacuuucaugagugaucuuagcuagaucuucugaauaacuugcugcuguuucuaugucagcacuugcugcuucgcguugcacuuuuaugauauggagaaggcuucuuuccuuaaaggucgugaaccaacuucugcuaccuuccaaccucugcagcuuccucaccugucagccgucaaaagagcugaugagauuuagggccuugcucuggauuaggcuuuggcuuaagggaauguuguggcugguuugaucuucuauccagaccacucaaacuuucuccauaucaguaauaaggcuguuuuguucucgugucauuuguguguucauggaguaccauguuuaauguccuucaagaccuuucccuucacauucacaaccuggcuaacuauuuggcacaaguggccuaguuuuuugccuauuucagguuuugacguacauuuccucaccaagcuuaauaauuucuagcuuuugauuuagagggagggaugugugauucuuccuuucaccugaacacuuaagagaccauugugggauuacuaauuagccuaauuucaguauucuuguuucuuaaggaauagggaggcccgagaagaggguaagagacaggguacagcuggaagguggagcauucagaacacgcacaauggcuaucaauuaaguuugccauuauauauuguuacuaaacauuauuuagugacauuaguaauugcaauagugacaucaaagaucacugaucacggaucaccacaacagacauaauaguaaugaaaaaguuugaaauauuacgagaauuaccaaaauuugacagagauauguaguaagcacuguuggaaaaauggugcugauagacuagcuugaugcaggguugucacaaaccuucaguuuguaaaacacugcaguauccguggagcacaaugaaaugugguaucccuguauuguuuugcccaagccuauuauguuucuuuugauuuuucuaugauguauuucuuucuacauauguuuauuuaguuuuuauaaugucaugugucacuuaacgauggggauauagucugagaaaugugucauuaggaaauuucaucauuuugcagacaucauagagaguacuuacacaaaccucaugguauagccuacuauaccccaagguucuauggucuagccucuugcuccuaggcuacaaaccuguacuguauguuacugggcugaauacuguaggcaacuuaaacacagugguauguauccaaacauagcaacaguauaguaaaaauacagucuuauaaucuuaugggaccacuggaauauauacagucugcugucgacugaaagcaucauuguuuggcagaugacuacaugugacauuacagugcuuuuuuuuugagaccaagucuugcucuugucgcccagguuggagugcaauggcacgaucucggcucacugcaaccucugccuccuggguucaaccgauucuccugccucagccucccaaguaacugggauuacaggcgcccaccaccacacccagcuaauuuuuguauuuuuaguagagacaggguuuugccauguuggccaggcuggucucgaacuccucacgucgugaucugccugccucggccucccaaagugcugggauuacaggugugagccaccacacccggccauuacagugcuuuuuuugagacagaguuucgcucuuguugcccaggcuggagugcaauggccugaucuuggcucacugcaaccucugccucccgaguucaaccgauucuccugccucagccucccgaguagcugggauuacagguaccugccaccaugcccggcuaauuuuuuguauuguuaguagagaugggguuucaccauguuggucaggcuggucucgaacuccugaccucaggugauccacccaccucggccucccaaagugcugggauuacaggugugagccacugcacacagccgaaauuacagcuuuuacaguuugaguuugguggcuugcuuugggaaggccuuuccuaaucugcaaaccauaacaauauucuauauauuuuuucuccuggcuucauaauuuuauuauuuugaucuuuaaccucaguggaaggguguguguguguguguguguguguguguguguguguguguuuuaaaggugugacuuuauuuuuccuaaacgaauagccaguuaaacuagugccauuuauuggaugguuccgcuuuccccacgcaugcacuugaaaugcccuuuucucagagagacacagagagaguguguguauguguguguguguguguguguguguguacaugcauacaugcauguaugugcugugugcaugugugucuguguuguucugucucugaacuuucuacucugcuccauugauaccuuuaucccuuuguaaagaagcagcacacuguuuugaauacaguagcuuugugauaugauuugcuauagauaaggaaaaucugcuuccuguuacauacuuuuuuuuuucauuaaaauuacaguuuuuauguucaugcuuacuugcauuuuuacaaauugagcuucuucucccccauccacugugaguuuaggguuauaagaaaaaaaacucucugcacuuauuagauagucuacugcacugggaauagcaguaagcuguuuacauuuuuucuuucaucugauacaacaaaccuugagaguuggugccaauauccucaucuguagaugaggaaagugaggcucagugaugaagcaguuuguccaaggcugcauuucuggacauuggcagaaccaggguuccagaccaaguccaggaaauuucgaaaccucucuuaaccauuaugcaacccagacacgugggguuuucucacaugacgagggcaggccauugucuagggcggguuaucagguguuucuccauguccugcagggcggucaguggcuuuuacagaguagaguguuuauugcaugaagggaagaccuagcaagaucucucuaaaggauuuauccauuggggcagcaagaguugaaaaauuuggcuuugccaaggguauuuguucagauuuaggauacaagucaaguugggaccacaggcuaaaguuuaagugaguggggagagaaauuauuuacccagugcuuuuuuuuaaugccagacacuguaacccuuccucggcucuuuucuagaguugggucugugguuuggaauacaaaggugaggaauacacagcccuggacauucagaauggggcaguaggcugggaggagcugugcgcacaaccccaggaaccuucuacuuuuuuuuuuuuuuuuuuugagacaaagucucgcucugucacccaggcuggagugcaguggcacgaucuuggcucacugcaaacucugccuccuggguucaaccgauucuucugccucagccgccugaguagccaggacuacaggcguacgccacaaugccuggcuaauuuuuguauuuuuaguagagacgggguuucaccaugucggccaggcuggucuugaacuccugacccuaggugaucugcccgcccgccccgccucggccucccaaagugcugggauuacaggcgugagccacugcgcccggccccuucuaccuuuuagaagaaaaugcaacaacgugucuuagcucucuaguggaggaacagaggucucagguggauccagaaaugcuuugcuauagaguggcauuuaaacugggacauucaugugucuaaauuaccuaacaguuugagcccucccuucccccgaggugguugcuucuucauuugaauucucucaggugccuucuguugguucuuagaggugaacaucagaaaaguaauuuucuuuggagaaguuugaagcagccucccaaacagaaguccuguugagcucccacugggaguuuuggaaaaguaaucucauuuauuaggaauaguguauugauuuuguguguaaaauggacuaagaggccugugacaaugaguccauuugaaauugcaaauuuaaauaucuaauacaauaguugugcggaaauacuacaccagaauauaaaugauuagcugcuuagugaauuucucaugugcauguaauuaauuggcaguggugguggggaucaaguuuguuuucauauccugaguccuuuaauuuaccuuuucuucaacaauuacugguguaaguauaggggaauuaaaucuuagugucuuuuauaaaaauauauaguuuugcuuugucauucauuuauuguuuuuuggucuacauuauccaauuuuguauuacacaauagaaggcaccuaaucaaagauuucuuguuuuuacugcaugauugcacucuuaauuuugugaaagcauagguuuacuuccagacugagagguaaaugaauaauuauuuugugauuuauuuagcacuugccgccccaaucuuguuuuucacgucugcaguuauggcugaaauaucuuauuccauucccagccucucuguuggugguaucugccugaucuccaccuagugucauugugggaucguggccacacaugggccuuccagggcugugcuguuggugaccaguggugcuuguaacccugaaguguuggcauggccucagcugacugggcuuucccucaugcccagggcuuaaacuugaacucugccugcucuguuagcaguuuuucucuacauuucuuuuaaaauagacuuucacuucuuccuucccaucccccccaauacaacugcccuggcauccuggcuuuuuccauucuugacaaaugaucuguccacuguaacuguagcuccacugugcugauaucuguugaaauuagaccuagaaucuaaauguggcuccaugaaacuaugggugagacauuuuuuuucuucaaauagucuaugguuuauuggcaccccaaaccaccuauccauaccuucuccacugugaugcugggggaagaaaaugggguaauauauguguaaaagugacugagaaugaaaaguucugcauaagguacaauguuagcugggguuuuugcauauauaauaagaagacaaauguucacuaccacuccugccugccuucccugggcauaucgaacugauuccagccuaauagcauuucuuaucauauaaugggaaucacaaacccucccuauguccacuccuacagcgccuucuuacccuaaugaggcuuuguaacucaaagauuuaaacaucucauuuaugcuccauugacugaguuaaccaaacacuuuguauuuggcccuuuccucuuagaaguucagaacaauaauaugguccugaaacuacuccugcaaaaucugcuuagggaagaagggucggccagggcagggguuacauugggguuugcaguguagucaggcaccagggaccuggcagguugggugggaucaauucuuuucaccucagggcuccaguuucucauuugucaaauaaaagugauuucuaaggcccccuucugcucagaccuucugugacuguccacuaagccacagagacucacuguggccauugaauucuuggggaccucagggagguuuugcugccgaagugacugcccauucugccggcauacauuuggacuaccauuugaggugacuuggagagaaugucacuguggaaguuggccuuccugacaccugccacacaccuuccaugccaugcaucuccucuuuucgaaguccuaggagcuccuugaugauauuuacuauuuacauuugcaucucugauagugcucuuuccaagugaguuggcagcaguucauuuaaauucugaagcagaucucugaguuaggguuugguucuucuggccuuugagaugggugcugcccagcacagcaggccucggugaacaccgcuguucaccaagggacuuuggucccucuccugcaacgauucagugaacugccuugaagcucucgcagggacucugaaguacugaaauguuuauuucuaaguuagaggcgaggaaaugaaacuaaggucacagacauuuagugauuuucuuuucucccaaggugagggaggugguuaagggcuuggacuuuggaguuuaaaaucucaccagcugcgggaacucaggcagucauuucucuuuucuagacccaaacuuccucuuuuauuuuuuauuuuuuuuuauuuuuugagauggauucuugcugugacaccuaggcuggagugcaauggugcgaucuuggcucacugcaaccucugcuucccggauucaagcgauuuuccugccucagccucccaaguagugggauuauaggcauaugccaccaugccuggcuaauuuuuguauuuuuaguagagacgggauuucaccauacuggccaggcuggucucgaacucuugaccucaagugauccaccugccucggccucccaaagugcugggauuacagacgugagccaccacgcccagcccccaagcuuccucaucuaacaugggacgguuaaugacuuaccucucaggguugacugggaagggagcggcugaaugagaaccaauguugggaauguagacagggucagaaagguuagcccucugauacgugcuaagcaaagauuagaguuggugcugaaaacaggucucuugccuaaaucuuggauuaguacacaacuuccacauauaaagaguuaggggcaucuuuagguagauaaaucuauuuuaauuguuccguaaauauauuuagaagaauuuuggucaacauggauuuggugcaaauuucguugcagcuuuuuuucccccuuuuguuauucuaagcugcccuacaaugauauuuuuagaaauuucugggaacucaagacugucauugccagggcagagccaaaacaccagagguucucguagaccagugguucucaacuggggaauguucugccccucaugugaccuuuggcaaugucuggagacauuuuugauuuucguaacugggagugggagaugcuauuggcaucuagugcguagaggccagggauacuguuaaacauacuauaacauaugugacagccuccccacaacaaagaauuauccagcccaaaaugucacuagugccaagguuaacaagucuugcucucagauaauucuuugccuaucacaggcauucuuuguccccagcuacagugucauauaagccaucucaaacaaggguauauucguugucccccuuauccacgguguugcuuuucgugcuuucaguuaccuaagguccaaaaauauuacaugaaaaauuccagaaauaaacaauucauaaguuuuaaauugcacucgguucugaguagcaucauuaaauaccaccugggacuugagucauccccuuuguccgguguauucgcacuauguuacacuauuccccaacccucauuccuuacuguauaggaaaaaacaguauguauaggguuugguacuaucugagguuucaggccugcaguaggggucuuggaauguauccucggaggaugaggagagacuaccguauuuuuuccggaaagucuaggaccauuucucaaacuaagagaaggacaaaguuggagaggaaacuguuucuguucugcauaguuugagauauguacaauuuugagacccaauccaauuuuuuuccaaccacuuucuuguguguuuuuuuuuucaguaucuuaacccacauugauguuuuaucuucuguaagcacuaaacaguggcaaguuacacaaauaaaaugugugcuuacuacauuuuaauugcucuuuuuuaugcaaauaauaauagaugguuuuuuuguucuuacacauugauuccugggggaauuuuaauauuuuauuaaauauuaaauaaaaugcccuauuuuuuuccuuucaaauugaaccacccuaguuauaaugagccaucaguucuaaaaugaauccucucuguuaaaauggcagcuuguucuaacuaaucaugcuuugaguauucugcuguaguuaaucaaaguuaaaauaggagguuauauuuuaaauauaaauucuacuuuuaaauucuaaauuugcuauuuuuccauucuggaauauuaugauaggguuaccagauaaaauacacgaugccaaguucaauuugaauuucagauaaacaacaaauaacuuuuuuaguauaaguaggucccaugcaauauuggggauauagauauuuuuuaaauuuguuguuuguuugaaauucuaauuuaacuuacuuaaugcucuguauuuuuauuugcuaaaucugauaacucuaaagauaggacucaggauaauuggaaaauaccaggaaauaccacucacgucugacaucucccugcauaacuuuaucuuggauguuuuacuuuacaaaguauuaaguaauaaaucucguauaguuauuugccaaagagaaggaaauaaauuucugaagggaauuuagaaaauuugucccauaagcacauuuauuggucuuaaaggguagcuugaauaaacuggaguuaguuguucacgugacauucagaaguaccauauuugacauaacaccucaauuccagaggggaaacuuggaugggagagaaaaauccuuuuuauggguuggcuucuagagauuaccuagaacuuaagugaggugauuuuacucuuucuucuuuucauaagcaguaggauucacuucagaguugagggccuguugcaauagagggacauguugauuauaaaagaauuggguuauuuuuggcuaaagcaggcagaucaccugaggucaggaguuugagaccagccuggucaacauggcaaaaccccaucuguaauaaaaauacaaaaauuaguugggcaugguggcgcacaccugucaucccagcuacuugggaggcugaggcaggagaaucacuugaacccaggagauggagguugcagugggccaagauggcgccacugcaguccacccugggcaaccaagagagacucugucucaagaaaaagaaaaaaaagaauuagauuaucuuuggaaaauagcaaaaaggcccaaccaaaauucucacuuaaaacacagaauucacaagagugugcugaaaaugagcaugccggagacacgguauuccucaacacuucucgucaucagcugacaccugaaucuacccggugggaggaaugcaacugucucuggaugccacuaucauuacaucucuguggccucaaauggguccauugcagaaucuugcuaucuucagugaccuuaaagauguuuuugcuucuggagaaggaaccagcugcaucaacggugaucugcugacuucauacaguacuccgucugcucccaccucgcaucccauggcccagugucccgugagcugagauuugccuucugcugacgguguccugccucaggugccaggagcacugcuuuuugcuuuuuugucucucuaggagcagacugaacauauugcaaccugugagucggaggggggucaacaccccagggccacccucuaccagugggaauggaagccaguggauaaauggcccuacuuccuagaaaaguuccagggggcauucuggaugcuucuugggaggccucagcagaaugaagccccuguuaccuguagccaugaccuucuacacacacucuucaauaauacacccaccucacucucccuccuccuaggaucacuucccaauaaacuaccugcacacaacuccuugucucagccucuguuuuuggaaauaucuaaauuuagacaccuauuacauuagucugguagggcugccauaagaaaguaccacagacuggguggcuucaacagcagaaaucuauucucucccugaucuggagacuggaaguccaagauguugucagggagguuuccucugaggccgcucucggcuccaagauggcugccucuucaccuggucgucccucugucauaagcucaccgggugucuuuuccuucagauuggauuugggcuuaccccaauggccucuuucaacuuaaucaccucuuuaaagguucauucuccaaauacagccacauucugaggcacuggggguuaugacuucaacauaggaauuuaacggggacgugggggugggcguuuagcccaaggcaccugugaaggagaaaaaucugauuuagaauacaagcuaccccaacauaauuggccucaagauuguggcuguuuucaaaaaacucuuccaucuuguauagaacucaccuacucuggggccuuggggaggggggucugugaacauggaggccaugguguucguuggccaccuccuuuuagauuaacugcgcagccugugucuucacuucugcucuguacauggagaagacagggaaggcaaggcugcugcuuaccugaaggaguucaaaguguaaauaagacaagcccauuagaucuaucaggggaaagccguuuagguuuguuugagacaagauauaugguguagaccacagaccuuacguuuagggaaagcguacuucuucagugggcugaguuucuuguaacagaagguguggucggaugauuacagcugggguugaauuagaugauuuauggaacagcuucugcccugaaauuuucugauugagagauggauguggucuggaguaugugaaaaugggauagauggagggaagguuaggggagaggugaacagggccucuuccagggucuuguggaagacccuguucgacguuuccucacguagacugucugaugaggcucuuccagggugugguauggccaggguguguuaaauguagggagcacaaggcaagaaagggcugcaccaagcugcuuccugccucagggccuuugcacuugcugucccaucugccuggaauggccuugccucacaucuucauaugaccuuggcuccuugucaucuauugacucaccugucacuucagaaaagcccuugcuaccaucuggucugccagucacucuuuauccuauuuucauguuuuauuaacauucaucaccaucugcaguuagacucuuuuguuugccuagugcccacaauguugcccgacgcucacuaggugcucugugaauauuugcuaaaugaaugaagaacuugaaggaagcuggcaguggguggacucgcugagauuaaggggcauggaagauuacucaaggcagccucagccccuuucuaauguuuuguuuuguuuuuaaauucagacucuguggacucaguucaauucacacaauugccaagugccugucugugucgugcauuaugcuaguuagaucccaggaaucaaaugaauuagaccugaaggagauuacagaccaguucuaugguucagguuguuaaugugggccccuggauagaauucuagauauuacuuaauuuuuuugugugacuacccucuaacugaaauuuagcguuuucuucuaguaugaacguaggcacuaaaccacaguagaacuggcaguguguuugacugucacccauagaaauagauauuuucauaucacauuacacuuguugcagcugucuugaaauauuguuuaugcucaucaugacuucaaaauuacaguaauuuuugaccugcugcuggaucuuuuuauuucacgcacuaacacagaagaacauagauuacuguaugauaaauugcuuuuuaauauuuugaauagcuauauuucaauacaaaguguuuccuuuguaaucccauauauauauauauuuucuuuuuuaagacauaaaaaagcacuagccugagaaaagggguccaauagacuucaucaggaggccaaaggaggcgucuauggcacgaaaacaugaauucugguggaauuaugugaaaagagaaguccuaucacuccuuaaaaucauguuaaugaagauuccuaucaaaugugguccccacccccugcucuggguuuacugcuucccugugaaucuucuccacacuuuuguuaauuuugggauggaaguuugagagagauacuuuuuucauagauagguuggaagugaugcucaccuuaucaggacuguaagaggauauugcaagcuuugaugauugagcagaaaaaucuuugcacagcuggucagaacaagcuuguccugccuugugggagggacagaguuuuccaaaugaucuuuugguuaagaccuuaauuaaaaacagccuaaauucacuuguggcaagaauuuauuaaaggaagauaaccaugagcaaauccacguugugguauaagaaaagggagcaccaucguuaaaaaagucagaggcuugaauucuggugaacuuagcacaaagaagcaagaaaacuuuagacugguuucuuaacaguuugcuaucuguauaacuaggggugaauugaucucaaagaccuaagaaucuguggacuuaaagacacugauuuguggcauaauucgagguaguuuaaacuggaauaucaaggugucagaagaaaaauguacaaguaauacaucucaguuucuuuucuccuacgccacuuaaaucuuagacccaccgaaagcucuaaauguaucaguggauuuuucauuauuuccaaaaauauucugcuugcucuuucugaauaaacuauagagagaaacacagguuucucuucaggugccuuauuaaguuuaacuguuguauaguacagcuuugcuucuuuguuucauuuaggaccagaagggguccagguagcugaauaucccuuccuugcccugacauccccauucacugcagcaagcuuuauaaugccuguggucauccuugguaugaaugagcacuggagaccccaccaugggcaguacuaagcagaaucaggcuucuguucaucagaaugaacaaaggcacacgcauaaaaugagagcguggcagauggagagggguggggagccuagagggugacuggcugcaggccucagcaguggagacaagggcacaggaacauggcgccagggccgacagauuuggcgucagccguggaugcucugcauagcacccaucuguaaaugggugugguccuggacaagugagguccugcuggauuauuuaagaauauuuuauggugaguuguauuuguucuuuccagcaacagcucuuugaaguaguuuagugguauauccauuuuacagucagcacuucagacucaaguuuggugaucacaugccccaagucuccaacuccugggcucaagcaaucuuccuuccucagccucccaaagugcugggauugcaggcaugagccacugcaccuggccgaugugccccaagucauguaaaaaauuaauagacaaugcagaauauaugggagaaugacguauugcugggccuuuuugauuugcuagugagaccagaacacuuuaacauacuaaaaguuauagcugguuagcaagccaacuuuuuaacuucaaaagauagggaaaaauaagcauuauuaaaacucauugacuuggccgggcacaguggcucacaccuguaaucccagcacuuugggaggccaaggcagguggaucacaaggucaagagaucgagaccauccuggccaacauggugaaacccugucuuuacuaaaaauacaaacauuagcugggugugguggcgcacgccuguagucccagcuacuugggaggcugaggcaggagaauugcuugaauucgggagguggagguugcagugagccgagauugugccacugcacuccagccuggcgacagagggagacuccgucucaaaaaaauaaauaaauaaaguaaauucauugacuugcugaacaccauaauuaaagggauucuggagguaagaaaaaggugcuccuuuuguuguuauauaacaacaauaaacauuauuguuacuauuauuacagcccuuaucuugcuuucuuuucuugucccuaucaaccuucccuggaagaaagagaacuuuuccaggcuaagaucauacauuaaagaauuguccuuuuuuuuuuuuuuuuuuuuuuccaagacagagucucucucuguugcccaggcuggagugcaguggugugaucucagcucacugcaaccuccgccuccuggauucaagcaauucuucugccucagccucccgaguagcuggaauuacaggcauguaccaccacgcccagcuaauuuuuguauuuucaguagggaugagguuucaccauguuggccagguuggucucaaacuccugaccucaggugauccaccugccucggccucccaaagugcugggacuauaggcgugagccaccaugccuggucuaaagaauugucuuuacgauagaggaauguuugacuuuagcacauuucugguaaaaucaagauucuagaucgggguguccaaucuuuuggcuucccugggccacguuggaagaagacuucuugggccacacauaaaauacacuaacacuaacaauagcugaugagcuaggaaacacacacacacacacacacacacacagagagagagagagagaaaaauuuuguaacguuuuaagaaacuucgugaauuucuguugggaugcauucaaagcugucuugggccacaugcggcccgugggccggagguuggacaagcuuguucuagacguucuuccucugucucucuauguuagaugcuuucccacguuagcaguccuuuuccccuccucucuuaaaugaccaagcaggacuaggaaagcauaaaggcaaugagaacacgcugccugggauuuaagcccuugaauuccaauaagguucuaauauggacuucuacuaaagcauaaugguuaauuccauuuagagaguggggaacaucuuucauacuuuuuaaaacaucaggccaggugcagaggcucauaccuguaaucccagugcugugggaggcugaggugggaggaucaccugaagccaggaguuugaaaccagccugggcagcacagugagaccccaucuccacgagaauguuaaaaauuagccaggugugguggcauguaccuguaaucccagcuauuugggaggcugaaguaugaggaucccuugagcccaggaguucaaggcugcagugguugcaguaagcugugauugugcugcugcacuccagcuugggcgcagaguaagacucagucucuuaaaaauuuaaagucauuauucccagguggaguguacuacugagaaauagaagucccuugguuggaccuagcuuauaagaaacuucaaagcagucauugccaacuacaggugaugauugguaauuugagcaaaauuugauagcuuuugaaauggcaucaauuuaaaagaaguaguuuuuguuucuugauccggggcaaggcuauuauucugguuuccaauacccuuuauccaucugaagagcaucaaaauuggcgggugccaaucaaguuuggaaauggaacugagcagcauaguaaccuauagaaaauucaugaauauagaaaauucaagaucauacauuaaagaauugucuuuuuuuuuucaaaaaaauuuuuuuucuaaaaauguaguguuauauuaaaauguagugaauauuauaauaauucuaaaaauguaguguuuauauuguuuuccugcuuaaguuaggccaaaguugguaaaaugcauuuuagaacccuauuuuuguuaaggagagcacagagccacugguuuagagaaguuuguaauauccagaggaugaagaaaacggacacuugucauucugaguucacgggaacgggagaaacugaacccuuuuagguugaucaucagcuugaugugaagggacuugagagauucucuaaucuauucuuuccuuuaacugguuaggaagcagaguccaagagaaaugcccugcccagggucuggcagaacugauggagagcagccuucguggcuaccaccuucccauaaagucugugcucuccagcggcgcuugguaauaagauuuauuuaaugacacguguaacucuaagacuauuugugauggcgaauaccacagauuugacuggguaaugugauauuuguuauuugcuuuaaguuaacuuuagccuuuagcacagugugauggaaagggcaccaaacuugugaucuagaagacuuggguucaaguuucagauuugaauuagcuuugcuucugcaaaucugaggacccuauuuucuuaauccaugaaaugggaauaauaauacucacccaauuuaccuuacacagucgugaggauucauuguaaugggcuuuguaaaaauauaaagugcuauauaaacauaaggguguuaaucuccugucuuuggugacaggcuaaaaagacauacuuguuucaaauuuuggauacucuaauuugcauaaucuuacacauucucuuucucuauuuuuaacucuauguuuuccccaucagauuuuuuucuguuaggaguuacaauaucucucuucaacugggcuuugccucaagguguauaaacuuaaagcauuaucuccggugcaguuugucagugucucggcauauuugaaauuuuuaguacugcauuugguauaugaaagcugcauccuauguaagaccauaggauauuuaaacagauguucaaauuucuauugugaaaauccuagcucauuccuugcuagagaugaagcacugaggacaguacaaucaccaccuuaaaacaaaccaccuaagcacagcuuuggcugcacagauuggaagggaaucugguaauuacacucuuuaguucuucugugaauauaaccaaucugggcaauuugggcaccagaguggauuuuuaggcaugaauuaucugguuaaguuagccagauaauugccagcugucucccgugcuuucugcucuggagaccccagccggaguaauugucuucuguuuacucaugcaagcaaguugcugguuuccauuuucaaacaaaaacuaacugcauguuagaaugguauuuuaauugagcuauuuuuguugcugauucagagauucccccacccuuugccaaaggaguugcccagauuagaacccauuaauuuaguugauuugggggguuccuuguugacuuuggggaagacauaaauauuauaaaagagauuuagaaguugaugguauaagguuuuccgaaacauucaaaacuuaucucaaauucugaccaaacauuuuucuacuaauuuuccuaacuaaauggaaacuccagcuguauaaauaaugauuuuuguuugaaaacauuuuuucucuugauuuuagaaccaucgagggaauuaaauuauaaauaaguagcaggaaagaacaacuuugucaaugugaaacagaaugcaaaauuacucacauuuugaacugaguuccagaauguaaagcaacgcuuuagcaugggcugcugaagcgagcugcucuuuagggaggaggaggaggcuuacugagacguuuuguuuguuucuuuauuuuauuuauuaauguauuugccauuucuccauuagaucugauuuuaauacuguaagucuuuccacugauuacaagugcagugacaugucccucugcaaccaucauuuuccucccauuuuuucuuuucucuuuuuuaaagagacagggucucugucacccaggcuugcauacaguggcgugaucauagcucacugcagucucaaacucuugaguucaagugauccucccaccucagccuccugaguaacuaggacuaggugcaugccaccaaagccuggcuaauuuuuuaaauuucuuuguagagaggggucucacuauguugcccaggcuggugucaaacuccugggcucaauccuccugccucggccucccagaacauugggguuacaagcaugagccacuguaccuggcccuccuccaauuuuuucuuaagaaaaaagagaauucauacuucauuuaccugacaguccucaucccauuuaaguguauacaauggaaauacguacauuuaugaccaauauuggucucuuucuuucuguagguuugaguuuugauuauagacuucgauggagaaagcaauggcgccacaacccagccagggugcccugccaggacuuccucaucucuugcagugaaacccccuuaucaaacauuacgugcuaucuggcccccuuugucauacuuucuugcacuccacuuacuacauaucaaggauuugccauguuguggaaaaguugguuucauaacauauuuugaacucuuauuuaagggaguuguuuuucuuauauucuucauuccacaaauacuuaaccaaggcauauuuugccacagguacaugacuuccaaagaaaucauaacuauaguuauccaaaaaaauuaaaauaauuuaguaauguccacaucgucuuaaacacucuuccagaauguuccaaaggaacaaaugguugcagugacuuuuaacuuuagccccagccuacuuccagcuaaggcaguucucacugcagauauauguauucauugguccaaagaaagagagaggaaaacuuggcucccgaguauuuagagugaaugauucacgauucuguacaugggagucuuggcuccuucucugucucucaggcuuuuugguaggaagucaaugauaccaguagaaaaaaggcuguuuuucugacuuaggauuugguccgcucucugcaacccacuagagaaacugaaguuuucuuuccauaaugaucugaaguguugauaguuaccaucucuguaaaagcucauuaaaaaaugacuuauuuuccuuuggaaggagaggucacaugcuggagcuagcaguggaauaucaggaccaaggaucauaagccuccugcuguaacucugguuuccagauuuauuugagccuacuucugccagaaguaaauuuggugggcaucuugaauggagaaaugaacagaugaucaaggagagggaaaagggucaggaguaggggugggaagaccccaaaauccagugaaaagggucagggguaggggugggaagccccaaaauccaguguggcagauaaggggaggcccaaaauccaguguggcagacaaggggugagggcauccgaaacacacaguuuacuauuuuaaccauuuuuagguguaugauucaguagcauuggcuacauuuacaauguuaugcaagcaucauccauguccagauuuuuuucaccgucucuaacagaaaaucuaccauugaacaauaacuccccucccaucccucuagucccugguaagcucuauucuacuuucugucuguaugaacuugaccacucuagauaccucauauaaguggaaucauaaaauauuuacccuucuguaucugccuuauuucacuuagcacaaugucuuuaaguuucauucauauuguagcauguaucagaaucucauucuuuuuaucucugaauaauauuccaugguauguauaaggccccauuuuguuuaucuuuucauucaucaauggacauuugaguuguuuucuucucuuggcuaucgugaauaaugaugcaaugaacauggauguaugagaguaucuucuguuugaguccccuuuuaaaauuccuuuggguauauauccagaaguagaauugcuggucauaugguaauucuguguuuagcuuguguuuuuguuuuuguuuuuuugagauggaaucuugcucuguugcccaggcuggaguguaguggcaugaccuuggcucacuacaaccuccaccuccuggguucaagcgauucuucugccucaaccuccuaaguagcugagaucacgcguggguaauuuuuuuuuuuuuuuuuuuuuuaguacagacagcguuucacuguguuggccaggcuggucucgaacuccuuaccucaagccauccacccaccuuggccucccaacgugcugggauuauaggcaugagccaccgcuuccggccauauguuuaacuuuuugaggaacuaucaaacuguuuuccacagcgggugccccaucuuacaauccuacuagccaugcacuaggggauugacgcggauccuuucuuugacccauccgcaugucacccaaccuuuuuuuuuuuuugcuaaccagcaguuugcucaacaggccucauccucauucaucacugggucuccuuuugcuguuugccgagucugccugccccuuugguguuggcuuuggcuagagaaaggagcauauuuguuuugcuacugaccugguuggacaugcaugccagccuguuuaugaggugcuuucucuggcugagggagucaggggcugugcaacuguauucuuuagugugaaggugagccaacacagcgaaguaugcucgcccugccuccuccagaaacaaucugccuuugagucuuuucauucuccugguaaccgucuucuuaauagcuguggcuucaucuaaaugaaaaauuuaucuugugcugcuuacccaaaggagaggcuccucacaugucagauauuauuucaccaauuaucucaguaacuucugugcuuuuuauuccugaaagcaaaguugagaaugaugcagguuuccacaacaugcgguguuucgugcauuuuuauccuuacguaguuacaagaaacaaagcaaaauuuagaauuauuugaaguacuuuuaacacccucaauuugauauguuguguguauauuuauaucuggacacaauucuuuucauugaacaguauagacaaagcauuuagaggacaguuaaguuucuccaauaaucauguuuaaacauaucucaggccgggugagguggcucaugccuguaaucccagcacuuugggaggccgaggcagauuggaucaccugaggucaggaguuggagaucagccuggaaaacauggugaaaccccgucucuacuaaaaauagaaaaauuggccgggcaugguggcaggcaccuguaaucccagcugugcaggagacugaggcaggagaaucacuugaaccuaggaggcagagguugcagugagccaagauugcgccauugcacuccagccugggcgacaagagcaaacugucucaaaaaaaaaaaaaucucaaaucuauuuuuuaaauuuaaccuuugaaacauuuguguaacgcagguggcucaugggcaccaccaucuucuuuuggcagaugaggaaacaaaccugucugucaacacagaaagcugggucugcucaagaauugcugugggguacaguggcaauagcagggacaagagggaugcagggguccugucuucgugucuguggaccagcccuucucaaaguccacggcugccccucuuggcuccauucuuugucucuucauggaauuguucugugggaauagucugcauauagugauucugcauuccaacaucuaacuucccugugccuuccuauuuacaaaagacacaguuucuugaccugaaauccccaguuugggauuauuaauaacauuuuuuuguaaccuguagugcuucagauacugucucagccuaugugaauucugguagcauuauugccuuauagaaauuauuugacaggccagaugcaguggcucauacccauaaucccagugcuuugggaagcugaggugggcugauugguugagcccaggaguucgagaucagccugggcaacauagccagaccccuaucucuucaaaaaaauuuaacagggcaugguggugcacgccuguagucuuaguuacucgggagagcgagaacccaucucugaaaagagcaaugcuagagguaagaaagucuaucuuuguuuuuuuaagcugguauucccauucugccccccaauuuaucuucaccccuuucaaggugagugcuuugugauggcccuaacauuuauuuagucuaaacaaaagaaaaauuauuugagaguuaauugugugugucuguacugcaugucuuccgucaaauuaaaaguuaacuauugcauuuuauuuauuuuaccuuaauuucauaucaaguacuuucauacuuuuuagcuuuuaaaaugacagaggcugggcucagugucucacuccuguaaucccagcaccuugagaggccgaggugggaggauuacugaagcccaggaguucaagaccagucugggcaacauagugaaaccaggucucuacaaaaaaaaauuagucaggcaugguggugugcgcccauguucccagcuacuuggaaggcugagcccaggaggcagaggcugcaguuagcuguguuugugccucuacacucuagccugggcagcagagcgagaccuagucuugaaaaauaaauauaaaauaauagaaugcucuucccagcuagauuguaagguuuuuauauguuaguguccccaugguauauuguaaguuguagguacauaccccuauuuauuauauguuaugguguuuuuaggcaaugagauuuuuaauauuagcuacucaugauucgcaacaaguucggucuuuaugaaauaaacuucauucaaaucuuugaauuccauuuuuaagugcagcuacaguugauaccuuagacaaaugaaagauuugucuacuucuuaguucauuccuacagaaaauaagaacaucuaguaucuaauaugaucccucgugggcccucaagaaauacuagucuuuuuuagaaagucuagucgugggucuguuucucuuuauuccauugugucugccugccuuguuauugcugugucuagaagaaaaugaagaaaauuagcauggcuccuuucguugcuguuuuguacaacuuuuguauccucacucagaagcaagauccuuggaaaugaaaugcuaugucaaaaaccagacgaaaaaaacacaacaacaacagaaaacacauuuuuuauaacuacucgauucaagauuuuguugcuaggucuuggaaaauguuguaugucaacccaaaggucuugggaagucccccugagucaugaaugggugugguaggacugggauguggaccucugggcuuugcuucugaugauaacuucuccuagggcagcagucaugcuggggacagccguuuugucuguuuaucucuaggccuugcacugucccugucauauaauagaugcucaauacaugucuuuugaacugaacugcauuggccuggccaugguuuaagcauuuggaccaauaacacccugagugucaaguuccuccucagucgggcuggagagucgagagcgggucauggugaguuggucuuuuuguguaagaaucccuaguggcagcagcgccuuguacuuaaaaauagaauacuaccaacaucaucuuccuucccaggaugacaaggcauugagaaaauuagaauguguauauuuucucccuuuuuuuuuuuugagacagucucacucugucccccaggcuggaguacaguggcgcgaucucagcucauugcaaccuccgccucccggguucaagcgauucuccugccucagccucucgaguagcugggauuacaggcccgugccaccaagcccagcuaauuuuuguaguuucaguagagacgggguuucaccauguuggccaggcuggucucgaauuccugaccucgugagccaccgugcccggccucuccauuuucuaagacaugcguuuuuucauuuguacauacguaucuuagcauugauacccccucuacauuuguuuauaaaacagugguacaucuuguaaucaguagcuucuuagaacugaggaauucguuuugucaucacucugaagggcaguuuagccaguacaguaagucuucacuccauagguucuuggaaauugcaauuuuaaaugaaugagauaucaugaaagcaauuugaccauaggcuaauugauauacauaagacuuaaguuccuuccaaaauacguacaauguuaaacacugaaauaaagguaagcuauacauacauuuaagaaagauuaauuuaaaaacaaguaagaugauuauuuaaucaguuauuccagcucgggguuucugguggauggagccugucccagcagcucagggugcaaggcagggcaccagcccuggacaggaugccaucccaucacagagcacauucguacacagccagagucacucagacugggacaguguagacaugccacuuugccucaugugcacagcuuuggggugugggaggaacccugaggacccagagaaaacccacgcggauguggggaaaacguggaaacuccaccgauaguggccauggccaggaauccuuuuuuuuuuccucauuaauguuauaacaaaaugacauugaaugaaauguuauucaaggaccugcuguaguuacaaauugguuauuagacggguugaagucucugcuuggccacuuucuagcugacguuaaguuucucaucugacuuaaaaguccaggaaagacgaaaugauauuauuuagcacagcagccugacuuauaguagagcaucaguacauauuaccuauaguuguuuucaugaaacuauuucaccagaaguuuagggauuuauccucaaaggcauuaggagugccuacacggcacauaagggcauuguuuuguaucauaccacaaguagcacuuaagguuggaaucauugcugaccccaauguaaaaugccucuuucuggaccagaaaauggaaagugaaauuugcaauucaucccauguuauuuauuuauuuagagacagagucuugcugugucacccggacuagagcuggagugcaguggugcaaucuuggcucccugcaaccucugccuccuagguucaagcgauucuccugccucagccucccgaguagcugggacuacuacaggugugcgcuaccacaccugcuaauuuuuguauuuuuaguagagacaggguuucaccauguuggccaggcuggucucaacuccugggcuccagugaucugccugcaucggccucucaaagugccaggauuacaggagugagcaaccaugcccggcccucuguauuuuugaugggauggaugguucaacauuuaaagagaaccuaaaaaguuaaaaguaaaagcaaagaagucuuaauaacaaaaagcaccuucaugcaaugucacuguuuuacugcaucuuaauaaagaaauguggccaccuuagacccagaauauaaucaauuuuuaauugucuuucuuggauaauaucaagauagaguguaauaaguuagguuaacauauuagcuugcaucuugucagggaaaauagguagauccucugaacacagaggaaggagggacguccacguuuguccuguuuagugucauacugaagaagaguaugaccagccagugcugggcguucugcagcuugggacagauguuggggggaagggcacugccuuucuugugaacuuucuugcccaagggacaaaugagcuaagcaguacuacguuauuagugggauguguauguguguguguguguaugagagagagagagagagaaagagaaagagaacagagccuguaagucuugccauuuugccuuuucagacaacccacccccaccccucagcauaggaauguaguccuaaccccaagccacugcuucuucugcuugcagcucuaaacuugagcaggucuugggggcaguucaccagugcaccacacuacacuacucucagcaaucuuuuuuuuuuuuaaacagugauuugcacugaucuagccucuaagggguaagggccgagaugaagcagagaauuuauuuuuauauuaugucgucuggugcagagacugcuacaaaaucaggagucaaaaaucuaagggaauaggcugugaagucauuuuguccaugaguuguguuacaacacauucauucauuguaaacaaucaccaacagucauugccauaauuuauucuuggcaguaaauuggguuuucuagugacagaguaagccaucagaauuaagcaaccaggagcuccaguucaugugugcuggaaaagauguuugcgagacuucagguaccacuaccucauauuaaaggugagcaaguggaggcccagagagggcaggugacuugcccaaggucacacaguggguuagagccauaucaaggacuagaacauugguaauccaucacaucguccuuaaaccuuucugccccacuuccuguugacacaauaggcaggauauuaaacuccaguuucauuccuggggauugauaugaaagguuuuuuacuuguccaaucccauuuuccuuguccaggcagaugacagguaguaauuucagaaacugagcaagggauggugaaagcuagauuguagugggcucuuuuugguuugguuguuaugagcgcucucaaugcaaagcuuagaaaccucuccagagaaauaaucagcucuccaaggagugcucuugcagacuagcauguugccuugcuugcugguguguaucuuccuauaaauuccugguauccaguguccauacaggagaaauuggcugacuuguuuucuugcuguguuguaugacagauaaucagaaauguaacucuggugccuugucaugugcccagaggaaguuaaaugugcuugccuuuaauauguauauguauacacacacacacacacacagcaguuagaaaauagauguuuguaaaauaugauuuuuuuagggaauauguaaaaacuggcaucucuucagauagacauagagguacuuaaaaaccuugguuaauaugucuuguuuguauacuccaugugguguauuuuacacaguaucuaaagguguugccugauuuugaauuaguuaaaagacagguuagagacgugggagaagaguauguuguauuucuugucugaucugaggaauuuuauauuccugaagucuauaauuaggugcuuguguugauuguuuauugaaacaaagcugaaggugggggugaggggagugccacauaguggaaaacacucuauggcaaacaucugagcuuuacuuaaaagcaugggcugcaaagaaauguaaauucauuggcuuaauuggaagagaguauuuauagaaauugaaugauccaguaaaacuaaaagccuggcuucuuucaucuucagagaccugccuuaguaaaugcuguucuggaaaucccuugccugcaaaguggacuuugccauccaauuucuggccuccuggcagucagucacuuugaccuaacccuauugcuugacucguauuuacuacguacuuuccuuuuuuggcuuaggguuguacugaaaauguacauguaaagaaaaaaauguccauguacacugaaguuuucugauuuuuuauauagcuccauaauuugauuucaauaacuauuacaaagaaacuuuuauaagaagauacaauuugaaaaucuugcugugcagccucuucccaucuacucugccugccuacuacgccuuuuauaguucaccauauccauuagguucucgaaaauucuuccacuguuuaugcaaaucuuuaaauuuuuaaauacuuuuauuuuccuucuuagaaaaggugacaacuagaugcuauucugcaccuuguuuuuacauggaaucauauaccuuaauaagcuuuucagacacucuuucaaucuucugcuauuaugaaguugcagugaauaaccuuguauaucacuucauacaugugcagguauaucuguaggguaauuuccuauaaggggaucaggauuugggccagcagauaugugcauauguauuugugaucguguggcuagccccuccuuuuuuuaacuuuuauuuuaaguuuagggguacaucugcagguuuguuauauagggaaacucgugucaugaagguuuguuguacagauuauuucaucacacagguauuaagccuaguacccauuaguuauuuuuccugauccucucccuccucccacucuccaccuucucugguaggccccacugucuguuccccuuuauguguccauauguucuuauaauuuagcucccacuuauaagugagaacaugcaguauaugguuuuccguuccuguguuaguuugcuaaggauaauggccuccagcuccauccaugucccugcaaagaacacagucucauuauuuuuauggcugcauaguauuccgagguauauauguaccacauuuucauuauccggucuaucauuggugagcauuuagguugauuccaugucuuugcuauugugaauagugcugcagugaacauacgguaugcaugagucuucauaacagaacaauuuauauuccuuugaguauauacccagaaaugggaaugcuggguugaaugguauuucugguaguuuuuuugguccuugagaaaucgccacacugcuuuccauaaugguugaacuaauuuauacuuccaccaacaauguauaagccuuuuuuuuggcaaccucaccagcaucuauuguuuuuugauuguuuaauaauagacauucugucuggugugagaugguaucucauugugguuuugauuugcauuuuucuaaugaucagugacauugagcuuuuuuucauaugcuuauuggcugcaucacaugugugucuuuugaaaagugucugcucauguccuuugcccacguuuuaauggggcuguuuguuuuuuucuuguaaauuuguuuaaguuucuuaccgaugcuggauauuagaccuuugucagaugcauaguuugcaaaaauuuucucccauucuauauguugucuguuuacucuguugagaguuucuuuugcugugcagaagcucuuuaguuuaauuagaucccauuugucaauuuuugcuuuuguuccaauugcuuuuggugucuucgucaugaaaucuuugcccguuccuguuuucagaaugguauugccuugguugucuucccggguuuuuauaaaaguuuuggauuuuacacuuaccuuuaauccaucuucaguugauuuuuauauaugguauaacgaaagaguccacuuucaaucuucugcauauggcuagccaguuaucccagcaccauuuauugaauaaguaguucuuuacccguugcuuaauuuuugucagguuugucgaagaucauaugguuguaggugugcggccuuacuucugggcucucauucugucccauuggucuaugugucuguuuuuguaccaguaccaugcuguuuugguuacuguggcccuauaguauaguuugaagucaaguaguguaaugccuccagcuuuguucuuuuugcuuaggauugccuuugcuauucaggcucuuuuuugguuccauaugaauuuuaaaauaguuuuuucuaguucugugaagaauguuguugguaguuugauaggaauaacauugaauguguaaauugcuuauguuuucccauuuguuugugucaucucugauuucuuugaagaguguuuuuaauucuuguuguagagaucuuucuaguguauuccuagguguuuuauucuuuuuguggcaguugugaaugggauuauguuucugauuuggcucuuggcuuaacuguugguauaugggaaugcuagugguuuuuguauguugcuuuuguauccugagacuucgcugaauuuauguaucagcuuaaggagcuuuugggcugagacuaugggguuuucuagauauagaaucauguugucugcaaacagaggguaguuugacuuccucucuuuuuauuuggaggcacuuuauuucuuucucuugacugauugcucuggccagggcuuccaauauuauguugaauaggaguggugagagagggcauccuugucuuuugccaguuuucaaggggaaugcuuccagcuuuugcccauucaguauuauguuggcuguggauuugucaucgauggcucuuaauauuuugagguauguucauucaauauguaguuuacugagaauuuuuaacaugaagcaguguugaauuuuauugaaagccuuuucagcaucuauugagauaaucauguguuuuuugucuuuaguuguuuaugugaugaaucacauuuauugcuuugccuguguugaaccaaccuugcaucccagggauaaagccuacuugaucaugauggguaagcuuuuugaugugcuaguggguuuguuuugccaguauuuuauugaggauuuuugcauagauguucaucaaggauauuggccuuauuuuuucauugugucucugccagguuucgguauaaggaggaugcuagccucauagaaugaguuggggaagaaucccuccuccucaauuuuuuggacuaguuacagugggaaugguaccagcucuuuguacgucugguagaauuuggauuuggcuguaaaucugucugguccugggcuuuucuugguugguaggcuauuuauugcugauucaauuucagaguucauuauuggucucuucagggauucuguuucuuucugguucacucuugggaggguguauguguccaggaauuuauccauuucuuuuggauuuuauaguuccugucgcuugcccuuucaguggacuauuuuuguuuuuuuaaauggaaugcuucacaaauaugccccuuccuugcacagaggccaugcuaauuuucucuguauuuuuccaauuuucauauaugugcugcugaagcgaucacccuaaguacuguuugauuuuugcacuccugucaacuuaauuagggcugcaccaauagaguggguuaucaaacuuuuggauuuuugccaaucucauuuguaaaauauacuuuauugauaugguuuagauuugcauaccuuuuuuaaaaaagcaaaagccuggacaucuuuucaagauguuuaaaggccauuuguuggccaggugcgguggcucacaccuguaaucccagcacuuugggaggcugaggaggguggaucacgaggucaggagauccagaccauccuggccaaccaacauggugaaaccccgucucuacugaaaauacaaaaaaauuagcugggcaugguggcacacaccuguagucccagcugcucaggaagcugaggcaggagaaucguuugaacccggguggcagagguugcagugagccgagaucgcaccacuguacuccagccuggugacagagugagacuccaucucaaaaaaaaagaagccauuuguuuuucuuguuucuuucuuuuuguuuguuuguuuguuuguuuguuuguuuugcaaacuguacuuaauuccuguacgugauuuacucuucuguuggauucuugcucuuuuucuuguugauuuguaagggcucuuuauauaauagggagauuagcucuaagucugugauaugaucuucaaauuuuucuugguuuaucauuuccuuuaguauuugugggguuuuuuuggucuuauacagaauuuuccauucuuucuuuuauggcuucuggauuucgagucacagaaagcauuuccaccaaccccuuccacacauacacgcacaagaauugacccauauuuucuugcagaauuucuaugcuauuacuuuuuuuacauuuaaauauuugcuccauuugagguuuauccugauauucuguuaaguauggauucaaguuuuuuguuuuuguuuuuguuuuuguuuuggaaauaggcucucacucuguugcccagacuggagugcaguggugcagugacggcucacugcagccucgaccuccugugcucaggugauucucuugccucagccuccugaguagcugggaccacaggugcacaccaccaugccuggcaaauuuuauuauuuguggagacgaggucucgcuacauuguccaggcuggucucuaacuccugggcucgggcgauccuaccuccgccucccaaagugcugagauuauaggcaggagcagucgugccugacucaacuuuauuuuuuguagauggcuacccaauuucccuaaccacuuagucaaaaugcccaccuuuccucccacugaagugccaccauuauaaaguaaauauuuuguaaaugaaaaaugcccacuauucccuuguaaaacaagaaacugugggucaccauuuuuuggaaagaauguuucaguucucuuuuuaacucaagacagcucuuccacuuuguccuccaaggauaauauuuacuccagagugaaugaaugagguuaacaacccaccugcuuguuucucccuaguggaauguuaacauuuugccucuuggcacaauucucaagauuuaucuuaagacccugucuccuuucacucaaaguauuugucucuuuaucacaaagccugaagaaacauuucuuguuacucaaggaccaugccuuuuaugagcccuaagaacaggaguuaucaaaguguggucuuccccagaccagcagucucaacaucagcugagaauugucagaaaugcaaacugcuauccuugagcuacagaaucagagacccuguguggacaagcccaacaaucugaauucaacaagccucucagguguuucugagcaugcucaagauugagacccaugaccuuagagguaauauuuaauuucauaauggcaguuuacaacccuauagcacugccuugugggcggauggguuugguccuaaucuucuugacauguaaaaauguagacucacagcaggaagugauaauaucuguucuuuaaaggugguauucuuagaguaggaaacuuuucugaguuuuuuccaggagucacaaagauaccucacuaggaccgcuagugcuuuggacuagaacaccuuacauccagaaucuugccacugggucagugcuucccuuugucauauaauaaaaaaccagcaaaacugguuucuauaauaugcuaaggaguuuuguagcguugaagacuugucuuacccccacaaaagcaucauuguuccuucucaucccuugccccucugccuuuaaaauuaauuugauaccagaauggcaaauacuucugaugacuguuagccacgccauaauggugcuuguauuuggcagguuaaggcagaguucccauaccucugagccuaauugccagccaggguucagcucagagcaguaguucuaaaguuuuucuggacauuagacuccacuggauagcuuuugaaaauucaacuacccgggccaaauccauguaacuaauucuauaucucagggguggaacccagggaucaggauuuuuuuuuauuacccagccgaugacaauguauaucgaaguuaguuuaagaacaaaggaugugcgcacuuguuuuaaaguaguuuugguuaugauaauaagaauuauaagagggaccaaauaucaaaugcaagaaaaugguccugaaugccaauacaaucagaauaagaaaugcauaaauagcgacuugcuugaagcugaaaucaacuccuuuuuggaugccuuucuugucuuuugaagaacacauguuguaguauguguuucucuccauauccuguguguuucauuguaauagucuugcugauugauuuuguuggcugcaagcaaagugauaaaaugccagugggugccugugccagggaggucaggacuggacuuucccacuuggcucuguuuugaugcauuuagcagauugauuccaacccucuuuggagacucugaccuacaaaagugucuguuaucuuugagagcuccagggaaagcuauggaccuuucuagaucuuuucccaccuuuuggcccaucagauauugccuuguccacagcagaacuugacgauucaucauagaagccuaugguuuuauuuauugacacugcuguacaauuuucccuguagcgagucauaguuggcugaagagagagucgaagauuaaguacaaaacuuucuaaacauccuguuuucccucaagacagggcacuguucuuaauaaacugaacauucuuuugcacuggcccuggggcaagggugucccaaaagcuuugacaggggugccauuuggucauaaacagugugguaauaggguggagucagaaagaaauucucucaucccuuuuacaacuccaggcaauucuagaaccaacccuugggaacccagggaaagaacucugaaaugauacgcuggcugagguuugccguggccacaccucaggguuaagcauugaaggagcuaggcaaagaguguguguguuuagcuacaaacuaagucacagaucaagaggcuuuugguauucuuccauuuuugcuuagaauucuaugaugguuuuugaaauauauuguccuuacuuuauguucuuaccuguaaucucauaaguuucugguaaauuuagcuuuugccagguuccggugggucuuacccagagauggucagaguaaaugaacaaaagaaggaauugauuaggaugugaaacuucagauacgcucacaggccuucaagcccuagaaaguaguaugccagugaauuuucuaguccucucuacacuuuguacagaugaagaaaccgagacccagggaacucaaccaagguuucuugccauuccuccagucccccaguuaaaaaaaaaaaaaaaauuagguucuauuuugcaaacugacaaggagaauuauacaauggaaauaacacucauuuuaauguaucuguucuuguaguuucuuauuuuauucaccuuuauaaaccauucugagaacauugucauaaagagcauucuccuaaauuggaaugugauucaaauaguccugucuccuuuccuccuugcuuuuuaugaaaugacugccuacacgcacucgcgcacauauuuuagugagcaaugcaaugugcgaauacaaauagaaauagauuuuguuaaaaaaaaauuaaugucaguccacuaguuaaaaaaguaccaaagucauuacaagauucauuaacuauguuuaagaaaaguauugagggcuuuuugggggauuaaauaauuuuaauuuauaaauaauggccucagauucauaaaccuuaacugauuguagagauuaugaagguuuguuucucacacaguuaauuauuuguugcuuuuuaaauaaccagauaauuacuuugcauuuguaaugauuaauugcaaaaaguugguuauaagaaucccuagaugaauucucagguaagaucucaugcagaauucuuugaaguucauuuggggucauuuaucaagaaaagcaaugcauuucagguuuaugaacucacuuugcccacaggugagguuuccaggcuucgaaccagcaggaggagagucagugggaggaucugacguagguauggcuucagagaugaagagaguauuucuccuccgcacccccuuugccuacaccuagaaauaaguuuagccuagggaaaaaauguucccugacuugucagguucagcuaguguacccuuugagauccuucauucucucuuuuucuuuuugagaagaagucuuacucuguugcccaggcuggaguacaguggucccaucuuggcucacugcacccuccgcaccccagguucaagcgauucucccgucucggccucccaaguagcugggauuacaaaagcacaccaucaucccuagcuuauuuuuucuuuuuuuuuuuuuuuuuuuuaguagagaugggguuucaccauguuggccaggcugcucgaucucuugaccucagguaauccgaccaccucggccucccaaaguggugggauuacaggugucaaccacugcaccuagcccguucucucuuuaaucucccaauuaacgaacaucuacugcgacagcauccauuaccuagaauuguaggaagguauauaggauagacguagcaaagagguaaguggguaagaaaauaaacacucauaaaaaggagacaaacugucagagugguccccuagcuacaccugccacaauugccuccugagaaguccuuguucugcacgagcuaaaauucccauucaaauaaauuguugcucuuccuauaaucauugagcugcugaauagagccaggguccuugauagacgucauaguuuguuauugacuuuaucaccaguaaaaguuaauacugucaucccuuuccugcagcaacacacuaccauuuuuuuuuccaaaauuaauuuagguaaagaacauuuuucuuaguauaauuuucauugaauucaguauuaucaaguuuguauauuuuuagagcuuuuggaucgcuauuccagcccacauuuuucauagcaauuugucuaguauuucuucaagaucuuuuuauguucauuugaaaaaugaacaugacuucauauguauucauuagcaaucacugccguaggccuuucuguuugauuuuucuucugaaccucagagauaguggcucauuaugaaguagaaaaaggcuaacuaagaccuuguucugaacuuacaguggguaagcaagaggcuucagauccauaaucucuaucaaaauguuugcccacauuacuguaacagggagucauucagaaugagaguggaggaauuugacuccuuuuaaagaaucgcgugugcuuuuucuacuuucaugguugugucguuuugccggggagauuuugaaagagaagacucauaucuugucuuccccauaccgaggggucuuuaaccccuaaucuauaaauuaaauagguaggucaagcaauaccuaccagaguugguugcucugcccacuggcuccucucugcaccucccucccagaccauuucuccacuuccucagccuuagaaaaaacagcucacucaugguggugcuugccgguggaccuuggagauaagcuucuauucuugguuguuuuuaagaaaacugaauucucuucuuagagccaacccauaucuuaucaguguaacuuuacucacucuccaagcccuaauuccauucuguccuuuaaacauuaggagauuucccaaaaauaggcuugucaguaaaacucuggugugacaaaggggcaaaaguguugcuuuuuuguguggagauugcauuuuuaauauucuguuccccagaagugguuccaggaugcuucccuagaagucuuugggaagaacaauuagaguaagaaagguucuuccauuaucugccccaggcugggugucuucggaugacucugucaccucacaaguuguuuaauccuguauuuagcuugucagggaucauacgaaauggggucuacaucagauuuuccacaguuguuuuuuuucuuuagugauauagccuggaagggcugggggcgguggcucacgccuguaaucccagcacuuuaggaggccaaggcggcuggaucaccugaggucaguaucaccugagaccagucuggccaacauggugaaaccccgucucuacuaaaaauauaaaaguuagucuuagccuagcgugguggccgacaccuguaaucccagcuacucgggaggcugaggcaggagucucacuugaaccccagaggcagagguugcagugagccaacaucgugccacugcacuccagccugggugacagagugaaacuccaucugaaaacaaacaaaaaaaggucauauagccaggaagagcuucagugggaagaacagcaggaggaaugaagucccacggguuaucugaagagauguacugauuucagaacagugaugccagcuaugaaaacuaacuaccacuuauaucauuagaugaagagccuguucugaaaccucccguuaccacuauauuauguuuaaaaaguauacaucugaacagucaguguagcugaaaauugaugucaccguuuacauugauuuuuuuuaauacauagaaaauuuuuuuaucuuaacaaauuaaagguuuguuagaggauccacuuuccuuuaauuaaaauaaucgauauggaaguacacaguaggcauuggauacauuuuuguuuccuuuugaaaaucugugaguuacagccagacucuucgucccagcacuuuaggaggccuaggcgggcagaucacuugaguccaggaguucgagaccagccugggcaauguggugaaacccugucucuccaaaaauacacaaauuagccaggugugguggcgugcaccuguagucccagcuacuuggggggucgaggugagaagauugcuugagcccaugagauugaagcuacagugauugcaccacugcacuccagccugggcaacagagcaagacccugucucaaaagaaaaagaaaacuugugaguuaccuaccuuuggggaaguggagaacugauguuauagaaaugggcaauaauccuaaaaucuggggguucccauugcucacuucuuuucucucauccgcucauucauucuuucacuaaauguuauucuuugucaguguucauagaggcuucccacgacuugucucccagaagcccagcugucucagaacuucucacgggcugacugguuccuccaauuucccuagacuuuuuuguuuguuuguuuuuaacauguguauccuuuguuuuuauucuauuuucaccaauuuuacaaaugaauuacacagauuauguauucccacacacauucuaucagaaguauauaggauguauuagcgucuucagcccuuccccuucuccucacuuauggacuuccuuccaggccuuuuucuauguauuuucaacagugguuauuuuggcuuuacauuggaaaccaugccuuaucuacaguucugacuuguuuuuuuccuuacuuguuaaaggaaagauguaccuuggccauagaauacugcagguacauaauguucuauaauauggguauauaagauaaaaugguuuauuuaaccauucccuuuuaaugaacaauagucauuuagauuuuuaacuuaccccuguugauuauagugcuauaauaaacauccuuauacaugccuuccugugcauguuuuucaguauuucucuaagauaaauugauucccagaaguacacuuguagagucaaaaagucaugcauguuuuggccaggcaugguggcucacgcccguaaucccagcacuuugggaggccgaggagggcagaucaucugaggucaggaguucgagaccagccuggccaacauggugaaacccuaucucuacuaaaaauacaaaaauuagcugggugugguggugcacaccuguaaucccagcuacaugggaggcugaggcaggagaaucacuugaacccaggagauggaaguuccagugagccgagaucacaccacuacacucuagccugggagacagagcaagacucuaucuccaaaaaaaaaaaaaaaaaaaaaaaaaaaagccauguauauuuuaaauauuaacacugccagguaauccuccaaaauaguuauacuaagucucaugcccauucuucugccucacuaauugacacuuguuuuuaauuuuuuaauuuacuauaaaacauuucagaugcaaaagauagaaagaauagcacccaugaaaugacauuaacaauacauuugaaggucgggcacgguggcucacuccuguaaucccagcacuuugggaggccgaggugaguggaucacaaggucaggagaucgagaccauccuggcuaacauggugaaaccccguuucuacuaaaaauacaaaaaacuuagccaguugugguggugggcaccuguagucccagccacuugggaggcugaggcgggagaauggcgugaacccgggaggcagagcuugcagugagccaagauggcaccacugcacuccagccugggcgacagagcgagacaauacauuugaagucuuguuucucuccccaaaugcauuguuuuuuccacuacauuucccuucauuucucauacuuugccuguguuguguaugucuacuuuuacuacguauuuauuaaucuaaugcuauuuaguaauguuuucaauguuuuuaaaauuuuauaaaaagaugccguauacauucugagguuuuuuuguuuguuuuuuacucacuacuauauuugugugauuggccuguguugauaacuauagccuggugcuaaugcugcucuacaaauucuuguguacacauccuugugcauaugcgcaagaguuuauggugcauauugagaaguugaugguuuucacuaaauauugauaaaacucuucucccgaggggcccuccccgucaaccccuggcuucaagcauaguaucaguuucucguauuuucagcacuugguauuuuuagacuuugucauuuuugccaaccuuguaagugugagaaggcuauuucauuuuaauuuauauuucucugacuucguauuuuaauauuuucaaccauuuaguagucucuucuaggaauccccuauuccugucuuuuaucuaauuuuucucuuggguuauauguucuuuucuuacuggcuacuccuaauucuuuaccuauucuggauaauaaugcugagguagcuuaccuuuccauuguuuuacuguggccuuuuguugacagauagcacgugugauuugugcugcccucccgugcagucucuuguuuauaccucaguaugucuggaguugaguuuuguauguaguuugagggauccaauuuuauuuuuccgauacacaguuuauuaaauuguccauucuuugcaguaucugcagugucccauuuguaauauaugacaucuucauguauguguggagcugugucucgguuuucuauacuauucuuuuggucuauuuaccuaucgguaugccuguacauauuucacuaauucuuuuuuuuuuuuuuucugagacagagucucacucugucacccaggcuggagugcaguggcgugaucuuggcucacugcaaccuccaucucccagguucaagcgauucucccaccucagccuccuaaguaacugggauuacagguguccgcccucuuaccuugcaaauuuuuguauuuuuaguagagacaggguuucaccagguuggugaggcuggucuugaacuccugaccucagguaauccgcccaccucggccucccaaagugcugggauuacaggcgugagccaccacacccugccuaguucacuaauuccuauaguuacacaauaaaaaccuggguaucgggcagggcaggucucucuaucuuguucuuuuuguuuuguucucuuucucucucucucuuuuuuuuuuuuuuuuuuuuuuuuuuuuuuuuuuuuugagacagggucucacuguaucacccagccuggacucaaacuccugagcucaagcaauccuuccaccucagcccccauucacucuuuagugcagucauagcucacugcagccucaaauuccuaggcucaagugauccucccacuuuaaccucuaaguggugggauuacaggugugcaccaccagacuuggcuaauuuuuuuauuuugguagagaccgggucuugcuguugcccacgcuguucuugaacuccuggucucaagugauucuccugccucugccucucaaaauucugggauuacaaggcaugagccccacugcaccaggccaaaucucuuuaaaagauaaucaauuuuaaaaauuaguaaauuguggccaggugcaguggcacacacuuaaaaucccagugcuuugggaggcugagguaggaggauagcuugaagccaggaguucgagaccagccugggcaacauagugaaguccccuaucuguaaaaacaaagagagagauuuaaauguaacauauuuacccacauaguuaccauuucuacugcucuuaauuccuucgccuagaucuguuuuccauuugacaucauuuuauucuguuugaggcacuuccuuuaauauuuucucuauucuacuggugaagaauucuuucggcuuucguaucucugggaaaaagucccuauuuugccuugagauuuuaaaagguuuucgcuggguaugucugagaauauagaggaacuaaaaaccucaguuucuccuacuguaguuucacaucacgcuucugacaccagaugugcugagucaggggguacuuucccuagacaucaagcaagcaauucauucugcaguggacaccagcugggugucccccaguucaauucuacuucaucuacccagagauagcgucagaucccacagguugaaggcugagccccgcacaacugucccccacuuccaaugccagucgcaagccccagauugucuuaccuguuuuuuucugacugaauagcuauaaauugggguucccacaacccccuucuuggguuugauuaauuugccagagcaggucacagaacucagggaaacagcauuuacugguuuauuauaaaggauauuacaaaggguacagauaaagggaugcacagggcgagguaugggggcaggaguguggagcuuccaugcccuccccaggugugccacccucuaggaaccucuguguguucaguuauucagaagcucuccaaacccaguccuucgggggcuuuuauggaagcugcauuacauaggcaugguugauugcaucauuggccuuuggugaucagaugggcuguugucuguucaccuugaaacugccuugaaaugcaucauaaacacagcagcucuuugucagucaaucagagagcuguuuaucagacacugaagaauccagcagcuccucacacaguuccagagucaggccuaagggggagguuaucuccuccuugcauuccucagguagguagcaugaucucuuauaaaccauuuccauuuuaugauagaacucuucugggcacugccauccccauuacaguguuccugugacaucacccccagacagcaugguuauuucagguuucagggucauuuuguguucuucagucuaggcuccacacaggacuaugccuccaggauaugucuccaccagcagucagcuucugcucuacgcccuguggccuugggcaaccuugcuggcucccauuuagcacguccaauuaauauugcucaaaggguggauuugcaugccuucuguuuuacaguacuauguagggggagcauuucccacucagauguaauguccauugcaugauaaagagacacagcuauuucuuaugaaguguguucaaauauaccaccucucucuaaacuuuuaccuuaguuccaucaacccuuacuuuccuaacuguagccuucauuaggccuuuaccaacagguuucggucguacaauucaguacuagcuaggggaaguguucccuggacagacauaauauccauuccuauaaaucauuuagguaaagaggcacaacuuccuuauauaaagccuacuuaaacaucccagcuuugaucauccuagcaauccuuacauuuuuauguucucacaaucuuaacuguagcccaagucagggcuugcccaguggguuuugauagcacagugcuuaaggcucccauaucgaggagucccaggaauuauucuucaccucccagacgauuuucccacuuguguccauaaggcuguggguacccagcaggggacugggccaagacaccuuugcugucugucagucuuuuucuugauuaaucugccugacuauugccccaggcaauuucagaucagauccuucauuguaaucucugccucugacuuuuuaaauuucuccaaacuaggguaaauguagcaaacauuuuucaaaccccuuuaugucgagagaccagcaggacuucccuuugaucuauccagccuuccacaguguugcauuaaaacauuuguuuuaaccucauuuuauuucaguuuccauuuuauucaucccaauuuuuuuuauuuuccauagguuauuggggaacaggugguauuugguuacaugaguaaguucuuuaguggugauuugugagauuuuggugcacucaucacucgagcaguguacacugcacccaauuuguagucuuuuaucccucacuccccugcguccccaaaguccauugugucauucuuaugccuuugcauccucauagcuuagcucccaccuaugagugagaacauacgauguuugguuuuccauuccugaguuacuucacuuagaauaauggucuccaaucucauccagguagcugcaaaugccauuaauucauuuuuuauggcugaguaguauuccaucauauauauauauaccacaguuucuuuauccacuuguugauugaugggcauuuggguugguuccaauuuuugcaauugugaaucgugcugcuauaaacaugcgugugcaaauauuuuuuuugaauaaugacuucuuuuccucuggguagguacccaguagugggauugcuggaucaagugguaauuucuacuuuuaguucuuuaaggaauccccacacuguuuuccauagggguugugcuaguuuacauucccaccagcaguguagaagugcucccuguucacauccacgccaacauguuuuuggggugcggggcggggggugugggcagagucucgcucugucacccaggcuggagugcagugucgugaugucagcucacugcaaucuccaccuccuagguucaagcgauucuccuaccucagccuccugaguagcugggacuacucaugcacaccaccacgcccggcuacuuuuuguauuuuugguagagaugggguuucaccauguuggccaggcugaucuugaacucuugaccuccagugaucugccuaccucagccucccaaaaugcuggcauuacaggugugagccaccauggccagcaauuauuuuuugauguuuugauuauggccauucuugcagaaguaagguaguauugcauggugguuuugauuugcauuucccugaucauuagugaugcugagcacuuuuucauguucuuagcugacuuuuuggugggauuuuuuggguuuuuucuugcuaauuuguuuuauucaucccauuucuuaauagccaucuaaagauuuccaccauacugggaaaagucccaugacucuucucuuuguuuuuccucuguuucaucccuaucgguguguucuuuuuuuuuuuuuuugagacggagucuggcucugucgcccaggcucgagugcaguggcgcaaucucugcucacugcaaucuccgccugccggguucaagcaguucucugccucagccucccaaguagcugggauuucagcugccugccaccacgcccagccaauuuuuguauuuuugguagagaugggguuucaccgucuuggccaggcuggucuugagcuccugaccucgugacccaccugccuuggccucccaaagugcugggauuacaggugugaacaaccgcgcccggcccaguguguucuuauucaccuuauuucuuaacaaccauaaaaaauuuccaccuuccugugaggaguccugugacucuuccccccuacccuucaucauucucuuguuaauuaaccuaauguuuguauuagcaucuguaagacucaugaggggaaacugagcaaguacaucucauaaggcuucuugaacuaucucucgauuuuguggcaacaagguuaaauggggcauccacauuaaaggggcgccccuaaucgcaucauuuaccaugacuuggguagcaaggcauauucagugcuugaauaaucugguggucauaaacccaggccccacauggcaugaauacaaaguguaucagcuguuucagcuugacguuuauagguggagucaggcagucccccuucuuccaacauucaaaaccaaagacacugcuccuaaauuacucucacagugcauuuuaguaaagccuccucaggaagcugaugauaccaaucuaaaaaaugaaacaauuccuucacacuauacccucugcuuucaauggcuucuugauuuugcccuuuccugacacugccuucuuggugcccaaaguccuuaggggugcuuucugaugucgcugcauaauuuuucccuugugggagcgagguucugugagucuacuggcugaagcauagauugacugaaaucugaacuuggucuggcaucgagguuuggcccagcacuuucuuuuuacuuucauucuagcuauuacagauaacaauaaccaaaggguugcauauuuuguuuuuuucuuauuaguucgcauuucuucaugcauucagcaaaccaccuuccagggaguuagauugauccaccucuaaauuccauugguaacuuuuaccuuuagugacugaugccacuccauaccauggguauggagcugccacuccauaccaugggugaccacaugggcacccaggaaucaaagguuucucaccccccaaccccuuuaucuguuuucuucccaaacaugagcuagggauguucuagcagucccgauucugacaccaauucugaaaaugcugaggaaugaacaaacucgguuucucccacuauuuucgcauauuacaguugugacaccagaugugugggggguuuccccaggcaucaagcaagcaauucauucugcagcggacacuagcugggcguccuccaauucaauucugacaccaucuacccagagaagugucacaucacacagauugaggguucagucucacaagaccacccccaacuucugaugccaguugcaagccccagguuguuuuaccugugccucuggccaaccugcuguaaaucgggguucccgcggcccauuccucagauucaguuaauuugcuagagcagcucacagaacucaggaaacauugagguuuacugguuuauuauaaacgauaucacagaggaugcagaugaagaggugcauagggcaaggcaugugagaaggagcacgcagcuuccaugaccuccuugcaugcgucacccuccaggaaccuccuuguguucagcuaccuggaagcucuccguacccuguccucuuggguuuuuugggaagcuucauuauguuggcaugauugauuaaaucacuggccauuggggaucaacuuaaccuucagccccucuccucuccuuggagguuuagagaugggucugaaaguucugacccucugauccugccuugguuuuuccagugaccauuguccauccugaagccaccuaagggcagccggccuucauucaaaucaucagcacacaaaaagauacuucaucuucuauaguaagugggccuaccuuacaccaagacugauaaagugagggguuuucuaaacauaggagagaaaguucaggugcugggcacucaaaucaagugacagauguucaccucgggcaucagcacaguguaugcagugaaggaaaacugcagaaugacagccaugcagcagaccuggagaaccccuagcuagucucaggucuggauaucaggaggccagagagcuucaggcaggaggaaaaguggagauuugguagaauaucugauaugauggagaguuggaaaaaauuugaggauuuggugagggcaaauggugccaacgagcuagaaagacaauuggaaacuccaaagaaaacaaacaagcuuuacaagaaaggauauauagucucaguauauuauuugauacugcagugaauacuguuuauacagucaugauguauagcacugguuuuuuauuuaaccaaaacuaauuauguaacuauuggggggaaauggaagaagugagauggguaucguaucauugaaggaugucaguacauuagaacuaaaauggcuaaaccagaaauagcugugugagcauaucacuuagagauacagaggugaccaccaggagaaauaguaaaggugguucccccagcaagguagccauuauaggcucucugagcuaguggguuuugaaaaaccaugugcaucuauuuguuuuuuaauugucuuaaauuauucuuaaaaacaaaauaaguuucuauaggagggaccgcagucaccaguucauagguuaaauggcuuuuauuccaaaaguucuaagucagugagauugcuuuuccuuuagaaacauucauauauaugugguuagauccccaaacuaguccacaaauacagguuauagugaaauuaaaauauccuaguuuagaaaucaaaagaagaaaaaugaccaacuuuggaguccauucuaguaauccaagugagaaaggauggggauacgguuggaguuuucugcacaccuguucaguucaccaguuauucuucucugagauagucugguuugugauuaggcuucucacccagcggcucacagaggaugcuacucucauuagauucugcacuuaccucucacuguaaaaagcuggagaagacuuuggagcccuucaucuuagguaaccucgucaaugacagguugacacuaggagugcauuuagcuuggcaugaaagggaccauaagcugucccccuuccucaucauucuguacucaaagccccucacuacucacaagcaccuccgaaccaggacuuuucaaaaucucugcuucuguucuuauuuggacagcccauucaacuccucugacuucacucccuuaucugcauaacacagcucaagagcugucaccucuuaacaaucucuccagaccucuacccacuucuccaugcaccccucuucaugcccuccuggacccacccugggcucacugcaguauucauucauaauaaauuucccauuguuucccauuguuugcuugccuguauacuuguugauagcagggaccaccauguugccuuuauaaucauaugcccaugcagggcuugguacauagcaggcacucaauaaauauuugaauggauucaaaaaugaugagccagauugaguuaauacauaguuacagcugaaaacuaacuuuucuuaaaauccucaugcccugacccacuaaccuaauggccagaguccaagugagguucagcuguggucugcuaugaagcuggaaauucccuccuuuggguuauuucacugauguacuuaacuuggucuucauucuuuuuauuucuauuuuauuucauuuuccuucuuccuuuguucaaaauaccugucucgucuuugguuuugagacaaaagguaucaucuaucaaguucuaucccuuuccugaucuccuauuaacuagggagaagggaguuuauuuuagcauucacaguuuguuaacauacagcaggccaugccuugugcuugauuuaauuuuuccuguggcucaguggcaugguggauaagaacaucccuucccuccccaccacgaagcuggaugcccuuucugguggcauaucccauuucuguuuugaacccguacauauugaaugguacauaagacauucaacagucuagaaaauaagccaccagauuucuguuuaaccccaaauggaaaugauauugcuuuucuuguuaugcaaguaacccacgcucacuuuaaaaugauuuucaaauauaaaaaagcuaaaaagaagaaaguaaaaucaccauaagccuacuauccaaagauuaaugcuuuucaacuauuuggugugugguauguauccuuagauacuugcuuucuaugcauauaauuuucuuacaaaaauaguuuuacuauucacaccugcuuuuuuuaaguuacauaugucgcuguacaucauuauuaauuacauaacauuucaagauauaaauguauaauaacuuacugaauuuuucuucugagguugggcauuuauguugcacauauaggccgggcacgguggcucacaccuguaaugccagcacuuugggaggccgaagcgggugcaucaccugaggucaggaguucgagacuagccuggccaacauggugaaaccuugugucuauuaaaaauacaaaauuagccgggugugguggugcacgccuguaaucccagcuacuugggagcugaggcaggagaaucacuugaacccaggaggcagagguugcagugaguggagacugcaccauugcacucuagccugggcaaaaagagcgaaacuccacucaaaaaaauaaaauaaaaauauguuggacauauguggaaaaaucaaauauucaagaaacaggcugugcuguuuuuaauagacaaacccuagaaacaaccuaaauguugaggauguacuccaagaaguagaagugccaguuaguaugguaauaauguauauguagacacauugcuuuuucaaauaagauuaaaaauugcagaaauguaaacaugaagucauuacucauuuaauuugacuucccagagauaaccaccauuaacauuugguguggaucuauuuucaggccuuuuucucuauggauuuaggaaaaauuuuagugaagucugugguuucauauuuuuuuauauuacacauaucucugcaacuuuaauuuuucuccuuuauauuucuugaaagucuuuugaagucaucuauagagauuaaacuccagccugcccccccuccaacacacacacacacacacacacacacacacacacacacacacacucacaucuaucccuucugcagguugguaacauuggagcuuuguaauuuaccugccaagggacuuugggaauuuauuccuugguucauucaaaauaaauaagucaauuugacugagugcaugccauaugcaaggcucuggggaaacuaagcugcuuaugaccugagcuuagaguccagugaggaagccuggaguaugcauuugucauggugguaaaaucgugcaguggcagcauggauguugcuauggaagcagaggaaggaaucucaauaaggccaagggugucauggucacugacaaauuauugcauagacugagguucaaauccugguaucugugcugaacguggaggcucacaucuguaaucucaacacuuugggaggcugagguaggagggucauuugagcauaggaguucaagauuggcuuggacaaaauagcaagaccucaucucuaccaaaaaaaaaauuagccacucaugguagugcuacucaggaggcugaggugggaggcuugcuugagccaggaguuugaggcuucagugaaccaugaucacaccaccgcccuccagcuuggguaacaaagcuagacccugucucuaaaaaaauaaaaaauaagaauucuaguaucugucccuuguuaacugagaccucggguaaauccuuaacuucugucucagugcaagcuggguguaauaauaccuaccccacaaugccagcaugauuauucauuggaaaaaugauuauaggagaggaguauugaauguccauuaguauaugucugcuuaaguaaauaaaucguggcauauuaauuaauacaauauuaugcagcuaugagaaaugagaucauuccauguguucugauaaggucuaacucggacauauguuauuaauagaaaaguguguguuuugcuacgauuuaugggaaaaacuuuuuaaagaugggaugguagauagucuagguaaauacaaguauguauauagcuaucugaaaggauauccaaguaacuucauagugcuugccuuugaggaagggaacugggaucaggaguagggagaaaguuugcuuuccauuuauacucauuuaugcugcuuaaauuaccauauacauuuauuauauguaaagaagaguuuuuaaaucaggaauaaaauaaagugugucauuaaggcaauaucaacuuaaucuagcuauucaaauauuuuuacaugggacuuuucacaaucuuuucaugaaguaguuauaagcauggacuuguaggugugcuuacuggcuauagaaucuuggaaaagucaguuaaucacacuagaccucccuuuucuucuauaaaauaagaauuaauaauagccaccuuauuaaggguguugugaaaauaagauaacaaaauugaguggaaaacaguuaacauggugcguagcauauuauaagcacucaaauauuuguuguguaauaauuaauacuaaaggucuguaucuaucagugguauuaauaauaaucuaauucagcugccuuauaccaaaaagggauauuugugggcucacacaaaugaaagucuguggcaugugugccuuuggguauggcuguaucuagcaccucccuugaagggauugggacucagccuuuccccagcucuucuguguuggcucacuucccaaguagcuccaggcucgcacccuacuggccuaauaaugcccagugaaaagaacccaguacuuucccagugguucccaagaaaaaucccaggauugacugacccuuccugcauuggucauggucucaucuuuaccccagacacuugagccuugggauugaggccaggauucaguacucaccucugcaacuuugaugggaagagucguccuaauguugaucagucucaagucuugucuuuucaugcuuggagacuaauagaaacuaagaacaucaguagagcuccuuccccaguggaaaaaaaauaggggcaacaaauaucaggcaggcagacuauagauguuccccacuggcuccagugguaauucuuuugggguuuugugguuuuuuuucguuuugagagagagagaugggagacuugcugugcugcccagguuggucucaaacuccugggcccaagugauccucuugccucagucucccaaguaccugggacuacaggcgcauuaccauugcacccagcucuaacuacauacauuuuccuacauagauuuucagaacugcuuaccaguacaacuguuucuuugcagaggcauguuaacguccauggggcugagguuuuaacguuagcacauaccuuguuuauaguacaaguuacccuugaaaguacugccggaaggugccacauggaguuccacacagaaucucacagagccaggcuuuaccacugcuuggaaccaaauggcccauccuucuguugauuacuggauaaguuggcuguuuuacugguaggggccauguaauguaaagaucugugcauaaacaaugaauaccucuccaaucaguacgaugcucacgcugugaacuaacaaaaauugagaugaccaagagaagagauuuccaucuacccuggugcucagcccagggcagggugguguagacagagcucacccgcacuauuuaaauccugucauauaguuuuuuguuuuaccaggcaugugugcuugaauuugcuaaguuaagcauuaaaauaaugcugcuccaucaaauaucaaaauucuuagcccuuuuucaagagauucuaauuauugcacccauguucagaucugagaccaaacagguaauaugugguccccacaaauccaguuccgcccucccuguucacucaacaggggaggaaaaauaacaggauaacccaacgggaaccucccuucugaaaaggggaaaugacauaaagugcucaccuccugcuucuugucauguccuccacagggacagcaguuuguagagccuauaaguccaccccaaguuccaccuccugggaggaauucuggggcugccccuucuucacaccucacuuauuucuggcguggcuuuuggaccuagugauugauuuccuuagagguucaacaucauggaccuucacuuucuagacuuagugauucuuucgcaauaaaagugccuugcaauuuuaguagcuuguccaucuagcauucaaauuuggucaauuuaugguuuggugcuuaguaacgagaguuacacaugaagacuagucccggucuuucgaaguuaagucucagucacuuagcagcagacauggaaauuucccuaaccuacaguuuaaugguuccauaggccuuugccucauggcagucugaaacagcagccugggagggagagauaaaacuaguaugcccccagccugcugaccagugggugguucuuuacugcugaggcacggcccuaggucccuaggaguucugggucccagacucuuuuccaaguuugccuucuuucuguucacuuuauuuucauuuuuugagacaagagucuuucucugucauccaggcuggauugcggaggcaccaaccuccaccucccagguucaagcaauucucaugccccagccucccaaguaacuggaacuacaggugcaugcuaccaugcugggcuacuuuuuguauuuuuaguagaguuaggguuucaccaggcuggucucaaacuccugaccucaggugaucugccuaccucggccucucaaagugcugggauuacaggcgugagccauugugcccagcccauuuguugacuuuaauuugggcagagaauacagcucuaugucuccuuagauugcuuucuguagagaaggccuccauagcaaagcuguuuucuuugaggcgggccagccucagaugaaguuucucucuaucuguaguaucuuccuggcggucacaagaagugaccaacacacucugccacucucuaacaaggccugccaacucccugucacaccauagccaucuugacucagccaguuccauaagcugucacuggcaacagcacaauucuagguucccgacucaaaacacuugaagcagcugggcacgguggcucacgccuguaaucccagcacuugaggaggccgaggaaggcggaucacgaggucaggagaucaagaagauccuggcuaacauggugaaaccccgucucuacuaaaacuacaaaaaauuagccgggcgugguggcggacgccuguagucccagcuacucgagaggcugaggcaggagaauggcaugaacccgggaggcggagcuugcaauaaguugaaauugcaccacugcacuccagccugggugacagagcgagacuccgggucucaaaaaaaaaaaaugcuuuaagcaaaaaggagaguuuauuggcuaauguaacuggaaagucugggaaagaccaacaguugcccccagggcaugaccagagccagaguuuugagugguggucucagaccccucucucuccuucucuccacucugcuuuccccugggaaggccccauucucaggcagcuuuaggcuccucacuuaccaaccuuacuggaaagacauaccugcuucuugccagauaguuccagaaacauuccugggguuagccuuugcuccuccagccuuggucauaagccauucaaccuguucgcggugggggcggggagggcaggaugggccacaaugauuagccaggccuggaucaccugugugcacagaugcgcuuagaccaggaaagggauggcuccccaaggaacaaacagggagcuucugccugauaaagagugaauguuugcuggaccaaccacagcaggcccacacaaggacuugacagaauggcugggaggggaagaugaaguccagcaagcagauuguccuuccggagccauuagaaugauguuuaacuuagcacugcaguagaaagauaaggugugccacugaggcaagccacaucguaaaauauauauauaaagaaacagaugaaauaauuuuaaugcuacaucugacccauuaacaacauugggguuagaggugcccugacacagucaaaaauuuagauagaucuuuugacuccccuaaacuuaacuaauagccuguuguuugggguuuucauuauuauuuuagugauggggggucuugcuacguugaucaggcuggucuugaacucuuggccucaagucauccuccugaguagcugggauuacaggugugauccaugcacccagcccuaauagccuacuguugacuagaagccuuaccaauaacauaaacagucauuaacacauuucauaugguauauguauuauauacuguauucuuacaaugaaguuagagaggaaauguuaucaauaaaagaaaguuuggaaugaaugaaaguggaauccacaggauagauuucccucaucagccaagcaggacuagaggugagggugugugaaauaggccgugcugggcagagcugggcuuugccugagugucuuacucuuuucccuuaugaucuaaagccagguuucuccaacuuuaagguguaucagaaucaccuggaaggccuguuagauugcucagccccauucccagaguuucugauccaaugcaucuuagguaugcucuggaauuugcguuuccuagcagcugaacuugguccaggguucaaaguguagaaggcauaugggcauauaaagcagcuggaugaaaaaaaaaucauaaggaagagaaaauagauuuacuauucauuacuggaaguggaucaucauaaaauucauccucguuaucuucacauugaggaagguguggugaaagaaaagaggagggguuggucuuacugucucagggaugacagaggaagaagaaaacccacauauagguggacacacucauggccgggugcaguggcucacggcuguaaucccagcacuuugggaggaugaggcaggaggaucacuugagcccaagaguucaacaccagccugggcaacauacagaggccccaucucuacccaaaaaaaaaaaaauuuaaauuagccagacaucauggugugcaccuguggucccaucuacucaggaggcugagaugggaggauuccuugagccugggaggacaagguugcagugagcugagaucacaccacugcacuccagccugggcggcagagcaagacccugucucuaaaaaaauaaaaucaguggaaacggacaguccaaacccauguuguucaagggucaguuguauuuuauuuauuucauuuaacaugugaucacuacuaaaauuguugagauauuuuacccuguuuuguacuaagucuucgaaauucaguguguauuuuacaauuauagcacaugucaguuuggaugagcuaguaaccaguggcuaucguaguagacggugcaggguuagcugguaacuuuccauagaggggcugaauaucuagcuuccgcugauaaguuauuacuuacguuuucacaucacggggaguuguuuugaaauugcaacucucggcuggguacaguggcucacgccuguaaucccaucacuuugggaggccaaggugggcagaucaccaaagaucaggacuucgagaccagccuggccaacauggcgaaaccccgucucuacuaaaaauacaaaaauuagcugggagugguggcgugcaccugcagucccagcuacuuggggagggcugaggcaggagaaucacuugaacucagaggcagagguugcagugagccaagaucgcgccacuccacuccagccugggcgacagagcaagacucugucuuaaaaaaaagaaacugcaaaucuccucauuagaagaaucugccugaaaaugagccuaaauacauauuuuugugcugaguguccaguuggugccauuuauuuucuaaaacaccugucauacccauacaauuaguacuuaacaacugcuuaaccaucuaucuuuucucuuggacucgaagccccuuaucuaucuugcuuacuaagcccaaugccuagguaccuagaagacgcuauguggauauuuuaaaauuuaauuggaguuaaauuaaaaacuuagauaagggcuucucauuugcuaggcuugauaagaaaauggagaaaguaauagugguugaagcccaagauugcauguuugcaguauuuguuuucccgaugaagggccguuuguagucugugacuaguuguguuacgauccaaucacccuuucucucauugaauauacaguauauagagagagugauugaaaaucuacagaaacccaggcucugugccaagcacuggguauacaaagauaaaugggaaacagucccugccuuaaaggaaaugagaaacagauaagucuuacaguaauaccgaauaagugucaugauacaaauaaacacagaguguuuggggagcacaaggaaggggguccaacccaggucggagaaugggagaugggcaggaaagacucacuguggaaagggaauuuaagccccacggcgccugugauauucuuagcauccaaccccaugccaggcacaugauguguugaaucaaugaacaaagugacuccugaaccuaaugcugaaggaucgcuguguuuguccaucuggguguggacggaugaucacggcaggugaagagagugugcaugacaacccagccuacaacgcuagaauccuggcucuagggaaugacaagaugcugagugggguggagcagaggggugagagcuggcaugagccugcagcauuuggcaggccagcccacaaacugccucccuucuuguucuuguccauaugaccggugacgagagaucgcacuuucuuauuacaggcaaagcgaaggcuggagcuaggagaaagcggucaucaguaccucucagaugguuuaaaaacccccaagggcaaaggaagagcugcacuacgaaguccagauaguccaaaaaguaaggaucuuuucaucucuuuccuuauucuccuugguauggcauuuccaaguuucaaagcuuauggccggaaggaugccaaggugugaauaauucuggcauguuuuguucuuuuucauuucuuucugugcuuauccaaaaaaauaaauacaaugucagcagacaaccagugaaaggcuacagagucacacugguaccauaagggaagacuucuuuuaacuguauguaguuucauuuuucaacucggaauacgaacuuuuggcaccauucuauaucaaauuuaauuuuaacuucccuuaauggacauugcuucagagucugaggcaaacuggauguccacgaacuaugccagagucaccagugucugugccgaccucaaucuccagcucagcauaugauagcguaagaauugauugagcccgauaaauugcaggcuguuucucuuucuaucaaauacuauuaccguuucuugugggagagagagaaacguagguuagaaauagccaacuagucccauuauguauguguuugcauuuaacauaagggcuaaauuagacuuuguucucucucuuccuuuaguucaugcauuaggcaauccacaaauugugugacacuaaauuaaaaccuugaccugugcaccuaugggggaacaaguacaauauuaaguaaggaaauuuccuuuaagagagauggggagauuuggcagaagacuuuuccagguaauuauuuaucaaaaugaagcauuguuuggaaaauuggugaacaggugauacacgcacacacagauaccagagccugaaaggccauuugagaugggucuguuuaagaccuuguccugcagugcuagugagacucauagccuggcuccaucaccguaggccucgugugugcugguccccugaggccacagcacucuuucauucauuugacagauauuuuuuagcgcccgcuauauguaaauucuucauuggagccagggaaugguguaagucaagguagaaacucuugagaaauucaaggugaaaugcuuuaaucaaacccuggaauuuuuaccuucccuuccugcucuaauaaaaaacuuucauagcuuucuaugacuugccaacaccaacagcaacgacagccuugcuucagauacuaauacuuuggcugcagugggaaagagagcuugcuugacugcaaagacacccuucauuucuuuaccuuucccccuaucccccacccgcucgguuuuuguuuuucuuuaagcuccaaaaucucccucagaaaaaacgcgguaugauacgucucuuggucugcucaccaagaaguucauucagcuccugagccagucacccgaugggguauuggauuugaacaaggcagcagaagugcuaaaagugcaaaagagaaggauuuaugauaucaccaacguucuggaaggcauccaccucauuaagaagaagucuaaaaacaacguccaauggaugugaguaggaguccuccccaugccccggcucugagggggucguuucaaacugccugguuucuuaguuccucacuuucacauccacgcccacacguucuuuucuuuucucuccuacuguuuucuucucucucauucucucuucccuccucagcuucuaagccagaaguuugaagucucuuuacaaagagacuuuguuuagauacugucagagauaaaaggauuuauauuugaugagcauccagcaacggcauccuuaaagaggucccugcaguuggaaaguggacugcuguucaucuguuacauagaugucugugugcacccacguguguaucugacagauguguacacgucuucagcuuguuucuaauaagaaucuggaaaugauggcuuauggguuaucuauguguauacguacaacugcauaguuacagaauaucuuuauccaugguucuaauagcagauuaacucacuuucuggguaaauuaaggcaagacuuaaaugccuccauuucgucuguagagcagggaugguagcaugauacuuauacagccacacguaugauuacauauguaauauauuuugugaauuuuagagcaucuaaauagccacuauaagcacaguauugaauuauuaaagcauuuuggaaggaauaauucuguuacaggagggcuuugaaaagauacuaauucagauggaagaugaauacauaccuuuuuuugcacauuuuggaauuuuguugacaguuugguaacccguuuuggccucugguuuagagaaacauauugugcacuagucucaguucuugcauacaucacauacaucuguuuccuuuacuuucuuuucuuuuuaguuguugauauaagacccucaguaauuaccugaguuuuugaugcuuuuuuggauggguuguuuuuuuguuuuuuuuuuuuuuuaauuuugaaccauuccaucuucucugucuuucucuaucuuuuuauccuuuuucgccuuucuucccccaccaccugggagccaugaggcaagggaggaaggugguugccuucuuuugcccucugaauuugaaccuucugaagaaguagaccuccccuggaggaaagaauccugaaaauagcagugcgcuuucacuaaauuucuaugcugugaaaagugcagaacuguauuuaugaaaaaaaaaauauauauauauauauauauauguguaaauguucuaauuuuaacacuuggcuaacaagcaaugugaccuccuaugucaagaggagacauuuacccaaaggaucauuucuccuuccccucccucccaugaguagccaugaagagucuguguuuggguuucuaggggcugcagucugucugaggaugggggcaugcuggcccagugucaaggccugucaaaagaagugaccgagcucagucaggaagagaagaaauuagaugaacugauccaaagcugcacccuggaccucaaacuguuaaccgaggauucagagaaucaaagauauccuuugugccgccaguucucuggggguuagugcuuccuagacuauuuccagaguugacaaucugacuuaugcacaagguagauuauuauucugaugucaugcaaaugaguaccugugugccuguguguguaugugugugugugugcacguguguguguaaacccaguuagcuuugccuaaaaagucaguauuuaugguaagauagucaccaacucgauccuauuauuaucuauuuugauaccaggugggaacuguuuuuuaaagcauuuuuucaugugugguugagacauggguauacucguagcguaaggccacacuauuaaaagauacauaaggugucgguauuaauauuaaugacaacacuaagcagauucgucuuuggcuucccagauuuuugguggguguuagcugucacuguugggguucucacauucuauuuucuucucaccagauaucguagcaauugaaauugguugaaucuaucugauugggcuauaguugaaggguuugaaagaguagagaaaaaucauacuauaacucuuaaagugcauucugcugauucccaaugaaaaaacugauuucaaaagcaccccaagaccugagaaaccccucucaauuccucuguuccacuacaaacauuaguccucgcaaauaaaaauacaaaaggucaguucuuguucucaacuuccugacaaucuauugacgaucucaggaaaacuugcucuucaucaucucacuacagacaaaguaagagagagauugccucauuaugucaaacaagacuugccaauauucucaguuauuagaagacaaaaaacaguacuguaaguuaucccaucucuaguuuuaguuccaaacuucugaugauugcacauuuaccauuauuugacaaaaacuaaaaaguguucugcccagauucuucuagugucucaucuuuaacaggcucccccuuggagaauauggagauauuuauuuucuuccaauguuggcaguuuuucaaaccugcaauuguucauuuccuguugaccaaagaauuaaccuugucagccgauaauuagugagauggaagagaggcguagugauuuggacccccagugguuggcagaguggguuuacaggggaagaaaccaacaguugggcuguuucauucauuguuugguugggagccccauuguggaagagaugggugguuacaugugauuggcagccuuccgggacauguggcuuauggcauugucaccuauauuagcucucucuggggccuuuguugcagaaaaugaaagcuuccuugcagggaacuucgaacccaaggaguaaauucaggagggagccacaaaggaagcacuuuuaaguuuguaagauuagaaaauacauuugcacaauuuauuucaguucaccauucaguucccaaauugguacagcuuguucacaaauguguugaaauuuuccuuccugcagcauguugaguaaucguagaugaguuuuucuuuuacacuugaucuuagccaaaaggccaagaagugaugaguuuuuauuuuaauaaguucuugucauacagcuuuuugacagugagcuguaguguaaguaccugguugucaguuuuuuccaguguucucaguaaaaaaucagaacugccuggcccucuauaaaggcauccguugacuucuuugauggguuauguagugaccuaaaacccagaauccugcaagagcagccacuacaagcucaacacugaauuagccaucaucucaacuguaaagauuugaaggagauagucugugauagauccccuacauguguaugcagauuucgugugaaugugcuuucuuucuggaguaguaguuccauagcugcauucaguuucuaauaagaagcuacuacagccaggcacgguggcucaugccuguaaucccagcuacucgggaggcugaggcaggagaaucacuugaaccugggagacagagguggcagugagcugaaaucgugccacugcacuccagccuuagugacagagugggaguccgucucaaaaaaaaaaaaaaaaagaagcuacuaucguaagggacaugauuuauucuagggucucuaagcccccccuuuuuuuuauauuaaacauauuagaucacggacucuauuagccauuaaauacguuauacuaccugcugaaaugccuucauugguuuguuacuugcuguuuuauccuaggaauuuuuuguggguacauauaaaaaauaauaacgggcuaaagacauuguacauuaauugaauacuuuugucauaucguaaguaccauauucuuucaugauagccuuuuaggcuuggcugucaggacauuuaaaagaaugguucagugcuuagaaaaaaugaccaaggccgggcgccguggcucacaccuguaaucccagcacuuugggaggccggaggcaggcagaucacuugaguccaggaguucaagaccagccugggcaacaggguaaaaccccaucucuacuaaaaauaaaaaaaauuagccgggugugguggugcacgccuguagucccaucuguuugggaggcugaggcacgagaaucauuuaaccccagagacggagguugcagugagcugagauugggccacugaacuccagccugggugacagagcaagauucugucucaaaaagaaaaaggaaauaacuaccaagaguacugagauauuauacuuuucucuuuuccuaaaucaguguuucucaaauucauucaagucgcagagcaccuggaaacugcuuucuuccucaugaacacugaaauauugauagaguuaauauaguaucacgcaaagcauaauuuuucuaacagaaauaaugacacucuuuucuguaggcaguacauaaucacaaccagcccaggugcacuuaagaaaacaagcugucugccugagcaguauucugaguuccuccacuaauguauuuguuacuuauuuauuuacuugguggcugcugacacuugcuuguagauagaaguaacuggaguuucaaaaaaauuauggcuaauagagauuacauuuuuuuuuccugcaaauuggaaucugccaucauucaguuugagugacagaacacuuuauuggaguucauggaaugccugugcugcaaaggacccuggcuucaagauaaaauuucugaccacuuaguuuuuuauuuucuuaugaucauuuauuuuaacuguucuguuucuauguuuaauauuuuaaauagccauagucuuuuuagaaaugggcgggauaaagcuauucauuucuuuaguuguuuagagugucaaccagaaaugaagauucaugggagacccuaaacauuugcacauccagaaggggagacauacacauacuuuuuugagaaggagucucgcucugucgcccaggcuggagugcaguggcgcgaucucgucucacugcaagcuccaccucccggguucaugccauucuccggccucagccucccgaguagcugggacuacaggcgcccgccaccacgccuggcuaacuuuuuguauuuuuaguagagacgggguuucaccguguuagccagguuggucuccaucuccugaccucaugauccacccgccucggccucccaaagugcugggauuacaggugugagccaccgcgcccggccacauaugcauacuucuaagucauaaaauacuuuaaaauauuccaugcaucuauuuugucauuuucaucauacuuauaucugagguaauuagauggaagauuccuugacacucuuuacguuagcuuauguuacauaucaagauauucgaaaaauuaguggccuuaaagaccaaacuguuauaguugugaaagccccuccagaaacaagacuugaagugccugacucaauagagguaaggagacagcgucuuuguucaucugcaaagaucuuuguggaaugccugaaauugaaugacucauugacucauaguuaaagucugucccccuccuaugaacuugaugguucuuucccauuuauuuuacuuaaccauacauuugaaaacauuucaaugguuugauguucauugaguauucaaacaaccuaacuuugaccuagcaggauguucaguucaaagugguauaugaugcgcugucccucucauacuuucucuuuuucauaauuugucaucaacgguuuugaucaauuugaaucacuuuggaaaguuuauauugauuauccuguauaugguccccaccacgaacagauauauaaauguuuuaaagucucucccuaacuuauaacauuuugagagaucacauggggcuuuggguuagcugauagacuagaauauugcaagaaaguagggggcauauuuuuguaauuuucagauauacuuggauaauagaggccuagacuacaacuauaacauaaagaguuguaguaaaaagaaaaugcauaggagauaaaaagagaaugaaaguuacacgcuuccaucuaggguagacuucuuaccuuaaaagauaauaauagcucuuugaccuagaugaaaaagauuuuuaaauguugguaugcugcauucucuuaauagaugcaguuccuagcacuuaagaauacuauucaucaguauacaguucaacaugaaaaaguccuaccauaaaggaacaauaacauggagauacugaauuuggaacacuuaaaggaccuuguaauaauuugcagaaaaagaauauauccaaagaacacaauucaccucacccauugugcuauuuucagaaugacuccccucucccccaagccccacuaaaauaguuuucuuucucuagggcaggacucagcaaacuuuuucauugaagugccagguagauaguaaauauuuuuggcuuugcgagccguacagccugugucuagacuauucaacugugcaccucugacauugugauacgaaaacagccagaggcaauaauaaacaaugggaauggaugugacucucuuccaauaaaacuuuauuuacaaagccacuuggugaacuggauuuggcccuuaggcugugguuugcugaccccugcucuagaggaugacagucuuucauagaguuggacuaguagggaaaaagcaagugaaaaacgaacauuguucuuacuuuccauuuuuagacaagaauuacuauggcuuuuauuucuaaaagaacuucugauucgaacuucucccacuucuguucauagagccuacaaauacauuuggcaaguacccaagggcccauugagguuuacuuauguccagaagagacugaaacacacaguccaaugaaaacaaacaaccaagaccacaaugggaauaucccuaaacccgcuuccaaagguaaaaacuccacuuuugucuuuuagaaacuauguuaaaaaugagggugacuagaaccaucuguauuggaaccacaagccuaggcaagaaacacaaacuucuauugguauuagguaacauguuuuaaaagacauucugacugguuugcagaagaaaauaaugauuugggaaaaacggcuccuucacccacuuauggagucgcuucaggcuuuugcuauuggcagagaauguuuccuuacagcauuuuugaaaaccagcuaaagugaggagcaaagcugugaacugucuuguuggaucaucagagacacuuggccacacaccuuugaaucacacugcagagcucaucagagagggaaaugaaaaagguuugaggagaaaagccuuuguuggagaauuuuugucuuauuuucccccccaaugagauggggagaggauaugggaggagaacgcuaggaaaguaagucuugccgggugcgguggcucacaccuguaaucccagcacuuugggaggccgaggcaggcagaucacgaggucaggagaucgagacuguccuggccaacacagugaaacccugucucuacuaaaaauacaaaaauuagcugugcgugguggcacgugccuguaaucccugcuacucgggaggcugaggcaggagaaucacuugaaccagggagucggagguugcagugagccgagauccgccacugcacuccagccuggugacagagugagacuccaucucaaaaaaagaaaagaaaagaaaagaaaucuaacuucuccuucccgcucugcaaagagcaaaggaagcucuuugcaguauauauuuuuccauuuccuaacuugaggagauauauaugcaauuguuucccuuagugucucccuauauagcagcaagaauaagggugauuuaagugaauaagucugauuuaauacugagcaaaaguacaucaccugaaaugguaaaacaaaaggccaucuuucuucaccacagaaauccaaaguggaucugucuuauuguauguauuuuuagagaucuuuuuaauaagcugguuguucaaaaaagacugaguuaaaaucagugaauucugcauguagucccagcuauagggaggcugggguggcaggaucgcuugagcccaggaguucgagguuagagugagcuaugcuugccugugaauagccacuacacuccagcguagacaacauagcaagacgccgucucuuaaaaaaaaaaguucuuuuuucaguuggugaguuucuacuaggaagccaacuuuucaguauguauauauuguuuuguuuugauuuucuuaaaacaaugacuagauagcagagagaaguuuuugaacuuguuauccucucaucauugaaguuauuugcauucuuguuuauugacaguaguuauuugaaaaaugagugaguagacuagggccaaagaaagauggccaggcaugguggcucacaccuguaauuucagcacuuugggaggccaaggaagacagaucacuugagcccaggaguucgagaccagacugggcaacauggcaaaacccugucucuacaaaaaaagauuaaccaggcaugguggcucacaccuggagucccagcuacuugggaggcugaggugggagggucccuugaacccagaaguucaagacugcagugagucaugaucacaccacugcacuccagccaagagaauaagacccugucucaaaaauuaaaagggggacggggguggcaaggaacuuuuuuguaccuguuagcauaaaaggugaucugcaucauaaagucgucucauugucauuauuugcggaagguacaugcuuuuuucuaacagcaacauauacauucuuccagaaaaauucauuugauuuuucuaacuuauuuuuuguuuccaucaauguuuucuuuucagacuuggcuucaaccaacucaggacauagcgauugcucaguuucuaugggaaaccuuucuccucuggccuccccagccaaccucuuacagcagacugaggaccaaauuccuuccaaccuagaaggaccguuugugaacuuacugccuccccugcugcaagaggacuaucuccugagccucggggaggaggaaggcaucagcgaucucuucgaugcuuacgauuuggaaaagcucccacugguggaagacuucauguguaguugauuaugcuucgugugaacucuccuuaaaaaccgauauuuuuuuaucauggaaccagaacaucugucaugcaguguugucccuuccuaccuucuuccuccaagagaguaucaugaaguaaacuacaaacuucagaagaaagcugacauuuuaaugaauuuuuuaaaaaauuaauaaacaaauugucuaaacgcacaguugcaggcucccuugggaaagcccugcuuugcuccaggcuccaagaucuccuggcuaagucagcaagugagaaaaugugcaaucaggugucucucaccccgaauuguccuuccuccuuccuccccggauuggcuugcugugccugacggaugggcuguagaauggggucuggccaccuggccugcugggaaacagcaaucuuccuuaauagcauuucaagccgugccuucuccgcagaaugcaugucuuugaggucugcuaauauggaauggaacugcagcaaaugcaaacuugaagucaugcaaaaguaugaaauggauuucuucagcucuucuuaggaauauuuaaauuacugucauaauucaguuuaagcuaugaacugugugucccaguaggaggucaagaaaaccuccacagccuucuggaugaagaaccuguuuucaaauauacuuguugcagauacagaagacuaguagaguucugccacucuaagcuguuguggauuuuccugucuccaugaaccacucccauucccccguccccaauguguuugugaguuuccaguugauuuguagcaaaugccuacuuaguucuuuguggauuguucuagacuuuuaauuuuuuuagcugccauuuaagcauuccuguggcacccaucaccauuucaauuuaauuguuuacuuugaagcgguuuuugcaaauucauauuacuuaagcagagggagagaaccucuacugaucagagcaucuaaaccugugugaucuaagguuuaucagccucugcaaggagcuuugucccaucgugcuuccauucccaggagggggagcuuggagcgagucaguccuggggcuugcugacauggguggcccauuggaaaggagaaccaggucagaugauguaacagccccaaggagcagcaggcaugggucccuccauccuugggcuucccgggccccugugacaggggaaagggcucucuuacaccgcacucagggagaccacuucucaggauggggucagauggagagaccucuagggagaaagacauccccauugugugaguggcauuuccuuaagcuggcaggaacagggagcagcccugugucgggggcuggaauaguucuggccagaccccguuccccuuccucuaugaaggaauaaguuggaccaagggaagucggggacguaaaaaaugaagcaaaacaaugccagggugucucccgcuuuacucuucaggaauggugucccaaguuggaggcuuugugucagcugcaaauccuaccaguuauguccaagaauggcuuucccucgggcagguggcagcggccaucucccacugggaauauggcguaguaucuccgguccauuccuuggaugcuaaggacugcgggaaugagggagucagauaaagaacaaaccucgaaacgaacaguuaaauugaaaugcuaugugccugacccaaugguaggcacauaguaggcacucaacucauauguuuaauugaauugaaaauaucccuuaggaaaaaaaaaaaacacacaaaaaaccacaagagccccagccaguuuacuccagguagauuuccacaauaugcaaaguggugguggggucaagacagaugacaccagcacuuuaaacucuuuguguggguaugcguggguguauguuugggaagaaaaacaaaggugcagacuaucuuccuuuuuuucuucuucagccuccaucccuggccuccuccccucacacacacuggacuugguacaaaaugucggugugguccuagaugaagcauuggggugggggagggagagggagcuuuguguuaagugccuacuggaaaugcacugugggguuuuuuccuguaugggaaaccauuuaugccaagcuuuuccccauuucccauauuuaucucaucugguuagcugccucugcuuccagcuuuguguaauucucuuugccagcugcacaaagcugauuuuuuccaaagucuaaagacugagcucaccuggcuagauuguuguguguuuuguugaauuuuuucauaauguaaugccguauuuauuguuuuuaaaaugaaaggaauacuaauaagucuuaaaaguuccuucaugcauaagauuuuuuuccaguuacuggguuuaacugguguacauuaauuagauguccauacuguauuuuguuugcauuaaguaauuuucuuuuugacuuaguauccggcacacaaaguggguuaguacuacaguauuugcguuacuuuaaguacuaaguaugcagguuuccugguaccauugaguugcugcuauuaaagcucacacacgaaauggcuaaaaguuacaagugugcaaauuaugacugcgugagccuuagaaaauaaaauguauaaagggcaacacaugagcugucaaacaguguuaggaguguguuuauauguacagaguugugcauagcaaucguuuuauuuaaguugauauguagucuacucacauuuucauuauuuagcaauuuuguacaaaaauagcaauuaauuuguaaacacugccagaauacuuucuagcugcuuuguaauuuuuuaagaguguuauuuuguuuuuguuuuucuguucuuuguuguggcucuuguuuucauuuuuguuguacguguagaucuguaaauaaaauugcaguauuuaaagcuuaagcuuucaggaaaaagaaaauaagaauucagugugugcaugacaacucguguguaugagaaggagggauaugaaggaagauggcuugcagaguaagucggguggcaauugucagggugugggaauuucuuuuccuacgggguacgugauuuuguaaaaaggaaguauuucucccaaaauugggaguaggcaaacuacuaaucaguuuagcuuuguguuguaugcuaguuuaaaaaagaaaauauguaauauaauguaaaaaaaaacaaaaaaaagcuuuuaugauggauuuuguaaauagauuuguuacagggugaccuguucucuagcugugaucuuaccacuucaaauggguguaauuugaauaaauuuuguaugguaaaggaucaauaaaaugauuuuuuuuaagaguucag

SEQ ID NO: 17245 - RNA, 5952 nt, Homo sapiens
cuuuccggcggcgcgcugucgucacgcgucccgcgccuccucgcgccugcgccgugguuggaaggucgucccugugaccggcuuggcgguuggagcggcugucgccauguugucgguagcaucccgcucaggcccguucgcgcccguccugucggccacgucccgcgggguggcgggcgcgcugcggcccuuggugcaggccacggugcccgccaccccggagcagccuguguuggaccugaagcggcccuuccucagccgggagucgcugagcggccaggccgugcgccggccuuuggucgccuccgugggccucaauggugagccggggcgagggccgcgagcagggcugggggucucucggugcccgcuccuccggcccccagcagggagcggccgcgggcgcgcgagcggagccugaaucaggucgggcugggcggccuccgcaacucugggccuggcccccgggcucggggcgucuuucugguggccggccuggacucgcguccgccggcuucgccugguuccuccucggccgaguucacgagcucuguagucccgcuguuccagccaccucugagggguuuuguugcuugcaggucguuugaccuugggcgaguuucuaaacguacuuccugugaaauggauucauaucuuuaucaauuuuguaggggugucgugaggcuuagguggaggaauucuacguaaagccguuagcacaguuugggcacuuacaugcuuaagaaauggaaacuuacuaauauuugggaaguuggucuucucaccacuaccgaucccuucauguccuuccccuucaucacccccccaccaaaaaaaaaacaaaaaaaacauacacaaggucaguuacaguguagugucacaacauaaucagucgucaaggacgggcagagauugacgacauuuacauuuuacagaugagaaaacagacgagguagaaugacucgcaccaggauccgugguguggacaugugguagcagggauuugacaagacgaauugucguagccacugagcucuucgcaggggcuauuccacacccucuguccuuagauccccguuuaucuucuuugccucgccuuccaucuuuacuuggcccuguaucggagauagagaaauggcagccugugggcagugugucugcaggcuguguaguuuucaaaaaaacugggaagacuaauggcaucucuuaaaaugcuggaagccgguaauacugggaucuaguuucuacuugggaaaauuccauagugugcuguguaguggccgcccccgcaguuggagcaaguggucuucuccaguuugucacagucuuuaccaggucugcguguuucauucuguuaccagccuggcuccacugauagcuguuugugacucuuccccuacacgcuaaccaaauugcccgccacuuuucuuuuuacucugucuucauucacccugggcucugcacuuucuucaugguccuuccacuaaguugcuacauguccauauguuuuccuuacccaucuuuucaaucucaguuaaggaucaggugaauaaaguuuuuauuugcugauuugucugucucuguagcacauacacuuuacacucuguauuguguuuauugguaacuccuccacccuugggcuuaagggcauagagaagguaauaucuucuuuauuuuucuaucuuucacaacgucggauuuuguauacaguuagugcaaaguauuugugaaugaauauuuguuaaggagcaucaguggguuuugaagaaacuguccauggcagguguagaguacccuagcccauccuugggaccuggaggugagaaggaaggaaggagaacauuucaauagcaaaagaaaagcaucuuuggaauucgucguguugcuaaaguuucuucaaaaaauuggaggcuuacauuucucugauggccagugaugcugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcaaaaauuuucucccaauuuuuagguugccuguaaaccacaaugagauaccaucucacaccaguuagaauggcagucauuaaaaagucaggaaacaacaggugcuggagaggauguggagaaauaggaacacuuuuacacuguuggugggacuguaaacuaguucaaccauuguggaagucaguguggagauuccucagggaucuagaacuagaaauaccauuugacccagccaucccauuacuggguauauacccaaaagacuauaaaucaugcugcuauaaagacacauuuacauguauguuuauuggggcacuauucacaauagcaaagacuuggaaccaauccaaauguccaacaaugauagaccggauuaagaaaauguggcacauauacaccguggaauacuaugcagccauaaaaaaugaugaguucauguccuuuguagggacauggaugaaauuggaaaucaucauucuaaguaaacugucgcaaggacaaaaaacaaacacugcauguucucacucauaggugggaauugaacaaugagaacacauggacacaggaaggggaacaucacacucuggggacuguugugggguggggggagggggagggauagcauugggagauauaccuaaugcuaaaugaugagucaaugggugcagcacaccagcauggcacauguauacauauguaacuaaccugcacauugugcacauguacccuaaaacuuaaaguauaauaaaaaaaaaauuggagguuuaccugacuuagagaaacuauuuuuagaaacaggcaaauaauguagaaccauaaggcaaaaaccuuuucuguaaucauuucagccuguaauuuaaguucacauuauagucugucuagaugguucauggcaggauggcuuaugggaguggagggguuggaucuggagaagauucuugaauuggagaggaagguuguacuauuuucaugcagauuuccaaggcgcauuggagcucaaccuuaaaauaaaacuuguuuuguuaaaauuccuuaaauuuucuccuuuaaguauuugauuuugcuuuagguuagaauuaaaucuagcaucuuacugaaagucagaccuaaugcagcucauguaaauauuuggagaaugauuuuugcaacagggcaguuuaauuuccgaaaggauucuuggugguguagccuacuaaaguguaaccagcuagauagagugggaggagacuuuugccaccaaaucucugaaugagaagggcaaagccauuuuauugaguuuucuuguacauuuccuuguauacuguuaaggguuguggauacuguuuuuaauguagaaguaugaacuuuuuauuccuuuaucuuuuagggaggaagcucaucuuuucuguaaucccagguagugcuaggagcaaguaauuuaugcuuaauuccaaaugccaguauauacuggcagguuagcauuuauuuguuagaguaguaguauaggauguaaugucacuuugacuccacagauucugggaugugagucucaaguugccauuaucuguguccuggucuucuccaggaaaugauuuagucagaaaagcacauagagugauuuugguagguuucauuauuguuugaauacuucuggcuuccauaaaguuauugaccuugagaaucaugugaaaagcaguucagguauuccauauuguaauguuugacuacucaaggaaguacaguauauuaggaugauauccuaguagagcaagguagaauugcaguuuauuacaauaaaaaugcaucauaaaagaucuuuauuuuggauacacauuuucuaaaagaggaauuuuuaguguccccuuuuuuaaaaaggaaacuuuguggcaaauuucuuaagaugaauauacaauuugcaaagagguuugcuuccugaaacauaccuaaaagugguacuagguaaaauuuuuuuuuggucagauauuuaaaaauaguauuggagagagggauguaacugugucuuguuuuuguuuuuuaaacuaccaaagaaacuccuugcucccaaaguacuacauaguaauuauuuguuuaacauucauuugagcucuuuuauggccuagacuagaagugccccaguugagagaacuacagcagugaaaagggaagauaauaccccuacuuuuacaguaacuauugcccuuuacugaagagggggagauaugaaaauuuugcccuuuuuuucccuugcuaaauugaaauaauuaguucuuuugcaguuuucauuuuauuuugagagcucugauaaggauguccuucucugccuauuagugguuuuaaguuaaaguaauacuaauuuauacacuagaguauaaaauagaaacgcuaauuuuucugcagcagaguuauacaguucacagaauguuuauuauaucauuauuauuuuaugaauuaacaguuuuuuccgagaacauagauuggacuauaaggggcagacauuugccuuaauaaggugaucacacgucaacuuacuguguggacuagaugaguuuuaggguguccuucuaauccagagaguaugggagguauuuagcaugauuuauauaguaagucuuggcaguugaauuuucggaaacuuugaguuauuacuguuuauuuugcuguuuaacguuuuuagcaugaugcacugagguguugugaauccugaaucagcaauguucaaccaacuagggggagcucaauuuacaaauaguaucuugugauuucauaccaguaugauagguggugguucacuucauuucauuuuuaagauuuuauaugcuagcaccgccaauuugacuauuucugagacccagugagugccauauuucacauuuuuagaauuugauuuuuuaccugugaauccauaaagggcuauuuccugauauauacucccuucgggauacucaucuaauuguguuuuuuaaccuucuguuugucuugcagucccugcuucuguuuguuauucccacacagacaucaaggugccugacuucucugaauaccgccgccuugaaguuuuagauaguacgaagucuucaagagaaagcagcgaggcuaggaaagguuucuccuauuugguaacuggaguaacuacugugggugucgcauaugcugccaagaaugccgucacccaguucguuuccagcaugagugcuucugcugauguguuggcccuggcgaaaaucgaaaucaaguuauccgauauuccagaaggcaagaacauggcuuucaaauggagaggcaaaccccuguuugugcgucauagaacccagaaggaaauugagcaggaagcugcaguugaauuaucacaguugagggacccacagcaugaucuagaucgaguaaagaaaccugaauggguuauccugauagguguuugcacucaucuuggcuguguacccauugcaaaugcaggagauuuuggugguuauuacugcccuugccaugggucacacuaugaugcaucuggcaggaucagauuggguccugcuccucucaaccuugaaguccccacguaugaguucaccagugacgauauggugauuguugguuaagagacuuggacucaagucauaggcuucuuucagucuuuaugucaccucaggagacuuauuugagaggaagccuucuguacuugaaguugauuugaaauauguaagaauugaugauguauuugcaaacauuaaugugaaauaaauugaauuuaauguugaauacuuucaggcauucacuuaauaaagacacuguuaagcacuguuaugcucagucauacacgcgaaagguacaaugucuuuuagcuaauucuaauuaaaaauuacagacuggugua

SEQ ID NO: 17246 - RNA, 7498 nt, Homo sapiens
aggggaggagaccggcgcgggugcuggaggucagcaggggccgugggcgguggacgcuggaaugccuuggguuccgagggacccagcugccugaauggacacgaguaggagguuuuugcugggcgucuuugcgguggcgggaagcggugagggagggaaagaaggauacaagcucaaggggcaggccgggugcaccauccauccccgugcccucgggucaucucagggagacugugggaugauagugcguuugugggccacaguucacaacgaugggcccugcaucgggucagaggaccccuccggaacagggggaugcacaaggucaagagaaugcauggaaucagagggcugcaccaggucaggggggcugcaccgagaccagaggaagcaucaggucaggaggaugcacuggagugugcauccccagggggccacacuggguaaggaggaugcaccagguuaggaggcagcacugggucagaaggaugcacuggaaucaggggacuguaccagguuggggggcgugccucaggucaggaggaggcacugggguccgggggcaacauugagucaggggcagcccuaggucaggaggaugcauggggucagggggcugcagggguuugagggcugcacugggucagggcgccauaccaggucaggggaugcgcaggaucgggggagaugcccggggucgugggaugcuggggguuggggggaugcucggggucggggaguucucgaggucgggggauacucggggucaggggguucucaggguuggggggauacuuagggucaggggaugcucuagguugggggaagcucggguucaggggcuauggccagggaggaaggacaaucaggaaaguggggguagcggauucuggaagcuaaauaguuucaggaaggaggaauugauagccaauguucagaaguacugugaggccaagacuccagagacaauugaguuuggcauaugccagucauuggcauccuugacaaaagcaguuucaaaggaguguggggaagcuacaucucgucagaguggacugugaaaagaauauuaagugaaguggaaaaaaguaaguuucaacaaccuagguuggcagauuuagcaauaaaaauacaaauacccaguaaaguuuaauuucagauaaacaacaaguaauuuguaguauagauauauuuaucacuaaacuaauguugcaugggauauacuucuacuaaaacauuguuuugagaggugacagcgugcuggcagcccucacagcccucgcucgcucugggcaccuccucggccuuggcacccacucuggcugugcuugaggagcccuucagcccaccgcugcacugugggagccccuuucuaggcuggccaaggccggagccggcucccucagcuuguggggagguguggagggagaggcgcuggugggaacccgggcugcgugcggcacuugcgggccagcgcgaguucugggugggcgugggcucagcgggccggcacucggagcggccagccaacccgccggcccugggcagugaggggcuuagcaccugggccagcagcugcugugcucaauuucuccccgggccuuagcugccuucccgcggggcagggcuggggaccugcagccugcagugccugagccaaccccccccgccaugggcuuccgugcgcccgagccuccccgacgagcgcugcccccugcuucacggcccccagucccaucgaccacccaagggcugaggagugugggcgcauggcucgggacuggcaggcggcuccaccugcggccccggucgggauccacugggugaagccagcuggguuccugagucugguggggacuuggagaaccuuuaugucuagcccagggauuauaaauacaccaaucggcacacuguaucuagcucaagguuuguaaacacaccaguccgcacccugugucuagcucaggguuugugaaugcaccaaucgacacucuguaucuagcuacucugguggggacuuggagaaccuuuguguccaaaaucugugucuagcuaaucucguggggagguggagaacuuuuguguccagcucagggauuguaaacgcaccaaucagcacccugucaaaauggaccgaucagcucucuguaaaauggaccaaucggcucucuguaaaauggaccaaucaucagcaggaugugggugggggccagauaagagaauaaacgcagccugcccgagcuggcagugguaguuugcuccgguuucuuuccacacuguggaaguuuuauuuuuuugcucuuugggguaaaucuggcugcuguuuauacuuuggguccacacugccucuaugagcuguaacucucgccgcgaaggucucuagcuucacuccugaaccagcgagaucacgacccuaccagaaggaagaaacuccgaacacaucugaacaucagaaggagcaaacuccagauacgccgccuuuaggaacuguaacacauaccgcaaggguccgcggcuucauucuugaagucagugagaccaagaacuuaccaauuccagacacaguuuuaguauuuguuaguaaaaguacggccccaauauugcacgggacauacguauacuaaauuguuacuaucugaaauucacauuuaacuggauguucuguauuuucaucuggcuacuuugacaaccccucugaggaguugugugacaaagggagcagagaugggcgguaguugcuagagaggcaugguaucaaggaaaaagucuguuuuaagaugggagcuauuaacaaaacauguaaagagggaaccgcugaugcaggagagagggagcaacugcagagcaagucuuugagaaagguaagagaggguaggaccuguugcacgagggcagagguuguucuuaggagccaccagaguugagcuguguaguaggagagugagcggaaugugaagcuauagcuguggguugguagacauggugaggagaaagugagaaaauacucuucugguugcuucuguguuaacaaaggaaccaacaagaucaucugugagcaggggguggggacgagggaggacugagaaggggugagauuguuaacuuagacauuguaaggcgaauuguuaaggauauguagccagauugccaggcagggcagaaugcccacuugggauguguggucuuaagucucaaauggaaccagucggccugcuuguguuguuuuggcugcucuagugcaggcagggaguuagaaaauuaguuguagcugagauuggaguuugacacagaagauggagcagggaacagaggaguucggguucuaugcagagaaauaacaucagacaggaucaugggguuuaagcuggugugacaggauauuuagauggguuuuucugguuauccuggaauuggccacuugaacuggcaaagaaggcagauaacuaaggugaccacauguuccacuuugcgugggaugacugauuugugucuguuaugaaggcuuaauuauugagugcccuuuuuacugucaaaaguguuccuuuuagacgcuauauggucacccuaaagucuccccgcacuauagagaaagcccccuggccgggcgcgguggcucaugcuuguaaucccagcacuuugggaggccaaggcggguggaucaugaggccaggagguugagaccauccuggcuaacauggugaaacgccgucucuacuaaaaauacaaaaaauuagccgggcgugguugcacgugccuguagucccagcuacuugggaggcugagacaggagaaucacuugaacccuggaggcggagguugcagugagccgagauugugccacugcacuccagccuaggcuacggagugagacgcugucaaaaaaaaagaaaaggaagaaaagaaagcccccagcaauuggguaagacaccucuugaagcuuaugaggaauucacucagcuguuuuaaucuggguuagacgccucuuggagcuuaugaggaauucacucagcuguuuuaaucuggguuagaugccuuuuggagcuuaugaggaauucacucagcuguuuuaaucuggguuaguaccuguuggcucgaggcacccacgagccugugcuugcugcugucagaguggagcugagcaucaguguggaguucuuggcggaguugggcugcccucaggacuauaugugaccaagaguaugugccugcuuuuggugcagaaauucccaaagguaggagaccugcuggagaaacauaagagcuggauggagaggaggguggccaggaagcagcugcauaaccaugcuguggauaucacagccucucagcucaagaacucacacaugcuccucacacaaacaguauuuggcccaucuaugugucuuacacaaaugccugcccggcagacagcauccgcagcagagcacagagcaaaugggaugauucagcuagggcaggucaggcagucucugcacaaugggccugugaauggaauggccauucacaggguuggaggcuacagggacccacagaaaaaggcagaucuagacagugccucugcccucuccagccguagaggccaaugggcagcccaugguaugguggcugccgucucucgguggcaaguugauuuccauaggcccagaugcauauucuggguuuggguuuggguuugucuuccuugcuuguagagccuuccaggcaugacuacccaauugcuuacagaaugucuugccuuaucacaggauuucccauaauaccaccuuggaccaagcacccuuguaagagcgaaagaggcagacagaggggacgugaccgcaagcuccacugguuccaccauagaucgcacaccccagacugccacccugauaggacaucagcauggccccacaaaggcacagcgaacgcuccagcagaguuggaagcugugcugugggaugcaguauauauucagagccuaauaucaguguauggugcagcauccccaguagccaggguccuggccccugggaugugccgaagaugcucuccugggugacacaggguucacuaaaucuaaaagccucuccuuacuugggauccucauggaucccaggcaacaaaauuugguccugguuaugaguaggaaacgggagggaggauuauuucuggaaugcaggggacucacugggcaucuuuuccuuggcuggugauaccaguaaacuggcaaugcagcaacccuggccugacaaggaaugauaaccaagggcucagaccucacagggaagaaggucugggucaccucguugaggaagcagccugggccacagaagugcuagcugcaggugaagagaacggagccgggugauuaaggaagaagaugaugaaaaucacuguagccuuagaacuaacugcagcagugggcauuauagcccaaccuauugacccuccugagguggguuuuuucccccaguaaaguaugacuggacaccaucaugaggaaucagggccaggacagagaucuguagccguggauccgccauaccaggcaggaugguaacagaggccaucagugcccauccagauucccccaacugaaggcugcuuucugggaacaccugcaucucucuuugugcuugagggauuucuuuuuggagcagagcaagcuggaagcccuagagaguuaauucagaagaaggccucggccaauggcaggcaaagaguugguguguaaaugcccuggcggggguagcuuggcugguugcacgugccccauugcauggcagagucccagggagcugcuccagucucccucggggaagugccccauagcacaccuuuacuggccuccccacuccccuccugcucuuuccugcugucaccucccaagugaaaugcuagcccuggaucagcuucugggggaauccagucaagguuguuauuaucacagacuaaaacaaccuauacuuauuacaauucaaagauauauauauuuguuauuagagacagggucucacucugucacccaggcuggguugcaauugugagauccuagcucacuguagccuugaacuacugggcuuaagggaugcuccuccucagccuccagaguaacuaggacuacagaugcgugccaccaugccugcguaauuuuuguugcuguuuuuuguagaaaugggaucucgcugugcugcccaggcuagucccgaacuccugugcuccagcaguccucccauggcaugagccaccacacccagccucaaauaucuaugugcugaauugcacacuuuuuagggaaguacauccuggaacaaaaaagugauguggaaucuagcaugacuucauuuuccucuccuuuuuaucagaggauguguugaagugcagccaguaugcaaucacuugacuguccccagcgucaucaauuauaaagagcaagggggaagcuaggaaaugugaaucugaggcuuggcagcagcauuugaaaaaaauaaagugagaaaucccuggcagcggcacgcccccuucacagugaaaccaaacccucugggucucggugacuugccguuucccagguuaggugauccugccauuaagccaggauguaugggccuugagaacacacagauuaaaaaaauaaauaacacuguauuccugaaacaaaaacacucagaauaggaaagagacucuuuuguuaacauaaagaguacuggugguguuuucuuucuuuuuucuuacauuucugguccuaauuccaaagccagcuagcaaacauuagugcaguauaugcagaaguuggcagcaaauaaaaucauuaaaccuaaaauugcagugguagcuguuagagcgauugaauaucguugcauagcuuuguguuuucaauucugucucagguuuuguuugaccuggagagaaagaauaacucugaagcaugaaaucccuuugcaaacagucuuuagaaguacuaggagagacacaauucccuguucuuagauuuuuuuaauguuaaaucaacaccuuuuguguucuguaguguguggcacaucagugugugguaagccauaauuaguacagaaccuaacccucaaaacuacuguaauuugcuguaucuuagacauccuuuuuacugaagacuaaugauuauuuggucuucuguuauucacaggcucucaacuccaugcuugcagauuccugccuuauucacuguuguagauaccacagagcuuccuagcacaguuauucaauacaucaggcugcccauucaguaacagcacucaccacaaccuguaaauacaguauuaucuauuuguuuucuaaaaauguuucucuccccucacuagaauguaaacuuaagaggagggaugcuguaaugcucauccaugccucacacauaauagaugcucaacaaauacgcguugccucaaaaacaaaaauaagaauacaguacauugugauaguaacagaguuggaggagaugccuguguccaguugucuaguucaaaauaugcugaguggccacuua

SEQ ID NO: 17247 - RNA, 13017 nt, Homo sapiens
uauuuguuauauacauuuuauugaaaaaaaauuuuacaacaaaauauuuuggcaaacuguaaaaguauacauaagugcaaauauauccuccuuuuaaaauacaagcaaagugugaguauacacggucauaaaaauaucuuuaaaauauggugguagaaaacaaccuuguaaaaacguuguauugucacaauacugaaaaccacuuucuuaaacuagacacauuguuucuaaauaauuccuuaauaauguucuuuggcaccuguauccaaauguagugucuggggaaaaugacucucccacucagcuaggcaacaagaagaggcuuucuugaaaucuugugcuuagcacugccuuuuugaaaagcacacaaguuuucuuagacacacacacacacacacaacuugucugcuuuuuucacacccugauuacugaaggcaacgaagaucccacagauacacguugaugccuuacgcauggcacaucuucccaccugagucugcccucucccucaugugggagccugcagguauucagauuggggaacgcuaccuugccagcgguuguccuucuuccagcaguaggcaaauaacagugaccaacgcgauccugggcauucuggcuaaguggcagguguguggcuuacugcuauccgcgugcaugugacuugaauccgucccaguuucuaucugcccccucugaggaggggagaggagagagcggccaucgcuuggccucuuuccguucacaugacgcagggcuuaauauccugacagacgcucugguggugauggugauaauacgacccgcuagcugagggauggaaagaagaaaucccauugaaguugaggacgaaaucuuuucugucacacacuggaguagagugaugcugguaacggggcagucccacugaaagaagaaagaaaaaaaaaccucuucagaaacaaagucauccaguggauggcagggugucuuauuuugccucagaguacaaaaggugcugcugugccuuuuaguaaauugcuagacagcugguagagaaagcccagcuuuagaaguagcucaaacacaccaacugcacgucauagaauugcuuuggaaucauuauguuuuguuuugaugcucgcacaaacacagagcaaguucccccucgagggggauucuuauguccuggaauuccaauuuuauucucugaggcuggggcgugcacuuuaaucucagaaugagcacagguaccggacaacuagacccagacucugguuccgggucucucccggcagagcuccuggccugugcugcccugagcccuggcuucagggagggccaagcacccuaccccagaaacaccacugcggccuucuuucugagccuuguuucccaacuaacugggccggucacagcagcgagcgcagaggacucccugugccaaaggggacgauagaaaacaacccaaucgcaagaugaagggauggggcagaaaagcacgccucuucuccugccccuccgcaggcaucuucgugggucccgaacgucuuagacuuccucuagagaagccgggacuucagggcgcagagaaaugcccuuugguccgaagcaucuggcagcgcgaggagucccugagguagccccaggcuggagggggacagagaaggccuggacccugcucucccggggcggcuccccgguccccggccugcaccgggccgcuugaccuccacccgccgccggcuuuugcuuuugcuuucucggcgccuccuggccccggggcgcaaucggcccgcagugcccugcgcacugggccccagaggcugcuggaccgggcccucucggcaccgggcugcguuagguccauucgcccgggucuuuucuuaguuaaccgagugguguggggaccauaaagugcacgucgcuucgggccggauucaguuuuucagugcaagaaaaccguaaccacggcccgccgggcucgggcccugcucucguggccucagccccgccguguccccgcaaugccggagcgaggcggcugcucaggggccgcugccuacuuccuugcccgcaacaccuacccgaacacacccggcgcugcgcuaacgcagcugcccugucccgcgagccccgaugugugcgcggcgcucugcacacaggugaguucccucgucgcguuaaagcaaguucugauggcaaguccuggaccacaaaauagcaggcucgggaggagagagggcgagcgcucacaccugcccacgaaggcggccgucggcgcuuugaugugcugagcgggaugacagaagcccgagcuccuuccugaagugcucgcagggcuuaauggagaacuccagggcagccccugcgccggcaggggcacauggaccauggccaccaggcccaggagcggagggcgcggcccuuggggugugcugggggagggagggucgugcugggugugugcgcguagacaugugcugaucugugugccggggagacugccuuggccacccccgcgccucgccgggcccccaggccucagugggcggcgcgcucccaacuaggccccgcggggucccggugcauccggccggcuccuccgaagccuccaccgcuggcgcuccagggagauggcaacagggccggguggguauccuauagggacgggagcaagacagcgaggaaggaagggcagagggucccugucgggcgucaggcccgagcuauugucucccccgggcguucccagacucggucggggguucugcgaggcucccagggaaggccggccgcgggaggccgcuggguaggggcacagaggccggcuugcuuugcugggcaguuuucacccccuccaagacaguaauguauccagauuccgaaguuuugggagcuugugccugcgcccaguguuaugagguggggcgagagcagccuugaggaagggucaggagucucuuuccugugugcuuuuuuuucuuccuagaguacgguuucuccaaggcugcuaagccucagaguccggguucaaguugaguggaucugccgggagaggagaagaaggggagcagggagggcagcuggcaggcugggagaggagcaggcaggcggggaagggaaggggccagugcaccgaggggugugugugugugugugugugugugugugugugugugugugugauugacagccgguccaagggaauacaaaaauaagaggggaaggccgccuguauugguuacuuguugaaauucccauaaaauugaacaagacucuguucucaguggguuaagucaggcuaaaauccucuccggugugguccugccgagacugucuuuguuugguuaaccucugagacccacauuuaaaaggccuauuugggaaauuucaccguccagggaaccaacaucuuuugcccauuucugggcuuuccuucuccccgggugcucccgcugcacaccggcucaggaacacauaaagcaugcaucacccuccaagccacugucucauugcugugggaggccagugugagagaguagcuuggggccuugccuuugacuggcaggcccaugggauuuuaaucugcagcccuaggugcuccgagcgagggguuaauguaaggguuuaucucuguucuucacauuaaccuggucaaauauucaaauucccucuuccaucccuaccguccccucccaccuuucaccgccuucagcaagucaauaauuuuucauaaucugcaaccagaacaauguaaaccagccacacuacaaguggcauccacagggcaggcgcauuucucaggggaguccuagcaggguccuucagguccugccacccaggaccuguaucaucaauguggguccauuguugggcggggggggaggcagggaaggggaggagucuccaacaguuuggugacccccuccacuggcaaaugucccuuuagugaaagauccugggauccagcucugucccucccacccccuccucuuaacacuugcccagcugcaaacaucucgcugcagacaccccaacauacagaacauaucugauucugacauuuacuucgggacagaaguacagcaaaaugaacgcaaggaaaaaaagggacaaaaggaacuagacacagcuuccugaccaaguuccccaaaggccagaugccuucucuccaagcuaagugagacucugaacgggagaccugcagucuccugcacagggauccccaaagagcccaggaaggcaggggacuuuacaccacgcucacagcagccagacaauucugaagcuucggcugcuggccagggauacugggaggacaguaagacccugaucccugcucccacgaauaagaugccggcuuuccccagcaucugcuuuucccagugcccucagaccuccuagcuucggggucccuguuugugggaguggcaguggccgccagcccuggaggccuagaagcggugcgcccagcuggcugggcuggagcgugcugcguuaccugagagguccucgcgagcguucuggugcaaguagcucugcuccagcgaguaggaggacaugcuggagugcaggccugccgaggcggcgggguugcugcugggcgucagggcaggcggcugcuugagguaaggcgaggcgccaggcgagcuccagugcgccgcagggcucguguagggcgaguggcauucgauggcgcucgccauggccggggacgaggguaccgggcugcugcugcuguccggcccguagucgccgccgccgccgcccccggccgcaccgacgcccccgggucccgcgggcaccgggcagcuggccauguagguggaacccggguugggcgacaugugcgggacgugguggugguggugguggugagggugcgcguggcugggggcgcccgcgccggcgucguagcccgcgggcaucaugucgaggccgccguagccgcccuggcuguggcagccgagcggcgccgacgggggcgccuggaagucgaagcccuggggcagcagcgacgccccgaagcccaagccgcucaccacgcggugguacaugggcuugagcgccuggcacuuccgccugaagccgcgcggccggcggcggaacgagcccuccucgaacaugaacucgcuggccgggucgaugguccaguaguggcccuugccgggccgcccgaggcccuuaggcagcuugaugaagcacucguugagcgagagauuguggcgcaccgaguucuuccagcccugguaggcgccgcggaagaaggggaagcgcgccugcaggaacugguagaucucgcugagcgucaggcgcuugcugggcgagcucuggauggccaugacgaugagcgcgauguacgaguagggcggcuucucgggccgccgcagccccgagcucgccuucuuggcgcccccgcucccggcgcccgcgccgccgccgcccgcgcucuugcaggcagccgagggggcgcuggccgaauuggaggaggacgaggacgaggcgcaggaggcggaggacgacgacgaggaggaggagguggucuccggggcggcggcggcggcggcggcggcggcgggcggcgggcucaucagggcggccuggagcgcgccggggaccgggcugcacgcgcggcggagcggggccggcggcggcccgcccucgguggucaucugggacccgggagcgaggccgggccgcgagggcgggccccgggcgggaagcggaggcgccggagcggggucggcccagaagcccugcgagcgcccuagcccgccgcccgggcugcagccguggccacuccgggccagcgcuucggcgucgccucccucagcuccucuggggcuucuggcggcggcggcggcggcgggcgggaggcaacgcccggcgcaucccuccccgagccgcgggcccugccuugcgcaacggccucccaggccgcggggccgagcggccggcgccgggcgacugcgcccgcgagugggaccgcggccuggaccccggggacgagcccgacgucucccuucaggagcgcuccucgcucugucucucggacuuccucccucccucgcccuccccggccgcccuccucgcucccucccucccucccuccccccccaccccgcccugcccccuccucgcuccgcgccgccgcgcucacuccucccccucccgaccuggcggccgccucccucucuuaucucgcuccccgcucuccagggucuccucgcucuucauuccucucgcggccuccuccccuuucccucacucacccucuuuccaauugagggaucacagacucacuccgguucugccagggggacgacccccaccccucgcaaaacucgaccaccucugacuucaugaaauauucuuucuguuugccccccgcagcaagccccgcgucccaucccaggacccagccccgccccuccgcgcccccuuccuccuccuggcccgccgggccgaguggugcugcugcgggugcggcugcucggagccucccuggccgcccuccccagggccgauacugacuccaucugucaacuucguuuagacuuugccgcccucagccacacgccggggugccagacgcccaaagguaacgugccaauccucucucuuucuggcagggccugcaggcuccccgacaauuguuagggcgacugggggccgccgcaggguugcgggccgcuggcgaucguggacguuuucggaacuuugagcagagggauuuacacugagaaaccuaggccaaguuucaaagacucuggaaaccuggaucucaugggacuuaggguugcauuugcuuccacuucuuccccccacccccgcaccccaguuaguguucuguaagaaaaaagugcaaaagaaaaaggaaggaaggaagaaaagaaagaaagagaaagaaaaagaaagacccugagauaagcgagauggcuauauuuauagucaguccugaaggggugugcagcugucacuagguuuacauccuccgucuuaacauugcccacccaaaacugugccaggucucagcuaacuccuguccgagaacacuucuccccaguuguggcuaauuccucccuaaguaagagucaggcucugagagagaugugcccucgggagcaaucacuuccaaugagacccgacaguuaguuauuggauuacacgugcagggaaauguaguccgaccagggauaggagcugggagagggaggaggagagcaggaggccggagcuggcggggccucccaagggcugaagggggaggcccagaaagaaggugcugcagaccagcggaccaaacaggagguagagcugggcaccccgcugcgucuaggcugaaaggaccgaggugcacgggugugccugcuggggagccuggggaguugcaggaggcaggagaaagggagguugugcaguaaucaggaggaagacaccaggcaaagagccuucacagccgcacagccuaggcaggcccccuggggcggcaggagcccugugugccccuggagugccgggggacugcuccuggcugagugugcugguggggcuguagaugcagagagggcggguggggaggggagggguaugugggaggggggugggccggggcuggccccagacagugaccugagguugaguggaagcaggcuuuuuccaucaaacccugccuggauaccacacacagagaccgagugucaguuuacugcccugagccggcuccuucucccuaagcuccacaguaauuagacaaagaaaaccuaaauuagcugaacaggcgucgacagcuuccuccagagcaccccugguaccuacaugggaauguguccgaaaauggcuugauuguagccgagagucagcuaagaaaacaccgccaaaccgaacucaguuuaccacucauuuccaauagaaaaaagaaacaagucgcucuuuuccgggugggauguuuugauuggguugggguagggcuucgcaguuguuuccacuuucuaagaauuucugacugacugcugagcguuuuuggggggugcguccccauauauuucaugguauuuuuuucucuugcccucauuugucauuuuguguggaauaacuuaaaaauacauaacuaaauaugaaaguaaauauaauguguucacuaaaccaaugcucuaagugccuaaaauauaauuauuuucauaaaauagaagcuggaguggggaggacagauaggaucuuaaaggagcucuacugacauagaguucagugugugugugugugugugugugugugugugugugcuuuaaauggaaagagcccaggggagaagcuugugggggaaaaggacaauuaucucauuuguaggugggggcggugggcaacgggcuuuggaaacauucaguacucauugucacuuagccauggacucucucugauucucugugccugaaaauuauauguauuuggaucucagggaauacagauccaacuuguuaagagcaggccuuaaaagguuuuaggacccggagacugaagaauaaaaggcgcuaaccuuaaaauccaggcaggaccagugauaaccuucuauacuaguagcucccaguuuugggguuauggggucauccucugagaauacgauggaagcuauggagccaguuuccagaaaaauacuuccaacuugccugagauuuuaggaaguccacagguacucauuaaaacaaacaaggaaacaagcaaaaaaccccagauucuuuuagcuucuaccaauucagcugguuaaauuaugagggauuuuuuuaaaaggcuccuuucuccauccaagcaacagcaguauccauuuuaccuaaacucuaaacuugcaagaaaucccacuuagaguguggugaguguuaugagggccggccaggucgugggaaggcaguggacauuggagagcaguuagggccaggaggcggucagcugacuggaagccuucccucucuguaggggucugcauacugccccuguagacccugaacuccagaaagauaagcagcuugggggccuucuuaaguuauaucagcaggaaggcuccucuccaaaacucuuucuuggauaccccacuucugcuucuggaaacuauucucauggcauagaccaccaccacgucuacagugacuaaacccugcaucuguuuguuacagaccucgcagguaccaucuugucacccaccaaguggcccagguaucaucauccuccuuuugaggugaggaaacuaaggcucagagacugggugacuggcuacaagucacgcuggggcaagugacaaagcuggccagcagccugggccuggaacuccaaagucaguguuccuuccacugcauuacagcaaagccucucugagcuuuguuuuaaucacugauauauacaaaucucuugaguaagaauguaugugauagcaaauuaugucaauuucuguaucccugggaggaauaccuuaauuucugguuagcagacaggguuuaaaaggaaagcuguguuugucucugaaacagagccuugcuuaggauggcucccccaccccccuacugggguuccuucuuaugggggugagcucuucacucacuuucacucccuauaaauaacaugaaucuugacauuuuuuuucuuacgggaagggaagguaugguucauauaaaugagucuagaucagcccaggcaguccuugguuaaccaaaacuaugcagccuccgccgcgauggguccucucuccaucccgcuuugguugacugucccgucugggcugcggguuccuuuccccuccaacccuuuaggucccaccccugccccagcgcaagggaauguaaacuucaacaagcuuggguuucuccgauuuuguucuguaaucggcguuuuauucuaggaaaucuccucauuauugcgguuuaaauucuguguucuuagcaugcuuccucugcuucguggguuucacaugaaauggcuuagacuaaaccagucaccgacaggagagacgcauccgcaccgcacuguuugcggccaucuaagacgcaccccucccugccuuccgccugggcccgggaggagggaagccucuucccaauucaaaaugagacugaccccuguuuucgcucuguauuuaggcgcaaaguuaagucguguagaggauucucgaacuccugcgaggccuuucuaaauguggacggcgagaacucagugcuggggccugggggugucagcgugauugaggaaaugcuggaagagcaccagccugcacgcugcagaggccucuuuagaaacuucacauaacagcagaagaugcggacgggaacagcaauaggaggacgcgcggaggcggggguuggagagagcaagguggccgggagugggaauuucacaccucuccuggagucugcucuccuuccuagguccagaaacccccagaccuccgggccugaacaccagccacccaguucccaguguuuauuuggauagagucuuccgcucuccaaaggcuugugucccggucagggcucuuuuuauagccaccuucaugagagaucucccaguagccccagaucuccuggccugggcggugggcacgacucgaugacccacuggccaggucugagggugcuugaagggggaaaaagggguccaaucuacgagacccucaagcgaagaccggccucaccccauuuccgcacuucccaaauugccgggcgcggguccccucgguugcgagaccaaaaccuugggaugaucccaggagccagcccagcggccugcaggccccgaucccagugcgcaggccgcgguaccaggcggagcaccucuucgacuucgccuacagcccgcugcguuuagggguggcgaguugcgggguugcggggagugaguggagagcagaggcggcccgcuuuguccaaaaggcagagagaaggggcuuagguuggaacagagucggucugcgucucccaacgggggaagaagggggggcacccagcggcuaaagaaaauaagucaggaagccuguaccgcaaguauuccuggaagcaagugugggugccgguggcccucagcauguuaacuuuucgcccacugaugcugcuggaagggacguccccaugcuuuaggucgcaggacagagcuugcagaugccuuggaaaccgguaggagccaagcugcguccugggagacccccgagcucugcacaccuucccuccgcccucccggcuguggcaacgcucgggggucguuuagggguccgcgugccuuuugcuccgcggcccccggccucggauccccuccucccgcccgccuucccaggcuggggagaaagauggcuaggccgcgcacacacgcugggcaggguuggaggggccgcggggcccacccaggaggcgcccgcggggccugaagaggucacuccgggcacugcacgcgggagggugcgcgccgagggcuacggaagacaccagccaaaggcgcccggaggucgccaggccgcgccugcgaugcccuccaaccgagaccagaggcuggccggcugcggccgcgcggggaagcgcccuggaggucccaacccagcccgggcagggcuuucuucucccgucuggcuggucuccuccccgcugcccucccuucccccaaauaaauaaauauuuccgagggcggcgaacucggcggggcgccggguccugagcgccugggcgauagaugaacuuccuggcgcaucaaaacuccccucucguccuccccgccgagcucaggauauggggcgcgcucgcuucucuucagaaaaggaaacguagcucuuccaaaaauauaaaucagcucugacguccaaauauuucuuuuguccuccagcauccucuguggggauaaauaaaacgugcucggcgcccagaggccgacuagggaccucagggcgccccgacgccgccuccgagaagcugcuuuggggagccccccaaccccaccccuccccgcagccuggccaaaggccccgggccccggaugcggccugaccuucgggcgggcugcggcggcgggagggagggacacaagcccuccgcggaaccccggcggccugcgaaggcgaaaggcgcccgaggccgacccagucggggaggggagcucguucgcgaugggccaagagaggccggggaagcuccgggcgcgcccuagaugaguuugggcccccaggcugccucuccaggccgagcugugccagggaaccuacgcccccuccccuucauuuccgucggaguuucugaccccagggcagccuccuccucguggggacccagaguaguucaaguuuggagcacggagggccccgacugcgucuuuucccagccgaggcugaggccgaggcugcugcuccuccagaagccagucggcuuugcggccucagaggacaccacuggccuggggcguggcccucgaggcucuccgcccgucagaccuggggucggcuugagccaggugacccuuuccagcaccccugccucccaacucccgccuccaccuugggggagguggacagguuuucuguagcggcuuggaaaucuaugccaagguaaaccacaugcacgagggugguugagaugcaggguucuacaggggcugaagggagauccuccuaggggagcacgguggcuggaggcguguccgcaccuccacuccccuuccugcuccccugacuccaaggcgcugagagcccacgggccuuucugcugcccuccuuucccaagaaaucgccccauggcacccacgcggccagucugcaaggcuuugggggucaaacggcccaggcaaggagaaaucuccaucugcucagggggagcucauccuccccucacgcccugugccccacaccgaggacuguguuccaggccuggggccucggggcugcgcggcgggggcuggucuccagccgccccuucucuccaggggggucuuuauugaugagcugccucgaaaacccccacccagaacgucccagaaggguuuagacaauccaucacccaccacuucaaggaugcuuccucc

SEQ ID NO: 17248 - RNA, 2679 nt, Homo sapiens
ugcugagggacaaaugaaaaaaaaaagcucacggucgggcgcaguggcucaugccuguaaucccagcacuuugggagaccgaggugggcggaucaccugaggucgggaguucgaggaagaaaccccgucuguacuaaaaauccaaaaaaauuaccugggugugguggcggacgcccguaauuccagcuacucgagaggcugagacagcagaaucacuggaacccgggaggcggagguugccgugagcugagauugcgccauugcacuccagccuggacaagagugaaacugcgucucaaaaaaauaaugaaagcucacgauccucuuuugguaguuucacguuacaugaugauuaaaguuuaacuuguuucucuagcguuucuauuaaucuuauuuuugagccuaacuuuuuuaguuagaaacaacucuuaaccagccagccaggcgugguggcucagccuguaaccccaggacgacuccaaaggcuaaggcggaagggucccgggcgcccaggaguucaaggcugugagcucuggucgcggcccugcacuccagccugggcgacagaacgagugagacccucaaugugcucuugcccagaugaaauaaaaauucaaguuuuggccaaauuucggaaaagucuucauucucccucaauucauuuaccucuucuaguuaccaaaaaugccuguuuugagauacauguuuuaaaacgggagacuuagacaaaagcaaaaaauaacaugguaauucauucaaagaugcagacuaccacacuuguuuuaaucugauauucuuuccauuucuauccgucuaggacguaauugcacacgggcgccucccaucauuugguugcuaaggagacagaaggcugguguuuccgauuugccacuauuacacagcggcccgcgagaagcaucucuuggcucgaagcgcgcuguaggugaaccgcccuugacuuaaacgccaacacaucuaaaagggggcgagggacgcuuuauuuucauuucccugaccacuacugaggugagcauuucuuucacucgcguacuuguuuguauuuuuucugcuguucacguccaauagaacacugguuuucuauuggaggcuuuuggguuuuuucccccauuucccuuucguuacaaacgacccgcugcggccgccuccugcuuguccccacaggcccauucaacagcccagcacggaaggccgggaaagcggcgcucgccgcuccaacaaccucgcgcaguccguggcuccucccugcccucgcgcgacucgcaggccugggcggagggcugcguccgccaccgcgcaaccucgcgcacgcgcaccacgcucgccucgcaacccccccccccgccccucccccgcccccgcaaaggcuguucucagagucggaaauggacgcacggcagcuggggcgaauggccgcggacuacacuucccgaagugccgcgcgagguauucucggcggugauuggggcaaacggccacggacuacacuuacuuacaugccgcgcgaggcgccuccgccgccggggcaaacggccacgaacuacacuucccgacacgccgcgugaggcgcugccagcggccggccgagggcgggcggacgcgggagcugcggacgugaggcaugagcggcgcccuccuccggcccgcgagcguccugcugguuccccgagcgagggucucgcggcgcggggccuagcggagggcaucgaaggccuccgcgugcgcacggguugcugcggccgcgccgggcgccggggagggcggcggccgccauggaggugagcgggccggaagacgaccccuuccuuucgcagcugcaccaggugcagugccccgugugccagcagaugaugcccgccgcgcacaucaacucgcaccuggaccgcugucugcugcuccacccggcggggcacgcggagcccgcggccgggucgcaccgcgccggggagcgggccaaggggcccucgccgcccggcgccaagaggcggcggcugucggagagcucggcgcugaagcagccagccaccccgacggcagccgagagcagcgagggcgagggugaggagggcgacgacggcggcgagaccgagagccgcgagagcuacgacgcgccgcccacacccagcggcgcccgccuuauccccgacuucccgguggcccgcuccagcagccccgggaggaaggggucggggaagaggccggcggccgccgccgcggcggggagcgcgucuccgcgcagcugggacgaggcggaggcgcaggaggaggaggaggccgugggcgacggcgauggcgacggggacgcggacgcggacggcgaggacgacccggggcacugggacgcggacgcugccgaagccgccaccgccuucggggccaguggcgggggccgcccgcacccccgggcgcuggcugccgaggagauccgacagaugcuacagggcaagccgcuggccgacacgaugcguccugacacgcugcaggauuacuucgggcagagcaaggccgugggccaggauacccugcugcgcucgcuccuggagaccaacgaaauccccucgcuuauccugugggggccgccgggcugcggcaaggugagugcggccuuggccguugggcuuccguaguuaucucggcgguggaugcagcugauggucggag

SEQ ID NO: 17249 - RNA, 2679 nt, Homo sapiens
cuccgaccaucagcugcauccaccgccgagauaacuacggaagcccaacggccaaggccgcacucaccuugccgcagcccggcggcccccacaggauaagcgaggggauuucguuggucuccaggagcgagcgcagcaggguauccuggcccacggccuugcucugcccgaaguaauccugcagcgugucaggacgcaucgugucggccagcggcuugcccuguagcaucugucggaucuccucggcagccagcgcccgggggugcgggcggcccccgccacuggccccgaaggcgguggcggcuucggcagcguccgcgucccagugccccgggucguccucgccguccgcguccgcguccccgucgccaucgccgucgcccacggccuccuccuccuccugcgccuccgccucgucccagcugcgcggagacgcgcuccccgccgcggcggcggccgccggccucuuccccgaccccuuccucccggggcugcuggagcgggccaccgggaagucggggauaaggcgggcgccgcugggugugggcggcgcgucguagcucucgcggcucucggucucgccgccgucgucgcccuccucacccucgcccucgcugcucucggcugccgucgggguggcuggcugcuucagcgccgagcucuccgacagccgccgccucuuggcgccgggcggcgagggccccuuggcccgcuccccggcgcggugcgacccggccgcgggcuccgcgugccccgccggguggagcagcagacagcgguccaggugcgaguugaugugcgcggcgggcaucaucugcuggcacacggggcacugcaccuggugcagcugcgaaaggaaggggucgucuuccggcccgcucaccuccauggcggccgccgcccuccccggcgcccggcgcggccgcagcaacccgugcgcacgcggaggccuucgaugcccuccgcuaggccccgcgccgcgagacccucgcucggggaaccagcaggacgcucgcgggccggaggagggcgccgcucaugccucacguccgcagcucccgcguccgcccgcccucggccggccgcuggcagcgccucacgcggcgugucgggaaguguaguucguggccguuugccccggcggcggaggcgccucgcgcggcauguaaguaaguguaguccguggccguuugccccaaucaccgccgagaauaccucgcgcggcacuucgggaaguguaguccgcggccauucgccccagcugccgugcguccauuuccgacucugagaacagccuuugcgggggcgggggaggggcggggggggggguugcgaggcgagcguggugcgcgugcgcgagguugcgcgguggcggacgcagcccuccgcccaggccugcgagucgcgcgagggcagggaggagccacggacugcgcgagguuguuggagcggcgagcgccgcuuucccggccuuccgugcugggcuguugaaugggccuguggggacaagcaggaggcggccgcagcgggucguuuguaacgaaagggaaaugggggaaaaaacccaaaagccuccaauagaaaaccaguguucuauuggacgugaacagcagaaaaaauacaaacaaguacgcgagugaaagaaaugcucaccucaguaguggucagggaaaugaaaauaaagcgucccucgcccccuuuuagauguguuggcguuuaagucaagggcgguucaccuacagcgcgcuucgagccaagagaugcuucucgcgggccgcuguguaauaguggcaaaucggaaacaccagccuucugucuccuuagcaaccaaaugaugggaggcgcccgugugcaauuacguccuagacggauagaaauggaaagaauaucagauuaaaacaagugugguagucugcaucuuugaaugaauuaccauguuauuuuuugcuuuugucuaagucucccguuuuaaaacauguaucucaaaacaggcauuuuugguaacuagaagagguaaaugaauugagggagaaugaagacuuuuccgaaauuuggccaaaacuugaauuuuuauuucaucugggcaagagcacauugagggucucacucguucugucgcccaggcuggagugcagggccgcgaccagagcucacagccuugaacuccugggcgcccgggacccuuccgccuuagccuuuggagucguccugggguuacaggcugagccaccacgccuggcuggcugguuaagaguuguuucuaacuaaaaaaguuaggcucaaaaauaagauuaauagaaacgcuagagaaacaaguuaaacuuuaaucaucauguaacgugaaacuaccaaaagaggaucgugagcuuucauuauuuuuuugagacgcaguuucacucuuguccaggcuggagugcaauggcgcaaucucagcucacggcaaccuccgccucccggguuccagugauucugcugucucagccucucgaguagcuggaauuacgggcguccgccaccacacccagguaauuuuuuuggauuuuuaguacagacgggguuucuuccucgaacucccgaccucaggugauccgcccaccucggucucccaaagugcugggauuacaggcaugagccacugcgcccgaccgugagcuuuuuuuuuucauuugucccucagca

SEQ ID NO: 17250 - RNA, 20449 nt, Homo sapiens
cucggcggugauuggggcaaacggccacggacuacacuuacuuacaugccgcgcgaggcgccuccgccgccggggcaaacggccacgaacuacacuucccgacacgccgcgugaggcgcugccagcggccggccgagggcgggcggacgcgggagcugcggacgugaggcaugagcggcgcccuccuccggcccgcgagcguccugcugguuccccgagcgagggucucgcggcgcggggccuagcggagggcaucgaaggccuccgcgugcgcacggguugcugcggccgcgccgggcgccggggagggcggcggccgccauggaggugagcgggccggaagacgaccccuuccuuucgcagcugcaccaggugcagugccccgugugccagcagaugaugcccgccgcgcacaucaacucgcaccuggaccgcugucugcugcuccacccggcggggcacgcggagcccgcggccgggucgcaccgcgccggggagcgggccaaggggcccucgccgcccggcgccaagaggcggcggcugucggagagcucggcgcugaagcagccagccaccccgacggcagccgagagcagcgagggcgagggugaggagggcgacgacggcggcgagaccgagagccgcgagagcuacgacgcgccgcccacacccagcggcgcccgccuuauccccgacuucccgguggcccgcuccagcagccccgggaggaaggggucggggaagaggccggcggccgccgccgcggcggggagcgcgucuccgcgcagcugggacgaggcggaggcgcaggaggaggaggaggccgugggcgacggcgauggcgacggggacgcggacgcggacggcgaggacgacccggggcacugggacgcggacgcugccgaagccgccaccgccuucggggccaguggcgggggccgcccgcacccccgggcgcuggcugccgaggagauccgacagaugcuacagggcaagccgcuggccgacacgaugcguccugacacgcugcaggauuacuucgggcagagcaaggccgugggccaggauacccugcugcgcucgcuccuggagaccaacgaaauccccucgcuuauccugugggggccgccgggcugcggcaaggugagugcggccuuggccguugggcuuccguaguuaucucggcgguggaugcagcugauggucggagagccgggugugcugcccucgaaagaagccgccugccucuccuggauaagggggugcagacuugggcugggcuggggcagugccugguccacagguggagucugugaugggugugaaaagggcacacacccccagauugguaaggcaggcuugccggguuugcaaaaggacgaugucugugaauccauaguuuuacaagauguggacucuuagauuugaucugccuuuaucuuccaucggucuccccgcccccuccccagacuuugauuuaguaaccgaauucgcaaggaaucagcauguuuaaauuguaaagaaacauuuguauauuccguuuguacauaauaacggauucagcuuugaaaaaaaucaaauuaauucuguugugcuuccuuccuuuuccacuaguuguugguuuaacagacugguauuuauucuuaagaauaaguuuauuuaacauucuuauauucuugagaauauauugauuuuacuaaauauacucauguauuuacaaaacuaacauaaaaacuuuuucaucugcaagucauuuucauccgguauuuccguaacuuuucucauaaugccuuguacucuagagaagaaacauccgugcauuuugguguccaguucugugucccuucgugaggcguuagcguuccagaugagggcaguuaggauauugugagucuagaaagcaugucauuggaaaaacacuugagaaaaaaauggaggaggugagccagaaaacagagaaagcuaagaagugcuuaaauacaggaugcuuuuauccauaauaagggagaagaaccagcaucaggaagggaaagggagaauucagggaucaaacuguaaagaguucuuguagcuuugagauucagacucguuugcacacaaggcuuuuaugauuuuucuccuauuuuucuuucuagcuuuaucucccacaacuuaagcacacccccuuuaacuccaguuccuggaaugaauugcccuuuuugugccuucuuguuugcacucaugccuucccuuuggccaggaauaaaccacaucuaucccaaauaacaucuuaugaugaugguggucgaguuguugacgucuguccccauggauuuaguuguuaaccccauuuaagggauugagcaguaucauucuuaguaauugugaagucuuuacauaagaucaugagaauggauaaucagcuguugguggccccagacagcaagaagguccuuagggagacgagugggugagcucaucccaccuaccaaaugccaggcaagagguuugggugguccaggcugcucagugagaugggcguuggucauuugcaagccuaggcaucugugacuugcgagccugauuccaaaaggcaggcaggcggggauuucugaaagaagcagccacagaaugggugcucuacaacuuuuagaaaagaaaguaccaccuuuccauuuaggugcagauuugucacagucauuaaacagucuucaguuuuucuucucauccuuuaguacuaauaacaacauucauauuaauaacagcauauacauauuuguugaggacccaagaagugcuuuaccugggucuccuugguuuucuaguaauugcuaaugugaccacagugcugcccuucaucuccuaccagagugaacaugcagaaguggccuacagucaucucaaaugcuagguggaugucauuggucucaaggcaaaugcucccucacucuccuuuucucagcuguccugagcuuccaguucgggcugugguucugcgaugaguucugcaccuagauccuuccgugcugucucggcuagaggagggagaauuuucucuuuggugagaggucacagcugucacucugcuaaaucaagacagccguucuuuacugggauuccaaagaucuuaaagagucacccaaaaaggaaucaaaggugguuagggacagaggagaaaaggucaggauuagccuaagguuuagcuacuuuccuguuuuauuuauaauauuuuuguuguuguuguuuuuaaauguccugugguauuuuugauuguuucugugcugcucagcauucuuccgaggucaaguugcuuuugguaaauagugaugcugcguguggugguucccaugggugcuggucucucugugucuuaccagcuuuucaaacuccauguaugucaucuuuucuagaccacucuggcucacaucauagccagcaacagcaagaaacauagcauaagguuugugacauuaucugcaacaaaugccaagacaaaugaugugcgagaugucauaaaacaagcucaaaaugaaaagagcuuuuucaaaaggaaaaccauccuuuuuauugaugagauucaucgguucaauaaaucucagcagguauauuaacuuccuucuaccuuuuggucguugugaacaucaaacaauauaaagugugugagaucacuauacaaacgcuagagacuuacgagcuuuguuuacaaagaagcguaggcuugugaacccaucuccuucaagccuauuucuccauacauuucuuaguguuuuuugauaacaagaaaaugcuuucucuaucugauaaaugaaaugguuggcauaucccugagcuauacguaucagaaaagcaccuuugaaucaaauuuccaguuuuaggaauuuuuaaucuaaauacuaggagucauugugaacaguaaaauaaugauuuuaaggucauuauuuuaauggguuuuuaaaaauuacuuuaacaguauuuuuauuuugaaaauuaaacaaucgguauuuucuguaacuccaggcucugucuucaaggugaauguuggaagagcuaaugauuacuguuuauuuaaauggguuucugaaauaaaaggacacaagcuauuuuuauaaacaaagccacuuagggauuuaaaaaaaaauaaacauuaaaauuuuauugggcugagaucugagagcuauacucuaaauaaaaaaaaauuaaauuuuuaggcauaacuuuaaaaaauuuuuuuuuguaacuuuuuaaucauacauagaauauuucacaaaacucuacugagccuuuuuugaaccuuuuugaauaaaaagacccuuuuaaaguucugacgaggcguuagcauucuagguuucauauuggaccacugacucaucuuaguauuuuuuccccauaaaacagcauaauaggaauaauaauaauaugauugagugcuugcuguggaagaagauucuggaaguguuaauguuuuuguguguucuugucuauaaauaaauagcuguuacauauaagcuaugugccaguucagccuuugguagaagaugguuuucugaguaaagaaaucauuuauguugaaacuaagcuagaauucuacuuaaagcuauuagucuaccagcaagagaucaggcuuggacgggcauuccagaagauguguuucagacuuaaaagcaagaguuguacucccccaaauauugcaucuauauucagugaauauaaggcugcugcuauuccugaacucgaaagauaaaaaugaggaaaaggaaggaagggauagccaacuuacauaggauucugcagguggcuguugacuggaaucacuuuuuucuguuuuccucccaugauuaggacacuuuccuuccucacguggaaugugggacgaucacucugauuggggcaaccacugaaaacccuuccuuccaggucaacgcugcucuucugagccgcugucgagugauuguucuugagaagcuuccaguagaggcaauggugacuauuuuaaugcgagcgaucaacucccugggaauccacguccuagacucuagccgucccacugacccucugagccacagcagcaacagcagcucagaguaaguugacagugugcagcguccugggggcacacaccucccagagagucuccuggcagggggccagaaagggccgggcgucagugaggagaggguggggacagagaagaaauguugauccgcccguaaugaaaauaaaagaggagggaaauguucgauuauaccuaacaaaguuaucccugcacacuugaagaugcauuuuccagccucuaauauguguuucuauaauucuucaagcuuuaacuuugcuuuguuguuuugguucuuggguguuugcuuuugugcuuaggcuucuaugggaagccuuauugaugauuugaaaggcuuuaugucccucauugaauagaacaaauagauagauaaauacuuucuagacuuaccauacaacucuuuugagcauuguacucauguuucaauuucuuuuuaaccugcaguuuagcauuuuguuaaaaaaaaaaaaucaaguaaaaauuaacuuguaaccuuaaaauuauguaauccuuuuuguguaguugaaacucaguuucaugaaaguaaaggaauguuaacugaauaugacauuauaggcugucccuauccuuuuagugaccuauuucugcaucaugaguaccacaugagcucguuaaugcaccaaguguauaucauagauaauuugauuucuugggucagggguuuuccuuuuuuuuaauauuagaacauauucuucagaugguauuuguucauacguuggcugaaauacugccauggaacauaaucuggugugaugagaggcuauugcccaccuccuccugcuguggacucugcagcugcucgugccugcccugaggccaaguucuggagccacuuuucugugaggauuaaaguacaaggcauaguuuaggcucaggguuuagguuucaccaggcucucccuaugugucuggccccauuugcuccugucugagauggagggagaauucugcugugucuaaugaaagcauugaaacauuuggcccguggaccacuggguaggacagaguggccuuguuuuggaauaccguugugauggggauagccauuacaucuguggccacaagcaguguguggaaccugugguaucagccacauggacucauacucagaagugcuuuauguggugggcauuugucagagccuaagggggcugccagcuccucauauguaguacagguugaguaucccaaaucugaaauccaaaaugcucccaaaucuaaagcuuuuugagcaccuucaugaugcugugaaaggaaaugcuuauuggagcacuucagauuucuggauuuugggugcucaucugguaaguauauaaugcaaauauucuaaaaucaaaaaaauaggaaauucagaccacuucuggucccaggcacuucagaugugggauacucauguguagguuucccguaacagaauucucauuacagacgcauagaaccacaugguaaagacaaauugaaagaaaaggggggaaauccuaacauguuucauguuucuguguguucuuugcucuguguacugguuaucguaauguaucugcaacuuaauauucugcauguguacuugucuggggugauuuuuauugauuucaugucaucaguucaugaaauagaacaugaaaucaauaauuaauauugaugacaugaagucaauaauaaucaguuguuacucagauacccucagguuuuuucaccucuccccagucacugccgugcaggaauuuaaaggaaaugagaaaggcggcagccaaggagcucauccuugugagaagaauuucuauauuuuauuauuaaaaauccucaggugauuugcaggcacauuaaaguuugagaagaucaagugaaauaauuaagauuuaguuauugaaacugauauaacaaugagcuagagauuguuuaucugcuaaaauugcuuuucagagaaaacuucccauauccaguaaaugauuuacuauuuccacuaccgcuugcuuagacuugaucccaauuauauuugcuaucuugugucccccgcuuuccugggaagacugugaggacaggagcuugucccuguucauauccccagcacagugccuggcacacauuaugugcuuugugaaugguuuggaaaugaauaaauccuagcuuucgauaugagaaaaguaguuuaauauguuuugcauuauccagcauaagggauaauuacccagguaucaagagccuuuuucuuuaauacuauugcccuuuucaucagcagcaagcagaguaaaaugaaagaauguuaagcuuaaaaccauuaauuggucaacuuguuagcaauucuaacaagaaguuaaguuaggagauaucauaggccacagaaagaacucuuacaagugauuuccgaauacaaguaccugccaccccaacugucagggauaauuaagaguggauugggaugucuuuuaguuguuuuagguaaaauuuugcuuuccaaucccuguugacagcucuauauacauccuugugcauauaaaucagauuuggugacacuaaucuaguugaaagaaaagacuuccaaccccauauacuuacuuucucucuccaggaagcuauuggugugcauuuguauucuugugucauguuuuggugcccuagauagcaacuagaacauuuacagagaagucccaggcuguugaacugcacgugagaggaggugagcagggcacuggauuuggaaacuaaucaagcugccgcuuagccguucuugauugcacuugaggaauugugaguugucacacaguauacucauguaagugauaaauucccauuaaagugaaauaaguguucuuuuuuuaaaaaaaaauucccuccuguaguuauuauucagucaaaauugaagcuccugcauaugcuaggcauuggcugaggguugaaaagcuuguuccugugccuucagagggagcgcaguaugaugaaggcuaggggagcagguccacuuccagugccacgcuuauacgccaagugcagugggcguagagaagcagcauucagaauaugugaaauccaguauuucaccuccuagaugaggggaugcggaguugaguuuugaaggauaagcagaauuuaacugagugaaauagaaagcucauugucuacgccauaguugcuuugguuuguauggcuaagcaguaguguucagguauuuugcucucccaaaaauauuuggaucacaugauacaaacagugaagauucugucugcucuggguuaauuuuggaggccaggaaaaaaauguccaugauucaugauacgaagaaugagcuugugcugcugaaaaugaaaaaguaagcuagcauuucgucauccugcacuacuugcugcuuugaaggaauauagauuccuaggucauagaauauauacauagucaaaaacacuccuaaagaaucaauuauuugugaaccagauagaguauacaagucuuuggagaucaagagagugaaaugagaagccauaacugcccucugccuagcuaggcugaguuccgagaggugguuggaagacagaaaguggcgucugucccuggguaagggcuguggcguaacuggguguggggcuuuucucuaaucaucuggagaggagagccccugacaagcuggcccccaaacaagguggcuauggauucuucuuuuuauaaaaguuuaaagugucuuaaauaaccuuuugugccauugaauagaaagaaagguaguggaacuccagaauacaagggauuggccagaauaaaugguugguauagaguagaugucaaucuuuuuauuuaaaaauuuuuuaaguacauuaauacaguacauuaacauagcuguuuuaauacaagggugcauuaaaauaaugccauaaaagcaccagcagccagaaccacagaucucaugguccuuggaugcacuuccuguggcugcuguaacaauugccacaaacuggguggcucagaacacagagcuuuauccucacaguucugaaagccagaagaccagaaucaagguaucaacaaggcgaugcucucauccagcaucugauggcccuuggcauuccuuggcuuaugacuaugucacuccagucucuacauccaucuucacaugguggccuucuucucuguguccuuacgucuucucuuuuucuguguuuuguaaggacauuugucauuggauuuaagguacacucuaaauccaggaugauuucaucuugagacccuuaguuacaucuacaaagacccuauuuccaaauaaagucacagucacagguuccagggauuaggacuuacaucuuuuggggucacuauucaacccacuacagaccccuaccaaguauaauguaauuuggaaagacaugugccuccaugggauuaaacagaaagacgucgucaucugaaauguaccuucucucuuuguggagaaagucaguuuuguuuugcuuugcuuucacucugauguuauggaagcggcagcaucuggggcucugccuuggauaugugcaguucuggagaguaugcuguugcacagucugaugagggugauucuccucgcuguugauaccaaagcaguauuugucgagucucaugacauggcaggcacugcucuaagcauuccacaugucuuaaucucauucaguccucaauacagcucugcaaaguagaucucauuaccuccuauuuacuagaugaggaaacugaggcacaaaaagguuaaguaacaugcccaagaccaaccagcuucaaugugauggagccaguguuuaaggcaugucucugucuucucagugacuucaagugcuacaagggguggaggugccaaguuuacagaggauggacccacugcucgguuuuucuguucugacuuuucucucuuggcacuucuuuguguaagagcagcaggagagccuuuuaaccagaucugcacaucacacuucccugggauacauuuuagaaacaugccuugcccagggucugccccuggagauuugagcucagucuaugguagguaagguacauguggcuguauuugugucuaacuugaugcauaucccugguugaaacuucuacacagcaguuaucacccugaccaugaaauguuccuuuuccuuaguggaagagauuugugggguuugguuuguaauuuagagagggagaguuuaaccaagccaugcauauucuuucauucugccuugaaauaacagguacauuuuuacuuacugcacuccuucuccaacuuacauauccagcugucuaaguaguauccuccaaauuccaguauuacccaauguguagaaagcuucaggauuuaggcaccuggaagaggaaagaagagagcuuccuauauucuucuguuaaaauuaaagcccuucucaucaguuggagaagccaagcucucuuaagucuguuucuaucucuagguuuuguuaacuagaaauagaaucuuuuccaaugcauuuauuuuaaccaauuuucccuuauuauaaauaguguuuuauuauaacaacauaauuuacuuccuauuguuuauuuccauguaggauguuaugacauuuugggcagucuauccccagaauagauuuuaccucuuuuuauuguauucuaccuuuggaagguuauuuuuaagugcaaaacacuuuauaaauauaugcuuaauuuuaauauaugcuuaaauuuaaaaauaauuguaaauucucuagacugggaacacucuuucaaaauaguuugugccgcaguuugcugagggauuuugccaauaucaauacaacuaucccuucaucauucuuggcaugaguucucucaugggcuucccauucuaagaucucaggguauuuuaguauaucuuacuucguucuucagaacuuaguaaaugggaguucaagauauauuggguguuuaaguggaaccuuucccugcucagucgucuucacagugaaucuccauuuuguaauuuucuugugugaucauugugagugcugucagcagguccuguauuacuuggacagaguugccgacagauugaucugggccucgaaauacuuucuucuuuuggacggggugaaauuuaaaauguggauuauacccaaggggaggaagaagaagggaguggcgcgagcucagguagcuuucguuguggcagcaccuccauuccccaugacuccaaaccagaaguguggaaccacuuguacuuuggucaggaguuuaaaagccaaaggaagaccuuauuuuccaaccacauaaaauacauaaucauugcuaaagacuuauucacagcauacuguugauaaaucaauggaguagacggcuagcuggcuucuguccuaauuaauaaggccugccucccugucuguauaugaggacuaauggaaaugaggcaguuuauacuaguaaauaccaugguauauaaggcugcccaucucgucacuguccaaagagcaugccaugccccuaaauacauacaaaagacaaauucauggagaagggauacauaccaaaauacuaacgucaagguagucuagcagaaggugaauuuucucccuuugucuauuuuuaaaauuuaauguaaauuuuuuuaaaguaaauguugacaggucugaguagcuuguuuuucaaacaauuauuuaaugguuaaggauguaaaacuauguaaaauauggucccaguuuuuguuuuagguuagcuguaagguugaugguugcaugggugaguggaucguaaagucagcacuuggcacaguagcuuucauucugcuggaaauaucaaguacauuuuuaucucucagugcuggaaauauggauucuuuuuguuuucucuauacuuuccauauaauuuauaagaaguaaagguuucacucugagauuaugauaaaacugaaguuaguccauucauuuugcaaauauuggaugccuaucaucuaccaggucugggaauacaaagaauaaaauauuccucuccuugaggugcuccgcauaguagggaugaugaauguaauguaaucaacacacaauccaacccauggugcaggauauaggcuaguucaguccguuaggauccaauggggcuccugcuuugacuccuuuuucuucccucaauuguccugaaggcuuuuuguugcuaggcagcuuuccaaggagagagaauccauuguuuuuacuaguucugaggcagaaaugagaugcccaagcaguuucuguucucccuaccugucuucccacacagguugagugcaguaaggggcugagagugcacccuucccucucaggcaugucacguacugcuacaccccugugaugcugguccuuccccauacauuuucuuuaguauauguucuguccaucauuaucuucuaaaucaucuuccagaagacuugcuaacuaauuucugguugagcagugauccccaggcuuuauagagugccagugacauggccucgguguuuguuuuuuuguuguucuggugaggucugcugagagaaugcuaccaucaggagagaggaagaugggucuccaggcugcaccacuggcucuggggcccaggcaguuggcaugagugaggagagagucauuuguuguaaagcuggggcuggccaguugucuuagguguggugagagacccacaaggaauaacuggaaaucaacuuugguaaauaugggggugagaugaggcaucuuuaaggcauugggaacaaauccuuccgugaaugaaaugcagauugguguuauuuggguuacucagugagcagaguagugucagugaguggguguaugcugaggaguucugcauugauccagcaggcaagcuggguccccuucggaaacugccaccccuccccggcccagccccguuggugccuguacauuguuuuccagguagcugauucggacaguccuaaugggcuuauuauuuacuguagauguucucagcugaauguugaugacaugggugaacuguaacugaaaaauuuuauuuuuuugcuucacaaaugugcagcuagcagcucagccaggaauaagaccccacuaaguuaugaaauguguuagaugucuuguuuaacucaacuagggauagaaaauuuuacugagucagccuucugaucauaguuagaucuuauuuaugaggguccaaauuuagaaaugugacuguaaguuuuaguccugauguucagagagagguuagguggcuuacccagggucucauggcuauguaccagcagucuucucgucgcuucccaggcuaaugaccucucugcuacccugugcggauuuugcaugauuaguguccacuaugagaugaccuacugcagcaucccaagauuccccaggccaagagaauccugagaccugcuucuaggaccugcugugcucagaguaacuagggacccaauuuguuguuuuuaaaaugaaggaauugaacugcaugaucuggagcccuucagagcuaauauucagauauaaugcugacucuccccuguguggaaaguggucuaagcacaucugucucaucggauguaggcugcauuuggaacauguuuuccauacacgguaaugaggugcuagcauuucuaauaaaguuuucacuguugugcaggguagaaccagagagaccaccugucaacagugacuuuccaggccagucagugucuguuucacacagacuuagauguaugaaccuaugcagugagauacccucgacacucauaagauacagggcgauaaccuggugacuuaggagccccagucaguucguagucuugaugaugcuuaagcacauugacaaaggugagaauaagaggcaaaggccuugaacucuucaguguccuugcugagaaguaugaguuucuaagacaugugcagaacaagaaguaugcagccugagugugaccguaacuaacccugcuuguguuucaggcccgccauguucauagaggauaaagcaguagacacccuggcuuaccucagugacggugacgcccgagcuggguugaacggacugcagcuggcggugcuggcuagguuaagcucuaggaagauguucuguaagaagagugggcaauccuauucucccaguagaguucugaucacagagaaugacgugaaggagggccuacagcgaucccacauuuuauaugaccgggcagguaaguaauucaccuguggaaagagugaaaccauacggaaagaagugugugcacacauucucauuuccggaagccugacuggguuccggaagcauuccagcuggguccagagcauuccagugauucucagguggaucugcauguugguauuaagccuucuacacagggcugaccuuuccgaagagaggcaugaagcagaagcugcccuguugagaaucuagaggaguuuugggguuggaaauggcaggcugcacauucaccuuagaagguaguuggcuauuccccaccuugcagaauacaaucaccuuugaaagccugugcauucacuugacaaugaauauguuuugugaucauuuacaacggcaguaaauaaaaagaggacuuuugucauaaugacuuauuaguuuuaauugagaauuaaaaugcuuuauuucuagagucuauacuaaaaaauagucauggaucuugaaguuuuuauuuuauguaguagcuuuuucaaaaauuuaauuuugcugugugcacuuaucuguuuuuguagaacugcauuuacagauagcagauuugauaccagcucuuauuaaaucugugacuuagcaauauuaaaugucauuagcacagcacauuugcaucuuuuuauaaaagaagugggagaugaauauaacauacuguagauuagcaaacuucugcugcuugagcauuugugggacuuuggauggaaucauguugcaguaacuguggaauauaauuuccacacuuuucaaagcucugccagaaaaggaggcugauaauugaauguuccugaucucacguaggcugugccacgugacaauggagaguccuuacugguuagagaagggguggaggggcuuaagaaugacuuugguuccaagcgcugccucuucgugggugagcacacucgcugcaugaccuaggggggcugaccaaagcuuuuuggcuuuagcgugccucagcugaugguagcucagggguguucauuagugcuaaggacacacuggcaaguugaauaaauaauccugucuacauugugacgugaaugugccucagcggggccugcucagauggcuggcucucccuagugcucuggagcaugacgugaaugcuugcaaagucugaaaagcaacacauucuagguguguagagcccugcuugacuuuuggucaaauagaaaaaauguagauaugaacaagaaaaaagauuuuaagacauuaaaaaaaucucaccaugccgggaucgccauuguuucugaagugcagcagcagcggucucucucucucuucuuguaggugucccaaaggauuugccuuguuuugauuggaacgacuaggacuguucuuugacauuuuaucagacugucacuugagauccauauaacauggcauucacuaacacucagccauugaguauuuuauagguguauucauuuuuuaaauucucaaaauugcuuuauggagauagcuauuaauauuacccccauuuuaagauaacaaagcaaguggugaaacugacccguaaauccaggucuuacugguucccaagacuguccuuccccccguccgcauuugccuccacaccagccuugccaugcuguuacugaucucacccauuacaucaugcuccugagaggggucacccguccaugcacauacagagcggaucuuggagggguucaguccuaggaaucccacuuccugagcuccacguugcagagcucugcacaguggggaucaccuugucuauagcuuggagcuggggggugguggaggcugccuagugccgcugccuagugccagcgccuuaagaaccccacauccuauacaucuucccaguaugaguguguuuacacaccccaccccagugcaacaugucugccccacaguggauccgcagacacauaaauaucauucagaucuuggagaaagcugcuuuuacaggcuuugcucuauaaauagggauaguggaagcauugcccuggaaaccuguuagcuuauacucuugggccuuuuuauaacuccagugagacaaagacccacccccagaguugugauuauuuuuguauaugccaccuaguucauaguuacccacuaguaggauccagugauguuucugcaucagagugaaggaauuucuaaaugagagcaaacucucugccaugcauugacaucgggguucuauagaagucgucagauuucagguuauaaagcaguguguaauaaaagcaaacauggaagguagcauagaauaauacuaguaucuaucacugaugcaaaagaaucuuuuuacagugccugcucugugccaggcguguguuauuuaauacagcccugugagguaaguggucucguuuuucccauuuuacagaugagaaaccugaggcacagugaggaucaggaacuugcccauggcccaugagcuuggggguccagcccaggcuguuuggucccagagccugugcucuuguccauuauacuggugguauugccccuggcauugacaaagugggaaaagaugacuaaccuguguagggggaguuuaaauuugacauaaagugguguggguaguuucuuccagcccccaugcccgugaguuuagccaggccuguuaccugcuacccucuuccccgccuuccuccacccugcagaggagcagagcguagccugagugccugggccagcagggugagggagugggccagaaccaugcagaugucauccaggacacccucucggccaguguccauagcacucugacuucaccaggggagcccugcacaggagacacucaguuuguucucagaaauccaguagcugggcugacccauccaucugcccuggcucucagaaaccagaaucacucaggcugagccguggguccugcaggucuuuccccugugggaggccagcaucuucgcuugcucucuucuccaccugaagaccaacugucaucuuaccagcgagcucagcugccaggguuuguggcuggcgccagucguauuguggacaugggcuuaugcugagcacagaccaggugcuccucugggaggagugagacucacgggaacaccauccuccgcuuucucgugaggagggugcccccuccuugaacuuaccuaagggacgauggccagagaauagugaaauguaugcaggugccacugcuuaguuccugagaacuguuuagcugucauuuuuuugcccuuaaauaugccuuuuuuuaaagcacauuucacugauuucaugugaaucuaggguaaaaauggaguaguaagaccaggcggugagagagugggcuuccguccacuucagggcggaagcugguuaguccacgugucgguccuucugggacccugccacacagguguccccacaccaaggcuggcagaaggagguuuaaaugaccacaggcuucggauaucagaaaggcagcuggaaaugacacugaggaacagaugggcuauaacagcugcccuugccacuuggcucuacauccuccuggcuccgagcaggcccaccguugcuuuuccuccaguagauggugggccacgggauagagccagaacagaagacucgucccccuccacucuugucucuggcaaauccaccagcugggaggaccaccuuuccucccuccugccucugugcgugugcgugcacuccaugucgacagccacagguuucugcugcagcagccucuuccccugaauaggacugggauuaagccccagcagcuggugcaccccacucagagcacgguuaaggcagcugcccaaaccucuccucggcuuucucagggccuuuauucguucaggcuuucuggaagucagcuggcggaggugaagauggcuugggcgccccuccugugagcucugugugaguggugcucuuugugaugucaggugaggagcauuacaacugcaucuccgcccugcacaaguccaugcggggcucagaccagaacgccucccucuacuggcuggcucgcaugcucgagggaggagaggacccacucuacguggcacggaggcuugucagguuugccagcgaggacauaggugagugugaugggagggucccggaguccuauguccaugaggguggggaaauggcuaacaguuacaucguggcuuuuuuuuuuuuuuuuuuugcagggcggggugggcggggguagcaggaagaaugucucagggcuaugugagacuggcaggagaagauaagacuuuaugccugagcucagucguuuauuuccugguguaugugcuuuugaauguuuauguucauaaagucaccauuuucuguuuccucuucgggaauguuuuuacuaacaugaguggcuauucagaguauugcaauagaugagcugcuuuuaaauuugcuuuaagucagguguucaagguuuucuuuggacagcucccaagguagaaauggaagacucuagacacuauaugaagaaaaagaucaggaaagcucuccucuucuuuggucuuaggggauguuuuguuuuuaguguuuccauccuggugaaugucuccauagccuucacuucuuauguuuguuauacagagacucauguuuuucuagaugcagaguuuuuauccacaaggaaacaguucuuaacaccacacaguaaccacucucaauauuucuugcauaaguucaugggaucagagacuagagcuaagucaggcuguuuugcuacaugggauuguuuuggucaccaaguguacaagcagugguggucuguggucgccugcacauaggccaggaggacagugugugucaugacugaaacucuccuuugucucuguguguggcaggucuggcagacccgucugcguuaacacaagcgguugcugccuaccaaggcugucauuuuauaggcaugccugaaugugagguaaaguaaucagcucauuucuugcaaaucacuucuuuucucucucgugcucugucccuuuguagauuugaauaaaugucccuccuucaccauugguguauuggacccacugaguaugcugcuuggcuuuggaauuccaauuguagacucuuagacuccuagagagggaaaccuucugugucaacgaggucauguuucaaacuguucucgggauuccgggguucagagcacaugcuccauauguuccagggagcagaaagguuaaaggagcugaacagcaaagccucugcaaguucgcccccagagcagcuucauauucaucucuuuuauauauugggggcuuaagaaaaauuuaauguaguaaaaaguccuucaguuaaaaaaaaaaaugaaaaccacucaccugguuugccucucguuucaccucaugagaauuucuucugucugucguaggugguuauccagacuguaggcgcaaaagggggauaauaaaagcauguggggaucuucucagaauuaccuagagcuguguaucagaaggggcucugcagaacagaagcuuggcaucuugcuaguaaaauguguccucugugucauugguaggugcuucuggcccaguguguggucuacuuugccagagccccaaaguccauugagguguacagcgccuacaacaacgucaaagccugccugaggaaccaccaggggccacugccccccgugccccugcaccugaggaacgcgcccacuaggcugaugaaggauuugggcuauggcaaaggcuacaaguacaaccccauguacagcgagccuguggaucaggaguaccugccugaagaguugagggggguagauuucuucaagcagaggaggugcugacuccucagggcacgacagcagaaggauguugcuuuuuuaagggagggccagaaagaaaguuaguggauugcaaaguugguugccugguggaaguuagaacagaccaacauuuugugccagaaauuuaagaguuccauagguggaggcgcaguucuuucgaauaaauguguaacuuugaaauuguguucauuugcacucggugcagcgguuaugcuuaugaaaauaccuggcagcuuugugcaaugaauuaauguuauaaggaauuaucuauuuugucauaguauuuaagucauaaugucauuucagaauucaguucuguaggauuuucuuuucuuuaaaaaauguauauucuggguaguuuuaauugguaaaaaaauguaauugugauuuaauacugcauaguguuuuggguauuuuuuuuauaugcaaaggucuuacgagccaauaaaacuauuucaaaguacucuu

SEQ ID NO: 17251 - RNA, 1587 nt, Homo sapiens
uacaacaguaauucagaaauaucucaaauguuacauugaugucaucaauauuacaaaaaaggaaaaaaaaagugacaggcaacagugaagagcaccagagacccagcgcacaccuaaaguagaccaugcuucuuuccuuccacugccagguuaucgucccgggaagccccccacccccucgcuuuccuccuccgcuuucccuaacccgucucgcgggggcaucuacgccucguccucgcccuccuccuccucgaacuccccuuguucgucggccguggcguccugguacugcugguacucggacaccaggucguucauguugcucucggccucggugaacuccaucucguccaugcccucgcccguguaccagugcaggaaggccuugcgccggaacauggccgugaacugcucggagaugcgcuugaacagcuccuggauggccgugcuguugccgaugaagguggccgacaucuucaggccgcggggcgggaugucgcacacggccgucuucacguuguuggggauccacuccacgaaguagcugcuguucuuguucugcacguugagcaucugcucguccaccuccuucauggacaugcggccccggaagauggcagccaccgucagguagcggccguggcgcgggucgcaggcggccaucauguucuuggagucgaacaucugcugggugagcucgggcaccgugagcgcccgguacugcuggcugccccggcuggucaggggcgcgaagccgggcaugaagaagugcaggcgagggaagggcaccauguucaccgccagcuugcgcaggucugcguucagcuggcccgggaagcgcaggcagguggugaccccgcucaugguggccgacaccaggugguugagguccccguagguggggguggucagcuucagggugcggaagcagaugucauacagggccucguugucaaugcaguagguuucaucuguguuuuccaccagcugguggaccgagaggguggcguuguagggcuccaccaccgugucugacaccuugggugagggcaugacgcugaagguguucaugaugcggucuggguacucuucccggaucuugcugaugagcagggugcccaucccggaccccgugccgccccccagagagugggucagcuggaagcccuggagacagucacagcucucugacuccuuccucaccacauccaggaccgagucgaccagcucggcucccucuguguaguggcccuuggcccaguuauucccggcuccacucuggccugccagagggaaagagaaaucuuaagucaccggugauuguacuaaauaccuuaccucaaaccccucaauauagaucagugagucaaugcucagauaagacuauuucagauuaucaccaaaauggccaaacguuaaaauauuuguucaugaauauaauuauaaauaaggaaggccaggacaccaagcucuuagcagcugaaaggcaaacaauuuuacacuauauuaaagcuaaguuggcacaccgcggauguucuucaugcuuucccucuggcaaucacaccucuucagccuccacugcccagc

SEQ ID NO: 17252 - RNA, 1587 nt, Homo sapiens
gcugggcaguggaggcugaagaggugugauugccagagggaaagcaugaagaacauccgcggugugccaacuuagcuuuaauauaguguaaaauuguuugccuuucagcugcuaagagcuugguguccuggccuuccuuauuuauaauuauauucaugaacaaauauuuuaacguuuggccauuuuggugauaaucugaaauagucuuaucugagcauugacucacugaucuauauugagggguuugagguaagguauuuaguacaaucaccggugacuuaagauuucucuuucccucuggcaggccagaguggagccgggaauaacugggccaagggccacuacacagagggagccgagcuggucgacucgguccuggauguggugaggaaggagucagagagcugugacugucuccagggcuuccagcugacccacucucuggggggcggcacgggguccgggaugggcacccugcucaucagcaagauccgggaagaguacccagaccgcaucaugaacaccuucagcgucaugcccucacccaaggugucagacacggugguggagcccuacaacgccacccucucgguccaccagcugguggaaaacacagaugaaaccuacugcauugacaacgaggcccuguaugacaucugcuuccgcacccugaagcugaccacccccaccuacggggaccucaaccaccuggugucggccaccaugagcggggucaccaccugccugcgcuucccgggccagcugaacgcagaccugcgcaagcuggcggugaacauggugcccuucccucgccugcacuucuucaugcccggcuucgcgccccugaccagccggggcagccagcaguaccgggcgcucacggugcccgagcucacccagcagauguucgacuccaagaacaugauggccgccugcgacccgcgccacggccgcuaccugacgguggcugccaucuuccggggccgcauguccaugaaggagguggacgagcagaugcucaacgugcagaacaagaacagcagcuacuucguggaguggauccccaacaacgugaagacggccgugugcgacaucccgccccgcggccugaagaugucggccaccuucaucggcaacagcacggccauccaggagcuguucaagcgcaucuccgagcaguucacggccauguuccggcgcaaggccuuccugcacugguacacgggcgagggcauggacgagauggaguucaccgaggccgagagcaacaugaacgaccugguguccgaguaccagcaguaccaggacgccacggccgacgaacaaggggaguucgaggaggaggagggcgaggacgaggcguagaugcccccgcgagacggguuagggaaagcggaggaggaaagcgaggggguggggggcuucccgggacgauaaccuggcaguggaaggaaagaagcauggucuacuuuaggugugcgcugggucucuggugcucuucacuguugccugucacuuuuuuuuuccuuuuuuguaauauugaugacaucaauguaacauuugagauauuucugaauuacuguugua

SEQ ID NO: 17253 - RNA, 812 nt, Homo sapiens
cguggucccaagaagcaucuaaagcagguagcagcuccaaagcauuggaugcuggauaaauugacugguguguuugcuccucauccauccaccaguccccacaaguugagagagugucucccccucaucauuuucauaaggaacagacuuaaguaugcccugacaggagaggaaguaaagaagauuugcaugcagcgguucauuaagaucgauggcaagguccgcacugauauaaccuacccugcuggauucauggaugucaucagcauugacaagaugggagagaauuucugucugaucugugacaccaagggucacuuugcuguacaucguauuacaccugaggaggccaaguacaaguugugaaaagugagaaaaaauauuugugcgcacaaaaggaaucccucaucuggugacucaugaugcucguaccaucugcuacccugauccccucaucaaggugaaugacaccauucagauugauuuggagacuggcaagauuacugacuucaucagguucgacacugguaaccuguguauggugacuggaggugccaaccugggaagaauuggugugaucaccaacagagagaggcacccuggaucucuugacgugguucacaugaaagaugccaauggcaacagcuuugccacuugacuuuccaacauuuuuguuguuugcaagggcaacauaccauggauuucucuuccccaaggaaaagguaucugccucaccauugcugaagagagagacaagagauuggcaaccaaucaaagcaguggguaaaauggucccuggauggcauguuaga

SEQ ID NO: 17254 - RNA, 43926 nt, Homo sapiens
augauaauaagaggcauauuuuauucaguuucccaguaagucaauuagaaacaugcacugcuaaaaugcaaguuacaauucaaaugguaccauaaauaauuagaguacacacugagcauuuucagaaaucagcuuccauaucuugaucacuaaauggaaagguucuucagaacagucccuuacccuauauacagaaggagaagaaaaauuaaggaugccauaaugacaucuaucagaauaacuggaaaacauuuuaauuuagcauacauuauugacauguaaaaaacacaaaugaauuugucgugaacauuucuauaaggaagacauuccauuaggaggagaaugauaaaauucauguugaauauaugcuggaacuaggauacuauuaagaaagaaacacauuuaugaagcccaauugguaaagaugucauuauaacuaaaugaggaaaauuacauauuugaauauauggcuuucuuuccuaucuucaacauucaaaagggccauuucuuaacuacuucgccuaaauuuuaucauguugauuccuuuguuucaucucagagauuuuauuucuaccccauauagcuagaguucugcuuacaaaugauaaaauacagguaaagcauaagaggaaugcaaauauggaacaaaacugagaacauuacauuuuacuuacucuaccacauaccauaaaacaguacauaaauauuucauuuugaaaaaaaaguccugaguacuuauuuuuguuaggaauaaagugguacuuaauaauggcaaaacauuucuauuauuuuaaaacaaaauuuugagacaguagagugaaaugagauagcuaucagggaaugaagaaaacaggauguauuaauaacgauuuaagggugaauauaagaugcucccccugcucaaaaccucgaaauuccaaccucauuucugaugaucuucaagaauaaagucuauccagaguguaaaaaaugucuaugcuuuccagaucucaacuauucucccaacccuagaaaaaacuguaacaucuuugagagccguaccuaacacuucuaugagcccucaagucugacaaucacuugauaucacuuuugccauaaaguauaauaaaagcaaaaaauucacggcagauagcauuugaaaagcauacagcuacucuaaaagaggaaugcacauuuauucaggagcauucacuaaauaaauucaaucuaguaggucuugcagaguuccaaauugcaccucagcaaaauuacagaguguaggaaaaucauguaacguacauaagacaguugauaggguuccuuucaaauagguagucuagauaugcuaaauuggggaguauaaaaaacccagaguaucuuuuucauuucccuuaaaaaaaauggcucugaauauuuugucuacuuuaagacuggaacacugguuaauaacgagguuucuacaggguaaguuggggaacagauacuaaaggaguugaacaguauucuuaauauuccaguuuguauucuuuugcaucugccuaaagcugaagacuacuuucagauauaugcuauucuggugguugcuguuuuucuaagaauccuuaacauccaauuuugacaaccauguguuauguggaaucucagcauccagcagccuuuuauauuacuaaaguugaccacuauuuuuauuuuaggggaggagaaacugggggaggggagaggcaggaaguaugauaaaacaagcacuuuacagacgcacuccacaacagcacuaauucuaaauaccaaacaccaauaaaacccaaaucauaaugcugaaaacuaaaaaauuagacaaaaaauaaaugaaggauuguuuuuuaauaaaucuuuuauaggacagaaaccuuagcucaugucuucugguugucaucaucuuccacugagcugcaccuaaaacacaaagaacaaguaacaagcaacuuuguuuuuuaaagaacagguaacaguuuugaagguauaagaugaacuguuucuaguggaacuuacuuaaaaaauuacauaaaaugaagccauaaacaucaccagaagcaucaaauugucaacuacuuugggugaaaauaacuacaagagacuugaauaugcagcauauuaucaccgaaauaaauaauggugggaaaaucacuacccauuucauuaagguagaauagcugcaccugugacgccuuaauuaaaaggcuucacucuaccugaagaugaaaaucaccuuguauuuauuuuaguaagucuaaaccgugaagagacgggguguagguucagagguggcuuauuauaucaucuaucaccuuccuggcuguaguucauuucaugucuuuaaauggagcaaaacccaccagaagaaucaaugcugcuauucugauuuuccauucuugaaugcaccaaaaugugcaugcuuguuguaauuaggugccugggugaauaaaaaaaucccauuuacaauuuaaaaauauuauuuaaaccccuaaaaucugauuauuuuccauauuccucagggagacaagcauuaauuuuaccccccaaacagcaaagauuacauauauuucugaaaaauucucuucuaccauguuaauaauacaaauuccuuuguguugcaaaaccaagcugauuuaaacgauuuugucuuaaauuguugcuaaauguuuaucuacacaugcugucagaaauaaccuuguuaagaaggugaagcuggugucucagcaaaucagaccccuuggagaaggcgucgaauggccugugccccguuuuccuuuuucucuuuccgcaccaucaaaaggaaaagugagaaaauagcagaaacauuaguuaaauccugaauuauaccccauaaccuacaggaauaaucucacuacacugaaagcugacaauauuuguaggauuuuuugaaauaauuaggauccuaauuauuaauaaacugguaauuuuggcuagguuuacaucuuuaacuaauaauacuuucaauuaaaaacuuucaggaaaaaaacaaaagguugcuuuuaacuauuuaugguuuaccugacuuaccagcacugaagacaaaaacuuuuaaaaauggcuacaaaugccuuguucacaaaagacuuuauuaucuagugaugcauacugagaacauacagaaaucugcaugguccacuucacaugcaguagaacaaucuucacuuuacaauaagugagugucaacuguuuuaugcaauagacaacacuuuaaagucacauucuuaaagaaaagcuucauuuacaaaagaaauaaaagguaaagaagcaauuaccgcuuuuaaaaagcagcugcuuuguucaagaguggaagguuuaugccuguauugaaagacaacaugaucacaaauaaugaaaacaaugaacaaaugaaaaacacuuuuaccauaaagcaguacacuuucaaaaugacauacaaauaguuaaaaauuucauuacguugucuagccuuuaaauaugaggacuuucagaauuaggccucaacauuuguaauuaguaaaugaaaacuacgcaucguuucuaugucacuaggaacuauauuuaacaaaauguauauaaagucuauagcaaguugauuuaaaaaaaguaaaguuaauaagaaacaguacacugaaggcgcucuauccaucaagcgcguucucuuccaauuuuaaaugugaugaacaaacagaaauuguaacuaugccacaguugcaaugccaaaaaauaaaacaagaucaguuaucacacaugcagggaauucugccacaaagcuaacaucccucauuugucaguuguuccaauaaaauaacaucuuaaaacaccagagauguugaugguuuagcuuaccuucaguguacugaaugcugcacacaaccugcuuuaaaaggagaccaucccugcaggcaggcucaagaaggaacagaccccuuucggcacugacuacaccaagggcaugcugcuguggccugcacacacacaccuaggaaaacgugaauauaaacagcauuuaugcuggccauuuuaucucaagaccaaaaugaagccaagucugcuaagaacaaaucaaccacccaauauuacuacucauuucauaacagaugcuuuugucuuuaugugaacugcaaccauauacauuagcacuguaauuuugugcagucuuggcaauuuaaaacagucuacagugaaauuucacguaagacacaaaacagauuaacuaacaucucuaaaagaaauaucacccuugguguuaauucaaauauaucaugcuuccucaaauuugcuggagaaauauuuauaaguuuauauacauuaauaaacugcugugaaauuucuucagucuuuguauuuacucaaacccuuggaguuucuucaucuuguuuaaauuuuuuccuggaugaaggcgugcuguagggccugguugaugcuaauucguuuagcuggguccaacaucagaaucugguccaacaaguccuuuagcugguguacuuucuuacguuggucuucaggaagucucuggcacccaaucaagucagccaacagguccuuaguuggauuaauggugcucauaacaguaacuuucuccuaaaaauaauuuuuaaaaugcguaucucuaaauaaguuacuaagcauauacaacuuaaaucagauuguuuuggggucuaucaaaaauauuaaaaacaugcauauacauacaaaauauauacacacagugcacauuuugggcaaugacagacugcauauaugacaguggucccuuaagauuggaauaccguauuuuugcucucccuuuucuauguuuagauacauacauacacuuaccacuugcaaaagugccuacaguauucaguccaccaacuuacaguucaggccuagaagcaaaaggccauacuacuuacccuagaugugugugaguguaugcugugguuaugugacgcaugacuguaucaucaucaucuauucauuuaaaacuuugcugugguuuccucuaugcuguacaucuuuuuaaaagguaaccaaaaaacuuaaaugaaaaaguugaugccaacucugggcugggcgcgguggcucacaccuguaaucccagcacuuuggaagcccaagguagguggaucacuugagcucaggaauucgagaccagccugggcaacacugcaaaacccaucucuacuaaaaauacaaaaauuauccaggcgugguggcacacaauuguaaucccagcuacucgggaggcugaggcaugagaauugcuugaaccugggaggcagagguugcugugagccaagaucgugccauugcacuucacccugggugacaggugacagagcgagacucagucucaaaaaagaaaaaaaaagucaacuccaaguuagcaaugaaaauuuacaauaagauaagcaugagcuguuugcacuguacuuucccuaccuugaagugguaagugacagacaugugaauaaguuaauacccugaaguauuauuaagugcucugacaaagacagggacauaugcuauaauaaugggacaaaaauaaggaaaucauuacuucaaucugggaguuuucaaaaggcucauacagaauguguauuucagcugaggcuugaagaugauacauuuuuuaggggguugggggugaggcagcacaggaaaugacuaagcucagggaggucuguuagcaaaggcacaaaggucugaaccagcacgccuucuggccaaauguggaaagguggggguucugaauguacugaagagaggucugaaaacugaagaaagcaguuggauuugucauucugaggaacuuaaauauuauuucauagguaacagggagccaacaaagguuuuuaagcagggauaggaacaugaccagauauguuuucagaaacaucacucuagcagcaauaagaaagcuggaugggaagccagaccaagaaaguaauccaaagaagaugugacgagggccuaaauaugaccuauaauaaaaauaaauuaauuaugcuagaaaaacauuuuaaaaucccuccaucuuuuccauggucugauguguuuuauuuaggaauuggucgacagcaaaaaggaaauacuuacuuuuggguuuuuguuuuuuuuuuaauucaccagcucguaugauuuaguacucaguuaacaauaaaauaacuauugcaugcugcauuuaaaacacuuacccucucuguuacuuuaucaacuucuauguacaugaaguugagauuuugaucaaaaugcugaucuuugaacacaccuuuucgaaucaucuacaaaacaaaacaaaaacuuggguuuugaacuauuaugaaacaggccuacuaacaauuuaauuaauauacaauaagucaaauaaguauguuauuuagucucuguagguuuguuugaucucagauucccuugaucccaggaauucauuaacaucuuugcaaaagcaaauaccaaugcuguaccuaaaacuacuuaauaacaugaaauuauauuuguccaggcagugacuuaaaacaauuauaacaucaaauuguccuuucacuauuuaaaauuggagagucaacaaagacuuuaaauuauuucuuccuaaaaauaucacaaaacucagguuuuuucuccuuggcaguuagggaaccuaaugccacuuuacuaauuauguuccaacagcccugauacaggucagacuucauuaaaacuaauaccaacauagcucauuuuuauguaacuuauucuaaaaaaaguccaaccuaauagaauuuggacaauauguacaaaucagccuggucaacauagugaaacuccaucucuacaaaaaaauuauuaaauaaauuaacugguugugguggcacaugccuguagucccagcuacauuggagacugaggcaggagaacugcuugagcccagggguucgguucaaggcugcagugagcuauaacuguacuccagucugggacacagagcaagauccagucucaaaacaacaacaacaacaaaacacaacugaaaaccauacaguuuucugaccuuuacgaaaaauguguaaaucuuuagaaauucagcaaauaggcugaaaucuuaaaaagcuaaguuacagccgggugcgguggcucaugccuauagcuacucgggaggcugaggcaggagaauggcaugaacccgggaggcagagcuugcaguaagcugagaucgcgccacugcacugcagccugggcgacaaagcaagacuccgucucaaaaaaaaaaaaaaaaaaaaagcuaaguuauggcccucagauacuuuaauaaaugcuuacauucuugcuucauguuaaacagaaacuagcauuauagcugaaguaucagcggugaguuagaaagauauuaaauaagaaaagguaccaagaaagguaccuuacuuucucaaauaaccuccaaucuuuaauaaauuaauuaacaucaaguuccucuuacaauaucuaauauucaccuauucauucucugaccacuaagcauguucuuguauuuuaccuaauucaacuuacaucuuuuuccauucugucuuccaaacauuuugaaacuuuuacccauaaggguguauccccaaaauauugcugcucucuguccaucauugaacaaguucucuuauccuuagcgcuuggcugauuagaaccacuaauuuaaaacaccagaaaagggaaagacccuaagaaaucaugauagccaucuacccaccuuucugaaauuuuuguuuuauagcucacuaguggugagcaagugucagcagucuugucaguuaauaagaaacuaagaccuuaaagaagcucaugcuaaugucuuaccuuauuuggcaucuuuccuuugagauccauugcaagcuucagcauaugguuauugguuuugccagggaauaaaauuuuuccaguauagaguucguauaaggugcaaccuacagaccacauaucuauaccauagucauagcuuuuaccuauaacugaaaacaaaaucaaaguuuuaauauacgaggauagagaaaacugacgacuauuaauuuuuauuuccauuaaugaggggcuggcuaccuuagcuuggacuauaaccacaaucuucaugccuuaguuugacaauuaguuuuguguucuuucccacuaauucuuaauagagacucaaacuuaaaaaccuuaaaaaauggagguguaggggaggaacuuaaagggcaaaagaaaauauguauuucuucucuuuucucauuucgccuuugguggaggugcuaaucagccucaaccaaggcaacaggaaaaaacaaaggucccauacaauccauaaaugugauaaucagaccuugaauaaucaagagcagucuucuaaagucgaggauuuuccacaacuguuuugcuacucuugcccgacaugaucaagacuccugucacaacuaccuucauuccaccugaggaggaugaacuugcuaugguucccuuccucaugaaugaacucgugcagcugcugaagugugauggaaaacagugcuuagacauuaaguaugcgguuuccaccacauaugauggcccaggucaaagaacauuaagaaacuuacugauuucaggagcacgauaaaaucuacugacaagauaagguguuaugucauuauccgcaacaugugaagccgacccaaaaucgcaaagcuuuaaaauaguuuuggauucauuaaccugcaaaacauuuuuucaagggaauuuaauucaagccaggaauaauuaauacaaauaaauaaaaauuauuggcuuugaaaaguuuuauuaauuccaauacugagaacaaagacauucauuuaaaaauuccuuuucuauuuauuuuuaauucaauuuccuaacuaugaaaaguuaauauguaucaaauauucauuacaaugaguaaaaacuguuuucagugaggaaauggauaucacaaaguacauuuaauuuuaacaacugcauuuuuaaaagggugggguacugagagaaaaaucuaauuucaugaagcaaagcaucuucuaaaaagacccugaauaccugaauaaagucaaguuuuauaacuaaggaaucagacuuaacuuucaguugccagagaauuacaauggcaaugaaagcagaagggugauucagaauaaacuuggacaaaaacaaaauauucuucauccgaagcugcuauaugaucccaaauuuagcaaucacuucaagucuaaaaaauauuaaaucccucaaauauaaagaagguauuagucaagaaaauguuaaauauaucuggcaaaacugauaaacaugaacucuauauuagucauuuguuucuuuuuuccuuuguaaauacuucaacauacacaguaauagugacaucugcugagaaaggcuggaguugcucccaugacugcugccacucaugagucagaggcauguucaggauuaacaagugaagauaauucauauuccagagucccuuccccccuucaaaagagacacacacaaauuccgaguugggacuugaacuuggccuacugcucccaccccaaagcagcauaacacuauagccuuaggcagucucuauggggagacuggacuauuauaaaugauauccagaguuaagcuauuaauaggaacagaaaugauuauuuuuaacucccacauugauuacuauucuuuucaucuugggaaucagaaaagcaucuuaaaauagaaaaguuauuuuaaaacuuuuuaaaguguaagcugaauucagcuacuuaagcaguuucaauacccacagaaaacuuaagaaccauuuuaaaauuagaauccaucaguggaacucuugggcuggcuaaaaugccuuaaagaauagcaggguauccauacucauaugcacuucaguuugcuacacaacuucugcuccugucaugaggaaugugguacuuaaaccacacugauaccugaaauuacgagcuaaaggcuuuggauuuucauuaacaaaaaucagcuccgucauuaaggucuauuuuuuccuuccccaggaagacgggaaaacauuucuuaaauguaugugaaaaccuauacuaguuuagcauuagguuuuaaaaacaagaguuucuucugugacacuggcaaauguguuauucuuuaaccuccacaauggucacaaagacgcucacuguaaaugaccuuuuaaauuguacauguuuugcauauucuuugacaugaaccauguauuucacaauuaaaaaacaaaaaauuggcucacgcuuauaaucccagcacuuugggaggacgaggcgggcagaucacgagguuaggagauuaagaccauccuggccaacauggugaaaccccgucucuacuaaaauacaaaaauuagcugggcgugguggccccugccuguaaucccaguuacucgggaggcugaggcaggagaaaugcuugaaccagggaguuggagguugcagugagccgagaucacgccauugcacuccagccugguaacagggcaaggcugugucucauaaaaaaaacugagguaaaaaucaacuaugaaauuggccacacaaauuuauacuucauuuuuaauguaccuaccauuucaaugaaauuacucagcuccccuaacuccaaguuacauuagauauacaauacaauaauaauucagaccaaacauaaaaauggaauacaccucauuacuaaugugguugucuggaaggaaauaaaggaaauauuuuaagauauuaacaaaaaagaaaaagaaauaugaauuaaauagcuuaguuauugauuaaaaaaaaacuccuuaaacuuuaaugagaucaccauuuuuuaaagaauuuaucuuggccaagcaugguagcucacaccuauaaucccagcacuuugggaggcugcagcaggaggauugcuugagcccaggaguuugagaccagccaaaccucaucucuaaaaaaaauuuuuuuuaauuaggcagucacaguggcaugugccuguggguagucccagcuacuggggaggcggaggcaggagaacugcuugggcuuaggaguuggagguuacagugagccauuauggcaccacugcacucuagccugggugacagaacaagaccuuaccucaaaacaaaacaaaacaaaacaaaaaaaacaaaagaaaaaaucaaaaguauuuauuuuguuauagcuccaagaguucccaauaaagaacaccuuacacgcuuagcuuuuagucuucaggaucucuccuaggcaucaacuguaggagaacugauaaagagaacccauuuuaaaaaaaugaaaugcagaauguuaccagcauauaagcuggaauucuccaaguugcgaacacgacccaaacugaaggccacaaaacaggguaaaguaauggggccagggaggggaggagugugugugugcauuaaucacaucacuaugauaauauguauguauuucaaaauuuuaaaaacauauacauugugaaaucugcuguuaccaccagaagucacuagucgaagagaauuaagguuucaaaaggugagaacacauggacacacaggggaacaauacacacugggguccgucagaggcuggagggugagagaugggagaggaucaggaaaaguggguacaaacccuccaugacacaaguuuaccuauguaacaagccugcacauguaccccugaacuugaaaguuuaaaaauaaaauaaaauaaacuucaaaagcgaugccuuuaaauauaauaccuaaccacaacugagcuuuauuguguuugagcccccaggagccacagcuuagggagcuauaaaauuagcaaacagaagaguacggacacuccuuauuucaaaacagcaacaugugcagcauuuuucuaaagauaacagaagaaacucauuacuacaguaaagcauuccaggauuggugcacacuuuaaaucuaucagucaaaagagaaaaaaagggacaauuguacauuuccuuuuucuucauacuugucaauaaaauuucacuguccgauuuccaagaaagauaaaaaaguauuagucauuugaaauagguuauuaauauacugaacuaugcuucuaagaugucguuucucauaguaauaauauuacugcuaguaagaagugaaauguauguucaagauguacagcgcagcuuggcuguuugacuuaccaggauauugucuggcuugauaucugcauguaggauauugcaucuuuuaaggaguuucaaugccaggaacaacugcugacuauaggaucuuacagcuuuaauaugaagaccaacaucuuuaccauauuuuuuuaacaccucucguaaguucaugcuuuuaggagaaaauuaaaaaaagaaaacaaaauaggaguuaaaaugcaaaauggaaauauaaaaaggcaaaaacauuugcaagcauaaaguaaaaucaagcgcaaaauaaaaauauguaagaaccacccccacauuugauaaaucauuuuauauugaaaggagagcauaucaaauuguauguauauaacacaguuucugaauaaauucaaauuuucuaaauagguaagaagaaagauaugcaagguaaaacucccauuucgauuuuagaauagauucacaucugaaaacacaacaaagccacacuguugaagauaaaaauuccuuccuugaaguauuucauuuuaagagagacucucuguugaacccgggagguggagguugcagcgagccaagacugcaccacuguacuccgggaggagcaacagagugagacugucucaacaacaacaacaacaacaacaacaaagacuagcuguuaaccacaaguuaaaaacaaaaaccagagcuguguggauaaaacaaaucaaauacgcagaaaaucuguuacagcauuuauccaaaaugagaucguaaagaugaagaaguuaaauuugcaauuuaaugcacacguuuugacauuguaccugagaggcucgaauaccagacaaagaugcugcuugugauagaagugccugaagagucucagacaaugaaauuugucaucaggaucagcaucauuaaguuuuuucaagaacucuaauucuuuuaaaccagucuuuugccuaaaauaaaaaaaaaaauugggguaaaauugaauauauacagaauuuaggagcacuaaauaauguauuugcuagccccaguaugacgaucaggugaugugugggagaagucuguauauuuuuaaguacuaauaaaucuacugagaaauggugucucuauauaucauucacauaacacuuuauaguuagucaacuaucauuaucauacauagaguuaauuuccaaaauaaucacugcacaaaacagaaacauugaggaacaaacccaucuuauuuugauuuuuaaaaaauuuugauuuugccugaaggaauaucaaucuuguauauuuuaucucaaaacaggccaggcgcgguagcucaugccuguaaucccagaauuuugggaggcagaaguggguggaucacuugaggugaggaguucaagaccagccuggucaacauagcgaaacccugucucuacuaaaaauacaaaaauuagccaagggugguggcgggugccuguagucccagcuacucgggaggcugaggcaggagaauggcuugaacccgggagacggaggguuugcaguugagcugagaucucaccaccgcacgccagccugggcaacaagagcaaaacuccaucucaaacaaacaaacaaacaaaaacaaacaaaaaaacaaaacaaaacccacaucuugacauuauuuuuaacaaaauggaaccacacugcacacuagucuugguuccuuuaagaaugcaguaaugggccaggugcaguggcucaugccugugaucccagcacuuugggaggccgaggcagguggaucacuugaggucaggaguucaagaccagccuggccaacauggcgaaacccugucucuagugaaaauacaagaauuagcugggcgugguggugggcgccuguaaucccagcuacuugggaggcugaggaagcaaaaucccuugaacccaggaggcagagguuacagugagccgagaucaugccaccaugccacugcacuccagccugggugacagagcaaaacccugucucaaaacaaacaaacaaacaaacaacaacaaaaaaacagaacauaguaauggaugccuuaucaaauuuuaacacuugguuaucugaggaaauucuuguuacaauuugucaauaagcuacauuuuauaguaagcagcuaaauacagaaguuggggcuucccaucaaaacaagguccuuucuaagccuagggcaaucuaaacuuaacacuuauuuccaacauuucaaacacauuaaauucauuuuaauaccagcucagugugugguauuaaaacacacagauauggcaauuaacuuucuauuggaggaaaacaggaacaaauuaaaaaaagacagauucucaucacucugauaaauuuucacuuuuuugcaggucaccauagugacagcuaaucaacaugauccuuucauuucucaacucgucuucagauaaagcaaaggacggcauaagacagacaauagagggaaggaguuuaaguuguuauuggugcauacaguagguacuaaaaugcacugaauuaaaaauaaucagccuguuguuccaguacauaugacauauggcuauaauuuuaaaauccagucaaaaacaacuguuuccuggccgggcgcgguggcucacgccuguaaucccagcacugugggaggccgaggcgggcggaucacgaggucaggagaucgagaccaucccggcuaaaacggugaaaccccgucucuauuaaaaauacaaaaaauuagccgggcguaguggcgggcgccuguagucccagcuacuugggaggcugaggcaggagaauggcgugaacccgggaggcggagcuugcagugagccgagauugcgccacugcacuccagccugggcgacagagcgagacuccgucucaaaaaaaaaaaaaaaaaaaaaaaaaacaacuguuuccauuacuuuauaauugcaauacuuguuuuacacauucuaucauguaucacuuuaaaaaaauaguuuaaaaauauguucuucuguaaguauccguacuguuaaagguuuccucacgucuucugaacuuacaugagcucauuguuucugaugaucuuuacagccacuucuugguuggcucuugcauuaucucuggcucguacaacauuacugaauacaccuugcccaguguagccauacacauuguaacguuuaucuaggacuucaccuauguucacaccuaaaaaggcaaauugaaaaauuagaauucugacuauaauaaauagaaucagaaaguaggaaacacagugcagucauuuaaaaauuguguuaaaucucuacuauuugguuuccuagacacaaugaagaaucaaagccaugccuccacugaucacucuaucagagugugguuagaagcugcaugccuacuucagaucacuacaagaguuccuguuguccuaucaacugcugaugauuuuaacauuaaguuuuuccaauuguagucccgcaugacaaauaccgcaugacuggcauccaaaguuuccuguuugucguuuuucuugguuucagaucaagacgaguaagugacguaccccuuccuucuggaagacuaucucauggcugaaaauaauuuugaauauauuuagguuguacaucaagacuuuaccucacuccauuugugauguuucugggcugcuuuuagaauacacacgaguucaugcagcuguuggaugugccacaauuuuuaaagauggcacugugaugugauuuuucagaguucuccaauaaucugugauugcaucaagcagcaugcuuuugcaugguguuacaaugaacucuaaaguuaauauaaaaugugaacuuacgauaauagccuucugcaucgguccaguuaucucugagguugggauucucuuugaaaucuuuuccaaugccagcggcccgaagacgagcacucugaaauuaaagaggcaacaugaacaguuuacccacuugucagacauuuaacgcacuuccuuuaaaacacaaaaggguaacaccagauauaauuuaauaaaagcauuuuauuccaaauuaaauaaauucuuacuaucacuuauguaaauccaacauagcugaaacaugagaccaaaguaucuugauucaaaauaacacuaaaaaaaaaaaacaaaaaccccucccagccugggcaacacagugacaccccuucucuacuaaaaauuaaaaaacaaaaaaaaagcgccagguguaguggcauguguuuguagccccagcuccuugguaggcugaggcaggaagaucgcuugagcucaggaauucaaggcugcggugagccaugaugucacuaauuacugcacucugcacuuuagucuaggacagagggagacccuaucucaaaacaaaagagaaaaaaaagaaaauaacucaaaaccagauacaaauuucuauagcuguuauaccauuuguuauaccauucuucccauacaugcaugaaauguaguaagucacuggcugcacuaguugacacuacguggaaaauugaaaaauaagaauauaugguacuccugauuauucuuuuuuuuuuuuuuuuuuugagacggagucuugcuuugucgcccaggcuggagugcaguggcgcgaucuccgcucacugcaagcuccgccucucggguucaugccauucuccugccucagccucccgaguagcugggacuacaggcgcccgccaccacguccggcuuauuuuuuuguauuuuuaguagagaugggguuucaccguauuagccaggauggucucgaucuccugaccucgugauccacccgucucggccucccaaagugcugggauuacaggcgugagccaccgugccaggcccuucugaugauucuuuauugcaccuuacucuccaagauacccagaagacucuucaauaucaaccaagcaaaugaguacugacaccaaaacugggucaauacucauuucauccucuccuaauucauuuauagguugguguuccuauugcucuguguguguguguguguguguguguguguguguguguguguguguacauauacaugacuauuuaucuuaccacauuuuuauuuucccuguuacauuuaucuucucuaccuccucuuaugaaggccucuuauuucucauguccuuugaaauuuauauugaaaauguccccaaguuugaccacguucauaguuuaagacuuuuccaacauaaggcaucaauaaaaauuuaagaaaaaaguggugaaaucaccaaaauuucuuaaucuacuccuuauaacauuuccaauucuucaauauucuauuaauaaguucucaaucaccuacuaauauaauauagaggccccaaaguggagucuauucuaauaaagaccuagaaaauacuguuaucuccuuauggcaccuaacuaccacauguauguguauguauuuaaauacacaauacuguacaaaugacauguuuaucauuugguguuugacuuuuauaaagcucucaaauuguucugccauaccugucuuaaaauuuuugacauuaauuuuagacuuauaagaugcaaaacuaguagaguuuucagauuccuuucacccacacuguucaaaauauuuauuacauuugcuuuauucuucuuucucuauauguauauacgcaccaauauauuuguuauuuuuuuuuguuuuaacacuugauuuaaaauaacuuacaucaaaauacgcagcaaacauaucaucagauucuguaaacauaucaggugccaacaacuucuucugagaugaaccuuaaaggaaauuagcauuaauguuugaaaagugaagagaugauuuaaaacacaaaauaagugaaugggaagucauuaauaguaauucaaacuuuuuugcccucuugcacaucaguuucccaacaguauucaauuuagaaucacuuuauuaacauuuaugauacauaaagguauucacuuuuuaguaacagagugcauuucagaaagcugaaagaccggccgggcaugguggcuuacgccuguaaucccagcacuuugggaggcugagguggguggaacaccugaggucaggaguuugacaccagccuggccaacaaggcgaaaccccaucucuacuaaaaauacaaaaauuagucgggcaugguggcaggugccuguaauccaagcuacuugggaggcugagaaaggagaauugcuugaaccugggagagggagguagcagugagcugagaucacgccacugcacuccaccugggcgacagaauuggacucuggcucaaaaaaaaaaaaaaaaguugaaagacccaauguuaacuuuuacuauucuuaguuuacaugaauaagcuaauagcuaagcaaugacuucacauuaaaauaaaagcucaucuuuaaaacauguuauuugcaccuuaaaucccaaaagguuaauauuucaacuauagaucuaaaucucuauguaucucucccuuuaaaaguccaauaaucccacagaaaaccuggcuaaaaaauaaaaggauuuucuagaaaaaaaaauccagucgcuuuaaccauaugaaugcaugcucauuaucacuuacauuaagggaaaugcaaauuaaaacuacaaugagguaucaauuucugaccucugauacuagcuaaacauccaaaaguacaacaacauucuguuaacaaggcucuggauauacaagcacucagaaagacggcaaaaugguacaacccuuauaaaagaguggaauuugguaauacauagcaaaauuauauauucacucccucuucugacccagcaaucccacuucuagggaacuaucguaaaacacaguggccaagaauuaaagaaugacuuaaugcacaacaccauuauaaucaguacccaaugaauagacagaaacuggacacaauucaaauaucaaagucugacugaauaaacuauggcggagccuauaaaaaggagugaggaaaaguauaucgaucuaaguauguauaguuugguuuuguguguguagguaggauacaacauauacacacauacaugcauacaugaaagaauguauuauuaagaaaaaaagaugauuccuaaaaaacaaaagcaaaugaaaauaaaccuaagccuaucaaauuuguggcauaccauacagagauuucaaaugauuuuaaaagacagagaauugugccuauacaacuuagaauguauccuaaaaacaaccacugaaauuuuaagccacaguuaguauauguaguaaugauaaucauacugauaucuaauguguauaaguuucaagauaaccuaucuguaaucauguuaagaacuaaauuuuucacuguaauaagagauagaaauauaaaaucauaaguuaauaaaccccaauaaucucaauuuuaaauuggcaauaucuguguaaacuccuccuuuccaaaagaguaucuacuuccuaacuuuguccagugcaaaggcccagaaauuacagacacuaguaagugugcugugaugucuaaauggcauuuccuauuaaauggaaccagggauccuuggagaaauagcugauucugcucugggcaggacaugcacaagauaaaccugugcaucuugcuagagcaggagucgguaaacuauauacagacugugagccaaaucuagcuggcugcuucuuucuguauggccuacuuuuacauuuguaaguguucgggggugggggaacagaauacuuuguggcaagugaaaauuagaugaaauucaaauuucagugccaaaguuuuuucuggaacacagccauguccguucaacaguguacugucagcugggcgugguggcucacgccuguaaucccagcacuuugggaggccgacaggcagaucacgaggucaggagaucgagaccauccuggcuaacacggugaaaccccaucucuacuaaaaauacaaaaauuagccaggcgugguggcaggcgccuguagucccagcuacuugggaggcugaggcaggagaaugguguggaccugggacgcggagcuugcagugagcugagaucgcgccacugcacuccagccucggugacagagcaagacucugucucuuaaaaaaaaaaaaaaauaauaauaauaauaauaaccauauauugucuguggcagguucugcccuccaacaaguucacuauauggaacuguaaaggaaaaggccaauauaauuacuaaaggcucaaccauuuacuaucuaaccucuuagacaaaaaguuugcugguuccuguucuagaaaguaagaaagcuauauugaauacuaaagggcuggggcaaaaggacaagagaaaucaacugaaaaagggcuccuuuccccaacccaguuagagagaccaaucuagcuucagaaagaaaaauaacagcaccagaucgaaacacaucaagcacauaaugacaccaaaugaugaacaccuaacaaaacagucaaaaucucauuagacaucucuggagguuguuaggacaccaacuguauucuaaaaauugguaaauaaagaaaauaauaaacauguauuuacccugccuuuccuauacaaacuaucuuuugggguaaccaaaaaguggaaaccucuuauuuaauguuuuaaaacauuaauguucuuaacugacagagacacaaacaaguacccagaaggggaauaaaaucauaauuggauuugcuuuaaaauagcaagcaaaacaaaagguaacgaauaugugagaguucaguauacuauucaggauaugugaacuaauaaaaacacauuuauagagaacauuucuaaggacauauuuaauauuauauuacugcaauauucagcagaagcaacaugucuaaucuuuuacuuuuccuaaucccaccccaaauaacgucucuuauuauaaaguuacagagcuaacaauucagagaaaagcgucgccaggacaaaacucucucaccauuauucuguucaacugucauuagauuaugcuuggcuuucacugaggccucaaauguaucaacauuuucccguucauacucuuuaacaucagcagcuacucgcuccagaaugucaucuggagauggugaucguguucucguacugcucugggggcugcuugguucagauggcacagacauguugcuaucuucagcaagguauuuauauuucuguaauaacaauacagaagauaauacuuucauaaaauuggaugcuauccaaauacauucauggcuaagaguugcugcagugaaaaguuaagagaacguaucaaauaauguaacaaaccaaaugguauuuauugguucaaucaaaucugcaaucccuuauguaauuucuaaauucacaaaaaucugaaaaaguuuuucuuucuucagugcacauucaucagguggcagcacuggaccugaucagaugaggcaccauuuauugucuuauuuucuccccagugugacuacuacaguaugccucacuguagaaauauuaacguguuugauuauggggucugcugcagaccccacugauggcacauaauagaugcaccauaucaccuuucuaaaacucaaaaauuucugaguuccaaagcacauauggccccaaggguuggagguaagggguuguggaccugagcaagaauaaaaaaagauucauccacaucuucagggauaucaguuuauuaacuacaauuuuaccagugucccagaaaaguaagcuuccuccggaauuaguuuugcccuacuuccuuucuggugaugcaaguucuguccuucacuccaacguggcacacuauuaccugauuuaugguuugcuauguguguuuagguaagcugccacagcuguuuucuccuuuugucuucgaaggaagagcugacaaccuuccaagucaccaaaccuuauaauuaaauggcuguaucaagaucuuuguauaacauucuuuccccacccaaucuucuucaucaucuggcucuagucuuaaaauuauuuuucaaauguuucauuuaaaccaccauauucacauuacaaaacuugccauuacuaaauauuaaaauauuuacuuuauucacacaguaacaugcauaauuuuuugcuaaauaaaauuccuccaguuuauucuauacucauacguguucauuaacuuaaaaagaaagcaaacuucagauucucauguuuuacagaagagguuuacaucagaauucuauguauaaacaaccagaauucuauguauaaccaacaaagagcaaccaucucaguuuuaguaacuaaaaaaagaucauuuuuucaaacuucacaaagauaauuuuauauauacuauccuuuucuaaggaccuguucaacuguuauuaaugcuacauuuuuguuaaagcaaaaaaaucuuuuacuacaauaaugguuauuuuucauuaaaaucacauaccugaacaauugccugccuuuggauucuucucuguucuauuagggcuucuucaucuucuuccucuacaucaaagucuucaaggcuuaaagaaaaauucaaacacccuuaagagauucuaaaaccauaccccuuauacauuuuaaaguuaaaggcaggaaaauguagguaucaguaaguuagagcaaaagucuuaaguccuauuacuuuuguuuccaaaccaucucaguuaacugccugguuuggaauguggggaaguaaccuaaccuuugucucaguuuucuucucaucuauuucauggcaccaaaauugggaauaaaagaaauaacuccagguuuacaaaaguugccacuaguuuuuccaugaccuuaguaaagucacuuuaccuaucuagccuuaguuuucucaccuauaaaaugauggcaaggguaagauaaguaaauugcuaccuuuucuggaugucagaaccgccugaaagcucaagaaagcuauacccguacuucccuaucaaaaaugcacaugcaaauauuugcauauaaucugaaggggaauguggcucuacuccgcaacacugcccccaacccuccgcacuaacccucaaauaccaccuccacaaucuuuaugauccuucccagugcaacuuuuucaaugaucuuaccugcugaauguucgcugcagaagaauaggcaaacuauacucugauucuaucagaaucuauguagaaugcccuucucccauccaacuuuaaucaccugguuuuaaucaggguuuuucauccuuagcaugauuuguuuuuugauauggauaguucuuuuugugugugugugugggggguuauccugugcauuguagaaugcaguaucccuggccucuagccaacaaucacaagaaauguccucagacauguccccagggaggcuaauaaccuccuguugagaauggcucuagauuugucccauuuauuuuugagauauuccacuuagacaaucaagucugcauuuuauuuauuuuuguuuuuugagacagggucucacucuuuuugcucaggcuggagugcaguggugugaucaagcucacuucaaccuucuccccccagggucaagugauccucccaccucagccuccugacuacaggcgugugccaccaggccuggcuaauuuuuguauuuuuuguagagacagggaaaaauguccccacaauuguauuagacacuugaaauguuucuacauuuucauguuguaaaaaggacacucaucacaaaauagccucaauugcaaaguauguaucaucuaacacaaacucaaaguucuaaacuuuuauagaaaauuccucccaaaaucuaguaacucuggccggcaggacuaauguauguauuguucauaauaaaaacaaaggguaggcucacaauaaaaugaaggcccaauguucacuccagccaaagcugaaacaccuacauucagaaaaccgcuuacuaacucugugauacaaccuacacaauauucacaaaagacuaacuuuuaaauucagagccaaauuaauggagccacuuauaauauuuagguggauauuauuuaacaauuuccaagucaaauaagacuucucuaaacuggaaaaacaaaguuauggguaaguucuauucuuacuuaucaucagacgaagauuccugcucaacuuucauuccuucagaaagacuuccuuuaaauuuaucuuccuuuacuuugcuucugcuccuucgucuacgaccaccgcgugaucgagaccgccuucgcaagcgugaucugcuccuccgaccucugucccuauuuaaagaagaaaagacagguauacauuuuuuuaaaugucaaagugggaaaggcaugcaugugugggcacaggggauauauagaaauucuacuuucuacucaauuuugcuguaaaccuaaaacucuucuaaaauauagucuauuuuuuaaaaaggucguuugaaaauuuuaaguaaaagaacagaacaucagaaagacugagauaaccagcuuagcugaagauaacuaaaacauaccuacuccuuaucaaacucugaacuaagaaauucuucccauggauaugaacuugaacuugaauauaagcucuauggggauaaauaccuacuguuucuuuguauucguacagcaccacgguuguauacacaggcacuggagugaagggagagaccgaaaaggggcaaaagggaacuuggagugaugaaaacguucucuaacuugagugugacuuaugugucugucaaaauucacacaacuuuacaacaaaaagcauuuuacuuuauguaaguuauaugcauguuucaaugagcucaacuuaaagaaaccucacuaacaugacaguaaaugaguacuuaaaaaaaaaaaaacugggggcugggugcagugguacacacauauaaucucagcacuuugggaggccaaggcaggcagggagcucgggaguuugagaccagccugggcaacauggcaaaacccugucuccacaaaacauacaaaaaaauuagcugggugugguggugcgugccuauagucccagcuaccgggaggauuccuugagcccaggagguugaggcugcagugagucgugaucacacugcacuccagccuggguaacagagcaagauccuaccucaagaaagaaaagaaaagaggagaagggagaggggagaggagagagagaaaagagaaagaucggaggggaagggaggggugggguggggaggggaggaaaacccucaggcaaggagaaugucaagagagaugauagcagagaugagaauaaaaucuuagaaugugcaaauuggaguaaagaauaguaacagaucaaauugagcugaauauugguccaacaugaacacacaagguaaaucagaaacagucagaacaugucacaacacccccagaaagccucaggaauuggagacucccuauccucugcaagauggugugagguaagagcugaggacagaauugguugaaagccuuuauaaacagccagacucgguacaguccccuccccaacucaguggaaaaugucaaccacucccuucacauucuagcagaacacuuaagauuugcuuucuagagaaggguuggucacuccagaugcugagaggcacauaccaaagauagacagauuauaaggaaguuuacauuaugaaggaagagaacucuacugguagccaggucuauuucccaggaggaaaugaaaggauuccggaaaacucauagcccaagaaaauacaucuacagucacuaauauccaaaaauaucuaauuacucugaagugauaaccacuagcugacaaguccuacacugucacaauagaagaaaaaucccauucagcuuucucaguaccuaaauauuaacucagaauaggcagcaaugaaggauccagcugugugagaaaagucuucaaaugaaaaguaaacaugcagcaaaaggaaucugggaagaaacacaauauagcaaagaaaacuauaaagaacaaaaaucucacacaauaaccucgcuauugucugagagacagaaaauacuauuuccagaaaacaugaauaaaauguuaauacguggaacaauauagaagguccaauuggaaaaaacagaaagaaagaaagaaagaaaaaaaaaagcacaaaaauuucccagaaggccauaaacucccugcuuuaaagggccuaucuaguaauuagcaaaauaaauggggauaaagaucuacauaccgaggcacauaauaaauuucagaacacaagacauuuuuuauaaaaagggaagagagaaaaaagcaagucuugagaucagcuuggagcaagaagacuagcagugucagaagggagguccucucuucccuccucucccaacuauuugcucagcaaugaauacauacaggaucacaaugauuauacugacucuagaagaacaaaaaagugugaugaaauuaggcaaaagcgaaacaugaguaagcgguaguauuaaaaacccucauuguggcugggugcagugggccaagacgagcggaucauuuggggucaggaguucgagaccagccugaccaacauagugaaacuccaucucuauuuagaaaaauacaaaaaaaaaaaagcugggcaugguggcaugggcaccucuagucccagcuacuugagaggcugaggcagaauugcuugaacucaggagguggagguugcagugagaucgcgccauugcacuccagcgugggcaacagagugagacugucaaaaaauaaaauaaaauaaaauaaaauaaaaccccucauugaccagagugcacucagaccaugcauuuccauuucuaggaauacagcauacaaaaauucugagagauauguaaagauggcuauaauauaagccuuuguuucuuaaaaauuauauucauuuauuacuucaauuaaaaauguuaaaagauuggcaaacaaauacccauuuauguuuuauauuaaaauauuucauguauguaugaauuuuaaaaaaugauucccugcuuuauaaaccaccuuuuuaaccuauuacugacuacauaugcuucagauaaaaugguuucuauggcaaauuaaauaggccuuugccuaagucuacaguaacuaucaauaugcaaaauuaauauaaaauguaagaaacugggcuauauauuuacuacuacaugaucuaccuugcugguuaaaaaaaaaaaaaaaucccuaagucuggcucauuuaguauugauugauaaaagagagaaaaaaguccuauuuuuaaaagacuaauuuuauugcauccuaaaugagcaaugauuuguuuaaaauucaaaggaaacgauauaaaagaaaacccauguguagagauugcugguaaaaggaaacuaugggaacacaacuacgauuuuucagagaaaacuggucuaaaagaaaaccuaccaagugagcucacuggugguucaaaaacauucagaguuuaaugaaucacaaggaugaaaugucuuuaccuucuccgaggagaucugcuucuucuucuuggagaccugcuacgucugaguggggaacgagaccuccuucuaaugggagaucuacuucuucuucggguuggagaccaucuauugauggggcuggcaucuuuugaucuuucacgucuacugaggauaucaucucgaggucguguucuuaaggggaucaaaugcaaguuaaaagaaauauaaaucaaaguaaaugauuuuuuucuauaugcaaagaacaucuguaagaaaaggcacauuagccuaaagaaagugaacuuugauuaauguguuuuguaacaaaacuuacucaggugacuacagugauauuuugguguuauugcaggcaaacaaugaaaggucuuauuuccucuggucccacaguuugaaaaauuacuaaagguuauucauaccgguaaagucacugauucuaauuucaaauaaaccaacucaaauaaaaccuccccaagugaguauaauacuccauuuacucaaauauuccauuuucauugacgacuuuuucuuucuacauccugacauuucuccaauuaaggaucuuuuuuuuuuuuuuuuuuuuuugagacagggucuaacucugucacccaggcuggagugcaguggcgcaaacacgggucacugcagccuugaccucccaggcugaggcaauccuuccacuucagccccccugagcagcuggaaccauaagggcaugccaccacaccugacuaauauuuuguuuuguagugaugggggucucacuauguugcccaggcuggucucgaacuccuggccucaagugguucucccuuggccuccaaaagugcugagguuacaggugugacccaccaugcccgggcaaaaaucuucuuuuuaaugucaaguauaauaggccaggcacaaugguuuacacuugcaaucccagcacuuucagaggcugagggaggaccgccugagcccaugagguugaggcugcaguggcuguguuugugccacugcagcccaagugacagagugagaacuugucucaaaaaaacaaaaacaauagcuaggugugguggcucacacuuguaaucccagcacugugggaagcugaggcagauggaucacuuaagcucaugaguuugagaccagccuggguaacauggcgaaacccuaucucuacaaaaaauaucaaaauuagccaagugugguggcaugugccuauagucccaacuaauagggaggcucaagugggaggauuguguaagccugggaggcagagguugcagugagcagagaucaugccacugcacuccagccugggugacagagugugacccugccuccagucuccccagaaaaaccccacaaaaacccaacuuuucaacacuuaucacacaaguaccuuucagugaguuuuacucuuguuuaaugugauauuuguauuacaacaggccuuucuacagcuuaauuuuuuaaaacagguuuugaacauuucuuaauguuauuccagguuuggucacaacuauucaaucugaacagucagauuguaaauagguuugucuccauaaucaaauaauauuacaguauuuuccucauuuauuauuauuauuauuuuuugagauggaguuuugcucuuguugcacaggcuguagugcaauggugugaccucggcucacugcaaccucugucucccggcuucaagagauucucccgccucagccuugaguagcugggauuacaggcaugagcaaccacguccagcuaauuuuauauuuuuaguagagacaggauuucuccaugucggucaagcuagucucgaacuccugaccucaggugauccacccgucucagccuccccaaagugcuggaacacaggcgugagccacugcaacuugccuuccucauuuaauaaaaaccuaaaaacacaaccugccuugcauguuucagcacgguauacagaacccaagaauccuucucugauccagccaaaaugagcaagguagacuuugauucagaucuguagugcuuacuucuugguagugcuuacuucuugauagggccaucugaggaaacucuuuuauuuaaucugcucacauacacgcacagccucaaaagaccaguuaaaaaauauaaaugggcugggugcgguggcucacgccuguaaucccaacacuuugggaggccaaggcaggcagauaaccugaggucaagaguucgagaccagccuggccaacguggggaaaccucaucucugcuaaaaauaucaaaaaaaaaaaaaaaaaaaaaaaaaaaaaaaaauuagccgggcgugguggcgcacaccuguagucccagcuacucggggaagcugaggcaggagaauugcuugaacccaggaggcagagguugcagugagccaagaucacaccacugcacuccagccugggcgacagagcgagacuccaucucaaaaaaacaaaacaaaacaaaacaaaaacaacacacauauauguguauauauauguauauauaaauggaugggauaaaguaaacuaguauaaaaagaacagaguguugucugcuaaaaugcaaugaaaauaaacaguggcucaggccuguaaucccaacacuuugggaggccgaggugggcggaucacgaggucagaaguucaagaccagccuggccaacauggugaaacccugucucuacuaaaaauacaaaaauuagcugggcaugguggugcgugucuguaaucccagcuacuugggaggcugaggcaggagaaucgcuugaacccaggaggcagagguugcagugagccgagaccacgccacugcacuccagccuggcaacagagcaagaccccaucucaaaaaauaaaauaaaauaaaauaaauaaauaaaaauaaagaaaauaaaaauguucacccucacuagucaccuaagaaauuucgauuaaaacaauuuuuggguuuuuuguucuguuuuuaagagugacaaaauacuauaugguauccugguaauaaagguuuuccuaaacuuuccuaauacaguuucaggaaaaggggcaguucacauagucauagaaguagaaguagaaauugaccuaacuuuccuggauggaaauuuagcaauaacuuucuacaauguaaauguacauacucugagacuuugcaaguccacuucuaugagucuauucuauaaagaaaccucacauauaaccaaggcacaucuucgcauauaauagugaaaaacuggaaccaaccuaaauuuuucaucaguuucaauaggagaaugauacuauaauacaucuacacugaaauaccaguugcugucaggcagaaugaaaaacaaucuauauguuuugucgcagaaauguuuccugaaaaaagcaagccacaugugaauaugaauaauaugacuccaguuuuguuaaaaaaaaaaauucccuuauauucauguuauugucuguacaaggaaagaccuaagauaaaguaaauuucuaaggagugguaguggagaaaugaaaagggagacaauuuacaggcuuauuuggauuucucuuuaauaaguaaguaugcaucacuucuguaauuuaaaaaaauauuuuuguuucaaauacucagcucuaguccuuaauaaacuccucagaauuugcucuucaaacaaagcaaacugaaagaccaccaagauaauuaagaagcacuugagauaacagaaucaguaaaacuaaucacugccucaauccaggaagccaaaggaaaaaggggcuauuucauuacagugccacucagaaguaaagaaucaagacgcucuuaagacacagcacuuggaaauaaaauuugaaauuucucugaaaauaugaugacuucacuuucagggugaguuuauauuuauacccauucacagaaaauauuauuaugaacacaguaaacggcuaggaauuaauaacauccuuauauaguauaagccaauacucuuuuaauaagcaaaaccuagcuggcaauuucauaauacuuaaauacuaaauacaaaaaagacauuaagaaaucuguuucuaaaguaguuuaagugguauaaacacuccuccccgcaaauacuuccguucuaugauccuacguaaauuauauacauucucugauucuauuucauuuauaaauuagguaugagagccccuucaccucaugaguuaagauaaucacaugaggauuuauaagaacuaagacaauauauuauucaaauaguacaaaauaauuucauauacuauucuucuuaagcuuaagagauacuacuuuucaacaaugagauuauauguauuaauacaaaauuuuccauuuuaauuauacuuuggggaccaaaaaauauugguauugguuucuauuuauacuguuaaaauuuaaaacucaugcaaauacaagagaaugaacagaacacaauuguuaaacugauuaccuuucccccuuuucaaaguuaagaguuucagccuacacuguucaugaaguaauaauccucucucuaaacgcccccaaugaagauuuaucagccaaauuacauggauugaaaggagugccuuagcaaacuagguauuaaaucaagaaugugaaaaaacccaauucuaucaucaagcucaguauuuguuaaacaccuauacuuaaaauacucaucgaaaaaagugcaaauauuaacaugguuaauggauuggguuacuuaaaauuaugaaacucauuacuacuucauuuauuuuuauuuuuacuuacuacuucauuuuuaaugguccacaaguucuaguuuuccguuuaaaaucucaugcacugguaaaaagcuuuaacauuuuguacacaaguuaccuuggagaagaaagucgucuccucucugguucucgucguuuucuuucuaaggaucggcucuuggcucuucucccaggagacaguguccgcgagggggauuugcucugcuuagaucuucuaucauucaaaaguggagaccugcuucuucuugauuuaucacgugguuuuggagacaaacuucuucuuuuaggacuacgaccaggucuucugcugggugaccuauuuucuuucccagaugaagcaucuuuagagggagauuuaauuggcuucuuuucuuuaucaguuucagaccguuuugauuuucucucuuuggaccgugaccuucugucuuuggauuuaccucuuaaaucaacuggggaucuggauuuuuuaccucgaucgcgacuucuacuuucauuuauaauuggggauuuuuuccuaucuuuugauuuacuuuuaucuucaauuuuaaccuuaucaucaguaggagaucuggccuuaccaauuuucucuugagaucgccuucuaaggguaggggauuuugauuuccuugcuugaucuugagacuuacuucuuuuggaugggcuuuuagauuuuuuccucuccuuugacuugcuccuaguuguuuucucuuuaacgauuucaauaccccccuuacuuuucuuuuuaucagaccuaugucuaguccguucuuuggaucugcuuuuacuucguuucuuuguaguaauuuuauuguccacaaguucaaguuuccccuuuguacuugaagaucuaguacuagaccuauuuccauuucuugccuuuucaugaauuucccccucuucuucagagccagacucauaaccuugcaaaaugagccccauaccagacuggaccuuuccuuccauuaacucauuaucaaguucggccuuaaucaaggcucucuguuuuuccaagucuucuagcaaagcuaaaucaucaaguuuaguucuuuuugcuggagacauacccucuuuaucagaagcaucaauaaucucuuuucuuuuguguuucuuauguuuaugcuuauguuuauguuuuuuauccuugucuucuucugaggaauguuuauguuucuuauguuuacuucuguguuuaugcuucuuuuuuuugugacgacugugcuuauuuugagacuggucuucugauacuucuccauuuucuucauuuauacucuuuucagaauuagcaucuuccauccuauaaauauaucaaacacauuuuaaaaucauaucauuuaucaaguauucaaagagccauaagaaaauaacaguaaugagaaaauacaucucaauguaauacaugaagucagucacuaaaauuuuuucagaacagcuucagacauuuuauuucaaagaaggucuacggcaagaacugaguuggauagugauacaacuuuauuguguuucuaaugguugaacucaccaaaaguauuagaggaaaucccuaauggagugagcuuaaaaaguacagguuagagaaaaagggaaaagcaaaccaggcacagcaaaaccucauuaacauugauuuaguacaagaagccacucaguaacuuaauuuuuaaaccaacauuucucacacauuaacaaccaaagggcccguuuucuuuuuuaauaagaccuacuaacuauuaacauacacuggaagacuaaucuccuucuccacuugaaauucaugaaacuuggugucucuacaguaaacccagcaggucacuuguuuugagcagauuucaucuuauaccuuaaaaacaaagcaaaacaaaacaaaacucuagagccaauacugagcuauacccaaaauaagcacucaaucaaugugcauugguagcugauacugaugauggugauaguauaaacacauccucacaaguugaaucuucaaagugaacuaaaccggaaguuaggacucuaggcuuguaguaagcaaucauacgacauuaggcugaaccacauggaagggccuuuuguaagucaacaagucuaauaucaguaauuuaauacaguacagcccaauauucauucagcaagugauuuaaucucucugaauuucaaaugagaacucaguuucccaaaauacauuuacauuaacagaugcuauggaaauaaauaaauaaagugggggauucugugcuuaaauguuuggcuuaugcugaguuaaaaaguuuaugauucuaaauuacguugucgagcccuugguguuuaagaaucccaaguuaaauacugguucaaaagcacuauuuaacuuucucuuuaaaaguuacuccauaauaaaccaucauccuagaauaucagaccaaaaguggccuuaaauuaucuagauucaggccaucauacuauuuuuggaggaagcuauggauuauuuugucaggucuucauauuauauacuccuauacuuuuaguaaguuuauccuugcaaccuaagaauucaucugucuacucacaaucucuuuaacauuuaaaaaaaacucaccaaccauggguaagcauuaagccacgcggcaggaaaacagauguacaagccaggcaugguggcucacgucuguaaucccagcacuuugggaggccaaggugggcagaucaccugaggucaggaguucaagaccagccugacuaacauggggaaacccccucucuacuaaaaauacaaaaauuagccagauguagcggcacaugccuauaaucccaguuacucgggaggcugaggcaggagaaucucuugaaccugggaggcggaggcugcagugagccaagauugcgccauugcacuccagccugggugacacagugugacgcagucucaaaaccaaaaaaaaaaaaaaaagaaagaaaacagauuacaaaaccaguaucugccuccuucaaagaaauuaaugucugguggaaaacuaagucacaugacauaaccauaaaauacuggagaagugcaaugaugaagacacaaauaggggcauuaugggaacacugaaggaucaccuaaacuaauuucgagaacggucagggacacuguuuuguagaucacagaaagaaaccaauuuguuaagcagggauguuaggaggaaagaagaaacguuuacugagaaaggacagggauuaaaaaauaaagguuggcccaggcacaauggcucacaucuguaaucccagcaccauggaaggccaaggcaggaggaucacuugaacccaggaguucgagacaagccugggcaacagagugagaccucaucuuuauuaaaaauaaaaaaauuagcuaggugagaccucaucuuuacuaaaaauaaaaaaaauuagcuauucaggaggcugagguggaaggauuacuugagccugggaggucaaggcugcaaugagccaugauggggccacugcacuccagccugggugacagagcaagacccugucuuuaaaaaaaaaaaaaaaaaaaaauugaguaacaccgcccuagagaaugaguaaggaauuaacaagaagggaaaaaggggcauuucaaauagagaaagaaggugacaaaaggcaguuauauauagcaaacuucaagucgaucaguguugugaaagacacugagguaaagauuccaaguggagccaggcaugguggugcacaccuguagucccagcuacucaggaggcugagguggaagaucacuugagcccaggaguuugcagcugcaaugaccuaugaucacaccacugcacuccagccugggcaacagagagaauccuccaucucauuaaaaaaaaaaaaaaaaaaaaagauuccaaguagaccaauuccaggagauaacaagauaauauaugguucuaggaguggguaguugagagagaauuaaagguucacuggagucacagaggcccaggaacugcaaaaguacguugucuagccaggucucauagucuugaauaaacuugcugggagaaggggugggggagagagaauggcgguaugacugagaaguuacuaauuaguugacaacaaugagggggagugaaaaacacauagccacuacaggguaccauacucaaagaacuuugauuuuuggaugucacauugccaacuuccauuucuggcaggaaaagguauuuaagagaugugcagaagaagcuacguccucuggugaaagucagguuuuaauuuggguugacuucucccuaauggaguaugagaagacacaugacaaauacaguaguguucucuggaucauuaauuuuucucaaagacuuggaaaaagugcaguaucuugguauuauaaaaacaccaccaggccaugugcagugguucacacuuguaagcccacacuuugggaggcugaagugggaggauuccuugagcccaggaguucaaggccagccuggggaccauggugagauccuaucucuacaaaaaaauuuaaauuaacuggguauggcagcaugugcuuguagucccaguuacucaaaaggcugagguaggaucacuugaacccaggaggggaucacuugagcccaggaguuaaaggcugcagugagucaugaucaugcacugcacuccagccugggcaacaaaggaagacccuaucucaaacacacacaaaaaacaaaacaccaucauuguuuuauuauggaagggaaagaagucacauagauuucaguaaaaagauuccaagacauuucaacuuuguucuuuauauaggcuauauucucauccuuuguccccagaaaucucccaucccauaauccagaaggucuuuuuuuuccugaaccuugacuuauagggggaaaagucugagaaaaauuuaggcuaauucaaguuaugaagguaggagagucuuuaaagauugagaaugaucuuuaggcguauaaaaucuaagugcccaaaguacaaaauucuagucacuaagcucaaauucaaaauuaccuaaaguuuugaguuuuaacucaagacuguccucaagacaaaggacagcugagugguuaagcagucucuggagccagacugccuggguucaaauuccaguuucauuacuuacuaguuguguggucuuggcaagugauccucaggcauuucaucuacaugacggagaaaacaauaguaccuaccugaaaagguguuaugaaguuuacacagugaauagauguuaaaugcuuaugacagugccuagcacggaccaacccccaccccacccccccaccccuccgccaaauaagcuauuauuauuguauagaugcuagauaaauauauuuauucacaaaaauccuguggagcugagagggcugcuaauaagaauguuauuuuuaggaacagcaucaaagagcauagauucuggagucaaacuaccugguuuaaaugcugccuccaacaugacaaagcuauugugcccuuaggcaaguugcucuucugugccucgguuuccucaacuguaaaaaaugggguaauaguacugacaaaucauaggcuuaugaaaauuaaaugaguucauaguauaaaaggcugucacacuaaguguucaagaaaugucucuccauuugaguugagaauuuugaguuucaagggacuugccuaaggucacacauacaacaaaccagugagaaggcuguuauuucaagucagucaaaagaucuuccauuugauuaagaugcuuuaaaagucagauuaugucacuacucuuugugaaauuuuauugcuuucuaccuuauucagagcaaaagguccuauacuuacagccccaacaucccccacacucuaaaccuaacacucuucucccacggucacccugcuccagccacaccauguuccuugaauaggcauacucacaucucagguacgugggaccuguuucuccugccaggaaugcuuuccccagauacaugcauuccuggcuaccuuggccuaccuugucuuugcuaaaacgucacuuucucaaacaaguuuuccugaucaauccauuuuaaaugcaaaaccacuccacugcacacauauucuccuucugugcuuaacauuuuucuccaaagcaauuguuaccacuaauauaauucuuguuugucucucccuaucauaauguaagcacuauaugagcagaauuuucauuuuaguucacugcucuaucucugagggccuagauuaucuaaucuauagcaggugcucaguaaguauuguuuguguuaauuauauauauagaauaacauaaggccgggcacgguggcucacaccuguaaacccagcacuuugggaggcccaagcaggcagaucacuugaggucaggaguuuaagaccagccuggccaacauggugaaacccugucucuacaaaaauacaaaaaacuagccgggcauaauggcggaugccuguaaucccagcuacuccggaggcugaggcaggagaagugcuugaaccugggaggcgaaggcugcagugacccaagauugcgccauugcacuccagccuggguggcagaacaagacucugucuccaaaaaaaaaaaaaaaaggcugggcacaguggcucacaccuguaauccuagcacuuugggaggcugaggcggguggaucaccugaggucagaaguucaagaccagccugaccaacauggagaaaccccaucucuacuaaaaauacaaaaaaauuagccgggcgugguggcacaugccuguaaucccagcuacucgggaggcugaggcaggagaacugcuugaacccaggaggcggagguuguggugagcugagaucacaccauugcacuccagccugugcaaaaagagcaaaacucugucucaaaaacaaacaaaaagcauauaaaaguugucuaaagcugauuuacacuaucuauuauagacucuuagaacuugaaaguuaagauuuuugcuuugcucaguuuuaucuccagugccucacacagugcacacacauaguaggcacacaccuauuuucugacugcgugauauucaaaauuacuuacauuucaucaaccccucccaaaggaaaaucaguuuuuugaaccuuaucuuuucuaaugcuaacaauuuacaaaaaucuuaggaguuucauuaaaaauuguuaagagucuacccauagaggaaucaacuucuaucaacagaaaaucuagcuccuagagcuucugggaauuagaaauacaucaugaugaccaguaucacuguagaagggucauucccaugagugacuaguuuccauuguaaauuaaugaguauuaucucaagaaauaaugaguagguuccugcuaaaaaugcuaccagcucgguacaaucagguuaaccuuaauuauagcauuuucuuauacaggggcuaggcauacaauggaucuuuaccagucucaacucaucucucaaugcaaaugucacaaaucacaacuaaagucugaccaggucaaucuggaaaacuugaaacauugagucaauggcauaauguauuacauacaaugggccugugcuaaaacagcuaaauuagcuuuaucaucaacgacuuucuucuaaagcucaagaaaaagguuucuuguuaagaaaccuaacggcccucuuggauaguuuauacugacaauaaauauaggccauauauauuucauuuauauaaauuuacgcuuuaacauuaacauuuuacaauuuaauaucccacauuuagccaaguggauguguauaccaaccuggucacaacagguuuaucacaaaauauuuauugagaaccuauugaauauuggauaacauucuucagaucacauuauuuggaagcaaaggugaaugagaagugcagacaacaugggguugcuuaacaguauuuauuuguuuuguuaaguuuuaccuuuuaaaaaacccaugucuugaggcacccagcacaaugaaugaaaaucguggaacgccuuuaaaauaacauagucacggucaggugcaguggcuuaugacuguaaucccaacacuuuugggaggcugagacuggcggaucaccugaggucaggaguuugagaccagccuggccaauauggugaaaucccgucucuacuaaaaauacaaaaauuagcacggcaugguggugcgugccuguaaucccagcuacucgggagacagagacaggagaaucacuugaaccugggacgcagagguugcagugagccaagauugcgcuacugcacuccagccugggcaacagagacucggucucaaaaaaauaaaauagucaccaaucaccaaccaccaguguuauuuuaacuucuucuuucacauuuuuuuccaaacaauagucuuagugaauuuauuugguaggcauucaaaauauacagagacacagagaacugacugauuuaaauuuguguaugaauaaagccguuuuuaagcuagacaauucuuuaaauuuuuuuuuaguggcgagcaaagugaacgccacugcuauuuaccaggaaaguaauuaagccuauuucucugacaaguuaaaauguauauaucuuuuaagaaacugggucucacuauguugccugggcuagauucaaacuccuaggcucaaaugauccuccugccucagacucccuaguaccugcagcacuugagcccaguaguucaagaacagccugggcaacaugggaagacucugccucuacaaaaauacuuaaaaauuagcuaggcauggcucggcacgguagcucacgccuguaaucccagaacuuugggagucugaggugggcggaucacgaggucaggagaucgggaccauccuggccaacaaggugaaaccccaucucuacuaaaaauacaaaaauuagcugggcguggugguacgugccuguaaucccagcuacucgggaggcugaggcaggagaacugcuugaaccagggaguccaagguuucagugagccaagaucgcaccacugcaaucuagccuggagagaaagugaaacuccgucucaaaaaaaaaaaaauuagcugggcauggugucauaugccuguggucccagcuacuccggaggcuggaguaggaggaucacuugaggcugaggcuacaaugagccaugauaauguuacuguacuccagucugggugacaagagcucguguuucaaaaauaaauaaaaugaacaaaaagaauuaauguagcuauaaaaaucagaauggguccaaaagaccaacuagucuuaaaacauucccucuggucucugcuuugccaaaucagguuugagaaauuaguucucaauaaauuagacaugucacaucaaaaaauguaucuuucugggacaguggaaaaaaacaaaaauaauuucauacuugacaagcaauuuaaaaagaagccacauuguauagugggaggccagacaguacaauaguuagcagcagggcuuuagaaccagacugccugaguuuaaaugggugugccacugagugugaccuugagcaaguuacuuaauuucucuguguuucaguuucaucaucucuaaaauaaggaaaauaaacguaucuaccuccauaggguuguuaaaagaauuaaagccuucagggagcuuaaaagcugcuucuuauauuuauucuuucuaaauuuucuguuuugaauagauucuauauaacuguaaacuacucaguguucucuaaagaacuguuguagacacuauauucagggacucacuaugagcaccaggcauaguuugcuuucauaccaaaugguuaucuucuuuguuaaauacuuucaaacuacugaaagugagacauauacagaccaaauauuccauuuacaccaagugcucuguggggaagggaagggaaauuaaagauuaucucuguuacucauacagcagaggccuaaauauguauuuuugaaauuauuaagucuaauauuauuugaauacaguaugugaauaaacuauggcugacccacuccuggaaaugaaucugaaacaucccuaaaaucaaauaaauggacauaauauuacagaacuuuucagauuaguagaaaauguaaccacauagcaugagaucugcacgguacuggcauaaacacuguaauugugccacacaaugaacuuggugagaaacaguaagagguuaaagcuaauuuaaaacuucagaauccauuuguucucugcuaagucaaauuguaaaaauaauacagcaguuuugaaaagcccuuaauuaaaaauuccguuucucugccuagcugaguaaugcagaugauugaggagcccaaaacuggaugcacagcaauuaagugucagguugucugguggcaaagauuucuucuaucgcucagucacaaguugcugggagacuauaccucuuucuaagauggcuggaaacagaucagacagugcagaugcaaaaaaaaacaaaaaacaaaacaaaaaaaaaaaacggucgcuauaggaacauugccguaaaauccauucucucuguuaagguucuuguuugaguuuuccuaacauagacaugaacagcaaaauacugcuuuaaguuaaccaaugguuaaccuuugcagcauacacucguauuuuuuuuuuuuucauuuuucauuuggccgcauggauucuuaauguuagcuuaauuauagacauaaagugguuuggcaguagcuagcaauucccacuacuccuuccacucguccuccuaaagaaggguuauaaacucaggcaaaaaaaaaaaaaaaaaaaaaaugccaggccucaaaaccaaagacucuaucuuacuuugccucaaguuugcaaguugguaaaaaagcugccgguaggcacucaaaacaaaacaaaacaauacugggugacugcuggacuaaagaguacaaggugacgagaucaaguaucccgcuagccacagacuagcucugggauggccagagagugugaccccagcaccuccgcucucugcuuucagguccuaaacugacaccaguaaaaggacgacuggggguaccgcaugaggaagaaaagacuuagggcuuggcccgccugcugccacugacccucguguccccaacacagaugccgcuaagagcugcggccagggagcucagauggguccccaaaagaggcauaggaaagcgcgaccucacugccgcggcagccgccacgcgcaccggaccuguagaggccgcucgcgccuacgccucccggggcaacgacgcgcggcaggccgcggccgccuucaccccagcagccacggccucugggagaaggaagcucgaaggccgccugcuccccaugccucccaccccacaacgaaucgcgccggaaaaagcaaaguuugacucucgccguuaggcccgaacuuucccgccaccccgugcagcucccacucggcaguccccgggcuccagcuucuggcccacucacagagacuacuuacucuggcugcucccguagcgacugggucuccgcggcggccaucuugaacuuccugacuccucggcggcgguggcggcggcucccggacgguggaggguaggggaaguggaggaagaaggaaaagagcugccgcgcaugugccgaccguguagggaagagcuggguucugaguccgcgcuaagaauccggauauaaaaccccacgucccgggacuagcgcagggcguagugucgcagcuuccgggagcauggugggcggugcugcuaaggauugaggucgagugucaagcuugagcucuucagucaaugcuagaaauggacguuuaguuauugaaucccgcuaacgaggggagccaacaagagagggaugucggcaucgggugugcgguuccaagaacugauuggcugug

SEQ ID NO: 17255 - RNA, 5426 nt, Homo sapiens
uuaaaagauauuuuauccaacucuauguguguauguguguuuuuuguacuaggaggaauuuuggggguaccuuuguccuuauauuggugguguaaauuauauuuuuuaaaacuuuucuuuuuaaaaauagcuuaugugucucauggcguagcgugcuuuuuuuuuuuuuugcucuccuaagucuuuuugauuuuuaaaauacuuuguuugccgugcauguuuuaagaguuugcucucuuuaggaaaccagucaagguccauaauuuuaugaaacuugggcugucaguuauuuacagacuaaccaguguggacagaaguaagaggaaaaguguaacacuuguguuaugaggucugggagagcugaggccacucccccuguuuuacaggaggaagguccuaagcaguggccucgcccagucagccaaccuccaguuucacccacgagaauggugggccugagaccaagagaaggccauuauucagucauguugaagugcggggcgcugccuaagaaccuagcuccuaggcuccccacaucacugcagggcaggcauuagucaccacuuuuagagcugaagagaaugagucuuugguuaaguguugaaauagaaguacaguucagaucucaaaauaaagaccuuugucuuacgaccgcaucuccaggccaguggccugggagccagagagagcuuguucucugaugcccagggcccugcucuuccuccccaucaguaggaaacgauggccuuggaggcuuauuuugcucaucacucucgccccacugcuguaaauaacagaauggcccucgcucugcgguuucuagacccuggcacuguuuuucaaacuugacugucauagagaccgcugcuaaaaggaacugucugcacguccgucuggguccauucuccuacucaugaccagugguggaaauuuuagguuguuugaaaaaaugucuuuuaauggcaaauuaacauucaagaagaguaauuagacuuaauaacuggaaggcuuuuuuaguccaucacuuaaaacacaaacguggaaaaugucacagaacucuuggcccauguagcgcaugcaucugucccauuucuauacuuuuaucugaguguuccagguuacacuuguuuuaaauaagagaagaaagagggagaaauuguucauaguagcugcaugguuaacgguguuagcuaguuugaaucagauuucuaaaucagaccaaaaaaaccccaaaaaacaaaaacccagaaaacagacuagauggugcuuuugaauaggaauaauauauaaaccauugaucucaaaacacuaaaaacuaguauaugcucaucagucagugaauuagcuuuuuacucuaaacuuaagaguaaguuuugcuuuacuuuuagaaacuuuuagaaccaaacaugggaacucauguaaucuaaguaacuuaguagugaaacucuauucugcuccccauugggggaaaaaaaagcauaugcuugguagaaagaauguuagaacuugaaaguagaaagaaauguuagaacucgaaucaggcaagguaccaucagggcucagagccacacugguaauucgaauggcggaaauuucauagaauuguuggagagguguuuaggauccuccagagaaacgaacccauagguuagagagagauauauagaaccagauuuauuauagggauuuguuuaugcaaugauggaggccuagaagucccaugaucugcuuucugcaagcuggaggccccggaaaguggugguggaguuccagcccaaacccgaaguccugagagccaggggagccaguggcguaaagucccagugggagacugaaggcccgggaaccaggggcagugacgugugagggcaagagaaauggauccuggcucaugaagagggaaaggggauuugcccuuccucugucuaccucuuuguucucuccaggcucuaaguggauuggaugaugccuaagaggcuuaagagggcggcucuucuuuccuuaguucacugauucaaaugccagugucuuccagaaacacccccacagacaaacccagaaauaauguuuuacuagcuacccaucugggcaucccuucagcagucaaguggacauguaaaacucaccagaggggcugaaaggagauguguacagaggggcagcugcagcaagccgcuggcgcaggagcaugaggaaggagcugagagcagcgcagccugccugcugcugagauucgaccgcagggagcggguguacaugccgcagggacgcaagaccugccagugcuggacagaguggccauccacaaaguccucugaggucagcaggaggggcccugcaugccgacccaccggcugugccaccuggaaaaccacaugcuggagaagaaaaggaaugcuugcagucccuccagcacccucuguuggcaaagccuggcaucaagcgucacccaggauuucagagcagggcagggcgaggucugcaucugagaagcagcaccuucacaccuccuccacgcugcucccagagccaucuuuccaaaaugugaaauucauucuggcaucccccuaccagaggaucuucauggcugucaaacagaaaguguuucaacuuuuuauuuugcaguaguuuuagaguuucgcagcaaaguuguaaaaaugauacagcauucucaaauaccacuccuccaacuuccugaguguuaacaucuucuguaacauuguagcacaguuaccaaaaccgggaaagucuuugggaggagcuaugcaggcuguauucacacugcacguuuucccaugaaugccuuucuucuguuccaggacccagcauugcauucagauccugucucuuuaggcuccuuccuucugcgacgguuccucagucuuuccuucgaugaucuggacacuuucaaagagugccuuuaaguucuuuuguaaaauguuccuaaauucugguuuucugucagguuaguacauuuuuggccagaauuccauagacacaacacuguguccuucuguguuagucuccuugggcagccguaauaaaauacacaaaccaaguggcucaggcaacagacauuuguuuccucacuguuucugagggugcauuccaaggucaaggugcgggcaggaugggauucucccgagggcuuccuucccucagaggcuuguggaugacaucucucugccguguccucacacgcucuuuccucugugcgugcgugcaccggugucuguguguguccaaauuucuucguaugaggacaccagucauguuagauuagggcucacccucuagaucucauguuaacucagucaccccacuaaaggcucuugucuucaaauguggucacauucugagguuauaaugguuagggcuucaauauaggaguuuuaggggacugcagcucagcccauacauuucagugggucgcuuauagaugggguauaugauguugucuaauuacuggugauauuaacuguaaucacuugguuacggggaugucugccaaguuuuuccaccauaaaguaacuacuuuucacuuuguaauuaauacauaucuuggggacgauaacuuugagacugugaaaauagggcauuucuccuugaacuuuuacccaucuuuagcauucauuccauuggccugcagcaguucuguggugcuuaccuaauggugauugucuguuccuuuguuucuuccacauuugcuaauuggaguuguuuugcaaggagaagcuauuccuucucuguauaucauucauucaugucuuuuuuuuuuuuuuuuuuuuuuuuuuuuuggagauaggcucuugcacugucauccaggcuggagugcaguggugugaauguggcucacugcagccucuaccuccugggcucaggcaauccuccugccucagccuccugaguagcugggacuacaggcaugugccaccacaccugacuaauuuuuaauuuuuuucuguagagauagggucuugcuauguugcccgugcuggucuugaacuccuuggggucaagcgauccacuugccuccaccuccuaaaaugcugggauuacaggcaugagccaccgcgccgggcucauuuaugucuuuaugcacuuagauuuuuuuuuaacucuauguauuauaauccaguauucuuauucuguuacucagauugucguagcuuuggucauuggaagcuccugcaguuuggguccuauguccuuucaucauguuuucccaauuucuuauuuucagcuaccacaggacacucagggugcaucuugaauuuucuuugcuccagcucuggagucaggcacuugagggagcacuguuucauuuuauuggcaaacggcauuuagaaaugcacaugcggggcaacacgugcuuguugccguugccucucgaaccucuaggaggacaaagcuuggaagugcaugccuguaucuuagcccacacaaaccugcacaucuauauauggaucucucugcauaugcaguuaaaaaugaguuccuauugaugaauuccauuuccaguuuaacaccauagcauucauucuaaccuucuucuuuuccuuaauuguuaacuccuuucuccagcagugagaaauccauacuccgcugucuguaauacauuuacucauuugcucaacucuaguauaacaucaaaguaguuucaaauuugcuaacccaaaucccucugagaagcagcuuuauuaacuagaacacaugccagugaacuguagcccauggguucaaucuggcccgcuugauguuuuuguaaauaaaguuuuauuggaacacagccccgccuauuuguuuauauaucacgcaugguugcgagagagaccauauggccuccaaagcugaaaagcuuuacugucugacccuuuauggacaugguuugcugacucuuaaaguccaagaauauagauuuuguguacggcucuuuuugucuuuagcuuuauggugucccagucaaaauacuguuuuccaagauugcuuuuucuuuucaccuccuucaaugugguuauuuuauucauuuguaauugaguuagauuaauuuguuacugcuuggauuccauuuuuuuguuccccauacacacauccugguugauugucauuguguguuuuggaugugugaaauauugauguggcuuccaagcgugagagcugugcaccaggguauacacucagaaaagccuccucguuccagcuuucccauucccauucuguacgcccuccacuccuuuucuacccacccucugugggugaccagucucuuuaguuucuaguuugucuuucauguauguuuugugcaaaucaacagauacauauguauuuuauugcauuaucuuucuuaaaaaaaagagcagguaguaugguauaagauacucuucugcacuugacuuuuuucacuuaucaauaugucuuggaaauca

SEQ ID NO: 17256 - RNA, 1295 nt, Homo sapiens
uaauugucuaaaaugacauuuucuucaagaguuaucuacaguuuaaagcucacuuuuaugaagugucacauccaucaccauuuuaagagacauaaaaucaugaaaagauaucaccagaagcuacguaaacauuucagcuaaggguaaagagaaaguuaagaguguuuucacaaggaaauugaaagaaggcaauccgaaugaagucaacuuggucacacaaaaaucuugguaaaagaacuagaauggaagcccaaacugcugagcaagugggagaagaaaagaaaacuugguucaaacagaucacacaagggaacccaggacaaaugcugacuuuggcauuaucuagguaacccuuuuuuuugucauaggugacucuaauaauagaccuguuguugcaaaaccagucaaaauccuaccaaauuaaaaagaagucccucauugacuuguuggguguaggugguaccccauguccucgcacaccaaaagagaucauuucuggcaagaaagcuccuacaugccuugauggugcugcugguaggaugccuuaggccaggcccaucccagcgauguucugcuggcugugguaaaaggugggaggagaauaugccuuauucauuacucaaucaacuucuuagccuugaagaagcaucacagguagaagaccugccagguggcuaguccagugaggcagaacauugaaaagaugcugaaguguaggacccaaguguuuguugacucacugguaucaccaucuccucuucucucuucuucauguaggcaaaaucauuaacaauagauucugaaaggucuucuaggugucgcagcuucaccucuaaugguuugagcuucucaacuuuugcaaucucucuguaauuuuucaccuccacuccaugcuucaugucuaggaucacaaguuggucagguaucugcccuguuuccuugcucucaaaacacacuucaaacaugucauaaucuucagugguaaaggcaaauuuccccuugguuguauucuuuuuggaguagaaaauauggccagcagaaucugugaucuugagguggcugcacaggccaccagugcccccagacuggucagagaucucguaugugccagucacuaguagguccuuguggaucuccucauggaagcaguugugagaauuaauggacagauggaaggagauggcgaggaccaagcuggggcccagcaggaacaaaagcagcaacgccgauggacaagggccaugccgggcuggugggccagacaaaccagacauggugcuggagacucauucccc

SEQ ID NO: 17257 - RNA, 1295 nt, Homo sapiens
ggggaaugagucuccagcaccaugucugguuugucuggcccaccagcccggcauggcccuuguccaucggcguugcugcuuuuguuccugcugggccccagcuugguccucgccaucuccuuccaucuguccauuaauucucacaacugcuuccaugaggagauccacaaggaccuacuagugacuggcacauacgagaucucugaccagucugggggcacugguggccugugcagccaccucaagaucacagauucugcuggccauauuuucuacuccaaaaagaauacaaccaaggggaaauuugccuuuaccacugaagauuaugacauguuugaaguguguuuugagagcaaggaaacagggcagauaccugaccaacuugugauccuagacaugaagcauggaguggaggugaaaaauuacagagagauugcaaaaguugagaagcucaaaccauuagaggugaagcugcgacaccuagaagaccuuucagaaucuauuguuaaugauuuugccuacaugaagaagagagaagaggagauggugauaccagugagucaacaaacacuuggguccuacacuucagcaucuuuucaauguucugccucacuggacuagccaccuggcaggucuucuaccugugaugcuucuucaaggcuaagaaguugauugaguaaugaauaaggcauauucuccucccaccuuuuaccacagccagcagaacaucgcugggaugggccuggccuaaggcauccuaccagcagcaccaucaaggcauguaggagcuuucuugccagaaaugaucucuuuuggugugcgaggacaugggguaccaccuacacccaacaagucaaugagggacuucuuuuuaauuugguaggauuuugacugguuuugcaacaacaggucuauuauuagagucaccuaugacaaaaaaaaggguuaccuagauaaugccaaagucagcauuuguccuggguucccuugugugaucuguuugaaccaaguuuucuuuucuucucccacuugcucagcaguuugggcuuccauucuaguucuuuuaccaagauuuuugugugaccaaguugacuucauucggauugccuucuuucaauuuccuugugaaaacacucuuaacuuucucuuuacccuuagcugaaauguuuacguagcuucuggugauaucuuuucaugauuuuaugucucuuaaaauggugauggaugugacacuucauaaaagugagcuuuaaacuguagauaacucuugaagaaaaugucauuuuagacaauua

SEQ ID NO: 17258 - RNA, 8960 nt, Homo sapiens
ccccauuucaaacaauaacuuuuauuuuauacuucucuauacuuuguagcaaaucuuuuuuugcugaauuuaauuuauaauaaacuuuuuaaauuacaucucucucucuuuuuuuuuuaaaaucaaggcucuuuuaugucaaaaucuuuuuuuagcuauauuuuagauuaacauuuaacaucccccccuugugaucuauaccguuggauauucagguauuacuguguguguaacagcuaaaacaagagggaggagggaaaauaaaggcagugaacuuggacggaugcaucaacaacagcagauaaagcuaaccccucagugaccauagcagcaugucuucuggaagccuuuacucuuaccccagagauuuccucagccccuucccucucucccuccuauccuccaaacacaaagccaacagucuguccuuucgcuuuucuugaggagaaaugugcaguggaaaugaucaaaacaagauacuguggaagaacgacgugagcgugaauuauucaccguauguuucguccguggacaucucucuugaauucauuccccuggccuucuccucuccucgccuuccuauuaggaggagcccaucauuuuucauguuacuagcaugauuaauauaguagguggcccagggccguuccugagauucuuuugccaacaaaaaaaauuaauaauaauaaaauuaaaaaaugggguggguuugccguuuucuuauuugugugugaagacggacuaaagcugagguccgauuuuggcugugcuugcuugcucacugauugguaacauuuggcaaauaaaacacaagaaaucaaacgaaauaaaaaagagaaucaggauuucccacaauccuauaugaguguuuucagcaucacagagaaucacaacguccccaaagaacuaauggaucuuccucucgauuuccgggagcauggagugagugugggugggcgcgcggggggagcuggccccacgcucagaaggaaagccaggucgcuaaagcugccgagagagacaccaggagcaccgggaacgccgggagcagggaccccgccgccccguugccgcugccgcagaguucgaauaagcugccuuggauguugagguuuuuggauucuuuucucaguuuaucccacauaucuuucgccccuuccuggcaauccguaagggcugugaccgugcagcuguggaaauccucccaguaucuggugaggaacagaacaaaacagaacaagcagguucacuugggacgccgggaacaccccgggcuugcgccccugcgccuccccgcuggcggccccgccaacuucccgggguguccccucccuaccuucucuucaccgcccuggcgccuggccugcgcgaggucgggacucgcgggaccuccgccuaccccagaagcggcugucuaaagcgggggugggggggcgcccccuccugucugguuuucccuuccaguugccgggagaggacuaggcagccgggagccgggccgugcacccgcuguggcgcgcuggcaccucggccuccgcaaacagauugcucgcccuccucggggaaagcuaggaaaacagugcuaagccucgcaagcugccgcccauuaaugccucuuagcuugcaagauggguuacuagcucugagcacggcccuccccucggggcuucuuacauucuccucccccucgccccuucugucucccuccuucuccacgccgcgguacucucgccuucgcccucauucucucccuccaccuacuaccucuuccuuuuguuuuccguucuccugaauuucccuuucuuucuuuuuccguuccgucugcuuuccucucuucuguuccccacuuccucuuccuccuucccacaaccugccuggauccuccuugcucuccacaguucccggcucagauucggccuggagacuccugccugccucucuucuccccggggucggugaguguuaguggccgagcaccuggggccggccucguagccuucaucugcucuugcgaauccaagugucccaggccugcgcguugggucccuccuguuucucccuccccagucuuuuccgugggcuugggccccauggggcuuccuccccacagcuuucaggauguagcgccagccuccaaggccggaacugcggggaaggcguggugcccaccucugccaaccuucgaggacuccccacccucuguccuccucuugcggucaguucacggagccuggcgccuaacucaaccacuuccuccucccaggcucagcuccuagacccacccccacaaccuucauccaaccugucccuuuugacugucccccuuucuucugaaaacccaaaauagauccugagacuaaauauaaucccaacccgugaucgauuccuggggcgcugucuccuuucagagcugggucggucugcgccucucuguaacuccgggcugguccccaccugccccgggccuugagcaccaggucacaggcaccugccuucuacaugguuugguuguauuuucuccucucucuuccuucugcuggcuggccuggacuguaagcacauugaaggcaggcacuguguuaauuuaugaguacuggagggacacagagcuuccagguuccucaacuuguaauaaacagcaacauuuggacauuaggaggcccagggaggacagcuuuccugcagacugucuguggaauugccccugcuaaaggaugccuaaauugcucuuuuuuuuuuuuuuuuuuuuuuuuuuauguacgcccagaugagggcagaguucugagggaccugguagagaaggauagacuccaccuggggcugggcagaagugggcuucagcuccguguugagcaaacagcucccccaaaugaguagggccuggaccuagccguggccugugaccucaggaaggaguucucacuuuccuguuuuccaagacugaaguucugcuuaaaauuaaaauagcuuggaauaaacaaguuccaccaaaugacagaggauuugggagcugcucuauaugcaaccuuuuguuauccuuauagauauacauucuuauccaucacgagacuuuuagaauuaaaugacuuugucccuuucaugauaggaaagcacuagccauuuagcugcuauggcuccuaguaggcacuggggcguuuaggaaauagaguagcaaaauugacaccauuuaauuuagcaaaaccuaaacaaacacccguccuuccaccaguccccuuugccccaguuggggagugaggaaagacuucacaguauacaaaugaugccacagaaaauggucacucuaaccucagggaauaaggggcacaaccugccuuggcuguuuugaaacaguuauuuugggggugggggaacacagcuguuuuuugcaaaauaaaagaauggguguugcagaggacagggguguuuucuaaggucugcagcagcuagauugcugcagguccacugcaguagggcucugcugguuaccuuauugcucgugggagcagugcuuucuagccaagcucugagaaaucaccacuggaccuggcuaugaacuacuacccaucucucuuuaccuuugaagcuguccaggucuggggacgccuuacagaugugcgagggggcaagggaaacaaggagagugccuauuccaaaucucggaaucugcuguaaacucaaagcgacuaucacuggaccaccaccuggacucacucuuuuuggguaaagucacuggcacacaauaagauagcguuucggccugucuccuagaaaacaggaagggagaccuguaucuccuugccugugccggcauuuccuugguguguauuagaggggcguuuugucacgagaaauggacagaagagaggagugacuuucccuuuaggcaaauguaguauuaccccaaacacuccucaaauccaaacuaacuguucuucagagaacaccuggcaggucacucguucacgcaagagcaaagaaugaucaagauugcuacaaggcagagagaucuugcagcaccaagauuuuguagcaauccuucaugccccuugcccuggcucccagcaugucgagcaugcgcaccucugugcaagccugagaggccgcguagagcugggacugggucuauauugaaggauccuccuccauaucccaccccgggcugugggauccccuugggaagcgcagguucuaacccgggggccugguccuaggccuggggguuggagccagaaggcaagagugagccgaugcggauucgcgcuggcgcugaacgcugagcgcaggcggggaggcucggcacucuccgaccucaguagcgcccccaaaaccgaaguccagccggccagagaggacacuuacgugcacacggucuugauguucgucuugucguccaggcccugcggguaguuggccaugcugucgcccagcuugagcaaacaguccgaaaagcccuugaagaccgcaucgcacuugcccgcugcucucacggccugcaccagauacgcugcggggaggagggaacaccggucagcagcgccacgaccccgcccugccgcccacugcccuuuccugcgagacccuggcuccgcgcggccucaucgcaucgggcggccucucccagcgcccagccucggggcucgccaguguuaaaggugaaugaaagacgugacccaggaaugcccgaccugcagcuaacgcugcgucuagugcaaauugucggugugugagcaggugugggugggugggagguaggugaguccauuccuuuccuccagcucccucccgcaucucgcuccguaucuuuuucuguuuccaucgcccccucuucucaccucccucaucccuuuuauuucucuuucuccucgcucccuccuucgucucccaacacuuccccagcaagcccugucacagcucucgcaaugcgaucuuccauuuugaggugacagaaggggucucggcugcagcgugcgggggcgagaacgggguggggagacgacagggcguggggucacgcagcugaacccaacgccacaucacgagaauaagccucaggcuuggcgcucuguccuuggugggcgcucagcaaacacugcugaaugaaugaacgaauauagucccuggaagccaccagcaguuaccgaaauggauuguuucauuauaaaaccgauugccuaccguggacucuguauuccgagugagacccucggaugcacccucucccgccccgcuggaaagagggcagccuggacguccugagaccuggcgcggaugaugaguggucuggagaggagaaggccagaggccgggcggggucacggaugagucugccugggucaccuccgcaaaggccaaauccacgaaccucgggccucuuucucuccuccuccccuguccgccacucggcuccccagacacccuuaacaacccacccgcccgccaaaaagcccgccuacacuccggacggcagcggggagaggcuguucuucuccaggugccagcccugcugcugaaagugagcucgccgcggcccggggcuccuggccccagcucaggacucccugcagagagcaggcagggauaaaagcugagcggcgggaggaggaggaggaggaggaaacacaggccgcacgaagguccaagccccaagcccccaagcccccggccucuggacggccaaaccccgaggcgcgggacuggaaggacagguaccaggcugcgggcgcgcggcuguggccaucucuuuccgcccugaggccgacgaacccggcuggaagcugagugccuagcggcccaaagcagcccgggcgccgggagggcgccagagaagcacagcguuagggcggggaagaaagggugaaucucagaaucgaaauccgcacuggcgcccacgacccugggcgccggccugguccucggcagcuuucuggcggcugcgcuugugugugaaugugucccgggaggaccggacaccucaaucccccggcccccaacgcgggcgccuguccgcgagcgccgggccagacgccgaagaggaaggugaccgaacccguagcagcuuccgagagcguacccguuugcaaauugcugcaggaagagcgaggcgggccuugcgcuuuuuaauccggaacgggaagcacuggggaagggaccgagguuaacuucgaccuccgcuggggcagauacguaaaccuucucaaaccuccgaguucaccuuacagcgaacauuaaauacccuugcgacuacaauacuaacaaaucgaacacugacguaaaaucuuaagaauaaacgaaucuuuguucugauagagcucguucaaaauggaaauacacuccacacaucuuccucuauaacgcaugucacaaauacagcuuugcagagaagaaacgaaauaaaauaaaguccaaucuccccguccacgucucuccccaccccuugccuacacccccaaaacucaguggcgaaagaagccccuaaaaugcauugacauuuuuuaaggggaauuggggcucgccgggggcgggagcgcucuugucacguuaucuucccaggcgcugcuggagaagacccugcacaccgcgcaugugugagugugugcuguguaaaauaagucgugaacauuucugucuuuuaaaacugugacuccuuggacucuagccuucucugggaggccgggaggcugcgcgcgggacggauuuugcaggcgcacgcgucccagcaggucgcagcccgugggucccucgcuguccuuccugaaccccgcuuaggcgagacucuagcgggugacccuggcuccuucccuguccucucugccguccccuucuugugcgguuuccauccguucauucauucguucgaccucucauucauuccgaacuuccuccugcugcgucuucuuucguguucaccacacucuucuaccuccccgccccucccaacccccacuuuucuugccaaaugucaaugauuugggacagcucccagccgugaauuaauaaagaccgagguucuguugcaggaaagggcagacauuagggaacaaauacguucaauuucaauuccacagucaacaaauagucauuuuuggaccgagguuaauguguucaaaacgcgucccucaggcacgaccaccgucuuuuuuuucccuccaaaccucucaaaguaagguuauuuccuaccgggaaaacagagucccaaaucuuguccgauuaaaauuucuaucucaaaaacaacucucucuccugcucucuaaaaauucaaagguuuauugcaaaaugccacauucacuuauuuccaacauuuaaggaauuugcugccauuagaaauauuauuuacagcagcucuuuucacuaaugucaaagauucaaaacaaccagauuuaaagcauugucauuuuuuggaacuaaaggaaaacaccaauauccugcacucacacacucuaaaaucuuuauaauguuucugcauuauaaaaucucaaaaucaugucaguugcauaaaaccccacugcaaagaauccauuuuaaggucuagagaacuccaaaccuuguuuccuucacauuucuuauggaaaaaacauauuaugcauucuccuuucuugccccaaaccaauuaccuaaagcacccccucccccaauacugcaaggauuugucugcaaagaaugccacagccugaacugauaggagguaacaauuccguuucaggaguuucuuuuuucccccguguuguccauucuauuaauaaccugcuucacuuucacuuuuaggccacguuaauuaauguucugacccagugucggagaaggggguuuucuagugcccucuucuauaucuuuucuucauucuggaugguaaaaaugugaacuuuaaaaagaccccugacagcguaacuacaacucaacauuccuuaacauaaaauggggacuaaauaauuccuuccauaaccaaucccaaacaaacaaaaauaacaaacacccgacaugacauauuccaaacacuucuuaacccuuuccuauauauaaaaugcagacaccaauguguaaaguagcaggcaaaugcaucuagaaaaguauaucuacguaaauuuggcugaauucauccucuucaaugguaagcauguuaaaauauguggucugaaguucccuaucacucucgauuugcccaccagccgggucugcggugcccgugcaaacgcugcagcuaggauauaggggggaggaggggcgggagaaugacaaaguucuaaaugcagcagucugagcccuggaauaucuuugcuuucagcacauaaacuuuccaguccuggcugccuagccauuuuauuccugcauucacauuucgacucuucaaaaucauaucuugcaguaucgcaggggccaguacauugccccagagcgcaccaaaccugguauaaacccagaaagggaaacaaaaauggaugugugcucaggaaaaagggggaaaaaaaccguguccagaaaauguccggccgcacacauuuccuggcgaacauuuggaaucuauagcuuuaggaaaaaccgaucugggacgcgcuaguccccaggaacugaugcccccacccucgggggauugccggcuucuccgcacccuggggcggccgcggacccgcuagucccccuccgcgccucgggccggggcaggcugccucccgccuccagccuccagccgggcugagcggccacuuaccuauuugcaccgcgaggaucagugaaauauaucugccguucaacuuaagucccauccuacguuuagucaaaccauuugcgaccgcagaccuuuaaauaguuaguuuagagaacgcgggggaaagccaaaaaauaggcauugccaacaaguuccgggagcgacagagacuuuaugcacugggaaggcagagggaggagagaaagagagggagcgaggaagagacagaaagagagagagagagagaaagagagagagagag

SEQ ID NO: 17259 - RNA, 8960 nt, Homo sapiens
cucucucucucucuuucucucucucucucucuuucugucucuuccucgcucccucucuuucucuccucccucugccuucccagugcauaaagucucugucgcucccggaacuuguuggcaaugccuauuuuuuggcuuucccccgcguucucuaaacuaacuauuuaaaggucugcggucgcaaaugguuugacuaaacguaggaugggacuuaaguugaacggcagauauauuucacugauccucgcggugcaaauagguaaguggccgcucagcccggcuggaggcuggaggcgggaggcagccugccccggcccgaggcgcggagggggacuagcggguccgcggccgccccagggugcggagaagccggcaaucccccgagggugggggcaucaguuccuggggacuagcgcgucccagaucgguuuuuccuaaagcuauagauuccaaauguucgccaggaaaugugugcggccggacauuuucuggacacgguuuuuuucccccuuuuuccugagcacacauccauuuuuguuucccuuucuggguuuauaccagguuuggugcgcucuggggcaauguacuggccccugcgauacugcaagauaugauuuugaagagucgaaaugugaaugcaggaauaaaauggcuaggcagccaggacuggaaaguuuaugugcugaaagcaaagauauuccagggcucagacugcugcauuuagaacuuugucauucucccgccccuccuccccccuauauccuagcugcagcguuugcacgggcaccgcagacccggcuggugggcaaaucgagagugauagggaacuucagaccacauauuuuaacaugcuuaccauugaagaggaugaauucagccaaauuuacguagauauacuuuucuagaugcauuugccugcuacuuuacacauuggugucugcauuuuauauauaggaaaggguuaagaaguguuuggaauaugucaugucggguguuuguuauuuuuguuuguuugggauugguuauggaaggaauuauuuaguccccauuuuauguuaaggaauguugaguuguaguuacgcugucaggggucuuuuuaaaguucacauuuuuaccauccagaaugaagaaaagauauagaagagggcacuagaaaacccccuucuccgacacugggucagaacauuaauuaacguggccuaaaagugaaagugaagcagguuauuaauagaauggacaacacgggggaaaaaagaaacuccugaaacggaauuguuaccuccuaucaguucaggcuguggcauucuuugcagacaaauccuugcaguauugggggagggggugcuuuagguaauugguuuggggcaagaaaggagaaugcauaauauguuuuuuccauaagaaaugugaaggaaacaagguuuggaguucucuagaccuuaaaauggauucuuugcagugggguuuuaugcaacugacaugauuuugagauuuuauaaugcagaaacauuauaaagauuuuagagugugugagugcaggauauugguguuuuccuuuaguuccaaaaaaugacaaugcuuuaaaucugguuguuuugaaucuuugacauuagugaaaagagcugcuguaaauaauauuucuaauggcagcaaauuccuuaaauguuggaaauaagugaauguggcauuuugcaauaaaccuuugaauuuuuagagagcaggagagagaguuguuuuugagauagaaauuuuaaucggacaagauuugggacucuguuuucccgguaggaaauaaccuuacuuugagagguuuggagggaaaaaaaagacgguggucgugccugagggacgcguuuugaacacauuaaccucgguccaaaaaugacuauuuguugacuguggaauugaaauugaacguauuuguucccuaaugucugcccuuuccugcaacagaaccucggucuuuauuaauucacggcugggagcugucccaaaucauugacauuuggcaagaaaaguggggguugggaggggcggggagguagaagaguguggugaacacgaaagaagacgcagcaggaggaaguucggaaugaaugagaggucgaacgaaugaaugaacggauggaaaccgcacaagaaggggacggcagagaggacagggaaggagccagggucacccgcuagagucucgccuaagcgggguucaggaaggacagcgagggacccacgggcugcgaccugcugggacgcgugcgccugcaaaauccgucccgcgcgcagccucccggccucccagagaaggcuagaguccaaggagucacaguuuuaaaagacagaaauguucacgacuuauuuuacacagcacacacucacacaugcgcggugugcagggucuucuccagcagcgccugggaagauaacgugacaagagcgcucccgcccccggcgagccccaauuccccuuaaaaaaugucaaugcauuuuaggggcuucuuucgccacugaguuuuggggguguaggcaagggguggggagagacguggacggggagauuggacuuuauuuuauuucguuucuucucugcaaagcuguauuugugacaugcguuauagaggaagauguguggaguguauuuccauuuugaacgagcucuaucagaacaaagauucguuuauucuuaagauuuuacgucaguguucgauuuguuaguauuguagucgcaaggguauuuaauguucgcuguaaggugaacucggagguuugagaagguuuacguaucugccccagcggaggucgaaguuaaccucggucccuuccccagugcuucccguuccggauuaaaaagcgcaaggcccgccucgcucuuccugcagcaauuugcaaacggguacgcucucggaagcugcuacggguucggucaccuuccucuucggcgucuggcccggcgcucgcggacaggcgcccgcguugggggccgggggauugagguguccgguccucccgggacacauucacacacaagcgcagccgccagaaagcugccgaggaccaggccggcgcccagggucgugggcgccagugcggauuucgauucugagauucacccuuucuuccccgcccuaacgcugugcuucucuggcgcccucccggcgcccgggcugcuuugggccgcuaggcacucagcuuccagccggguucgucggccucagggcggaaagagauggccacagccgcgcgcccgcagccugguaccuguccuuccagucccgcgccucgggguuuggccguccagaggccgggggcuugggggcuuggggcuuggaccuucgugcggccuguguuuccuccuccuccuccuccucccgccgcucagcuuuuaucccugccugcucucugcagggaguccugagcuggggccaggagccccgggccgcggcgagcucacuuucagcagcagggcuggcaccuggagaagaacagccucuccccgcugccguccggaguguaggcgggcuuuuuggcgggcggguggguuguuaagggugucuggggagccgaguggcggacaggggaggaggagagaaagaggcccgagguucguggauuuggccuuugcggaggugacccaggcagacucauccgugaccccgcccggccucuggccuucuccucuccagaccacucaucauccgcgccaggucucaggacguccaggcugcccucuuuccagcggggcgggagagggugcauccgagggucucacucggaauacagaguccacgguaggcaaucgguuuuauaaugaaacaauccauuucgguaacugcugguggcuuccagggacuauauucguucauucauucagcaguguuugcugagcgcccaccaaggacagagcgccaagccugaggcuuauucucgugauguggcguuggguucagcugcgugaccccacgcccugucgucuccccaccccguucucgcccccgcacgcugcagccgagaccccuucugucaccucaaaauggaagaucgcauugcgagagcugugacagggcuugcuggggaaguguugggagacgaaggagggagcgaggagaaagagaaauaaaagggaugagggaggugagaagagggggcgauggaaacagaaaaagauacggagcgagaugcgggagggagcuggaggaaaggaauggacucaccuaccucccacccacccacaccugcucacacaccgacaauuugcacuagacgcagcguuagcugcaggucgggcauuccugggucacgucuuucauucaccuuuaacacuggcgagccccgaggcugggcgcugggagaggccgcccgaugcgaugaggccgcgcggagccagggucucgcaggaaagggcagugggcggcagggcggggucguggcgcugcugaccgguguucccuccuccccgcagcguaucuggugcaggccgugagagcagcgggcaagugcgaugcggucuucaagggcuuuucggacuguuugcucaagcugggcgacagcauggccaacuacccgcagggccuggacgacaagacgaacaucaagaccgugugcacguaaguguccucucuggccggcuggacuucgguuuugggggcgcuacugaggucggagagugccgagccuccccgccugcgcucagcguucagcgccagcgcgaauccgcaucggcucacucuugccuucuggcuccaacccccaggccuaggaccaggcccccggguuagaaccugcgcuucccaaggggaucccacagcccggggugggauauggaggaggauccuucaauauagacccagucccagcucuacgcggccucucaggcuugcacagaggugcgcaugcucgacaugcugggagccagggcaaggggcaugaaggauugcuacaaaaucuuggugcugcaagaucucucugccuuguagcaaucuugaucauucuuugcucuugcgugaacgagugaccugccagguguucucugaagaacaguuaguuuggauuugaggaguguuugggguaauacuacauuugccuaaagggaaagucacuccucucuucuguccauuucucgugacaaaacgccccucuaauacacaccaaggaaaugccggcacaggcaaggagauacaggucucccuuccuguuuucuaggagacaggccgaaacgcuaucuuauugugugccagugacuuuacccaaaaagagugaguccagguggugguccagugauagucgcuuugaguuuacagcagauuccgagauuuggaauaggcacucuccuuguuucccuugcccccucgcacaucuguaaggcguccccagaccuggacagcuucaaagguaaagagagauggguaguaguucauagccagguccaguggugauuucucagagcuuggcuagaaagcacugcucccacgagcaauaagguaaccagcagagcccuacugcaguggaccugcagcaaucuagcugcugcagaccuuagaaaacaccccuguccucugcaacacccauucuuuuauuuugcaaaaaacagcuguguucccccacccccaaaauaacuguuucaaaacagccaaggcagguugugccccuuauucccugagguuagagugaccauuuucuguggcaucauuuguauacugugaagucuuuccucacuccccaacuggggcaaaggggacugguggaaggacggguguuuguuuagguuuugcuaaauuaaauggugucaauuuugcuacucuauuuccuaaacgccccagugccuacuaggagccauagcagcuaaauggcuagugcuuuccuaucaugaaagggacaaagucauuuaauucuaaaagucucgugauggauaagaauguauaucuauaaggauaacaaaagguugcauauagagcagcucccaaauccucugucauuugguggaacuuguuuauuccaagcuauuuuaauuuuaagcagaacuucagucuuggaaaacaggaaagugagaacuccuuccugaggucacaggccacggcuagguccaggcccuacucauuugggggagcuguuugcucaacacggagcugaagcccacuucugcccagccccagguggagucuauccuucucuaccaggucccucagaacucugcccucaucugggcguacauaaaaaaaaaaaaaaaaaaaaaaaaaagagcaauuuaggcauccuuuagcaggggcaauuccacagacagucugcaggaaagcuguccucccugggccuccuaauguccaaauguugcuguuuauuacaaguugaggaaccuggaagcucugugucccuccaguacucauaaauuaacacagugccugccuucaaugugcuuacaguccaggccagccagcagaaggaagagagaggagaaaauacaaccaaaccauguagaaggcaggugccugugaccuggugcucaaggcccggggcagguggggaccagcccggaguuacagagaggcgcagaccgacccagcucugaaaggagacagcgccccaggaaucgaucacggguugggauuauauuuagucucaggaucuauuuuggguuuucagaagaaagggggacagucaaaagggacagguuggaugaagguugugggggugggucuaggagcugagccugggaggaggaagugguugaguuaggcgccaggcuccgugaacugaccgcaagaggaggacagaggguggggaguccucgaagguuggcagaggugggcaccacgccuuccccgcaguuccggccuuggaggcuggcgcuacauccugaaagcuguggggaggaagccccauggggcccaagcccacggaaaagacuggggagggagaaacaggagggacccaacgcgcaggccugggacacuuggauucgcaagagcagaugaaggcuacgaggccggccccaggugcucggccacuaacacucaccgaccccggggagaagagaggcaggcaggagucuccaggccgaaucugagccgggaacuguggagagcaaggaggauccaggcagguugugggaaggaggaagaggaaguggggaacagaagagaggaaagcagacggaacggaaaaagaaagaaagggaaauucaggagaacggaaaacaaaaggaagagguaguagguggagggagagaaugagggcgaaggcgagaguaccgcggcguggagaaggagggagacagaaggggcgagggggaggagaauguaagaagccccgaggggagggccgugcucagagcuaguaacccaucuugcaagcuaagaggcauuaaugggcggcagcuugcgaggcuuagcacuguuuuccuagcuuuccccgaggagggcgagcaaucuguuugcggaggccgaggugccagcgcgccacagcgggugcacggcccggcucccggcugccuaguccucucccggcaacuggaagggaaaaccagacaggagggggcgcccccccacccccgcuuuagacagccgcuucugggguaggcggaggucccgcgagucccgaccucgcgcaggccaggcgccagggcggugaagagaagguagggaggggacaccccgggaaguuggcggggccgccagcggggaggcgcaggggcgcaagcccgggguguucccggcgucccaagugaaccugcuuguucuguuuuguucuguuccucaccagauacugggaggauuuccacagcugcacggucacagcccuuacggauugccaggaaggggcgaaagauaugugggauaaacugagaaaagaauccaaaaaccucaacauccaaggcagcuuauucgaacucugcggcagcggcaacggggcggcggggucccugcucccggcguucccggugcuccuggugucucucucggcagcuuuagcgaccuggcuuuccuucugagcguggggccagcuccccccgcgcgcccacccacacucacuccaugcucccggaaaucgagaggaagauccauuaguucuuuggggacguugugauucucugugaugcugaaaacacucauauaggauugugggaaauccugauucucuuuuuuauuucguuugauuucuuguguuuuauuugccaaauguuaccaaucagugagcaagcaagcacagccaaaaucggaccucagcuuuaguccgucuucacacacaaauaagaaaacggcaaacccaccccauuuuuuaauuuuauuauuauuaauuuuuuuuguuggcaaaagaaucucaggaacggcccugggccaccuacuauauuaaucaugcuaguaacaugaaaaaugaugggcuccuccuaauaggaaggcgaggagaggagaaggccaggggaaugaauucaagagagauguccacggacgaaacauacggugaauaauucacgcucacgucguucuuccacaguaucuuguuuugaucauuuccacugcacauuucuccucaagaaaagcgaaaggacagacuguuggcuuuguguuuggaggauaggagggagagagggaaggggcugaggaaaucucugggguaagaguaaaggcuuccagaagacaugcugcuauggucacugagggguuagcuuuaucugcuguuguugaugcauccguccaaguucacugccuuuauuuucccuccucccucuuguuuuagcuguuacacacacaguaauaccugaauauccaacgguauagaucacaagggggggauguuaaauguuaaucuaaaauauagcuaaaaaaagauuuugacauaaaagagccuugauuuuaaaaaaaaaagagagagagauguaauuuaaaaaguuuauuauaaauuaaauucagcaaaaaaagauuugcuacaaaguauagagaaguauaaaauaaaaguuauuguuugaaaugggg

SEQ ID NO: 17260 - RNA, 1237 nt, Homo sapiens
uuggagugucccucuuuauuuaaaaaggagaggauuccacagcagagcuucucaaacucuuccacccaaauccccucaccacagagggacaggaguccugggcauguagccuaaagcagccaggagaaaaaaaccuugaccuuaauuuuuuuaaugauuucacaugaaucaguggaauguguuuaugauaaaaucaucuccuccugaaauacauguguaaaacugcugccccaguuaaacgcacuuagucuaaccaagcccuaggauuggccucuccagcaugagaagcauuuccagcacuccagcuccccagcucccacucugggaucccaccucagacccucccacuuccuugcacucuggccucucgcucuugacccugcucccgccacgcucuuuccucagaguccaucaguccugucuugucuucaccuuggucucugccaaguguggguccaagucauauauuugggcugugaucacaggaaccccaagccccagaccucccaaagcacccuauggagagaccuuacccuccuggacagacccucuccccccagcuagaccucauccucuggguagacccaucuccccaaccagaacucacccuccugaguaaaccccaucccccuagcuagacuucauccuccuggacagaucccauccccccagcuagaccucacccucuuggguagaugcaucuccccaaccagaacucuccuggguagaccccuucuacccagcuagaccugauccucuggacagaccccaucaucccagcuagacuucucccuccuggacuguccccauccccccuccagccagaccucaccccucuggguagaccccauccccccaacuagaccucacccuccuggauggacucuacccuccuggagauaccuuccccuccuggguacaucccacguggcuacacacuccuuccccugucagcuuucucccccaggguucugggcagcagagucugugauaaaggauacuaagugauuccccaauacuucccguuuccagccuccagugggcucucccuggggcuaacgguucuuuuugcuauuucuccaggcuuugccugaugacaaguauacucugagaguguccuaaugauacagauuuuggacccuaucccaguucuacugaauccaagucucugggggaggaguuggggcucugcaucuggacaccuuccugcagggucccuccugggaggcaagcccgg

SEQ ID NO: 17261 - RNA, 29904 nt, Homo sapiens
auauucugcugacagcagcucucuccuuccuuuggccugaaaucgcggggugcuugugugagcugagauuagccgaggcugaccugccccuccguggcuucccgcuggccucaucguuacuucguguguucaccgccgcucugagcagagcgggccccuggggaaaggggugcgggccuggguugcggaggcgcaggagccucgcgggauuggggcgagccgucccauggcgggaaggcaggaggccggacucggaaggcucucccagacucggucccucgcuccagcccuucccugccggugcgcggagccggggcucgggcggguagcggucgcgcgccggcgcgggcgggcggggagaggaaggggcgcggccucuccggggcggggcgcggggcgggcgcugcgaggggaccggaggccgcggcgagagcgcgcccagccccgccgcgaugcccgcgcgcccaggacgccuccucccgcugcuggcccggccggcggcccugacugcgcugcugcugcugcugcugggccauggcggcggcgggcgcuggggcgcccgggcccaggaggcggcggcggcggcggcggacgggccccccgcggcagacggcgaggacggacaggacccgcacagcaagcaccuguacacggccgacauguucacgcacgggauccagagcgccgcgcacuucgucauguucuucgcgcccugguaacgccgcgcaggccggcgcccugccccgcacuuggcgcuucgcggggcguggggcgcuugggcgccgcgggcggggggucccggggccacguggacgccgacggcucuggucugcggcgugcgugcuacgggcgcggggcucggggcucaggggugcgggguguaauacugggggcgcggggccgggagcgcggggacccugcggguucggggcuccggcuggcggggagcggggggcgcgggcgccgcggcucggggccgggagccggggacugcaggggaccgagggcuuggggcuccgggucgggaggcgugagcucagcgggccgggcacuggcggcugacguggcgcucggcggccggggcggugcgggaggagggggcggaccccuaggggacagccgggaaaagcccgcccugcgccgcgcuccugaauucaaccgccucuugcaccucggcaccgagggaggggaagguggggucgucgcccuuucgggcagccgggaguccaaaugucaccccgcggucccugcccagcgccccaaacuuccugugccggccggacgcgcggccugcccgugggccacgugcacucaccagagcggccuugcugcugccgcggccaccggggucggcugggacagacugcgggcacguccccuuccagaggcuuuaacugaaaaauagaacccaggaaggugugguuucccacuuugugcgucuuuugugggauaggaaggagugguccgggcagaggaggguugcugagcuaccccgggaagaccaagguagugcgaauucuggaaccccuccgccccccugcagcucaggguggauguaaucucugaacggagcccacugguccucaacuccaggcuguccugucaccucccugcugcucucucggguccaggucacuuguuaugugugagaucggaaaagccccuccguugagcagauggucccucuugcuuugguucucugggcgaggcuuuggugugggccucgcugcugaccugagagacccuacccuggcacucaucccacggaagagcuuccugucauucacacaagcaugugcacagcuuuccugccagugccgggaugccccgaggaagggaagugaccacaggccagagcagaaagccauaauuuuaggacacaagaccuuugagagguuggaauagccugcagguucuuguugcagaacuugguauucuuccccagagcucaguagaggcucacuugggaaagggauguagggaggcauagagaaaagguacccuaagaaaaauggccaguucagaaauuguaccuuucaaacugggagaaacguuuuucucuuaaccuuguauucaggcuauuacugcguuucaguucauuuggaguuaaaucaacuuuuagggccacuguggguuuauuaacaauguguauaugaaguacauuauguuucacauuccuaagaaccaacugacucgaauuuuuacaacuccaaugguuuagaaauuacuuuguaacauaaaacaaucaggcaguauuaacaguuucucuuuguucgggaguauucucagcaacuauuucaauuaaguguacuacuuaauuggagccuauuucaguggaauacaucugucgauggguuuucuuuuuucuuucuucauuauuuauuuauuuuagagaugggaucuugcucuguuacccagccugaaaccagugguacgcagccgcagcucacuguagccucuaacuccugggcucaagugauucuccugccucagccucugaaguagcugugacuacaggcgcaggucaucacacccagcuuauuuuguuguuguuguuuuuguuguaguugguagaaacagggucucgcuauguugccggggcuggucucaaacuccuggccucaaucaguacuucugcccuggccucccaaaguacugagauuacaggcaugagccaucgcaucccauucuuuacuuuuuuuuuuuuuuuaaagaaaaacugacaugcagauguaauaaguccccacagugccaaaggaauuuuaaguuuagaaucuuugcaauaaauaccagcuaguccugggcugagugagagaaaacuggcacaucugggcacuugguauuaaguaaauuccuuuuccauuauauguggcuuguagacauuuagcuggaugcuuccagaauaauuagcuuuauguuguuacuuuuuuuuuuuuuuuuuuuuuuugagauggagucuugcucuguugccaggcuggagugcaguagcgcaaucuugauuuacugcaaccuccaccuccuggguuuaagcgauucuccugccucagccuccugagaagcugggacuacaggugcgugccaccacgcccagcuaauuuuuguauuuuuaguagagaugggguuucaccauguuggccaggauugucucgaucucuugaccucguguucugcccgccucuuccucccaaagugcugggauuacaggcguaagccaccgcaccuggcauauuuguugacuucuugauagucuacuacaaauacuuaaacagagauauguggguuucuaugaugguguuuaaguuggacuuuuaagagggcccuuucagaaaacugcagauacugcaguagggcucacgaauaggcugccaggaaaggaggcugagugggcggcgagucaaaugggaggucagcaggggcaagaucaaguaggaccaacaauaccuggcacaacacuuugguaaguuguaaggcugagagcaagguggugacucuggaggggucuaugcaggagagggaaggagguccuggaguggugagcugagcguuuggagcucagauagaagacucaguggacucccccucaacacacacauaccuuuuuccaguuucagcugccguggaguggugaaagcccacgugugauuaaggggcuggggccccuguaacaaaaacaucaaucuguguauuuuugcccugcacuuggcuucugcaggguuauccugcugcuguagauuuuuugccaacaucaggucacaacuucuguauggccaguuugugagucacccugaaccuggugacagugaggucaagauuuggaccagguagcuuugcucuacuucuuggccacaggcuaccuucugagugcagcugccugucucagaguugggugcuguagccgcagggccgacuagauagcaccuguggccccaucacagccaggagcaagggcacgcccaacuuggugauggcccagaauggucaguuuugauuuagcgcaccacaaacuuauuuauuguuuauucucauucuuaaucuaaucuuguguuuucucaaaaaaaaaaaagggaaaaaaaaagcaguagcaaaacaaaaccuugucaagauugcagaggaguucuaaaguuccagaaugagcauaucugaucaaaguccccugaaggucagaacugcccuugacagucccuuaggaaggugccuuguuggacaccgccccagucagucagucaguccccacugccagcguuuccuccagcauuagaacuaucauggcuucuuugguuaaacaccaaauggacuaguucucaaaccugugccuuuagacagcagggucacacuuaauguagucggagagaugcucaugccaugagaagcauguaggaaccaaggccugcugaggaacaaaaaccucacaucucccagcuugcacacacuucaggguucugugggaauugccuuuuuuuuuuucuuguuuccuucucccccgccacauaaacucacuuuguugaaucuacagaaguuaaaucugcauguauaguuucauugugcuuuuuuuuuuguaucugaguaucucauaaagcagggauucucuuagcuggccaagaaagugcuguuuagggaagacacauuaacuugaagcagacuuuuucagugcuaccuuuaagucuguuuuucuuuuuuuuuuuuuuuuuuuuuugagauggagucuugcucuaucgcccaggcuggagugcaauagcauggucucggcucacugcaaccuccgccucccggguucaagcgauucuccugccucagccuccugaguagcugagauuacaggcgugugccaccaugcccagcuaauuuuuguauuuuuaguagagauggggcuucaccuuguuggucaggcuggucucgaacuccugaccuugugauccgcuugcuucggcuucccaaagugcugggauuauaggugugagccaccacacccggcuuaaauccuuuuuuucuuaagagacaaaaucucugucacccaggcuggagugcaguggugugaucauagcucgcugcagccucaaacuucuggccucaagugaucccucugccucagccucccagguagcuaggacugcaggugugugccaccacaccaggcuaauuuuuuaaaauuuuuuguagaugggggucucacuguguugcccaggccagucuugaaccccugggcucaagcagcucuccugccuuggccucccaaagugcugggauuacaggcaugagccacugcuaccgacuuaaaugcuuauuuuugagguaaucugucagaaaauaaaaggagauuuaacagauuauuaaauuauuuugaggaagaagucacaauucuaagcguugaguguucauauaagcaaguguguuuaaaaaaaaagcauuuuaaaaagcgauacagcaaagugguuacauuguaggcaucaguguguuccugccauauuaaauagcaaacaaacccaugugucauaaugcuaugggauuguaguugaaaccugggauaaaguuucuaggguugucucauucaaaauucgaguauggcacuguagacauacuguccagagaacacagcaagagcuguggucagcuguaugacuuaaggucuaguguugggaaagaugcugauauccucaugaaaugugaagcauggcaagaagccuaguuaagauacuauuuuaaaugaugggugauuuuaaaauauuuauacauaacugaauucauacaaugaauacuaagaauagacauuugcuuacuucaacccuagaaguauagguggccacaaacuuuuuuuuuccccuucucauuggagaaaauugcaggugauuaaauuuugagauugccuuauguuuguagccauuugguuauauaguggaggagacuugacgaauaaaaguagcagauacagcaggaagugcuaagcuacuguccaagggaggaguagagaggcuuuccagaagggcaggagaagagaaugggugcugaacagcccggggagucagggccaacuugcuagaggaagugacacccaaacuaaaccugaagggcagauagauuuagcuagguggaguuuagggacgaagugucagagagaaugugucccagggccaagccaagcuauaguccuuugggaacacugcagaugcugcaguagggcucaggaguaggccacaagggaaggaggguggacucugggauagaagucaagcgggaggucagcagggccagaacaacuaggauccagaacaacacuuugcuaaguuuaauacuggaacaaggccaagauuucaugcugagaacagggcagugacucuggagggaugggagcaggggagagagguccuggaguacugguccaggagcugccaucugcaaugguguaaagaaaggacugagagccccauuguccccuggacagagcugaaguugugggccagcugcccugugaccugauacucaaugugcuuguacucuugccuuguuccagguguggacacugccagcggcugcagccgacuuggaaugaccugggagacaaauacaacagcauggaagaugccaaagucuauguggcuaaaguggacugcacggcccacuccgacgugugcuccgcccagggggugcgaggauaccccacguaaguuggaaggaagggggcacacuuccuagguggcuccuggcuacaaagaaaguccuaguuaaacuuuugguaaaggugugaagagauacuaaauuuaagcaggcagucccugucauuagggagaaacugcauuuaaugcugugucuguuuuagauggcuuuuauacuuggauaaccuuuaauucaucaguguuggguuuuccuguuuauaagagaauguguuugcaagagaaaaaugacggucccgccaugcuagauguucaccgguacauuuuacacagugugcauggacugucaucaguuuuggcuugcuuuugcuggugacuuauucgcaaacacccuuccuauaguuccuucccgugugacucccacagggcuguuccuguuggaaagaaaguauagagucugacagacgaugauacuuacuuccuugacaguuaagaauuuuuuugguuauaagaaauagaaauugaaauguucucaauucuagaaauagaauuguucucuuauuaaacagaaagaaaggacuauuuaaaaggcuguggaggaaccucugagagccagcuccaggggccuggggucuguuucuccugcaccucccuugagaugacggcuuuccaggccuguaucucuguuugcacagaagggcccaccacugacuggcccugcuuggcuggaauguucguuccaggaauagucacuguggccagggaaacaggagcuuauagcaagacacaugcccauucacaccaugugccaaguguuggagggaaaagcaguucuucaaaaaagagaagaagcuguuucugaaggagguggagggauugccacggucacuuccuugcuguuuguuucaauugaggaaugaagucaauucuauacaauuuauugcuuaauugaauaauauagggguccaucaauaaagcaaaaaauuggagcuuauauucaaaccugggaggcagaaaaguggagggaucuccaggcuugaaccuagaagucguagucaaaucccagcucuaccauuuacuuaccacccagcucugaccucaucacuuaaccuguaaguaaggugaucccccaaacauuguuacaggacuuacauggaaugugugcagacaccaaucugagcacacccaauacauguuaggguuuucccuaccauuuggaaaugugggcguuuccacaaaggacccuggaauucuuggucuuuggugacugcuugcuaauguaagugccauaauuuggguuuacuuuaaaucagaucaauggagauaaaauugcuuacuaucuguaucuacguaaaagcauuaacuauucuaugcuuuauaguauugcauugaaaguauggaucaagagcaucccaaagaagcagguagugagcagagaugagggcgaggaggugaaugcuuaccuguugagaaacuguugcuuucaaaguucaggggcagcaggggugagcuggcuguggugucuuuccucuuaaccugcugaccaucuguggccugagacuaugugcaucacacaccaugccacagggaaggugacacaggaccuguaauggagcugagagugguauguguuauggggcuucagagaaggaagugaaggcuuccaccucagccuggccauaacagcugucagcugcaauaucagcuacuccauaguugguauucaccaaaaaccaucacaaauuuaaaaagucacaaauguaaaaagucacaaauuuaaaaaggcccauguuggaucauguguuuagauuuuuaaugagaagagcuggucuccccaaguaaaccauggcugguuuuguguuauuaaaaagaacaaaaaugaacguacaccacacugaacacaguuugggaaggaaccucugugaccaucacugcccugcagaagcuccaagaacagauuauuuuccccccgagaaugcaggagguggaaugugcugugugcaauguggucgcacuggggcaucuguagauugacuugagcgagcuuugacuccucuaagacaagugcccaucccauagagugguugugaggcccgaggcaggugacgacuguaccugccugaguccaggcaugugucaggacaugagcuuucacguuauucuuuccuggcaaguguaacuggaguaaaggauuggaggggcagggaguuugggcucccacgcucccuagagauggcuggcugugcucaggaaaauguuuugaggucuuccuguugggccagucaugaaucauuacagcagggcaggacugacggggggaacuaccuguguuaguuuccuaggcugcuguaacaaaguuccacaaaccggguggccagaaacaauagaaauguauucucugcaguccuggaggccagagguccuaaaucaaggagccagcagggucaugcucccucugaaaccuguaggggaauccucccuugccucguccuggcuccuguugguuuccuggucaucuuuggcguuccuuggcuuguagaugcaucacugccguccucuguccucacaugcccuucucucucugugugugugugucucucuguguccaaacccuucuuacaaggacaccagucaugcuagauuggggcccauccuagugaccucauuuuaacuugaauaucucuguaaagaccuuauucuaaauaaggucaccuucugagauugaugguuaugacuuacacagaucugucuugcaggacacaguucaacugauaacacugucuacgguaguagaacuuucaucaugcuguuugccaaggcaguaccuacauggggauuuucucccugcagucuccuugaaaaaggagacucaaaugcccauguggaggcuugguaauagcggaaaucuggggcaauacuuuguuugggcuuguacccuguggcccagucuccaucaccucccucaccccugucgacagugagaauugaagucagaugucccaaacucacugcaaggucuggaccagaaguguccgcucugucccugggcucugugaacuuaccgaggaagaaucucagacuuccugggcagguuagaacgauuaucaguccaacaacaagaagaugguuuuuuuuaaauuauuuguuuugcaaaugaauagcaaauuacaaaaaaaucauaggcuaggucuuacuguauuuuacuuuuagcaaagacacaagugugaccgucccugguccuuucugaugucuugaggauccacccauuucccuuccugaagagcguuagcgggaggcagagccgugcaggaagcaguuucuguuuccaggugcggaacacaccuugugggagccuggggaggugccaggcuaggugagggcaaucaucuuugauaccgcagauguugcaguugcuuaucauguugaacuucgugacguagccgguguacuggccaaaucuaguuaaguuuuggcuguuuuuugugguuaugagagucugagcugcugaggaagcuggguguauauucugcacuggagacacauuagggacccuaccuaugccccaucauaccaucuuagguucuggguaaggccaguaugcugauacuaauuucaaagccuaaucuagccaugugacuucauuuuaaggagaauuagccauuuuuuuuuggacugaauguguguguaccccagcauucauaggggaaauccuaauccccaaugcuggcaauaggagguggggccuuugagagggagcagguuauuaggguggagcucucaugaauaggguugcauaccuuaugaaagaggccccagagaguucuguuuccccuuuugccaugugagggcacagcaagaagacaccaucugugaaccagaaagcccucaccagacacugacucugcuggcaccuugaucucagacuucccagucucuagagcuaggcgaaauagauucuguuguuucuaagacacccaaucuguggucuucuguuacagccguugaacuaagacacuauucaaaccuucaugucagauuuuacauauguugccgucuuacaauucugauaccguacauugggcauuuacucacaaaauccacauacgcgcuguagaaguggcagggguguuuagaugagcaggcuugcuaacaaaugguacucuguauuucuuuuuucuucuauugguagucacauuuuugccuauccuugacaccuucuaugaauuuuuaucuagaguauuagagcacguuuucccgugacugcuggagggauacaggaacugaguguuaauuucauccucuggugaugucuuuugcuuaugguuaaaggaccuacucccguauccucucugcagauuccuucagaggccaacauuuguaggaaaaagaaaagauuccuucucuaugggaaggugaauggacagcaucagucaaugucaaggauguucuuauagcuggaaacuugaauucucacaguaacuggauauucaggccuuguaagaguugaauaccugccagguggccuggaagaauaccuuaauugcaaaacaacaccgugucugcuccaguccuaauuugaacacagacaacaacugcugaagccgggaaagcauaacaguagcuugcagggaaggcccgaggcugcugcagaggagcacugaguacuguagcuuuugaggccucagucacagcagcgggcuggaaguuuucaccucauuuuaguuuuccuugaauaaaaccagaaacuucugaaaguuuaggauuaacugaauguauuaucuccuggaacguuauguuuguuuccuuuuuaucagagaggagcagauacaugccuggcugcagccccuugacagcucauuuucugauuguuucacuaaaugaguuugcucucugauaagacaacuuucuuuuugcucugucuaauccuuuguuauucuuucagcuuaaagcuuuucaagccaggccaagaagcugugaaguaccaggguccucgggacuuccagacacuggaaaacuggaugcugcagacacugaacgaggagccaguggugagugucuaccuccuucccucccucccucccucccucccucucucccugccuacaucuuugggguaauauguaacggggcagaggccaguugagguuaaugauuaaggcugccauuuuaaagcaacucuacuuuuuuuggagcuuauugguauuacagguaaagaugaacuuuuacagaaacuuuuugguguggaaauaccuaaaugugcacaaaagucaagagaaggcuaaacccugaguuucagcaguuaccaccauuuugguguuugucuuccccaccacccugcgccuuguuuggcuguagucagucuucagggaagucacuuguguggccucacagauaagcacuuacucuuuguuaacacugccacccugccacugucacagguaauacaguucacaacuguaccccagcaucagagacugacucuggaccaccuggggucagggcugggcccagccuagaaucuccuauccaagccagcacuggagccuccucccauccccccgaccuuugcccuccaccaccugcagcccucuggcucgggccuagcccgacagcuguacccguaggguggauccuuccuuuucuucucggugcucaguccccgagucucuaaugggcuuugcuuauaacaucauuuuguaccauuaauacucugugucuuaaugcacuucccuuacuaaggcuaauaucaggagauuguagacucuuagaauauuauguacuaaaaaggauuuauaauccucccccuccccaguugauguuggaagucuucacuuuuuuauaaaucaucaugaucauaaaccacugguuaaguguuccuuuguggguggugccuucugauuaaugccgagugcucaggucccuggaugccggguagaccuggugggucaugcugcuguguuggagagggacuggaaaaacacucguguuccuacacuguaggauccugaugagcuaggaagagcaucugaagucuuuguaauuucaauuucaacaaauaccuaagacuaccuucuuguaucagcuaagcgcccacugauuugaagguggucuguggugguccuuuuggagcuuugccgcuuacuguugccaguuuccagugugucugugcggcucuuccgcucugccccaucuucucugaugaccuaaucagaaacuuggcugcugauucagugcuuccaucccucaccugcaaagacucucucaacucggcugggugugguggcucaugccuguaauccuagcacuuugggaggcugaggcggguggaucacccaaggucaagaguucaagaccagccuggccaacauggugaaacgucgucucugcuaaaaauacaaaaauuagccaggugguaggugccuguaaucccagcuacuugggaggcugaggcaggagaaucacuugaacccaggaggcagagguugcagugaggcgagaucaugccacugcacuccagccuaugcaacagagcaaaaacuaucguggaaaaaaaaaaaaaacucucugaacuguaugguggagacuguuggugugugauguuaugucguugaaccagagacuuaccuaacuuuagcuaaaagaaccacagaccucucaggaaauuugcaucuuuguccuggcaagaaagcugaaugagcaggugugacuuucauaguuuucaauuggacauuguuuccuuugugaaaauauucucuuuguggggacacauauauuggaugguagcaaaccaauuuuaaggaggaguuaauagccucaaauaaauuucaccaaaaaagccagucuucuaugauggcuuuauucaagaaaccagcagccaguaucaggacggcagaaagaccucaucucauggcccauuucccuuaguggagguggcggccucaccugcagguuggaaagggcugagaggcugcguccaggcucugcaagggacuuucugucuccucagugugggagcaggauggccgcguguaauccccccaugccaccccagaaccacagucaccaacuugccauauuuuagugucuccagcaauagcaggccccagauaauugccagaaacaaugacaaugcgccuuauuguggaaaaguuuaaguauauacacuuuauacugcaaaccagaauucucuuagcuuuuuaagugaaaacuuuaaaaaaaguucuuuaucuguauaccuaaguaacuuaguacauacauuuuuuaauauucacgugggauaaauuuagauuuuuuuaaguguuguggcaauauucaagaaacucaaaagacaauuugucacuuuguacauucuacugcaauuuuuguauuuccauguuugcuucuguauuuuuucuugaacaguuauacaaacauguuucaucucauuaaugauuuuauauauuuauguggucuuuauguugaucaugucuuauauuauuuuaucauguggauuugccauaauucaacucuaauucugucaguggauauuuagguuauuuauaccuuuuccaucaucaguaaugauguagggaacaaguuuaucuuuguaaaggacuuuccacccccccuucuuuugagugauauuuuuagaauauaguauucccagacauaaaauuauaaggccaagaauaaaaaaaaagaucauuuuuauggcucuugaugaauauagccagguuucuuaagcaccauaucagcuuaugcugccacuguagggcaagacgugaccuguuucugggaugcacugugguguucccaugccgggggacugcucuggagucugccaggaacccaggaagcaacuagaggccccgcaugugccauaaaugaacacuucauacugaaaggcccuugaacaucucauggagaguggcacacgguauuuuauuucaccuuaugugcacccauugacuguucacuuagccauucuucccuugggcauuguuuuguguggguauuuagcacuuugaaagucuugacgcgcuggcagcagaagggaaacuuugugguucuuuaugauuccagcccugcacagcuuugaacugucagcaccuuuaaagccuuuaacaacuuagcuuggauauucuuuuuaauaggaauaugaacccccagauaaaagcugaguaauauacacuuaaugugucugcagcagaacacugauuccauuaucuuucccucauuucugguuacuuugguuggaagccacagcuguaccuggucugaaaaguugagaaauguaggauugugacuagacagcugcacacauugcugucugcuuggguccuggcagaagcaucuuuugaaaagccccuuucccccucuuucuguaugagacuuagucauaugaauuacauucuuucuugaaggugcagcuuauguucaugccaugguuuucucucuguugccuuucauucaccugcauuuuccuucucaucaccuccuuuucucucugaucagucuuccacaguugugucuuccucacaguuuucccugucauuuguguaaaguaaggauaaccaggccuuccuggucccugaguuucucauucucagcuuuguccauuuugcuacccucgugucuguuuguguguuuuuugaggaagagucucacucuguugcccaggcaggagugcaguggcauguucucagcucacugcagccuccacccccugggaucaagugauccucccaccucagccucccaaguagcugggaccacaggcgcacgucaccaugcucagguaaauaaaauuuuuuuuuuguagcgauggggucucacucuguugccuaggcuggucuugaacugcugggcucaagcaguccucuugccucagccucccaaaaugcuaggcugucaccuaggcuggucuugaacugcugggcucaagcaguccucuugccucagccucccaaaaugcuaggguuacaggcacgagccacugcgcugggcacucuggugucugcaagugcugaccccuucagaauacguccauugggcguuguauuuuguauucuuugugaaguauccaaguacguuucaaagaagaggacaggguauaggguaagacuguccuuugcauugucugcuuuguuugguuggguuuugggguagggacagcuaucacuuggcugcccuggagacucagaccuagagcuuucacugagggugaggcugacgagggggcuuuuugcugaagcuuccagagggcuugacgagaucaguuccugaccuggccucacucagcacagcagcaucguacaaggguuccagguuguugggugagggaggcaucugcaggcgguuccccacagacacagucaccuccuggaugguuucccugugucuccacugacacacccaugacuguuuuauuuccuccuguuagacaccagagccggaaguggaaccgcccagugcccccgagcucaagcaagggcuguaugagcucucagcaagcaacuuugagcugcacguugcacaagguaagggggacguccugaugccagcuucagagaaucacuauuauuccuuggcgugcugggcuuuuccuuccugcuacucaagggcucuuagauagcagcaucaguggcacugacaaagggucacucuagaggagcuguugggaccguuguucagugcaccuccucuaaaacaugaguucuccuuuugucugugcccuuauagaaacgccgagucuaaugcuaagcacacgugacccgcacacuagcuggacagugcauccuuggcuaagaguguuuauugacagacucaccucgcuugauugcucuuuacuuuauugcacuuuggagauacugcauuuuuuuacggauugaggauuuuggcagcccagcaucuggcaggucuagcgguuuuuccagcagcuugugcuuacuuuguaucccucugucagcaucuuuuuagcaauaaaauauuuuuuaauuaagguacauuguuuuuaaagaaguaaugcuguagcacauuucauagacuauaguguaaacauaacuuugauauucacuagggaaccaaaaaauuugugugacuuguuuuauugugauauuaucuuuauugcaguggucuggaaccaaacccacaguaucucggaaguaugccuguguauuaaugauaaucauaugcuuaaugaccucaggcagaaacaaaagcuucucucugucuaaacagaauuuagauugggcacaguggcucaugccuaucaucccagcacuuggggagaacaaggugggaugacuacuugagcccaggaguucgagaucagccuaagcaagaccuugucucuacagaagauuaaaaaaaaaaaaaaggcuggguaugguaagcgcacuccugaagcugaggugggaagaucacuugagccuggaaggucaaggcugcagugagcugugaucaugccacuguacuccagccugggugacagagugagauccugucucagaaaacaaccaaacaaaacccagaauuuaaugacaccguuauaacaugaaucaaauuaguuacucuuuacacuuaaaagaucuuucuauaccacaucccauuuuuugcaaauggucuccuaauaucagaaugauccccauaaaauuuccagugugaauacauaagucucccuuuauucacacauagauguguuucagaaaacuuggcccaacaccgaaugacuugaaagcaauuuuggcuuccuggccggcucccauuaccaaaugcuaccauggagagaaauccccuuagaagacuggguuggaaacgugagaaauggcuuggauugccucuggccuugugacuugugccugcugggagucagagccccucccccaccacacuuacuguccacaguaacuuaucgugaggccuucagccuuuucccacuuuugcuaaaaguuauuucauccauaccagcgcccugacggcagaacucuagcaugcuuuccgcuacgggaaugcauuuucagcugggauugucuugggcucugagcaggguguguuucccaaaucaccuguuacggaccgacuccggcaggacagaccgacuccggcaggccuagccagcgccucccuaagugggucacugccacacagcugugucguguagguaccaugguggcuuccugcccuugcuggcuucccaucaguacucugauuagguucccagagagccugucuccaccuuacagugcaggaucuacugugcaccugcacaugguuucagcuuugcacauuuuuuaauggaaguuguuaacuuuuaaaggaaguuuuucaccauuuucuucaagugcauuguugcugugcugaugagacaguagcugugagccuuaguguggcagaguccugcucagacgccaggccacaugccacugguuaguucucuccccggccacagccugcuuucaguuugguaucagcccaaugucaggguagaacagcuaaacaccuucuguguccaaauaaugaugcugugaggguuuguuuguuuuuuuccccguagccaagggggugauguuucauuuuuuaaacuuuuuuuuaugauaaaauauaauacagaucgagaaaacaaauguagggcuuaaugaauuuuuauagcguggucacacuguaacuacuguccaguucaagaaauaaaacugccagcuucccgugucccaugcagggcacagcccgcccucccuucuccaagaaggcacuugccugacauuuguggaaaccacuuguauuaguccguuuucacugcugaugaauacacacccgagacugggcaauuuacaaaggaaagagguuuaauggagaacucacaguuccacguggcuggcgaagccucacaaucaugguggaaggcaaggaggagcaagucacaucuuauauggauaucagcaggcaaaaagagcuuguguagggaaacucccguuuuuaaaaccaucagaucucaugagacuuauucacuaucacgagaccagcaugggaaagaccuguccccgugacucaguuaccuccuaccuggucccucccacgacaugugggaauucaagaugagauuuggguggggacacagccaaaccauaucaacuccuuuaugugcacugaagugcacauuccugagcacuauaguucuauauguguauguguuuauauaucuuuuaaggcucuuuuaaccugcauguucuccagacaucucuuuaucuuucuugcugaagacauaggugguuugaccuguagagcuccccgugguccagacuuugcuaauuguguccccguaguguggucuacauguuucccugauuucucuguuuccuggaaauugguaguugggucuggggacaaaaucaguuucagugugauguuuuuugggggcacaagaagaccucauagcuggugggggcacagaacguccaguugucucucuuugggauguggucgaccaugacaggcagagccuggguccguccauuccuuagggcugccaagugccgaggcucauucaagcgucccuucauuuuuuaaccaagagaaacucacccucauuuaucaccugguuauucagcgguacagugcauauaggagaggugggagaaaugccugauucuuuccuuuuauuacaguuuuccaaauaaugaguugauugcugauuguccaucaaagaugacaaauuugguuuugaguauuguuaugaagucaugaacagaaacacauuugauggagucccuuuguaccaauuaaagugcucaugccgaacuaagauuugcuaagcaggacaaagaucugauucuucaauuaacucucuagugaggucugacauaaauuacaguuccucuuucccccgucucugccuuggcucuccacuccaggcgaccacuuuaucaaguucuucgcuccgugguguggucacugcaaagcccuggcuccaaccugggagcagcuggcucugggccuugaacauuccgaaacugucaagauuggcaaggugagugaaagcccuuauuaaacuggaaauggacugcuuugggcuggauuaauuagcagaguggcccauuauucauuccgugugcaaagucgcaaacuugauuuauuaauuccauuuagugugccacuugauaauucauuucaccuucacagauggcagucugauuuugaguuuugcuggcuuuuccacagccuagagauaaauuauggccucggcugcuuuguuuauuuugaagagauggccaaaucugaauuggcagccccagagcccguucugcaaagagaugggguagagccuuguagaauguucacuggacgaacuuggagaccguccacguucgaccucacccaagagcucucucuaaaaggacccuggcucugugcucccccaagcacgcagaagacccucccucaguuugcacugugccugggauucuuuccagcauuuccuacuuuauacagagaagccaagaguggugucugacaacuucuguguaacuggauuuucuggaaauauccaguguagcuccagggacaucacuuuuauucuucuacacuuuccagcacccaccagacaccaugcauagauuuccuuucuuaaaaaucucauuuuucuaccuugccauggggcugauuuguauccaaaaguaaugcugcgugucuaggacugaaugaugguuaacaggaugaucuacuugggauggugagauggucaaaagcauaaacuuggggguuggguagaccuggcuggcugaccuugggaaaaaccucuccacgccucggucucccccuuugcaaaacugagcuaagaucuacuguguggugucugggcagaugaaaguacacugcuuagugugaugcuuagcauggggcagaugcuugguaaauuguaaucacuuuuguugucaguuaaauggauauuucacuguugccucuuaaacgcuuacgauaauauauacuaauuauacauguuauuaucaguuuauauuuauugaacauuucggggaaguaauuauaaaauaaucuugucuacugucuuaccccauuccuuguauccuuacuuaauuauuguaugaaauuuuaugggagauucuuuuagguuuauauccauagaggauccuagcagaccuaggcgugagcagacacaagcccaggugaccacgcugaagcccuucaucccuggcacauguggcuggguuacacuggacccuuaaaaaugcuuguccucucccgaccuugggcugaggccucuuguacuucaguuccgcaccuuagcugcucucugacgggucuuagguguugaaauaguauuuuuacccccguuugcugacauagugaauaacaacuuaguccugccuauuuuagugcugguagaaaauaaaaaagaaagcaaugacuuagaacaagauguuucaugaaaauguugggcaagcagcagcuuuaugagauuuaaaugaaagaaaaagcuugaagagcugugcuuguugguaaauuaaguuuauaaaauuaaggacggauuauaaucuugacaucuuugcagucuuaccuuuauuauauaccaacuacuccuguuuaaaauucacuucuugcucccuguugauuuuaaaacccucuaagcuucagcaugagaguaaauucuaagcuggcaugugaacuggucugggucccagucaccgacagccaggcuaaccccccucccaccaccaccaaaugucaagccagggcccugacucaagcuaccaggugcugacuuuacuugcucgaguuaaaauguugcuuccuaaaaaccggcauguuuaacugagcuauuaauacaauaaaucuugccucuaaagucuuuccuuuacuccuuuuagcucagguauguuuuagcauagcuuucaggaacauucucuucaaaaacugcaccuugcuggcagaguugcuacagaauguggauuuugaaaagaauauuuguaacguacaaaguguccaguagccccauuagcaagaagguucaugaagaaacugacugggaaguugaucugcuuuuauucucagguugauuguacacagcacuaugaacucugcuccggaaaccagguucguggcuaucccacucuucucugguuccgagaugggaaaaagguacgucugcacuucuuaguacugagaauucuucaucucuuaaccccaucaggcugagcuacugagugguuuaaugggcacagugaauugccaaucuugauuguuagggcacugguuuggagaaauguguauaaugaaacaaacgucuuucucuuaauugauaagauuuggguuguggagaugaaccuugaaacauuucaguggcccagguuaucacuagaauaacccacaucuuacagucacaggguaacugugcucugguuguaaacacaaaccuucaggccuuugaacagagcuaaggcuugcacuugguccgguucugccugccucccucccuccuucccuggccgauggucagcagcucagaguuccccaucagcacaacggcuugcuggcaggccucugccccagacuucugugauguguaaccccguggagggaagaggggccuguacaguucucucaccaaagccgaggcauucaguuauccucucuacauucccgucuaaauaugaacaugcagacuuugcaccaccgcuaagacaucugggagcucugacccgggcaagcagggguugcaggaaggcuuaagugauucagaacaccucaguggacucacucagccgcgugcccgugucuuggccagguggaucaguacaagggaaagcgggauuuggagucacugagggaguacguggagucgcagcugcagcgcacagagacuggagcgacggagaccgucacgcccucagaggccccggugcuggcagcugagcccgaggcugacaaggugggugccugcuggagucgggauccccauaaguggcccguggcccccggccccccaccuccccacccucagaggccuccucaaaugcuuuggacaaaaugacaguuuggggacacagucaucugaugguuggcuccaguugcguuuucaacacguauuuuucaucgacuuucacaugcuuucaggggcgaaugcaaacaaaagcuuuccuuuugaaaacaugaaauggaugugagacaaaucccaagacaauauuuggugucaaaaaucucuagagaauccuuccuuuccgcuucauucauuuuaaagaaugacucugcugggcauguuucugcuaugaaaucucgacugcuggccccggggcccugauucuauuccugaccuugcuccgggcauuuuccuuuacccguuguaaaggccccuagaagaccuguagccaagagggcauccgcagcgaucaggccagugacuguagcuguaaccugccuaggcaguccugaugcacugaggggcuuccuuccuucacucagguagcaggagguuucagauucauuuguucugcuuuaugaagcccuuguuaugucacaggcacuguucuaggccaccagggaauaaaaauaagaccgguuuccugccucugaagcauacaggucucugaggcaaauggugagaagacacacaagccaauggcagggggcuggggcagaaaugugugcagggcuuggcugcuagagagaagugggggcaaaugggcaagaagugucccuaaggagcugauugacgggaucugugcuggacagauaggcugggcagggcugccacugaggggcugcaccaggagaggcacaacccgagaaucagccggcauuucugcagggccagagcuggggcugggggaacacagugggagacaggucagggugugguguaggaucccugagagugagagaggagcuggaguugagagucugugggcagcuggccaaggauuaggaacuguaucccauauugacagggagcccauggaggcucugugcagauuggaguuguaggaaaaugaccggcaugcacgugugcuggaggugggaagcugcucuauuaggccuuuaaagaugaugcguucccucaugcugcagccgugacugugcgauggcgaggaggagaaagccagcauaaggaguccagccgcugugcagcgcggagagggagggaggguccgaggcgagucugauucccgcauaucugguggaggaugguacccagcacaggggcggggccagagcucgaggaaagggaugagcuugguuuucaagguguugaucuucaaggcuuucggcuguguagguggcaguguccaguggcaguuccaaccaugagccuggggcugcggcaggaggucugcacuggacgagagugcccgugucauccucuucagguagaagucaugccugaaggccaggaguuuggauuuggaaaaaccaguggggccaccaaccccuccucccugguggggccacaccaggccuccucaccccuacaacccugucccuaguugggcucuuguaggucggggauggccugaguguuguuuaaaaguugacguuuugguugaagaaguaaacagcugauuuuguaguugucaggaccacuuauguuagaggaguguaugugucauggugguuacaaaggucaucccaaauugaguauaauuauauaccacggauguuuucaucgcagcaccauuucuauuuauaaugcaguuuuccaccaugaagugggucuuuucagugcguguggcgucauguuucuggacauaaagaugguaguguuccacaguggcccccuuggccuccgucacugacauguuacucgaugccagacucaaauggagcagcccugguacacuuagccacgugauaaaucaucccauuccugcucucaggagagaaucgcagauccauuuuuggagaaacacauagacgucauucuguaaagaacugucaagggagaauggcuuuaaagcagacuaccauguagcaccuuucccuuaaauucuccagccagagcuuccaucagcguuuuucacauugacuuagaacaggcugcuuuccauuuuuauguucaauguaaaacagguaucauugccuuugcuauuguaacuagguucuuucuguugcauagagaggaugucacaaagggugcuaggagaauaggguggccagugagaaaagcggcugaggaugagacuucaguggguauccuggagacuccaggcuuagaggugcagacucaagugucagacacccagggcugccugguccacaccacagcgcccuggagaguuuucaaccugccucauccccaaaagacagucccccuccccaccuucauccccuguacaguguccagccaccuccucaccacaucucccaggcuugggacccagggacuugcauugaucucucugcccuucagaggcugccagccucccuuuguguguagccuaugaaaugcagauuguguagguauuucugugugaccuuggagccuacguaacugcauuuuuaaaaaauuacugauucguguaucugcaaucccaaagcauggcccugcucaacuuuaagggauguacuugaacuguggcuuuuuccucccuugaagggcacuguguuggcacucacugaaaauaacuucgaugacaccauugcagaaggaauaaccuucaucaaguuuuaugcuccaugguaaguggcuguuuaauuagaaacuacuuuguccauguguacuaagucacaucauguuuuucagcucaucugccaccccuccagacucaauguugggcacauguuacauuuauauguaggucauguuguaggaaauaaggaaccguuaucaugcuccuauauucaaauauuuuaaacuucaauggccuuaauuauauauggagaaugaggcuacaguuauaucaacuuugauuauauauggagaaugaggcuaaaguuauaucaacuuuggagaaaacauaaaaauggaggcaaauuaugauggccauauucaguuuugugguaucugcacuuuuccaaauagauggcuuuucuuuuuggcuaaacaaugagugucaugauguagcuuugcuccucgguucuuuuaaguacucggauuucuuuuguagagaaauccaguagagucuguuagagccauucaguaugcuacgcaguuuccugaaccugcaugccacguggucuuggagaccagagcagaaauggauugcagguagugugagauccagacaaccuugguucuaagacuuaccgugaaugacuguauaguaaacuuggauguccuuuaauuccuuugaaccccaguucccucagcugaaaaaugggaguaacuuuuugucuucacaaauaaaacaauccauuuggaaaagcagaguguuaggacaacaguagauuguuuaucuaaacaugauaaaggcgucacuuuucuuguuuguuacacuccacauguuccugagaaacuaaccauagggguaaaaaguuaauaagcacaggacuugaacgaaccauagcaaugccuuucaaaucauuugcaacauuuaaaaaccuaaagcuccacagaucaaguaucaaaaaggaggauccccuuuggcugaaggggagccauccauacggcaggagggggucagaagagacaagggaacagagucggguagaagggaggguuugaaccaaacuuaaucauggccuugaugcucaccccacaucgcugaaguaccaaggaggccuuaaaaugguuuugaaauugugagaccauaagcaaucaaaucuaaaaugucuuuggcauucaagugaccuuuuagaaauuguguggcaucugcccuguucccuguuccucugcuccugugcuuucauaaaccaguuagcacaguucaccauggcauggaaauggucucagaaucucaacuuguuuugagacuggcuugcuucugucacauuaucugaaagucuaccuuggaucaacuuuuggguucuucauuugggauaggaggaggaagaguuaaugugcacccagugggagaauuugguauuuuacaaauuucuaggcaauuguugacugucccauacagaagaaacagagcuugucuuggcagcagaguguaggugaaugaucucgacccaggauuucaacgaagcugccauuuuucucgucuuagguguggucauuguaagacucuggcuccuacuugggaggaacucucuaaaaaggaauucccuggucuggcgggggucaagaucgccgaaguagacugcacugcugaacggaauaucugcagcaaguauucgguggguacuuggauggaugcuuaugggagcucucaguaugggggcagaucccaagggaacugugccucaaccacgauaacucacucugcucucaucuucucaacaaugugguuuuuaugucccuuugaguuguuuguuuggagaagcaaaagagauccucucucaaagggaaggcauucuucuucgcccgcuuuguaguuaguauccauguuucagugcagguuuucaggccuugcugucugaguaacaaggccgugaaguaacagaccccacgccauagacuguggggcuucccacaccgcgacucuugaugauugaccaguggucuguagccuuugccauaaauacccgagucgcucauuuuucacacauaagccagcauuauaaaaugcaguggcugaaucuaagaaucauuucaacauaaccuccuuucugaaagggccaugccagcaagucgguccugugcuuggguuaacuacugccuucauuccaagcuguuagcacagucugauggccuggaagauuugucauuuuuuuucuucuuuguuauucagacacuuuuggagcccuuuagauggagaauagacguaacccagacauaguuuccuuaucauuaaaagauaccaguuguuuuuugugcccuaaaauucuuagaaacgaguugccacugaaacauguauccucaagaggaucuugcucucauggucuggucugcagaccaccagggcaucgccagggaggucauuggaaaugcagacucccaggccugcucaauccaaaucugcaccuucagcagauccgcaggugaucgugugcacaguaaagacugaaagcgucugcuuuaggguaaagucguuccuuugaggcugaucuuuaaugaugucauuuugaauucagaagugaacacacagccccacggcugugcuuucuaaacaguagucugcuccuguuuuaauggaauauacaccuuuaaaaauuagccacagaauuuuuccagccacaacgguaggaguguaucugguuuuauuuaggaagcaauuugcaugugaucuggaccgcugguuugcaaacuuuuuucuuuuuuguuuuaagguacgaggcuaccccacguuauugcuuuuccgaggagggaagaaagucagugagcacaguggaggcagagaccuugacucguuacaccgcuuuguccugagccaagcgaaagacgaacuuuaggaacacaguuggaggucaccucuccugcccagcucccgcacccugcguuuaggaguucagucccacagaggccacuggguucccagugguggcuguucagaaagcagaacauacuaagcgugagguaucuucuuuguguguguguuuuccaagccaacacacucuacagauucuuuauuaaguuaaguuucucuaaguaaauguguaacucauggucacuguguaaacauuuucaguggcgauauauccccuuugaccuucucuugaugaaauuuacaugguuuccuuugagacuaaaauagcguugagggaaaugaaauugcuggacuauuuguggcuccugaguugagugauuuuggugaaagaaagcacauccaaagcauaguuuaccugcccacgaguucuggaaagguggccuuguggcaguauugacguuccucugaucuuaaggucacaguugacucaauacuguguugguccguagcauggagcagauugaaaugcaaaaacccacaccucuggaagauaccuucacggccgcugcuggagcuucuguugcugugaauacuucucucagugugagagguuagccgugaugaaagcagcguuacuucugaccgugccugaguaagagaaugcugaugccauaacuuuaugugucgauacuugucaaaucaguuacuguucaggggauccuucuguuucucacggggugaaacaugucuuuaguuccucauguuaacacgaagccagagcccacaugaacuguuggaugucuuccuuagaaaggguaggcauggaaaauuccacgaggcucauucucaguaucucauuaacucauugaaagauuccaguuguauuugucaccuggggugacaagaccagacaggcuuucccaggccuggguauccagggaggcucugcagcccugcugaagggcccuaacuagaguucuagaguuucugauucuguuucucaguaguccuuuuagaggcuugcuauacuuggucugcuucaaggaggucgaccuucuaauguaugaagaaugggaugcauuugaucucaagaccaaagacagaugucagugggcugcucuggcccuggugugcacggcuguggcagcuguugaugccaguguccucuaacucaugcuguccuugugauuaaacaccucuaucucccuugggaauaagcacauacaggcuuaagcucuaagauagauagguguuuguccuuuuaccaucgagcuacuucccauaauaaccacuuugcauccaacacucuucacccaccucccauacgcaaggggauguggauacuuggcccaaaguaacuggugguaggaaucuuagaaacaagaccacuuauacugucugucugaggcagaagauaacagcagcaucucgaccagccucugccuuaaaggaaaucuuuauuaaucacguaugguucacagauaauucuuuuuuuaaaaaaacccaaccuccuagagaagcacaacugucaagagucuuguacacacaacuucagcuuugcaucacgagucuuguauuccaagaaaaucaaagugguacaauuuguuuguuuacacuaugauacuuucuaaauaaacucuuuuuuuuuaaaagucuggucuuuccuucaauguuacagcaaaacagauauaaaauagacaauaaauuauaguuuauauuuacaaaaaaagcuguaagugcaaacaguuguagauuauaaauguauuauuuaaucaguuuaguaugaaauugccuucccaguacaugauugugaaaaagacauuuagaaaauauucuaaaauuua

SEQ ID NO: 17262 - RNA, 5727 nt, Homo sapiens
ggaacguuuaugaucucgggggcaccugugugcuaccucuaaucagguauuaugcuaaaagaaaauacuagcuaaucuccggaauggcaucaaacuuuccaauauuuggaaguaugugaugaauacaaaagaguugaggaauacaaauugaauuauuaaaaaguuauauucaacauauuuaauuuccagaauuugccaucuccuaauaggaccucagagacguuaaaugauuuguccccaacugguaagugacaggaauauuuuaaacucaggucuucugacucuaaggcgagugcagauuauauugcuuuacuuuuucucugaaaaguucacaaauguauaagccaugauggugugguaaaucacaccaggagaugccagcaguauuucuucucuagacucuagugcugagaaguugaauacaacaaucuuuaaauuaauucuuacuuggcauucuauuaucauuagauugauuuaacucagccacauuuuuaauauuucaaagauagaagauauauggcacccgauuucaucuucugauuuuuuuuagaauacucuauaaaugaagaaggaaaauacuuaguaacguuuuucaccagcacauaaaauuccuuucucuugccuuccauggcaccagccuccuagcccucucuuuccacuugucuuuaagccccuuugcuugcccauuggaggcuguuucccagaguucuguccugaggucuccuuucuucccaguguacaugacgccuccucggugaggagagcaaagaucaccuggugaccaucaagcaggccaccugaagacaaaacuccuuaucugaggaauuuagaaguaauuaugaagcggcuuccuugucugggguaaauacccgagauucguugucuuauggccacggaaaacuaggaugugggcacacaaagagugcaguuagagcagaaguuuaauaggcgaaagaaagaaaagaucucugugcagagaaaagucccagagaaaacggguuguggcuuccgcaguggaauacagguuuuacagaggagcuugaggggacaguguuugauuuacauagggcaccaaagauuggucagaccaggugucucauaugcauagcacaugaagaaacuggcugcccccacccuaaucuuuuauuaugcagaugagcucucuacccggcuggcgccauguugccugguucuuuacuguacacguggugacgaagaaagggaagauggagccuccauguugaacaugccuggcccucagguagcccuuuucuauuggcgcggcugccggcauucaccagugcaaguuuccagcuugcuuaucuaugucugcagcucgauuuuucaggcugcucuuuguuguuagaaaagaaauaauuuugaggugcuuuuuguuaaaagggaaauuccgccaaggacucuguuguccuuacuaucugccuaaauaauuucuuucuaucuccuguaucaauuagacuucccuauuaucuaaagcuggcgucugguacaaagcuucuuuuguaccagauagaaguuacuuauaaacucuaguuacuuauaaauuuauuuuauuuacuuauaaauuuauaaguaacuagaauuucuguacaucuccagaauacgugcaugcugaacgcauugugccaaccuggcuggcauuaagcacaaaaaugucuacaaauguaaucauuuaucuaaugauacuaaugggcuaauaugguccaaauuaccuucagcuccggcuuuaagguccauaaauaccccugaggaaggauccacuguguugcacucaguccucucuugcugaggugcuccgcugcagcugcacucuucgacagcguucuuucuaccuaauaaaccuuuccuuuuccaguccuauacggucagugguaaauucuucuuaccaacccaccagucaaccaccuuuugauguuggagcucugacaccuugccuggcucugggugauugcuuucacucaauucaucuguagaccgaugacuucaucucugguacagaccauucugaccugcagaaccauagauuccauuucuucuuaguggacaguucugucugaaugaccacagagaacucaaucucaacaugccccaauugaauuuagcugccuucacuaugcucugcucucugccuuucccaucugcccacucuccccuaaauuuccagugucauaaauuuaaugacaucauaacugagcugggagucaugcucaagugcuuucccucuucacauccgaguauccaucuaggcuuauuguucugccugcauucucucucucaaagucuucuccucuggauauuccuucaauacaacucucaucaaguuuaaucugcauuauucuaguucaucuccucacuaguccccccagcuuugucccugucucauuccugagggauacugcugaaucauguuacuuccagccaaaggccuuacaauagcuucguacucccaaagaaccaaaugcaaacuccaaggccccccugcuuccaucugcagccgaacccuaauugaaaucuguuucagcugcaccaaacuaccugcagcuaucuaaacacccuuugcuguuaaucaucugcaauuauaugccuaagcugcucacuccgcccaaccuuuuagugcuggcuuguuagaucuuugccuuuaauguccuugucauuauggauuuguguaucuuuuaauauuuaaaaugauuuucuuuuauuauugccuuuuacucccugaauuuuucacaaugaacaagcaaaucauuuuuaaggggaacaucuaacauuuauuaaaauaccuaggugaacagggaauggcuuucuccuuuuucuacuuuaugauaaaauccagaugaauguaggaaucguaaaacuucaaaaaaguuauuguuguuuuaggucuauucauaugugcaagguuuucaauuuuacgaauaacucauaccauuuuggggcaaguuuuggggcugaggguuuacacccauaccuccacuaagagaaccggguauuccuuuccugcuguguagguguuuucaucccuuucuuuuuaauaaaauaauuaaggaguuuuuauuaguauaguuaaagauuuaccgaaaaauugaguacaauuccauauaugcaucccauucccaccacauauauuguuucucuauuauuaacaucuuucacuagugugguacauuuguuacaacuaauguaccaauaucaauauauuauuaacuauaguccauaguucacuuucagguucacucuuaguuguacuucuauagguuuugacacauguauaacaucauguaucugcuaguguaguaucacacagaauagucucaccugugcuuugccuauccauccuccccuucccuuucccaccccacccagccugugcccacccucaucuuuuuacuaucuguauaguuuuuauuuuuuauuuuuggagacagagucucacucuguuacccaggcuggagugcaguggcacaaucucagcccacugcaaccucugccuccuggguucaagcaguccuccugccucagccucccaaauagcugggauuacaggugugcaccaccaugcccagguaauuuuuuuuuuuuuuuugacuuuuaguggagaugggguuucgccauguuggccagacuggacucgaacuccugaccucaagugaucugaccaccucagccucccaaagugccgggauuauauaguuuuucuacacagacagucuguauaauuuuucaacacaggcaguaaucauuguauuuugagccaaaguuuccaucaccuuuuuaggcagacuucuuucuauuuguuuuaaaaugaagaaagaaugucuucaugaaacaugaguuauucugcauagucaaaaguguucacagauugaauuuuuaaaguugguaaugcuuuucuguuuuuuuucaagauccaguuugcauuuucuacucccauuaaccuacagugaauacaucauuggucaaccaaaguuacaggaugaagaaagacucuugggaaacacauguggguccaaacuuagacucagaaaugcccaugagggaaauugauuucucuuguccauuaccaaauugcuacuguugacaucagaguaagaaguuaucauuuuccuacauaugagaagauaaaauaaucugauacacaauguaggcaauugaaauggucagcaugaugaucuuuucuauuuugccaucagaaaaaaacccagugguuuaaauugcagaccccagcauggcuuuuucagauggauaacaacucauuucuagaggcuuuucccauuuaaauuugauaguacugacaccaaagaauggggggcaugcuuaucguuacuuauuuuggacuaaacaaucacaauacccacuuaacaaagcugcuaaaagcuuggcgcaugauuguggguguuaccugugccccaacucacaggcaagaagcaguggcacauuauaaucauucgacaggaaagaauuucaaggagacauagaaaaauugaaaguccacaugggauauaaucaaaguuaaaagagaauuuccuuuucaacaaaugaaagcaagauauuuaggucaaaccucacguugacaggaaacagaaagggccacugcccauguuagaagcagacuggacugcacgacccaaaggagucccuguggucagguuaauggcuucacaaaaaguauuacuuuuagaguacuuuaugguuuucuaagugccuuucuucauaucuaucuugauacaaauuguccuuaucagauguuauuaauauagcaguguuuuaauaugcugaaauucugcuacagagagcaacagauuagagugcaacagguuagaaaugauccuguagugaaaauauaaugguuuuccucuucaucuuugcuuuagugaaaugcuugaaggccuacucucucucugagcugaaaguaugauuuguuauuccaaaacuauuuuagucucagcagagauggaguuugcacaugcauuuuugauaacuaaggcugacucccauuaggguggaaaauaaagccuauaauucauaauaagagauugcugccuuugaaaucacuuccuaccauaauacuggccacuucauuacagugguaauuagaaagaaaaaaaccagaaguggccauuugaaggggaaauuagugcuuaauuuccaagacuguuuuauuuuaauggaugcaacucuggcaagauuuuauacuucaauugcaaacccaagaaugauaaggcugguguuucagaucugucuucuaaauggaaaacacuucaugcagcaugugaugaaagagcaucuaaugacugaauauaucccuuaaagucagauauacugucuuuaaaggaggguuuaaaaaauaaguauguaugugaaggugggcauguguggguguaaguuacauccauuuaaucagcugcuacugucauuaaccaaguacacaacuugagcguguuaaaauuacuccaauuaaaagaaagugcuguuaaaagaaaaucucauauuuuauuaaaaaugucugaugcggcccaaaaggaaggaauggaucuuuuccuggaagaggaaaacaagauuuaagacaaagaaauacgcauagguugaucuaagagucuccauuuuuagagagcugcugaggucuucuaaagaauguuucuuuucuucccccagcccacuuccucuuuuagaagacucuuuuauuguggaauguaauacagaaaacuccac

SEQ ID NO: 17263 - RNA, 22855 nt, Homo sapiens
ucaacauaaauaaaauaaaacuuuauuuuuaauaauaaaauuaauguuucuaguaaggaaaagacaguaugucauuccuuuagcaguacaaacaaucuuuuauccaaaagaauacauuggguuuuauugugucauuugucugaauacagacacaguggaauaucuaaaugauacccugcucugaacuccaaguugaaaguaaguuuuuauuauacuugagggaaacaauggguucagcugcuuauugcaaggagcaauugccaagggagaguuaaacucaauuacuguaaccauacugaauaaaaaauacugccaagaacaaaaauacgccuggguaaagacagccacugaauaaaaaaaaaucgacauaaagcguaucaaauauuuauuuaucugggcaacaaaggacuaugauacauugacaggcauggaaacuacugccagcacaacucaauacaaugcaacuagaacugcuuccaauauggccagugaaaauacagaauaccagguggucccaaauguuugaaguucuuugaacagaaagagagaggagagagagagagagaggaaaauucccuaacccuugguuuaaagacaauauucauuuauugcucaaaugaugcuuuuaagggaggacaguggaauaaaauaaacuuuuuuuuuucucccuacaauacauagaaggguuaucaaaccacucaaguuucaaaaucuuuccaggguccaauaucacuuuuuuucuuucgguucaaugaaaagcuaaauguaauaauacuaauuauagauaaaauuuuauuuuacuuuuuaaaaauuuguccagcuguuugucaccuuuaacaugcuacaacagggcuaaauucaugaaucccagagaaaaaaaucccccaaacacuggauuucuaaaucaguaccaugaaccacaugaagaacuaauagggaagauucaaaacccacuaaacaagagguaaacaagaucagauaaauaaaaaaaaaaaggcuuaaaacagacucaccauauuuacaauucccauuaaauuacacauaaauaaauauauacagagacgugaacacugauucccuuauauaacugcgaaucguguugccagagaaaguucaaguuggucgcuuuaccuuaaagaggaaaaacuucuacaacugaagacaugacauggaacuucguguauuuguguucaaguuuauucacaauacugauaaaaauguugucaucaucuuuuggcuuuuuuuuuuuuuuuaaguauggcuacaaucugaacugaaguauguaagggaagguggugacucagucccaugaagcgcauauaauuuuuuuuauuuucacuuuuuuuuuagaaaaaaguuuuuaauuuuuguuguuguuguugcuguuguugauuuguuguuuuguuuaaaaaaaaaaggguucacaaacuuggcagaacuuuucucugcuggcuucacggccuguucuguucucuuaggcuccacaugagggcacaggggugugggagcggguggggaggucgaggcgggugcagagucggagaggcugccccacugacagucgagagggcagucccggagacucggggggacccaagggcagcggcggcggcggcggcggcagcagcagcagcaguagcagcagcaggaaggguugcugaucccggagcugucacccgccggagggugggcgcgcggggggcuggugaggcgugggaggggcggggcgggaggagagccucacuuucugugcuucuccucuuugucacugcuuuuggcguuguuguccguguggcuguugggguuguugcugagguacauuuuguccauggccuugagggccucggugagauaguucugcagggccgugaccgcggcacacaccgcggggcugccgaagccgugggagaugagguugaagugggucaagcagcucuggaugccgggcuccaggaugggguugggccgugaguuccccaggggagaucgguccugagccagcaggucggugaacucuuugcauaucugucugcagcacaaguggagcagagagagagacauaaggcuccacuaugggcagcacuagcagcaaagagaaaaccucccucccugcagcuaccucugccgggauccagccgguaccugacaugacccaagaccccagagacagacaguguggccacauguugggagauccagccaccuuucagugaccacuaaaccaucucucuuuacuuccuaccuucacaaaugacucucucucucuuuccucucagauaugguaaacuuuuauucccaccuuucucccucacacaaaacauccuagacauaggaaaccauuucacacauuggaagagaaagaaaggagucacgcagaccggaagucagaaacaguagcaucuugcgaacauuaugcugcagccaucagccuuccuauucaaaaugucauaaagacccucuucccugcuccucuagagagaccucagcagcaguuuguagaaugaaguccacacucguucaccuucaaaucaaauucaggucaauguggacagagagacaaaacuuuacuugggauuauuuugccuuuaaaaaacaagaauaacaaaaaaacaaaacgggcccacacaagcccuguuacuuggagauaauucaaaguaguguuugggaagaagaaacagacauuucgauuucccauuccuccucuuuccccacauagcucaaaauaaaaauacugcagggaaauuguggagaugggugugcuuacgaagccuggggaaagagaaaguugaaauuucgcagagguagaugaggccugcacucaggaagcucugucucugaaucugggaagcaagggcuagcuggggccuuccaggggcagcagcagccuggccuggggggcuggggagggggaugaaugaggagccugggcuggcucccuucuccaaggccagcugauguccccaggccagaaacagggucccacccaaggccucagcuucugcccucugcuuccaugcccuccugugacaucaacuuugauaauuaagggcuuccaaacaagccuuuuaauuuccagaaaacacaucaaaacagucauuuucuuuucacacaucaccuggagaagccuauucagcccaggcaccgaugggaauauaacuugggccauuuugaaaucuauuugacuucucgccugugggcuaaaacuuauguggggugugggucucucucucucucucucucucucugucugugugugugugugugugugucacuuucgagaagggguugugaaaggaagguaagaaauggaauaacagauuaggguugaaacuaggacagcuucuggcuugcacauuuugcaggccacuguuuaaucuuugcccuuggagaacauauugauaggauacaaaaacugauauagguaagccuguuaccccuuugaggauuugauucuggucuuucugaaacaacauagucacaaauccacccuuaacuucagucaaaccccuccuacaacccacucccauacacacucauuaaaaaaaaaaaaaaaugaguaaaugggacagaugagaggaaaaagaugggagcgcccaagaaucccaccuguauuucuuccuuaacauagacuauauauaagaugguguuauaacugcaacaaagcugauuaacacaaaaggaaaacaagggagaaggaagagcaaaaacgauuuuuguuucucuuucucuugacaacgagacacagagaccccauagagguaaaugccuuacuuuguagccaggagcauguuuuuucuugucacuugcucauugggaucggaauguugucgguugagaaauucagcuacugcuuuggcaggaaauucgguuucgcacacguacccaaagucccuggcuagguggacagcuucuccuggcaagaggggagaggagggagccagugcgagagaaugaagaguggggauccuaacuuccuccccacucccaacucccuaauucccuucaccccagauguugcaggaaacacaaacuacuuguuuucucauuucaggcauuuuauuuccuucucuguaggaucugguggaugcauuuaucaggaaaaaugaccacuucuccuagagggccaagaagacuugaaaaugaaaaucucauccaccaaccuccagucccaucccccacccuaaaugacacuucuccaaauucucuuuuaaaaugcuucuuguauuccaacuucacaccuaucaacacauucauaaaugauauucauaauuacucuuugagcuuuucugcaagggaacaacugagggguuacauuuuaacuugaucacauaaauuaucuguucauccaaaccgauuaaccaagaggauuugagggucacuccacugagucugucuguguuguugauuuucgaaucuuugguuuuaauuuccugaaccaguugguuuuuacugcagggcuuccugccauuagcuccagcuccggaagaacgcaugcgccaauuagagcaucaaagcccucuccgcagagcuuguuuccauaaaauggagcggaucacaaacaauaacaguucuccagaaacugccucccugcuacagaacucaacccccaaacccagacgaacuccacgcuauaccuuaagccaccacuaccauuuucuuggcuuauaauucuuuuggaguaugaauaguggguucucuauggacuguuaugauuuuuaauguaaugguacuguaguugaguuucuggcacugaacaauugcugauuuucuaaacaguuauauuacuaucaaucucugacaucaucaacaaagagaauucauaggauuccuccucaaauauaugguuuuaaacauuuuaaaaaauaauuuacaaagccagaacuuaaauucaauuguaauauaucuccucaaauacaagaugugaaugaaauaaaaugacuucuuuaaauauauauacaugcuaguuuuaaaaucugucugguaauuaaaguaacuuuuuuuucccuguuagcaugagauauuuacaauaggacacaaagaaaaacacaggagagcuauagauucauuccaguacaccaaaaccuaggccaaucuuguaucagaaaaacuuaaucuagaggcagcaggaauaugaguggcuuccgguggcaguuaucuagagcagggagugaggauaaggguuggcuuuuuguuuugaggcauuuggaaggguguauguauguuuaaagcuaccaggagaaacuuuuugcaaugcuuauauuuaucuuuccauauccacaucauccagaaucaaaaauugcucacuuuucuucuucuccaagagaaaagcacaauuaaagagauaagggagcauauguuuggaaaacaaagaccugaaagggcacauaacccugagcuuucaggauggucuuaaaucaggacgcaggucaaagauucccaaauuaauucaggaaguaauggucacgcauuucucaaacgcagaugucagaauaacuuaaguuauuuacugcugagcccuuuaaaggagacaaacuuggagaaugugcaguucuuaaacuugugcguuguuuagcucagaauuaggcuggggagguguaacuuuaugguagaggaaaagaaggaagaaggauggagguauaggaguacaugcaaauguuucuuuuugccaugaaauaauuccauucacaucuggcuauauucucugcaaagaugaaacugcccaacugacauaaaauacgaccaaacaucuggccacuaaauauuauccauuuuccaagaaggaaguuccuucuaguuagcaaguggauucgcuuacccucuacuagugaugugagcaggguaacguuggcagcuuuacgucucccugcaggcagauuuaauccuauuuuguccaguuuuucucuuaaagaucuuccuccauuuuuagacuucgcccuguuucacaaauauaugcgagaaagggauuuagaaaacauuggguugcucugcaccacauuaaaaucauuuugaaagcuuccuaaaaugugcuuucaaaaacugagaagcuuggccccaagacauuuaaaggagggaaaccuaggaauaguacagaaguucauaggagauaaacgccuguuaaacuguaaagcacccccuacguucaguuauuauugcaacucuuguggcagguuggaagguuuugauuucccaacucucuaaagaagaaccacaaacaaacacagccccaucucuaggguuugagguauugaguucaacugauuccuguauauuuucucugcuguuacaaucacaccaaucccaauggggucuuuaaaacugucuuugcaagauaugcuguuagguuguuccgaguaaccaaaguuaucaucacucucacguuucuugcucuggcucuagccccaaagggaaauucguuucgccaacuguuuacgugccaugucaccagccuaacuggaaaugucaaaagcugauaucagcccuaaaaguuucacugauuucagagacaauggaggcaguucuaaacagaugucuaaauagaaucccauaaucagaaagugguuaagauaaauuguuuaaauaaaacagcaaauuaauuaauuucagauuuuauucccuacucaagugcucuuuaauuguguggauuagauuauacuccccuagguaaacagucuccaauauuggggaugggggaagggaaggaaaaagcagagggcaaggaaaagaucugugucagugaaagacuacaaagggaaagcaaaaugacugugcaggaggaagaaaagacuagaaugguugauguuaaacccuuccaaaaaaugaucuuuauaggcuuugugcgggauauagccacuagaaaggaacugugggucuaucaacacauaaguaaaugaauaacagucaaaacaaugaaguucucaguauuauuaaagaagagaagaaacauuauccggguaaguucaacacaagccccacaacucacaacgugcaguggaauccuagggguaggaagcccacagcagggagaaaacugcccuaagggaaggugcuuuaccuugcugacccuuauaaaaucuuaucuacuaaaugaaucacucaaaccucgcaggggugagguaagaaucccuggcuauguauguaacagaugcauuccuugguagugacuacacacaaugcacguaaacaugcucgcacgcagccuggcacacaucagggccucaguaaauugggaaucaucaucauaugcaaacgccuauaguaugggggucuggagaugacagcgaccggaaagcauggcgugcggacucaagaggacaaccauucucuuccuuuaguuaaaagccauucuauuaaaacccuauacaaggcacgaccgguuacccucggagacccuacucagagagguaaggcaaagcgaggagccugagaggaacuuuuccugggcuugcaaggugugcgcgaagagggaaaagguggcuguacggcgccccgcggcugcaguggccgggauugagcccgcggcggagcgagcugcgcuugcgcgaggaggagggcggagcggaggacuccgcgagcgcgcggcagcgaacgaagcgcgcaccagaacucgcucgcgggaaagcagcggagagcgcaggcgcgcgccgcaucgcccgcucccccgcccccagaucccgcccacuuggcucuacgcucuucuccccgcccccuuuccuuucccgcguagggagggccgcggcgcgaggccuguuugcgucgccgccaccgccccggcgcaagcgcagugguucccccggccgcggggcggggcgggcggggccgugccgggccucaccuccggagcacuccgcccagcagcgacgcguugagacacucggguggugagagccgccgcugcacuuccgccaccgugaccuuguacuucgagguggagcugaggagcgagaggcgacccggaacugaacagaagacuucguugggguucaccacgccgccgaagagguuguccuuguuaauagggauggcggagacggcauugcuguuggacuuggacagggacacggggccugcggagacagaggggaggccgcguguugggcgucguggaucacccccaaauccugcccgaccccggcccucaucccggccagggccggaucccaggcuuugggccacaguccccgcuuuuccguccggcucugaaauucuguggcucugcuacuucccuuccucgggcucgagcccuucccuaccucacccggcggccgggaggcggcccugcccucccccagccagccuggccugcguuucugccuugacccuuuccccuucgccgucaagggugcucucuagagauggguggugaaauuggugaccccugaggcgcugagcauccgagcggagugggccccagaugagguccaggaccacggguucagggugcaggggagggaauuacauuugcaaaccgagagcaaguuacuuguacuucagggguuuugcugggugggguuuuagugucggggaaaaacugcuucaaagacccauuauuaaaaucagccgacaauuuagauggcuaaagcacccuguaaacgagcguuuuaauugaggcaccacgcugggaagugguggauuuuguuguccacaccacacgucccgucuuuuugauaaauaggcccuuuccuauguucaauuuugaaaacgucucaguuuuggagauccauuccaaggccaguuuugaacugcggaguggggagggaagaacaggccuacaguggaauacuagcaaugugcccuuuuguuaaguaaauacuuaacaguccucugcuaaagcgccuuuauugggaaaguggguauauauacuuccuaguuaaaaccauaagcucuuuauugcuggacucaccacuguuagaaaaaaaaaaaauagaagaccugcagaaaguauacuaaugcauuacguuucucagcaccaguguaauucagaugcauucacaaccauuuaaguacaguaugcauuguauuuuaaaauuccauuuggagacaucauaugcacacaaucucaucacaguguuccuuaugcguucuuuaauggggauaugcuagagguauagggagguggggggcucuagguuuuggauagaucacuugugacauuaauagcucuggggaggcuaauagagacaauaggaguuaaacgaacucuugagagauuacuaauaaaagagccaauuaucaugucgacuuggaaagagcaucucuuaagauuuaucccuugcacaucuaauuugacgugacaaagacuucacagaugcaaaaaugaaacuuuaaacuagcuaacaauauacugauugggguuagaaaugagaacaguuuuauauagcaucguccucugguggugccuagaauccugaaauguaacauugccaccauaaccaaaaaaaaagcugcuaccaagagugaauagcauuuaauucaguaaacuuuauuucuacucacuaaacacaauacagauuacaaauccaugcaaaucacuugacacuuuucuaacaauuucuccucugaacaaguaugcuaauauuccucccaucuucaagauacuaauuuuaaccaaaagcuaaaauuuuguuaaccuaauucacaaaguucuaagacccuuaaacagcuaacaagaaacuaaauugaagaacaugaauguuuuuuuccucuacuaaagagugcuucuuaucaucuguucuuacauuaauguuaaauuauuuguacuauuuuagcauuauacacuucuuaaccuucauccaggcaauggauuaaacuaucaaacuguuucaaaauugaaaugccacuuccaaaucaguucaacuacuguacauuuuguguguuuguccaaauaucauuaaacuaaauuaaauggucaaaucaugagucagaacaaagcuagccuguuggcauuaccaacauacugaaggcugauuauuuaagcauugcuguucugugccuaucuauuugcuaauucugagccuuuaggaaauccuauuuggaaaaaauaaacacaucucugcaaguucuuuuaaauagcacucugccuguaaggacaugcuuggaaugcagaaggaaauggcuuaccuuucuuaauuacaguuugaucugggauguuaauacccgggucuucuacaugcugcaacaaaaggauacacauggauguaaguguaucaucaaaacaaaaggaaaugaauauucccugcaagaugggaggaggggaagguguagaaucaaaauucccccucccguauaaugacauuuauauauaaacaucucaucuuggcuuauuggaauuuggggcuuugcaacucaagagguuucacugcacacccauggccaauuucuccuccuccagcaaauaauccauguuuaaaagggguggagauggggaauaaaacuuucuuuggaaauuaaaucaaguguuggagcaccuaaucauucucagucaguucaacauuuagaaauguaccuagcuuuagauuggcgccucagcggcuucugacuuuagcaauuccaguguucaggcagcgaaagccagggaaacacaauagaaaugacaggggcgggaguaacaggagaguguuggaaaagaaaagguuuagguaguauaauaaagagcaaacacacacaccuuuauggaaaacuccacauaaauuuuuagaaagacuacugccuaagccuggguaugauaggaauaugaaaaugaccaaaaccaaaaaaccuuugagcuugcuuuccuguuguccaacagcagguuuguuguuagugugggguguuuuucuuuuucuuuucuuuuuuuuuuuuuuuuuuacagauggauggguauacgugugcgcacuagagucaaaacgugauuagaaaguaaaaugaagucauguuuucuaaugcagaaacugacaggcaauauaaugucuggcuguguuuacaaauuagcaccagggcugcugagauagaagauuuugcaaucauuaccaaacacaggcauuaccauuuaaaaaacuauugcuuccuucucuagucuuuguccaacaauaauacugauucgaacauuuuccauucugucuuggauuuaugcuccuguuaauugugccugaucgcaaugauuccggguggaugguacuaaguugcuuuauuacagguuuuauuauacucaaugcucucauuuguaacuugccuaaagugcuucuggauuuaaguauaauuaaauugagaaauguucagaaaugacuacugcugcaguucuuguguuuuaacuauauggggaaauaugaucccuuuaugcaugcacccuaaacccauaaaguaaauguaguguggcauaauacuuuuauuuguguuauuucuagaccuuguccauacagggaagacuguuaaguuuaaaaccccacugagauauuaaugauuaaauaauuuucaccaucgauuugauuuucuuaaauauuuagcaguuauacuuacuaaagguuaacuguugcagcaaugggaaaaaauugaaaacaaccuuuuucuugacccaaauuccuuugaaagaauuuuuuucuuaaaagaugggggagggagagggaaaaacagcaacuggguuuccuuguuuuuguuuaaucuuuuaguuaguuucuccuacugaccaauuuugccacaaagagugaguauacagguguuaagaauucaccuugaaauuuuugcaaaguagagcaauucucauucacaguaguuccaaaagcuugcaacauuauuuugcaauucaaauauuuucaaagaacaagcaaggaaaagauucagagugcuuugggaaagggaacuaaaauaaucauaacucccaguucauguuuaaauugcucuuauauaaauuagugcuccucucacuuccaaaaaaaugcacuguuaaguaucaguuucuaaaaacauguaaguaugaacacacauauacagacauacagugcucacuaaaccuuauacuggaucaagugcccacuuuccugccuuccaugcaagggcugcuaaacauaaccaacaaauuucagugacuaacugggccaaaugagagauguaauaaauuuucuauuuuccuacggaacuuaaauaauguuuuaaauucaccaagcaaggagguaaguucaucugaccauuuuccuuacaaucuaauguaguaaucauuaaacugucaacggacauacugcugcaauauuugaugcaguaauuugaaauagcauuuuaguaaaaaucacauccagauacauuuccucuccaaagaaaagcagcuuuaacagaagccuuuacagcuuuaauaaaauuauuggcuugcucuaauuccauuucaggaggguugugaggaaaccauaaauauauagaauugaagcagagguacugguuuaaguuuaauuccagaaaguauuuucaaauuaucaauagccugguuugcauuguaaauaguaaaugugcuaaugccaugcuuauuuagaaaucauuuuaaacugcauuuauugauaacuaaauuagaacucaaauaauguauuacccaauagucucgaaacauuuaauuuaauauggaguguagcagguucugauaggcguugggaaccuagcuaaugauuuaugaggucaccacuuagcaccccuaguaagaagaaggcugcauuuuaaugucccucugcuuggauuugcuacuuaguuuuucuuuaaucaggauaggguguacacauaacuuuuagguuucacuugugcuuauaaaauccgguuaaaaugaucuuagugugucuuuuacacuuccuuuuacauuuugaggacauuuaaugagcucuuuugguugcauuuaacaucauucccaggacagggagaaaucuccacgccagacucagcgauggaaguagaucuuuuagcaauugagacaguuuacugucgucgagaggaagauauuguuaauggugacauucgucugauuuaucuguguugguggaaaugguaaugcaggcauuguuugagggagcuccagaaaccauuguucugggguagaacucgcaacuacuuugugugguuccucaaaacgucccucacucuccgccuccgaauaaaauguuuuuauaaggaaauacuagggagaacccgggcccaccgacuguauguuccagguauccuuucugggguagguaaguagggggcuguguucccucccgcgcugguugcgcggccucuuaccgggaccuccucgauggcgugagguaaggaguggaucgagaggucuccgaguccugagcugagcgcgugugggccgugcaggagguccucgugccgccuguagucccugcgaggauccaggcccgacagcuggugaggcagcccccggugcgugugcaggagcccagacuccuggcucugccucuggccgggccagccugggugcugcggcugcggcugggcgugcaggggguucaggcuguaggggucguugacgugggaguaaggaucuugcgacuggggguagauaggcugguaggguggggggaaguaugggggcuggaagucggcauugggggugugggacagcggcggggcgcucguguagggagauugaccuacagugcccagcuggggcaaccgugccgucccguugcuggugccgucgugacgguccuagaagagagcgagaggaaagguaaagaacaaggaaucaggcgucgagcuacaacuauccacacaaaauccacuugacaagucugcgugggaaaucgcccguucccguuggcuggccgccgggaaaaaaucagcucuaaguucuuuucaggaaauacccucaagugaaacagaccgaacaacgcagagaaacuguauauggagggggcacaagagacuauuuagggguuucuuucaaagagaggaaaagauagaaaagggucuccuggaacacagcccauuaaacugcagcgugaaaucucucuuaagcaaaauuaaaauuccuccuaaauacuaaacagcagaagcggccuuuucuuuucccccgauuugaaccugucugccacugcguuauuguuuauucucuuccauuuauuuggagagaaaaaaaucauaaacguucaaagacuguuaccguuucaugacuacuuaaauagaaacauauuucgcagaggggcuguaacaaaaacacacguuuaaauuaccagcuuaaagaagguuuuaacugcaggaucggggucugucuuuuucgcuuccucuguuaggagccuuuuucucgacagagucgauuuaugguuuggauagggaaagggggacgucaagucaagguuuaaaauagaaagauucagccuuauuggguuuaaaagagagaggugcaccccggggcuguggccccccccccccgccccuuccaccccagccccaaagggcagaagaaacgccugacuuuagguuucucuauugcaauucccuugcaaaacaagcgaagagaguugauuccagagaccgcgaacccucggcgguucggccgcaggucccgaggguagggggcacaccgcgcugcacuuuuccugcagacaguuuaagcaucaaauguugagaacaucucggggacaagugaagacucaaggaaaucaagaugaacguggggagaaacacgccuugggaagccgcggcgagguaggucugcgugcucggagaggucgagcgggggcugggguaggggguaaugcacucgauuuagggauggaaaagagcgagagaaaggcggaagguggggugggggaugcaaauggagaggguguccugaaggaaagcugggcgugaaacccgagguuucgggcagcuccacggcaccagguuuccagaauccaauuccuaaagaaacagcaacggggguggggaugggacucaccauggcugaaaaacugugaacuaacaucugcgaagagucugggguaacgagucaggguggaaaaaaacaagcaagccuggagcgcccggcugccccgccgcccgagcgcgccccacacaaaaggcgccgagagccccgcgccacccaggacuccagucacggcgccgacgcuccccggagcgcgggagcccggcucggauccauccgaacuugaaccaccgauucgcgcggcgccuucagcuggucgaacccacggucucuauccugccgcgacugguuaugauucaaaguucuuuaaaaaugaaaaaccccaaaaaaggaaaaaggaaaaaguaugugugagugugugggugcgugcguguuccuuaauccgugucucccccucuuuucuuagcggcggcuucgcuugagcuucuaauaaccgcgcugggcagcguuccuggagccuccuaauagcagauauucaugacuauuaauauuacacgaauacuuaauaagggaagaaugccuggaaaucgagcgugaagcggagaggcaacucgcgccggagccggcucucaaugcaguccauugacgggagucucaguguagcaaaucggaguggggagagggagcgcgagagacaaaaagcgagcgagagagggagcgggcgagcgcgcggggggccgcggcgcggcgucuggcgaaucacagggaaggggcaacauuuuaaaagguugcagggcaugcaaaagugaaagagaaagaggcagagagggagaccgaaggagagagcgcagagagggagaaugugucugcgugcgugugugagaaagaaagugugggcgagggagaggagccccggguggggagaggggagggagggaaggagggagagcccgagaggaggaagggagggaaagagggagggaggaagggagggagggagggggagggggcccagccggagcgcacggagggggaggccgcgggggagggggaaggggagaggaagcgagcgaggacaaucagaccuaaaaggcuggggcagaccucgggaugcagcgggggucgugcguagcggguaggagcugcuugggaccgcguccgggcgcucguggggcucucggcgcggcaggcgcuucccggcccugucuggccgcgggcuccgccgcuucgcagccgagucugggacucgggacucggcugcccgcugcugcgcggcuccuccaugacccggcgcccugcccgggaccggcccgcucgcugcacugguccucuccucggccuccucuugagcuuuccucggacaggggcaccgugcgcuccccggccaccgucgcucugcccucggcucucuggggccggggauuccggaucgggagccgggaugcgggccggggcgcgcacagacgcuaggcggcccagcccgggcgccgcuggcaccggcucgcggcucccggcaaaaacccguccgacuggcugggccacucccgccugacgcccccccagaugacacgacuagcucucccggcgugcugccuuugccagucuacccgccagguugucagaacaagcggcaccucgccuccugcgugucccuacagagccccggcacaaucagacugccccaagccagcuccgaaacccgaaauccccgcuccggcgcuugcccaccacggccaaaguuguggaaacagcuuugacuuuauucuccucucucucucaucuuuuuuugccucgcuuacacacgcauucacacuugcccccacaggaucccucuaggggugcaaguucaucccccaccuagccacccaccccauccagucggcaccuagagccgcacggagguucggaccccgcccgccgagggcgcccacaccuggagcuggguuucggccucugcgaaagugaaaugcccaagccuccggccaaagcccagaccaguacaguaugaauuguccuaugagacugagggguucggcuucauuccuaccugcccgcaaagcucgcccccagccucgaaaacaaagcgacuggucugacguggggucccugcgccccuccucuagcgcgacaggacccccccagggaagagccaguacccgugggaugucaccccguccccaucuaccgggguggggggccugaaaggagaacgauuuaaaauaaucuucagaaagaaaagggaggagggagcgggugacacaucguucacauaaacccaauuucugguuucgagugaagucaagaucuccgccccugcgccugcacacacaccuccugccuaacauucucagcugcaaaugccaaaaaagaaaaaaaaaaaaaacagcaaaaguugggacugccaccuauuuauuuagguaaucuccagcccuacacaccccaaccccucucucggacucauugcucauuacaguguugguuguaaccguucccagcgccuccugcggguggacaggucgcgcuagggucucccuugcugccucaagaaggcgagcucaggggacucugcguuuuaaaauggguuccaaagcggcgcgcucugucggcccagcgggcuugcggcaccagagguggucugcagccgcgcaaggauucccacggucguucugggcuggugcagaagcuggugcucccgcacccagcggccagcaggcucggcgcagcacaucuccccaccccacccccacacacccccguggggugcgucgauccuguagcucagagggagaagcuacuuagaacuucgugaagcacagaggaucuggagcgagccccgcagcugggaucaguggucuuaaguugaacccgcuuacaggaagaugcagcccagcucacagcgaagugugggggggccgucucuaaagccgagaagggaaccgcuuuagaaguggggguggggggaagaaagaaugaaugaaugaaugaaugaaugaauagaaagaagaaggaauauuaaagaucggagaggaaguucaagagagaaaagaguuuucucuuuccuuucuguuccuggugacuugggcccucaaucucgaugaagauaacacgaggagugcacaggcaagugcccaguugccagcaauugcuucaaaagcccauguucuucuuuucccccauucuuaggcacagccaaaauuggucagaaaggggaguaaagugggacacgagcuucaaaguagggaaaccaaagaagggagcauccacguccucucucugcagcuucucccccgcguucuucgggcgaauccgagggacgggcgcugcgcuggggaaaguuugucccacccgcguuucgcagcugguugcaaggagaggaggaggagagggagggucaagcucggagccugugaccgcacggaugaucgagccggcgucgcgcuuaccucgcaguccucguacuugauauuauccgucaauuuccaaagcauuuucauggaucggcgugaacggauaugccccucucggucucgcacccaaguggagcuacucucugggugagcgcaaagugcuggcugccggcggugagcgcaggaggaggaggaggagggagaggagguggaggaggagaaggaggagggagaggaggagggcaaggaggaggaggaggaagaggagggcgaggaggaggaggagggcgaggagaagggcgaggaggaggagagaagggaaagagcucccgugugcgcucggagaucucccucuaaugguagaaacuuuucccuuuuccagcucuuuaccaacagccuaaucgccucauuagcauaucaacaauaguccaauugcucgccaguaccacaaucugccgccggccgcuccgacacagguauaaaggccucucuacgccgcgaacuugcuucuagagcgcacuccagccugcgaacugauaaaaccuuccucgagcuccgccgcgaggcccugccccaacacccccucucuuaccccaauuccgccacauuccccuuccuuucuuucuccgcuuccuuuucuccagagaugccuucugcaaagcccggcacugcucaagguccaagcgccacgccuggggcccagcuucuagcacuucucccuuaacccugcuaccacgauccgagcugcccuuuuggccccgugcaauuuuauuagaaaucauuaucccuuucgcaauuaaacauaaccaccaaaccaagaccggcgaagucacuccaggauuuuuucccaacaagggaucgccuccgcucgaggcagccacccccucgggccgcagcgccuugggaguuuuauuggcuuugagcuuucccccagguuggagauucugccaagcggcuccgguggcucugcugggguuugcaaucccuuaauugcagcguguaaaauaaaaguuguacccugaagagguuacuugacagcuccagggguuaaacaauuuuucuccuguuugugugaagcuagggccaacugacaguucaaauugguguucaggcuaagguuuccugggugcaacguggacacgaauacagaacuccuauggaacugcacacccgcuucugaaguugagccuaaaaacagacgugugugugccugcaagucuagauaccgucucgugcgugcaucaaaauaaaucaccgggaaccgacuuuuagcuguguuaaucugcucuaguuuucccaagauuccccuuuuuaauuaaagcagggagaguuccuucaugauuuggugaugcuacuaacgcgggcgugcucgcgaggcagagcccggcugccgcggaaccuggaggccugggagccaccuacucguccagacuggucaguccgggcuuuuggacuccucaccggggccugcuggguccucuggggcuuuuaucccuuucgguuuugggauuuuuuuuuaaguaagaaaaaaaaaaaagaaaaggaccuaaugugacacuaggaaauacagaguaauuaauuuuccuggcugagcuuccucguuuguccuccaaaagaaaguuaccucugucuuuucucucugcuauauguacaaacuccuuaacuacacuaggucccgccucagaguugcucuaguaaggaccuuugauucaucugggcuuguuucucgaaaaucuccaggccucccauauuuccaccgggcguuccuaaaaggggaugggaacuguggcagauuggagcauucccucacagguggaaggaaggcaggagcugggagaacuccccauuccacccaaggcugcagaaggggaauucucccuccaaacaccucagcaaacuccccaaaccuagcagaguaggcagaaggcuccaaaaagcuagggagaagccggagcuggcaaggggccuuacagacccaggaagcccuccccaugcucugggccucccuugcccuaccugaacugagcacaauuccucggcugaaccgggcuggaggcuuggcgccgcccuccguccagaaaauggucgacuuuccagggcuagacccugcagggcugucccagccugucgccagugcagugguuugaagucaggaucugggcugccaggagcaccgacacccucccagcagcggccauagccugagcaggccaaacccuaggccugagagcauggguuuuuacacuccguagacgucgccgcggugugcuuaagggaacuccaaguuucgcuuucuugcccucugcgggcuuggaaaggccgcccuccauccucugccaccccauuucaacccccguuuccaccuccccgcugccccgcgcccaacagaucuccggcuccgcacccgcuggggcugcuaaacuguuguuguauucccgccgagggcgccauugaggugcagauugggaccugccggcucuggacugccgcccccgguguaggcgcugaugaaaggcccgggcgagcgccagggucgccucuggagccagccgagcugcauuuaugccagcgucauuaccacgcuaagucgcuucauugcaugucaaugcuccggcggggccagaaccccgggacagcagcgccaggccugggguuggaggucggagauccaggccugacguggggggcauaaaaagggcgucgcggggaagagggaguauuugugugagagacagagucacaaagagaaagagacagugaggggccagaacgacucucuuuucuccgauugucaaugcccagugggagccgggagcccaacaggcccagcccaucagauucggccccuccgggccccaaauccgcucgccccacccgagauccaggccuccagccacuugccuaacugugagcccgcaagagccaggcccgcggcucccuccuuccuccuccugcggcagucucgcggcuuucaaaccuuagucgaacccacagaaggcccagucccaggccaaaccuacucaacaggcaccuucucacggccuaggaauucugcagcgaaauucacuggaauuugaggagaaaacccaaagacugcuccgaaaggacucccccagucuucagccuccaaauaagagaguuaggaagggccuuuagcccacagggucaggaagggaaagguguggauucccgggauuugucucugguaugggauuugcauccuuaaaccacgagguuugucuaaacuugcggaugaaauaccauuuagugaggcuuaacuagggagaagaauauaaaagagcucacucuugauaaaaguaauaaauccaagggaaaaaaguacagaacgcaaaaggccuuucuuucuccaacuccagguagcuuagugaagacugcacuucucagaacuuuacuuuuaauggccuaaaucugaaacaagagaaagaacucgaccaggaguagcaaggccucagauuuuuggggggaaguucagggcauuagauucgaauuguccccugggcuuuugggcacacagaaucucacccucaccaggccucuugguuggggcgaaaacagggccucgcgguucugaugaugaaaucggcgacaggcagagccuuuuaccgccaccauccuggccagagccgcucuguuucccgaagggaaagugucuggaaguuggaaggagagagcuggacaaaugcuuccuuggccagggucggaauccggggcucaggaaggacaggagccaagccuuggaugccuugugguguccgcggccuagcagggccaaguuccacaggcguugguuuuggcaaauucaccaccccccugccuccucacccaccauucucacacucccucauccguagcccaggcggcaaaaacccauuucaggaaguggagugaguugcuagcuaaacuucgggcaaacuuuguaucuccuacagaaacacgcugccuccgcgacccagccaucuggaccccuuuccauucuucacacauccuagaucucccgaaaucuggggguaccaagagagacaggugcaccagaaccuguccaacacucaacccuggggucuagggcgaggccgcaggcgcagcaggcugaaaaccuucaccgccgcgcaccacaaccccaggccuucucccuccccccuuccgaauuagucauccucccaaguuucuacuugaggugggaggggggugggggaaacggccacagcacaaaccacaagugacccaccaggccaccuguggagcgugcgccggacuuccccggcgccgggccccgcgggcugcgcgcuuugcgcccagcaccgcagucgcugccugcgcccguuuuuccugucuucgcugucuccugggagcucuccugggcgcugccaggcgcgccucaccuacgacuccccugcccugggccacggcgcuuccucuccuccuccccgcuccggcccccuccccuacuccaccccugcccaccucaaccccagccaaggcaaaccccccguaccugccagucccccauuuuggcaaguauggacaucgcggcucugcgcuccuggcgacugguccccgccgggcaugggcuggagggcucggucgggccagcucccuggaaucgcuu

SEQ ID NO: 17264 - RNA, 7106 nt, Homo sapiens
ugcauuuuaaugucccucugcuuggauuugcuacuuaguuuuucuuuaaucaggauaggguguacacauaacuuuuagguuucacuugugcuuauaaaauccgguuaaaaugaucuuagugugucuuuuacacuuccuuuuacauuuugaggacauuuaaugagcucuuuugguugcauuuaacaucauucccaggacagggagaaaucuccacgccagacucagcgauggaaguagaucuuuuagcaauugagacaguuuacugucgucgagaggaagauauuguuaauggugacauucgucugauuuaucuguguugguggaaaugguaaugcaggcauuguuugagggagcuccagaaaccauuguucugggguagaacucgcaacuacuuugugugguuccucaaaacgucccucacucuccgccuccgaauaaaauguuuuuauaaggaaauacuagggagaacccgggcccaccgacuguauguuccagguauccuuucugggguagguaaguagggggcuguguucccucccgcgcugguugcgcggccucuuaccgggaccuccucgauggcgugagguaaggaguggaucgagaggucuccgaguccugagcugagcgcgugugggccgugcaggagguccucgugccgccuguagucccugcgaggauccaggcccgacagcuggugaggcagcccccggugcgugugcaggagcccagacuccuggcucugccucuggccgggccagccugggugcugcggcugcggcugggcgugcaggggguucaggcuguaggggucguugacgugggaguaaggaucuugcgacuggggguagauaggcugguaggguggggggaaguaugggggcuggaagucggcauugggggugugggacagcggcggggcgcucguguagggagauugaccuacagugcccagcuggggcaaccgugccgucccguugcuggugccgucgugacgguccuagaagagagcgagaggaaagguaaagaacaaggaaucaggcgucgagcuacaacuauccacacaaaauccacuugacaagucugcgugggaaaucgcccguucccguuggcuggccgccgggaaaaaaucagcucuaaguucuuuucaggaaauacccucaagugaaacagaccgaacaacgcagagaaacuguauauggagggggcacaagagacuauuuagggguuucuuucaaagagaggaaaagauagaaaagggucuccuggaacacagcccauuaaacugcagcgugaaaucucucuuaagcaaaauuaaaauuccuccuaaauacuaaacagcagaagcggccuuuucuuuucccccgauuugaaccugucugccacugcguuauuguuuauucucuuccauuuauuuggagagaaaaaaaucauaaacguucaaagacuguuaccguuucaugacuacuuaaauagaaacauauuucgcagaggggcuguaacaaaaacacacguuuaaauuaccagcuuaaagaagguuuuaacugcaggaucggggucugucuuuuucgcuuccucuguuaggagccuuuuucucgacagagucgauuuaugguuuggauagggaaagggggacgucaagucaagguuuaaaauagaaagauucagccuuauuggguuuaaaagagagaggugcaccccggggcuguggccccccccccccgccccuuccaccccagccccaaagggcagaagaaacgccugacuuuagguuucucuauugcaauucccuugcaaaacaagcgaagagaguugauuccagagaccgcgaacccucggcgguucggccgcaggucccgaggguagggggcacaccgcgcugcacuuuuccugcagacaguuuaagcaucaaauguugagaacaucucggggacaagugaagacucaaggaaaucaagaugaacguggggagaaacacgccuugggaagccgcggcgagguaggucugcgugcucggagaggucgagcgggggcugggguaggggguaaugcacucgauuuagggauggaaaagagcgagagaaaggcggaagguggggugggggaugcaaauggagaggguguccugaaggaaagcugggcgugaaacccgagguuucgggcagcuccacggcaccagguuuccagaauccaauuccuaaagaaacagcaacggggguggggaugggacucaccauggcugaaaaacugugaacuaacaucugcgaagagucugggguaacgagucaggguggaaaaaaacaagcaagccuggagcgcccggcugccccgccgcccgagcgcgccccacacaaaaggcgccgagagccccgcgccacccaggacuccagucacggcgccgacgcuccccggagcgcgggagcccggcucggauccauccgaacuugaaccaccgauucgcgcggcgccuucagcuggucgaacccacggucucuauccugccgcgacugguuaugauucaaaguucuuuaaaaaugaaaaaccccaaaaaaggaaaaaggaaaaaguaugugugagugugugggugcgugcguguuccuuaauccgugucucccccucuuuucuuagcggcggcuucgcuugagcuucuaauaaccgcgcugggcagcguuccuggagccuccuaauagcagauauucaugacuauuaauauuacacgaauacuuaauaagggaagaaugccuggaaaucgagcgugaagcggagaggcaacucgcgccggagccggcucucaaugcaguccauugacgggagucucaguguagcaaaucggaguggggagagggagcgcgagagacaaaaagcgagcgagagagggagcgggcgagcgcgcggggggccgcggcgcggcgucuggcgaaucacagggaaggggcaacauuuuaaaagguugcagggcaugcaaaagugaaagagaaagaggcagagagggagaccgaaggagagagcgcagagagggagaaugugucugcgugcgugugugagaaagaaagugugggcgagggagaggagccccggguggggagaggggagggagggaaggagggagagcccgagaggaggaagggagggaaagagggagggaggaagggagggagggagggggagggggcccagccggagcgcacggagggggaggccgcgggggagggggaaggggagaggaagcgagcgaggacaaucagaccuaaaaggcuggggcagaccucgggaugcagcgggggucgugcguagcggguaggagcugcuugggaccgcguccgggcgcucguggggcucucggcgcggcaggcgcuucccggcccugucuggccgcgggcuccgccgcuucgcagccgagucugggacucgggacucggcugcccgcugcugcgcggcuccuccaugacccggcgcccugcccgggaccggcccgcucgcugcacugguccucuccucggccuccucuugagcuuuccucggacaggggcaccgugcgcuccccggccaccgucgcucugcccucggcucucuggggccggggauuccggaucgggagccgggaugcgggccggggcgcgcacagacgcuaggcggcccagcccgggcgccgcuggcaccggcucgcggcucccggcaaaaacccguccgacuggcugggccacucccgccugacgcccccccagaugacacgacuagcucucccggcgugcugccuuugccagucuacccgccagguugucagaacaagcggcaccucgccuccugcgugucccuacagagccccggcacaaucagacugccccaagccagcuccgaaacccgaaauccccgcuccggcgcuugcccaccacggccaaaguuguggaaacagcuuugacuuuauucuccucucucucucaucuuuuuuugccucgcuuacacacgcauucacacuugcccccacaggaucccucuaggggugcaaguucaucccccaccuagccacccaccccauccagucggcaccuagagccgcacggagguucggaccccgcccgccgagggcgcccacaccuggagcuggguuucggccucugcgaaagugaaaugcccaagccuccggccaaagcccagaccaguacaguaugaauuguccuaugagacugagggguucggcuucauuccuaccugcccgcaaagcucgcccccagccucgaaaacaaagcgacuggucugacguggggucccugcgccccuccucuagcgcgacaggacccccccagggaagagccaguacccgugggaugucaccccguccccaucuaccgggguggggggccugaaaggagaacgauuuaaaauaaucuucagaaagaaaagggaggagggagcgggugacacaucguucacauaaacccaauuucugguuucgagugaagucaagaucuccgccccugcgccugcacacacaccuccugccuaacauucucagcugcaaaugccaaaaaagaaaaaaaaaaaaaacagcaaaaguugggacugccaccuauuuauuuagguaaucuccagcccuacacaccccaaccccucucucggacucauugcucauuacaguguugguuguaaccguucccagcgccuccugcggguggacaggucgcgcuagggucucccuugcugccucaagaaggcgagcucaggggacucugcguuuuaaaauggguuccaaagcggcgcgcucugucggcccagcgggcuugcggcaccagagguggucugcagccgcgcaaggauucccacggucguucugggcuggugcagaagcuggugcucccgcacccagcggccagcaggcucggcgcagcacaucuccccaccccacccccacacacccccguggggugcgucgauccuguagcucagagggagaagcuacuuagaacuucgugaagcacagaggaucuggagcgagccccgcagcugggaucaguggucuuaaguugaacccgcuuacaggaagaugcagcccagcucacagcgaagugugggggggccgucucuaaagccgagaagggaaccgcuuuagaaguggggguggggggaagaaagaaugaaugaaugaaugaaugaaugaauagaaagaagaaggaauauuaaagaucggagaggaaguucaagagagaaaagaguuuucucuuuccuuucuguuccuggugacuugggcccucaaucucgaugaagauaacacgaggagugcacaggcaagugcccaguugccagcaauugcuucaaaagcccauguucuucuuuucccccauucuuaggcacagccaaaauuggucagaaaggggaguaaagugggacacgagcuucaaaguagggaaaccaaagaagggagcauccacguccucucucugcagcuucucccccgcguucuucgggcgaauccgagggacgggcgcugcgcuggggaaaguuugucccacccgcguuucgcagcugguugcaaggagaggaggaggagagggagggucaagcucggagccugugaccgcacggaugaucgagccggcgucgcgcuuaccucgcaguccucguacuugauauuauccgucaauuuccaaagcauuuucauggaucggcgugaacggauaugccccucucggucucgcacccaaguggagcuacucucugggugagcgcaaagugcuggcugccggcggugagcgcaggaggaggaggaggagggagaggagguggaggaggagaaggaggagggagaggaggagggcaaggaggaggaggaggaagaggagggcgaggaggaggaggagggcgaggagaagggcgaggaggaggagagaagggaaagagcucccgugugcgcucggagaucucccucuaaugguagaaacuuuucccuuuuccagcucuuuaccaacagccuaaucgccucauuagcauaucaacaauaguccaauugcucgccaguaccacaaucugccgccggccgcuccgacacagguauaaaggccucucuacgccgcgaacuugcuucuagagcgcacuccagccugcgaacugauaaaaccuuccucgagcuccgccgcgaggcccugccccaacacccccucucuuaccccaauuccgccacauuccccuuccuuucuuucuccgcuuccuuuucuccagagaugccuucugcaaagcccggcacugcucaagguccaagcgccacgccuggggcccagcuucuagcacuucucccuuaacccugcuaccacgauccgagcugcccuuuuggccccgugcaauuuuauuagaaaucauuaucccuuucgcaauuaaacauaaccaccaaaccaagaccggcgaagucacuccaggauuuuuucccaacaagggaucgccuccgcucgaggcagccacccccucgggccgcagcgccuugggaguuuuauuggcuuugagcuuucccccagguuggagauucugccaagcggcuccgguggcucugcugggguuugcaaucccuuaauugcagcguguaaaauaaaaguuguacccugaagagguuacuugacagcuccagggguuaaacaauuuuucuccuguuugugugaagcuagggccaacugacaguucaaauugguguucaggcuaagguuuccugggugcaacguggacacgaauacagaacuccuauggaacugcacacccgcuucugaaguugagccuaaaaacagacgugugugugccugcaagucuagauaccgucucgugcgugcaucaaaauaaaucaccgggaaccgacuuuuagcuguguuaaucugcucuaguuuucccaagauuccccuuuuuaauuaaagcagggagaguuccuucaugauuuggugaugcuacuaacgcgggcgugcucgcgaggcagagcccggcugccgcggaaccuggaggccugggagccaccuacucguccagacuggucaguccgggcuuuuggacuccucaccggggccugcuggguccucuggggcuuuuaucccuuucgguuuugggauuuuuuuuuaaguaagaaaaaaaaaaaagaa

SEQ ID NO: 17265 - RNA, 7106 nt, Homo sapiens
uucuuuuuuuuuuuucuuacuuaaaaaaaaaucccaaaaccgaaagggauaaaagccccagaggacccagcaggccccggugaggaguccaaaagcccggacugaccagucuggacgaguagguggcucccaggccuccagguuccgcggcagccgggcucugccucgcgagcacgcccgcguuaguagcaucaccaaaucaugaaggaacucucccugcuuuaauuaaaaaggggaaucuugggaaaacuagagcagauuaacacagcuaaaagucgguucccggugauuuauuuugaugcacgcacgagacgguaucuagacuugcaggcacacacacgucuguuuuuaggcucaacuucagaagcgggugugcaguuccauaggaguucuguauucguguccacguugcacccaggaaaccuuagccugaacaccaauuugaacugucaguuggcccuagcuucacacaaacaggagaaaaauuguuuaaccccuggagcugucaaguaaccucuucaggguacaacuuuuauuuuacacgcugcaauuaagggauugcaaaccccagcagagccaccggagccgcuuggcagaaucuccaaccugggggaaagcucaaagccaauaaaacucccaaggcgcugcggcccgaggggguggcugccucgagcggaggcgaucccuuguugggaaaaaauccuggagugacuucgccggucuugguuuggugguuauguuuaauugcgaaagggauaaugauuucuaauaaaauugcacggggccaaaagggcagcucggaucgugguagcaggguuaagggagaagugcuagaagcugggccccaggcguggcgcuuggaccuugagcagugccgggcuuugcagaaggcaucucuggagaaaaggaagcggagaaagaaaggaaggggaauguggcggaauugggguaagagaggggguguuggggcagggccucgcggcggagcucgaggaagguuuuaucaguucgcaggcuggagugcgcucuagaagcaaguucgcggcguagagaggccuuuauaccugugucggagcggccggcggcagauugugguacuggcgagcaauuggacuauuguugauaugcuaaugaggcgauuaggcuguugguaaagagcuggaaaagggaaaaguuucuaccauuagagggagaucuccgagcgcacacgggagcucuuucccuucucuccuccuccucgcccuucuccucgcccuccuccuccuccucgcccuccucuuccuccuccuccuccuugcccuccuccucucccuccuccuucuccuccuccaccuccucucccuccuccuccuccuccugcgcucaccgccggcagccagcacuuugcgcucacccagagaguagcuccacuugggugcgagaccgagaggggcauauccguucacgccgauccaugaaaaugcuuuggaaauugacggauaauaucaaguacgaggacugcgagguaagcgcgacgccggcucgaucauccgugcggucacaggcuccgagcuugacccucccucuccuccuccucuccuugcaaccagcugcgaaacgcgggugggacaaacuuuccccagcgcagcgcccgucccucggauucgcccgaagaacgcgggggagaagcugcagagagaggacguggaugcucccuucuuugguuucccuacuuugaagcucgugucccacuuuacuccccuuucugaccaauuuuggcugugccuaagaaugggggaaaagaagaacaugggcuuuugaagcaauugcuggcaacugggcacuugccugugcacuccucguguuaucuucaucgagauugagggcccaagucaccaggaacagaaaggaaagagaaaacucuuuucucucuugaacuuccucuccgaucuuuaauauuccuucuucuuucuauucauucauucauucauucauucauucuuucuuccccccacccccacuucuaaagcgguucccuucucggcuuuagagacggcccccccacacuucgcugugagcugggcugcaucuuccuguaagcggguucaacuuaagaccacugaucccagcugcggggcucgcuccagauccucugugcuucacgaaguucuaaguagcuucucccucugagcuacaggaucgacgcaccccacgggggugugugggggugggguggggagaugugcugcgccgagccugcuggccgcugggugcgggagcaccagcuucugcaccagcccagaacgaccgugggaauccuugcgcggcugcagaccaccucuggugccgcaagcccgcugggccgacagagcgcgccgcuuuggaacccauuuuaaaacgcagaguccccugagcucgccuucuugaggcagcaagggagacccuagcgcgaccuguccacccgcaggaggcgcugggaacgguuacaaccaacacuguaaugagcaaugaguccgagagagggguugggguguguagggcuggagauuaccuaaauaaauagguggcagucccaacuuuugcuguuuuuuuuuuuuuucuuuuuuggcauuugcagcugagaauguuaggcaggaggugugugugcaggcgcaggggcggagaucuugacuucacucgaaaccagaaauuggguuuaugugaacgaugugucacccgcucccuccucccuuuucuuucugaagauuauuuuaaaucguucuccuuucaggccccccaccccgguagauggggacggggugacaucccacggguacuggcucuucccuggggggguccugucgcgcuagaggaggggcgcagggaccccacgucagaccagucgcuuuguuuucgaggcugggggcgagcuuugcgggcagguaggaaugaagccgaaccccucagucucauaggacaauucauacuguacuggucugggcuuuggccggaggcuugggcauuucacuuucgcagaggccgaaacccagcuccaggugugggcgcccucggcgggcgggguccgaaccuccgugcggcucuaggugccgacuggaugggguggguggcuaggugggggaugaacuugcaccccuagagggauccugugggggcaagugugaaugcguguguaagcgaggcaaaaaaagaugagagagagaggagaauaaagucaaagcuguuuccacaacuuuggccguggugggcaagcgccggagcggggauuucggguuucggagcuggcuuggggcagucugauugugccggggcucuguagggacacgcaggaggcgaggugccgcuuguucugacaaccuggcggguagacuggcaaaggcagcacgccgggagagcuagucgugucaucugggggggcgucaggcgggaguggcccagccagucggacggguuuuugccgggagccgcgagccggugccagcggcgcccgggcugggccgccuagcgucugugcgcgccccggcccgcaucccggcucccgauccggaauccccggccccagagagccgagggcagagcgacgguggccggggagcgcacggugccccuguccgaggaaagcucaagaggaggccgaggagaggaccagugcagcgagcgggccggucccgggcagggcgccgggucauggaggagccgcgcagcagcgggcagccgagucccgagucccagacucggcugcgaagcggcggagcccgcggccagacagggccgggaagcgccugccgcgccgagagccccacgagcgcccggacgcggucccaagcagcuccuacccgcuacgcacgacccccgcugcaucccgaggucugccccagccuuuuaggucugauuguccucgcucgcuuccucuccccuucccccucccccgcggccucccccuccgugcgcuccggcugggcccccucccccucccucccucccuuccucccucccucuuucccucccuuccuccucucgggcucucccuccuucccucccuccccucuccccacccggggcuccucucccucgcccacacuuucuuucucacacacgcacgcagacacauucucccucucugcgcucucuccuucggucucccucucugccucuuucucuuucacuuuugcaugcccugcaaccuuuuaaaauguugccccuucccugugauucgccagacgccgcgccgcggccccccgcgcgcucgcccgcucccucucucgcucgcuuuuugucucucgcgcucccucuccccacuccgauuugcuacacugagacucccgucaauggacugcauugagagccggcuccggcgcgaguugccucuccgcuucacgcucgauuuccaggcauucuucccuuauuaaguauucguguaauauuaauagucaugaauaucugcuauuaggaggcuccaggaacgcugcccagcgcgguuauuagaagcucaagcgaagccgccgcuaagaaaagagggggagacacggauuaaggaacacgcacgcacccacacacucacacauacuuuuuccuuuuuccuuuuuugggguuuuucauuuuuaaagaacuuugaaucauaaccagucgcggcaggauagagaccguggguucgaccagcugaaggcgccgcgcgaaucggugguucaaguucggauggauccgagccgggcucccgcgcuccggggagcgucggcgccgugacuggaguccuggguggcgcggggcucucggcgccuuuuguguggggcgcgcucgggcggcggggcagccgggcgcuccaggcuugcuuguuuuuuuccacccugacucguuaccccagacucuucgcagauguuaguucacaguuuuucagccauggugagucccauccccacccccguugcuguuucuuuaggaauuggauucuggaaaccuggugccguggagcugcccgaaaccucggguuucacgcccagcuuuccuucaggacacccucuccauuugcaucccccaccccaccuuccgccuuucucucgcucuuuuccaucccuaaaucgagugcauuacccccuaccccagcccccgcucgaccucuccgagcacgcagaccuaccucgccgcggcuucccaaggcguguuucuccccacguucaucuugauuuccuugagucuucacuuguccccgagauguucucaacauuugaugcuuaaacugucugcaggaaaagugcagcgcggugugcccccuacccucgggaccugcggccgaaccgccgaggguucgcggucucuggaaucaacucucuucgcuuguuuugcaagggaauugcaauagagaaaccuaaagucaggcguuucuucugcccuuuggggcugggguggaaggggcggggggggggggccacagccccggggugcaccucucucuuuuaaacccaauaaggcugaaucuuucuauuuuaaaccuugacuugacgucccccuuucccuauccaaaccauaaaucgacucugucgagaaaaaggcuccuaacagaggaagcgaaaaagacagaccccgauccugcaguuaaaaccuucuuuaagcugguaauuuaaacguguguuuuuguuacagccccucugcgaaauauguuucuauuuaaguagucaugaaacgguaacagucuuugaacguuuaugauuuuuuucucuccaaauaaauggaagagaauaaacaauaacgcaguggcagacagguucaaaucgggggaaaagaaaaggccgcuucugcuguuuaguauuuaggaggaauuuuaauuuugcuuaagagagauuucacgcugcaguuuaaugggcuguguuccaggagacccuuuucuaucuuuuccucucuuugaaagaaaccccuaaauagucucuugugcccccuccauauacaguuucucugcguuguucggucuguuucacuugaggguauuuccugaaaagaacuuagagcugauuuuuucccggcggccagccaacgggaacgggcgauuucccacgcagacuugucaaguggauuuuguguggauaguuguagcucgacgccugauuccuuguucuuuaccuuuccucucgcucucuucuaggaccgucacgacggcaccagcaacgggacggcacgguugccccagcugggcacuguaggucaaucucccuacacgagcgccccgccgcugucccacacccccaaugccgacuuccagcccccauacuuccccccacccuaccagccuaucuacccccagucgcaagauccuuacucccacgucaacgaccccuacagccugaacccccugcacgcccagccgcagccgcagcacccaggcuggcccggccagaggcagagccaggagucugggcuccugcacacgcaccgggggcugccucaccagcugucgggccuggauccucgcagggacuacaggcggcacgaggaccuccugcacggcccacacgcgcucagcucaggacucggagaccucucgauccacuccuuaccucacgccaucgaggaggucccgguaagaggccgcgcaaccagcgcgggagggaacacagcccccuacuuaccuaccccagaaaggauaccuggaacauacagucggugggcccggguucucccuaguauuuccuuauaaaaacauuuuauucggaggcggagagugagggacguuuugaggaaccacacaaaguaguugcgaguucuaccccagaacaaugguuucuggagcucccucaaacaaugccugcauuaccauuuccaccaacacagauaaaucagacgaaugucaccauuaacaauaucuuccucucgacgacaguaaacugucucaauugcuaaaagaucuacuuccaucgcugagucuggcguggagauuucucccuguccugggaaugauguuaaaugcaaccaaaagagcucauuaaauguccucaaaauguaaaaggaaguguaaaagacacacuaagaucauuuuaaccggauuuuauaagcacaagugaaaccuaaaaguuauguguacacccuauccugauuaaagaaaaacuaaguagcaaauccaagcagagggacauuaaaaugca

SEQ ID NO: 17266 - RNA, 38063 nt, Homo sapiens
cccgaguccucgcucgggggccgcgcgaggacggcgcccggcccccuccccuccuuccuccguccgccguccucaaugucuccccggcggggagggggcugccugggagacacgcugagcggcccccccacggaggcccuccggcugcagcagcagcagcgcccggcccggcgucccgcagccuccaccagcggcggcggccuggaggagccgcgcacccgccgccgccccccgagccucgcagccgccgccgccgcccggcacccgaggagagggcggcgggcgccccucggggaagaugaaggcggaggggggcgaccacuccaugaucaaccugucggugcagcagguccugagccucugggcccacgggacggugcugaggaaccucacggguaauugacgcgccugggcuggggacggggaugcgguccgccccucuccugucuucuccuuccucgggaggggacacgcuccucgccgccccacccccgugcgcgccccgcucggagcuccaggucccggcgaggaagguguuaaucggagccacucugcgcgugucccgggggcgccggcucccgccacccccuucccugagucgccaggggagcaucagcgacccccgcuccugccccgcacggggagagcucccgguggcggcccggccucuguaguacgcgcggaguagcuuuagugcugagacuugagcgcauuucgcuuuuauuccauuacccuccuccccucccccuucuacacacaucgcuucuugcuauuuacaucuuuuucugauuuaguucuuuuucuuucuggcaaaucucaagccaaauguagaaccuaaaaucauugcccacaauggucgauuuacuuuuucaaccgcuaauuuuuugggcgauguagauaacugaguaaauuauagugggucaggggcugagcuaaggucuagugcggucuaagcguguuagcuucauauaucuccuuccccucccauuuccuuuugucugucugucucuuucccucaggccuccagcugcugcuucugagacauuugauaauuuuguguauuucccuucauuuauuaaggcugucaguaauuggccuuauaacaucaauuucuauuuguaaaagugagugauaaaacacacaauauuuuuauucagucuguagauuugcuuugugaagaaacuucugguuuuguuauguggaaaugcuuacauuauacuuugaguuccgaauuuaaaaauuauucucugaaguagaauuuacgagaaagagauucaguugcgauuuggugacuccucagugccugcuuuucagaggaaaaaaaucuuaaaaaaauacucagaauuuaauucuugaaaauguguaaggcaguuaauuucaguagaacauuaguauuucaaaaugcauuuugucaaacugguuaaaguguugugaguauuuuacaaauauaaccuggguucauauauauaacauauauauaaagucuggcaugguauagaauacaaacauucauagaagaaaauuuuauggaauuauauaccacaaaagacaacuuuaaggacacugguuucuucgaauggaaacuauacaguuaaaguagauucuggauugcuucaugcuauccucacuuuuaagcugugguuauuuaacuugaaacagacugacuuuacaugaugauugccgguaaggaauauauuguuauaauucuggaaaacuaaauggacauaaagaccaucucaugauucaguugaauuuagagguagacugcuuuaucuuacuuaugauuuugcuugcauuuauccacuguuugguauuugaacuguaccaguuuuuguuuaagugaaaugaaaaguagggacuuaacauauauuugugcaggcauaccuuggaaagauugcagguuugguuccagaacaccacaauaaagcaaauauugcaauaaagugagccaaaugaauuuuuuguuuuccuagugcauguaaaaguuacauuuuaccuguagucuuuaaaugugaaauagcauuaugucugaaaaaaaaguacagacguuaauuuaaaaauacuuuauugcugaaaaauugcuaacgaucaucugagccuucagcaaggacguuaucuuuuuucugguagagggucuugucuuuguguugaugacugcugacugaucaaggugaugauugcuggagauugggaugauggcaguuuucuuaaaacagcaaugaaguuugccacuaaggaagagcaauagacucuuccuuucaugaaagauuucucuguagcaugggaugcuguuggguagcauuuuauccacaguagaacuuucaaaauuggagucaguccuuucaaacccugcugcggcuuuaucaaccgaguuuaucuaauagucuaaauccuuuguugucauuuccacgguguucacaugaucuucaccaggaguagauugcaucucaagaaaccacuuucuuugcucauccauaagaagcaacuccucauccauucaaacuuuaucaugagauugcaacaauucagucacaucuucaggcuccacuucuaauucuaguucucuugcuauuucgaccacaccuaugguuacuuccuccacuaaaguguugauccccucaaagucauccaugaggaauggagucaauugcuuuccaacuccuaugaaaguugauauuuggaccucuucucaugagucacgauuguucuuaagggcaucuggaauggugacuccuuuccagaagguuuucaauuuccuuugcccagguccaucagaggaaucacuaucucuggcaguuuuagccuucuuacacaguguauuucuuaaauaauaagacuagaaagucaaaauuacucuuugauccauggucugcagaauggauguuguguuagcagucaugaaaacaacauugaucuacuuggacaucuccaucacagcucuugguugaccagguacauugucauugaagaaaauacucauuaaaaugaaaggaaucuuuuuuuuuucugagcaguucucaacagugggcuucacauauucaguaggccgugcuguaaacugauguacugucauccaggcuuuuuuguuucauuuauagagcacagccaggguagauuuagcauaauucucaagggcgccagaaugguaaaugagcauuggcuuuaauauaaagucaccagcugcauuagcuccuaagaagagucagccuguccuuugaagcuuggaagucagggauugacuucucucuagcugugcaaguccuaaauggcaucuucuucugauauaaggcuguuuaaucuacauggaauaucuguuguuugggguagccaccuucaucaguuagcuagaucuucuggauaauuugugcuucuacaucagcauuugcugcuucaccuugcacuuuuauguuauagaggugucuuuuguuaaaccuaaagaacugacaucugcuaguaucaaacuuucuuuugcagcuuucucacaucccagccugcauggaauugaagagaguuggggucuuucucuggguuaggcuuuggcuuaggggaguguuguagcugguuucaucuucuauuuagaccacucaaacuuucuucauaucagagagcagucuguuuugcuuucuuaugauuuguguguucacuaguguaacacuuuuaauuuccuuuaagaauuuuucuuugcauuugcaacuuggcuguuugguacgagaggccuagcuuucagccuaacucaucuuugaacgugccuuccucauuaagcuuuaucaucucuagcacuugauuuaaagugagauaucugacucuuuuuuucacuugaacacucagaggccaauguaggauuauuaguuggccugauuucaauauuguuguaucucagggaauagggaaacccgaggagagggagagagacugaggaauggcugguugguggagcagugagaacacacaagauuuaucgaguaaauuaucgaguaaaauaguaacaucagagaucacuuaucacagaucacuauaauaauaaaauacaauaauaaaauaauaauaagauaauaaaauuugaaauauuguuagaauuaccaaaaugugacacaaagugagcccaugcuguuggaaaaaugguacugauagacuugcuugacacagaguugccucaaacuuaccauuuguaaaagccaaaauaaagugaaguacaauaaaacaagguaugccuguagauauuaaucacuggauuagcucaucaaaggguuuuuagagaaaguuagcuuugggagccauagaguaaauguaaauguaacuuaacuccuggccagcuucaacaauauuuuuaaauaaguaagauucuaaugauuauaauugccuccaguucugcaagucaaccauuaagcugauaauaguaguuauucauccaggguuagcuccaauaugucuuucaauaugaucuuaauacuugccaguugcucauuggaccuugccauuucauaaaggauaugccgaacaucccaaacuaggacugaggcgggacugaggaccaugggaaccucuacuaggaaauaacuacugucugaauaugugaaauucuaggcgucaggauaaaaaugcagaaagaaacagauuagaaauauguuucacuagugguagaguguaccacguuaggaaccacaucucuucucaacaguggcagucuauaagugauaauauucugaugggauucauuguggccuucuccaugccagugaccuuagugauuugguguguaucuuaaucauuaguuaacagaugcugccuacagugccauuuacaacuuugucugcucaaaagaggcgaguaaacacaacuucugaaacaucugucauuuguugaauggccgcuguguguuaggcacuuuacauauauuauuucuaaucuucagaauaacucuucaaaguacauuugaaaggaaacucagagagguaaauuaaauugucccaaaucuuauagcuaguauaugacugagcugggcuuuagacccaagucuuugccucuagacuccucuuucuucuuuaccaugcuacuucagcuacuuccuccuuacuuucuucacgcaaaauuaauuucuugcuucaucuugcuacuucugcucuuuguacauauuuuuauuauguuuuucaauuacguuauaauuuguauuuaucucuucuagacugugagcuuuuugagggucaguccauugccucaccuuugaauucuuauacccuagcauuauaguaccuggcacguaguaaaugauaaauauauguuuauugagaugaauuuuuaaaauuuuaacaguugcuugauuuaaacauucuauauugcauuguuucucaucugcaucucuuggagugaauaugcuguuaaggaagaaugaaguguuuaagcaacucauauaaaucauuuuuauacauaccuuuaaaacaugcaaaugcuuauugagaguaguuuucuguguuggguauaaugcuuucauauauuuuguuuaaucuuuuaggcaauccugagagauuauuguucuuauuuuacagauucagauacugaagcaaagaguaacuugcuuagaucugauagcuaauagugaaaaagucauuaucuuuuuucauaauaugauaacacauauguuaacucagaaggcauuuuuucgucaucauaaacuuggaaaugaaacuaauagaaaggagcauagucuagaaccaguacuacuuggauuuaagaaauaacugugugaaggauuugcacaaauuugcuuaauaggcauucugauuaauuggauaccaaaugaaagggaaauaugcugucacuaguguuuuuuucccauguacaaagagaugugaugugauuuuucaccuuguguauuaucccaauaggugaagugggaaaauauacugaccuuuuuaucuuagagacugaccucuagaaaguagucuuguuuauauauuacuuugauaaaaauaaauucuuaaaaaguaauaaugagaacuacaaacaucuuaacauuuuacagccagaacgacuuaauuuuagaaauauugaaauaucacuccaucagugaagugacauggcugagaucaguuauuuaaugacagaggcaggacuggaaccagaguuuccuggaccuuuguucucugccuuuccuuuuucuccuacauagcuuguuaacucaggcaggucgagagagaauaaauauuacgguacagguugaacauuccuaaucugaaauuuugaaauucaaaaugcuccaaaauccuaaacuuuuugagcaacaugacacucaaaggaaauacuagaacauuucagauuucggauuuucagguuaaggaugcugagucaguaaauagcaugaaaauauuccaaaaucugaagucugaaauccuucuggucucaagcauuucagauaagggauauucaaccuguacuuaaaaguacccugguaaguguuugcaucagugagccugaagauguaugaauggaacuaauuuguccagaaaauaaaauauacuggaaaauguaauauauuaggcuuucuaacauuuuaaguugccauugcccuuguaaaagcuagugauccauauucauuaucuagccaguuuuagaacuccuaccaaguucagccugcuauuuauuuccccuaccuuggaagacacuuguauggggauuccauguagagcauacuaaucccucgaaaccccguaucugucacuuaauaaccauugccaaaauucucuuucuguacauaucacuucuuuaaguguguuuuucacaggauuccuaaauuguuuaacugugucaguuauaugcuucugaaguagagagauaaauagcuuccuuucuuuuucaaauagauuuucuuucuuugaauauauucuaaauucccaaccccaaucuaaaaugagagucaauauuguauauacaguuuuuuagguaacuugacuuuuaaaaaaucuacaauuaaauguuuuuuuuuuggcuuuacuuuuauuuucuuuaacuauuuuggcuuccaucuuaguguucugacccaaauuugguugcuaagaguuuagagaagaauuuuuauuuagaaaagggcagggucuguaaaucccaguauaaaugcaaaacuuggcugguguuaggaaagggauaauuggucccugggaaaaagaugagggcugcuucaggcuggucucucugugucagcagcaaauguaggggcagguguucccuucuuuuuauugguaauaagcauugggaggcugggaauucaaccuggaaugaagguuaaaaggcuucucucucucucucucuguguguguguguguguguguguguguguguaguacuaguaguaaguaguaguaguaguaguagucccguuuauucaaaggcaauauguuccaaaacccccagugggugccugaaaccauggauauuucugaaccccauauauacagucaugugccauguaacuuuccagucaaagaaggaccucaugugaugauggucccauaagauuauaauggagcuaaaaaaauucugucaccuacugagaucauggccguccuaaugucauagcgcaacacguuacucacguguuuauggugaugcuggugucaacagaccuacuguacugccuguuguauaaaaguagagcauauauaguuauguacaguacauaauacuugauaacaacuguguuacuggcuuauguauuuacuguacuagauuuuuuaucauuauuuuagaauguaccccuacuuguuuaaaaaaaaaagcugaaucccagcacuuugggaggccgaggcagguggaucacgaggucaggagaucgagaccauccuggcuaacauggugaaacccugugucuacuaaaaaaaaaauacaaaaaauuagccgggcgugguggcgggcgccuauagucccagcuacuugggaggcugaggcaggagaauggcaugaaccugggaggcagagcuugcagugagccgagauugcaccagugcacuccagcuugggcaacagagcgagacuccgucuuuaaaaaaaaaaaaaaaaaaaaaaaggcaagcuguaaaacagccucaggcagauccuucaggagccauuccagaagaagacguuguuaccuuaggagaugccagcucccugccugucauugccccugaagacuuuccaugggacaaaguguggagguggaagacagugauauugaugauccugacccuguguaggccuaggcuaauauguauguuugggucuuaguuuuuaacaauuuuuuuuuaauuuuagaaguagaaaaaguuuauaaaauuaagaauauaaaguauuuuucauacagcuguacaauguauuuguguuuuaagcuaaauguuauuagaaaauaguuaaaaaguuaaaacuuaaaaguuuauaaaguaaaaaaguuacaguaagcuaagguuaauuauugcagaacaaaaaauauuuuaaaaauaaauuuaguguagccuguguauaguguuuauaaagucuacagcaguguacaguaaugucugaggccuucacauucacucacaguuucaccuggagcaacuuccaggccugcaagcucuauucaugauaacuuccccauacagauauucauuuuuuaaucuuuuaugcuauauuuuuacugaacuuuuuuauguuuagagacacaaauacuucccauuguguuacaauugccugcaguauugaguaaaguaacaugcuauacagguuuguugccuaggagcaauaggcuauaccauauagccuaaauggaauauauguuagcuuauaccaucuagguuuguguagguacacuguauaauauuugcacaauaaugaaauggccaaaugacacauuucucagaauguauccccgucauuaggcaacacaugccuguacuauguuuuuuccuacacaugcauaccugugauaaaguuuaacuuagaacuuaggcacagucagagauuaacaacaacaaauacuguaguaaaaguuauaugaaugcggucucucgcucucaaaauauuguauuguacuauacuuaucuauguucagacaauauucgauaguggguaacuguaauugcagaaagugaaacugcagauaaacgaagaguauuguauauauguauauuuaggauauguauacacaugcacauauacauacuacaucauaguucccuuuuaggcauuauaguugcuaagccauuuuuguuucaauauuuagugucagucaaagaaaaaauaaaagaaagugaauauuuaguauauauauuuggaauuguucacauucauacugguauagucagcaccuuccuucaauagcguucccaagaaggcaugcuucucuugggguuacucuguauucuagcuuaccauuagguuaaguuccucuuccuaaaugcuguauuauaggaggugagcuuaaguagaaaaaauuacuucaaaugucuacuuagaguuauuuauguuuuguaaaugugcccuaaagauauaugcuacuuuucaguauuugugucagaccuccauuuuacuuuuuuaaaaaaugugaaaaguccuuacccuugauagguacagagucaauuaauaagugccaguaugauauggccuucauaggauuuaacuucuuaggaggcuuaccuguauaucuuauugagaaugaaaaugcuauaauuuuuaaaaaccgaaauugucauuagggauuuuuuuuuguuuuuaccauuugucauuaaguuuuuauuuucuuaauuucugucucauuauuuuugaaucauaaauucauauccucuagcaauaccaaguccaagguccagaugacauuucuucgaucugaaccauuuucuggauaugucuugggacugcuugaguuauaauuuugauucuuuaauauuaacuaugauaauaaaauguauuuaucuuuguuuaguguuugaaaggaaggucuaagaaaguaagauaguucaugaagaggagucacaauuucuagggauauguuuucuguagaaaagaaaccuaaacagaagagagaggagguagggauggggacaaggaauugaaacuaaggaaggaaauuggcaacaaaagccaaaauugagaaaugggaucucuaauuaaacuaaagagcuucugcacagcaaaagaaacuaccaucagacugaacaggcaaccuacagaaugggagagaauuuuugcaaucuacccaucugacaaagggcuaauaucuagaaucugcaaagaccuuaaacaaauuuacaagaaaaaaacccaucaaaaagugggcaaaggauaugaacagacacuucucagaagaagacauuuaugcagccaacagacacaagaaaaaaugcucaucaucgcuggccaucagagaaaugcaaaucaaaaccacaaugagauaccaucccacaccaguuagaauggcgaucauuaaaaagucaggaaacaacaggugcuggagaggauguggagaaauaggaacacuuuuacacuguuggugggacuguaaacuaguucaaccauuguggaaaacuguggcgauuccucagggaucuagaacuagaaauaccauuugacccagccaucccauuacugguguauauccaaaggauuauaaaucaugcugcuauaaagagacaugcacacguauguuuauuguggcacuauucauaauagcaaagacuuggaaccaacccacauguccaucaaugauagacuggauuaagaaaauguggcacauauacaccauggaauacuaugcagccauaaaaaaggaugaguucauguccuuuguagggacauggaugaagcuggaaaccaucauucugagcaaacugucgcaaggacagaaaaccaaagaucgcgugcucucacucauaggugggaauuggaacaaugaaaacacuuggacacaggguggagaacaucacacacuggggucugucaugggguggggggaagggggagggauagcauuaggagauauaccuaacauaaaugacgaguuaaugggugcagcauaccaacauggcauauguauacauauguaacaaaccugcacguugugcacauguacccuagaacuuaaaguauaauaauaauaaaaaaagaguggucagagguaagaggagagcccagagaguguagcauguugaacuuauuguaguaucagaugaauaagucuacugauggcuauauuuauugaaaccucacuguguaucagacccuauauaaagcauuuugcaugcaucucauuuucuauaaagugagcguauaaauuuauuuaaaauaugugauaucaggugugauagguuaauuuuuuauuuuaaaugacuaacuacaugaacaguaaaauaaucauagaauaaacaguggcaguaccaacacauuuaaaagaagccucaggccaggcacgguggcucacgccuguaaucccagcacuuugggaggcagagguggguggaucacgaggucaggagaucgagaccauccuggcuaacauggugaaaccccgucucuacuaaaaauacaaaaaguuagccaggcguaguggcgggcaccuauagucccagcuacucgggaggcugaggcaggagaauggcaugaacccuggaggcggagcuugcagcgagccgagauggcgccacugcacuccagccugggcgacagagcgagacuccgucucaaaaaaaaaaaaagaaaaaagaggccucauuagauugucacauuccaucucaugacuuuggcuaaguagauuaagcauugaaagaaaaagauuuuuuucaccaaacuuuaugcaaauaggaagaacacaauuucuuacuggaguccaguugcuuguguuaugauaaucauggaauauaaucuaagagcauauaucuacuuguuguaguaggacuugaaaaaaaugaaaauagcuuugaggaauguagguuacuagaucaauuaacauuagcuuauuaacauacuccauuacuccccuucauuugguauguuaucccauauacuuacauguacaucaauuuuucuaacuuuuuauaaauaaagacggggucucgcuguguugcccaggcuggucucaaacuccuggacucaagcagucugcccaccuuggccucccaaaaugcuaggauuacaggcacgagccacagugcccugccucuaauuuuuuucauaauccugucguggcuuauauaauuuuuuuuuuuuuuuugaagcagagucucacuuugucacccaggcuggagugcuguggcgcagucuuggcucacugcaaccugugccuccugaguucaagcgauucucuugcuuccgcccccaaguagcugggauuauacaggugcccaccaccaugcccagcuaaguuuuuuuauuuaguagagaugggguuucaccauguuggucaggcuggucucgaacuccugaccucaggugauccacccgccucagccucccaaagugcugggauuacaggcaugagccacugugcccagccaauuucuuuuuuuuuuagccaacgcuuuacccugacggauuguaugauucuuauauaaaaaaacguauacccaggguuuugguacuaaggaaggaaagugauguauuuccuucuuagaaauuuuacuuuuaguaguuaacauuucuuuaacaccuuuuaaugugcuuggcauuguucuaagaauguuacauguauuauuucauuugagccucacaauaaucccacgagguagacaccauuauuaauucaguuuguaaaagugaggaaacaggcagagauuauuuugcccuugcuuacggagugucuaagccaugacuugaaaaauuaccacucaacugcaguucaguugagcaaacauuugaguaacuuuaccauggacauggugcugucagagauacaaagauaaauacauagcgacuauuuucaagaagcuuauauucuugaguauuaacuuauacaucuuuguauuaguuaucuauugcugaaugacauuacccccaaauuuaguagcuuaacacaagacacauuuauuuucucauacagucucugauggucaggaaugcugguucuggcucagggucuuacaguguccagucaagcugucagccaggacuacugcauucucugcagacuugucuagggcuggggguucagcucccaggggcauucauguggcucuuggcagguggugggaggccuucuccauagggcuacucacaacuguuuuuuucagaaugagagaucacacacacauagacacaaacacacaguaagagaaaccaaaacagaagccacagucuuugauagccuaaucuuggaagugauauaccaucaugucugcuguauucuauuggucauacacagaccagcucuggaacauugugcgagcagacugcacaagggugugguagggacucuugaaggccugcuggaugcuggcuaagacagucuuaaagguggguauggggagaaaggaaugaggcuaagggaagacuaggggcaucauagcaggugagggaaugaagugucuguaaaaacaaggugauuagaaaaagcagaaaacugucucgauauguaaaaucauguuuaaauagcacagucuagcauuuucaaggauuaauccugauauuucuugauuauaaguuaugugccagucucugugguaaacacugaugaacaaaagugaaaaugucagucauuauccauaaggagcucagugaucuagagaagcuaaccuuuagauuaaguaauucuuuuguggcuuguugaguucaggaagaaccaggcaauggaacugugaagacagcacaagaagagguuaagaguggagcaggaaccuguucaugggaggguagagaggcaggagaggugaacugccuauggguugguacuaccaggacaugauuauguugcugcucuugggugccuuggaaagcaaagauguuuucaucaguaauaugaaacuggauuuucauuauacaguuuuuuccuucugucacucccuaccaugaauuacgugaaucugucaugguuuccaggccugcguaucagaaucaccuggaacuguucauacagauccauggcuccagucgauaaauguggaauuaggaucuuagaacaaggccuaggaugcugccuuguaaaccaacucuucaggagauuuuguuauugagagcuuagugguugggaacacccgauuuuuuuaaaauuauuuuuugugaucaauuuauagcuaucuuaacgauguauaauaguuaauaugggagauuuggacuuauuaaaauuucaguauaaaugacucacuuauuuccaagagcauaugauaacccagauuuuuuuuaaagugacuugucuuuuaacagauuauauuaaauuuaucuuuugagaauguuuucuucauuuguaugcaguauuagccauagaaaauuauccuuacuaaauuauaauacaguuaucccugagugucgucauccaaaagaccacuaggcuggcuaaauaguagaaaggauaguuuuaucagcaauaucaauuugcaaaccaggaagagacagucucugccaugugcaugugcagaaagcacugucucuucauagaagggaaguugagguuggguuuuauugccucucagaguuuguauuacacaauagagucauacauauucagcagguuugggggaaaagcuauacauauuuaugagaggagcugagugcaugcucaguggguaaacauggguaacauauauucucuguuuacuuuggggcaagguuuuagcauuaaaaugagguagaauuugacugugucagaaggugaacuaugggaugcaaaggcagucugugcacagucucuaugguauaguaugacugguagagacuggcuuaaggucuacaauugcuuaucagaaaagaacguuuauaaggcugguccugugucuaaucagaguuguggucuggguuguaaaucaguaagggguggucugauagcuccuauugucagggaguuuagagccauaggacuuuagaaauucgccaugccgccugggcccugaacccuugaccuguagguaacuuugcuuccuuaaucuuaguuucggucuuaguugauaaagaggugucuauuuugaucucaaaguauauaugggggauugauucuaggaccgcugcauauaccaaaauccugcaguggcccugcagaacccauguaugugaaaagucgaaccucccuguagguggguuuugcauccuuagaauauuuuugcuccauguuuaauugaaaaacaaaaauccacauguauguuggacccaugcacugcaaaccugcauuguucaagggucuacuguaucuuaaaaauucuaaacauuuuaguuauauuaaaucugaaguauauaggagaaucaaacauuaaaaauguuuauguaaauauguuaggugagcagcuauuggaauuuccaccucccuucuuggauaauugggguucugcuaaauuuuuuucuaaaaauaaagauuugaaagaaguaauaggauccuugaauguaugagucaaaaaauuuuuuagccucaacuucuacuagcuaguuuuuuuuacuuuagacaagucauguauuucccaggccuguuuccucacuuauaauacuaucuaauguaaauaguuuucauauugauuaagggagagcugaucuagaaauuuuaugaguuaagaaaaguuuagagguuuuacuaggauuuaagaaaaaauguaugcauuugcacauaaacuuguuucuuuaaucuuucaaguuaagcaacuuucuuuuucaagugggacuucuucagacuuuuaauauacuuauuuguagaguaagguuuagaaccaagaaaaucuuugcucucugcacaccucugaccucuuagacuuaggccuucuugaaauuugguuuaggaaacuugauucaguauuuaaagauuccuuccaguuaugaaauuaucucucucucucuuuuaaucccaguacagcauaauuacuuccuuacaguuagucugaaugcuauuuaaggugugauuaccgugacuugacuuugcauuauuugcaguuucccugguuaugcuuguauuuccugaucggucauuccuuugguuaccuauuuauauuuaguuucaggaauguauuauauugagaauuucauuacaaguuaugcucguugguguaaaaaguuuaauuuucaguauuuaguauaaauaucccauggaaauguuauauuaugagauuguaaaacauuuuauccuucauggagaagguuuuuuuagguuggugauucaaacaaacaugaaucaaaaaauguuuuuuuguaugauacauacaauuuaagauacuugagggcacacaauaacaauuaaaaccauuguaugguuacuguuauaauuucauacuagauucagauuuugacauuuaauccuuacacuuuuuaucugaguaaaaaucacuggaauuauaauugauuaauuacucaguuaaucaguuauggggaagaacaaauugaauggcaucuuuuaggaagacagugcuguggcuuaaauauagagcaauuuuugaacuauuuuaaauagccuuaaccugauuucuuuaaagcaaaugauauuuugauugguuuuaauuaaaaaccuguuuuucuaagaauugucuucuguuuaauuauggguauuguuauuuacaguuugaaauuauauaauuagcaagcaaaaggguaauuugguuuaaguggcuaauaaacaguauugccaugaauuuuaagaugggcacuauguuaaagcagcucuugaaggugucacaauuaaguuuaaaagauaauguuucugcucucucuuaagaggcaaaaguaggaaacuauuaaguaucuacaguagcuuuaacuuauguauuaaaugugguugccaguugauaaauacaauuuauuuuuaagucugguugaaauguuagcgugauuaaaaauaagaagaaaaugucuuuuauguuuaccuucauuuuagccuccuuuguugauuauuucuugguguaaaguuugcaucugguaucauaauccugucuaaggagcuuccuucaauauauuuuguagcauagaucuucuggcaguugauucucugagcuuuuuucuuucugacaaauaaauguucauuucaccuuuaguuuugaaagacauuucuguugaauauagauuucugucuuuauaguuuuuuuuuccccuuucaguauuuuaaagaugucacucuauugucuucuggcucggaaauuucugauaagaaguuuccuuuacuuuuuauauuuguuccacuguuuguaauaugucuuuuaaccucugacuacccucaguauuuucccuuuaucuuugguuuucacgcauuucacuaugaugugucuagguaugugugugcgugguuuauuuuuguuuuguuguuuuuugguucuuggaagugggagguauuuaucuuaggauucugugagagucuuggauuugugguuugaugacuuuuauuauuuuugaaaaauuuucagcaucuuucccuucaaauaucuuuucuucuccauugucucuuucuuauucuggacuccaauuacauauauguuaaaccauuugaaauugugccauaucuuuuuuucuaaacuucuagcauuuucauuuggcucucagaauuuccaucucuacugaaauucccaaucuguucauguguguugucugcuucuuccacuagagacuuuaacauauuaacaauaauuauuauaaagucucugucugguuauucuacaaacugggccaucucugacucugguucuguagauugcuuuaucucucaacagugaguuguuuuuccuguuuuugagugcuucuuuuaauuuuuugauugaaaaagucucacuaaagacugagguacaaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguggcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaaaagacugagguacaucguguuuaugucuggagauggucuguugcuuccguuagaccaauagugagaauugauuuaaucuacuuaggaguugagcugaauuugaauuuuguuguugugguuaccuucagugcacugcacgcuucacauucuguaagguugcuguuguugccuugugcuuagggugggagcucuguacugcaggguuauucucaguggcaaugcuccauuguagcuuuuagccauuucuucacaacuaugccucaaaaggggucucucuccacacacuagccuccccccagugguggaaugcugaugcuuguuacuugcugcuaggcuccugaggggagcuguccuguuucuguguuaggcaugcucuguguauggggaucucaggagguggggcuuugucagcauuccugccuuucugaaccaugguggccaaacucuucuuacauuugugauuguucuuaggaguuucucguccuuccaucggcaguaacagaccucugcuuggaauuggguccuggguccuggaugguuuucugcuucucucccaggaauagagguuuuauucuucuacccuucccuaaacuggaguucuacuagagcuuugccugucccuuuagggugacaggauuugcugcccuccccuaauggcuaaggguuuugccuugaauaagagaagggucgcaagaaacaagauuucuguguuucccuagcagucaccucccgcaggccuauaccaccagugguggcucucuccagucuccagccuaugauccagucuuuccagggagcacucaguagagaccuguggaaaagcacuugcaagcgagugugcauuugugucugucacuugugucauuuacucaagguugauauguuaacccaugcuuggucuuuaacaaucuguaaaaauuguagcugauuucuucuuacccacuuguauguugcccacugccugcucuugugcuuuaccagguaacacaugucccccacuccuugcuuugcauccucaccucacuaaugagcuaaggaaaaguuacgauuguauaauuuuaucuuuuucucauuggaugggagugacauuuuuugcaaauuuuuauauuaaaauuuaaauagaauaacugaacuguuuuaguaagcauagauuuuaaauucuacaaaaucaugcauuuaggaaaaaauuggggacacuacaaaccugaaaugaaugcaugcugggcuuaauaccuaggugauggguuguuggguguagcaaaccaccauggcacacauuuaccuauguagcaaacaugcauauccugcacaugcaccccagaaauuaaaaaaaaggaaauaaaauaauuuaaaaaaagaaauuuagauauuuuuagaacauggucaguaauguaauugugcagguaaucuucacauuuuuguacuugguauuuuccuacuuuuaguuucuuuacugcuugcuucucaccaguguuugaacaguaugguagauggacuaaacguacuuuuuuauacucccaaaccuaauggaauuaucauuuauccaguuguucacaccagaaaucugggaggccagacaucacaccucgcucaucucuaucauccaggccauccgcaaguucuccuaaauauuucucaaauuauuuucaaucacaaagccaguacaaaaauccaggccuuaauuuaucuuuguacucuuuaaaaugguuauuauuuauucauuuauuaucauuacuauuuuuuuuaaagugacagggucucacuccauugcccaggcuggagugcaguggcacaaucauagcucacugcagccucaaacugcugggcucaagcgauccuccugccucagccuccugaguagcugggacuaugggcuuaugccaccacaccugaccaaucucuuuguacucuugaaauauucuuauagucucucaucuccauccauucccacuuuuccauaucuaccacaguaaucuuuuuaaaaggagauaugauucuauaacuucuuuauuuaaaguuuuuauuggguccccauaaucuucaauuuucacaaaaauucuucauucuauauggucuaugagccucuccccuuucuucaccaaaaauuacucugacucuaacauaccacuguaauuuacagccucaucuuaccauauuuuuugguuuuagucaaacccagaauucuugcaauuucauauucucuauuauauacaauuucaugauuugaacauuguguuuuagagcagugguuucucauucuuggcuguaugggaacauaagaaacguuuaaauuugggcaacuuuaaaaaauuccagugcccaagcuacaucguaaaccaauuaaaucagaaugucugggggugguaucaaggcaucaucauuuauuuuaggcucucccaggugacuccagcauacagccaagucccaccucccacuccccacucuuaucgcaccuccaacaugauuaucuaauuuguuuaaaucuuguuaauuuuuuaaaaauucacguguggcgaugacucuucuugggaccuuucuugacaacccacacccuugccacagggcuguguaccccauagcaucacguacauacuguacucugcagaaacugaggaauuagaacauauguaauugaaaugucauuaauugaacacucaaagugccaacucuugauaauaugugaaacuaccuugacuauaauuuucaaugggggaugggacagccaagcccagcccagaagucagcagacauuuucuguaaauacaguauucuacuuuuagcaauaguauuuuauuuuacuuaaauagaaaauguaguaaauauuaauauuuuuggcuucaugggccauauaaucucugucucaauuacucagcucugccauuguagcuugaaaguagucauagacuacuaugaaugaguuuguuccaauaaaacuuuaugaacacugaaauuugaguuuccuaugauuuuuacaugucacaaauuauuguucuuuauauauuuuuuucuuuucuuuucuuuuuuuuuuuuuugagacgggguuucacucugucacccaggcuggggugugguagcaugaucaugggugacugcugcagccuugaccuccugggcucaagugauucucccgucucagccuccuggguagugagggaccacaggaaugcacaaccaugccuggcuaauuuuuuaauuuuuuguagagacagggccucaugcuggucuugaacuccugggcucaaacagucccccugagucagucucccaaacugcugggauuacaggcaugagcuacugugcccagcuucuugauuuuaaaaaaucauuucaaaaucuaaaaaccauucacgaagacuauacagagacaggugguaaacuagaugugacucaugggcuauauuuugccgacccuugaucuguauagcacuuuuccaaauuauaaauguaucaucucucugagagucuaguaaguccccuaugugggacauguccccaaauucagaagucauugcuguuagaaaaugggugcaaguucuacacuucagauuuguugguauaauaaaaagcuugaaauaacccaauuuggacacagauuauuuaaauauguaauauggaccauuucuauaaagaaggugaugguauaaagaaagaaaaaauauauauauaaaauauauaaaugguauuuucagcuugauuucuagaauguuuagugcauaguaaguuuucaguauugacuugcuaaugacuuuuaauagagagguuggguucucuguauuuuugaggauuaaaaaaauagucuaaugagauagguuuuguuguuuuaaugacuuucggaguuuuaaauaaauaccucuuauguaacuuuauccuagaguagugauuucugucucuacugcauacccaguaugcaguaauucucaugagcagcucaaguugagaaccauugaucuagcagagcaucuucuccuuuauuuuuauuuuuuuauuuuuuauuuuuuauuuuuugagacagucuugcugugucgcccaggcuggagugcaguggcguggucuuugcucacugcaagcuccaccuccuggguucacaccauucuccugccucagccuuccgacuagcugggacuacaggugcccgccaccacgcccagcuauuuuuuuuuuuuuuuuaauuuuuaguagagaugggguuucgccauguuagccaggauggucucgaucuccugaccucaugauccaccugccucagccucccaaaucuucuccuuugauaaagaauagaaugagagccaggcauaguuguacaugccuguaguagcagcuacucaggagacugaggcaggagaaucguuugagcccaggaguuugaguccagccugggcagcauagcaagacugcuaucucuuaaaaaaaaaaaaaaaaaugaaaaacuaauuucuaaaaauauuauauuugcaguaaaaauguguguaaaauauuucagaccaguuuaaaauaguaaagaauguauaaaaugauaucauucaucucauaucuuaucucuaaaagccauuguuaggucuucuuccauuugguuauauguuuucuauacagauaugaaaauguacuuuuuuaaacaaauaggauuauacaauauguaccauucuuugacuuguuuuuacucaguauuuuuuagacaucuagagaaauucauuucucauaaauaauguuguugaaggauuaaaaacaaaagcacagaagauaauuuuuuaguggcuuggcaaccagagcugaugaaaguuacagauugggagcagagcuauuucuaguauuguuuggaggcuggaacagaucauaacucugcugccuuuuaccccaccaaaaaguaacacacugcaacaauccaggcaaaauuaaggugaggauuauagacagucuugaguggggaaauguuaccaaaggaauuucugagauacguucuggaagaagggauauucccuuccagagaauuauggugauuauaggcaugagaugcuucaaaguuucuguuguuuuuuuguauuacauuuuuaaaauguuuguuuuguauuuuuucagcacuagcaaaagucucucuggcuuccucccuucauuguuacccaauugcuagaagcuuggaugaggugggguaugaguggagagagaaaacugugagccucuggguguucacuuuagcauagacaguuuaagaaaaggcugugauauuccacuccugucuuuuuacuagguguucuuccuaggaccuugggcaucugcuuuugcucuaguccuuaggauccugcgguucucuucaccugaacuaauccaguagguuucauguauuugccgauagugauugggccuuagacuuuaagucuugcuuauccagaguugaucaaaaucuuuagggucccuguucacucaugagguuauguugaucugucagguaauucaaaauaauaguaauaacacaaaaccuaacauaacuguuagguuauguuuucuaucauuuuuuccaucauaaagaguaugauuuuuuaaaagagagaaagaaauauaaaaguaaaucugacauuaggguacuuuguucauguucagucugaugaaggaauaauccuggacuggucauuggaagaccauuugaaauucuauuuuaauuuuaugauuauuuugauaccuuugguuuuuauaaaacauuaaacugaaauuuuacuuugccuucuauuagguagauuuauuguugagaucauagcuacauauucaguagucaaacaacacuacuuuuuuauaaugucagauaauuuccuguucacaguguuaaauauagucaauaaauaaauuauuuccucuaauuguauuauaagaacuuuuuuaaaugggcgugagguacaaggcggauuguugacuuuuguauugaagagccugugguuguugcagagccuuuccuugucucaggguaaguugagaaaagagcucccuugaugaaaauauacacccccauauucuacucccuuauauucucacuuuauuagguucacuuaggaaaacuguaucuuucaauaugcaaauaucugcugagcaaguugggguuuuuaaauuuuaauguauuuauuauaaauugaagccauuuguuugagaguaaugaucugaaauacuguuucccugaaugcuggaagagaaaagccucuaaaaggcaaguuuugucuauauuuccguaaucacuagcaucuaucuuguaugccauugagaagcaugcaugguaguuuaacacacacuguaaaauauaucagauguaucuucuuugaaauaauuucaaauugcaugaguccauucuacgugccaguucuuaagaauuuggcaggguaaagcugauuuuaaaaaaaucuuucuauucuuucguuuuuuaagauuaaacuuuuauuuugagauuauaagaaucacaguuguaagaaccaauacauagagagcuuauguacccuuuauccaguuuacccaauaggaacaucucagaaauccacaguauaauauaucaaccaggauauuaacauugaugcaauccaccaaccuuauccagauuuugcuaguauuucuucuacacuuguacucuucucuauuguguauuuaguucuauacaauuguaucacuuacauguauauccaccacuauagucaaagaagaaauccauuaccacaaagaucacucauguugcuuuuuaauaaccauacccuccuuccuuuuuaaggaguuuuuguuucguuuuaaaauucuuagucauuuauggucuugaccuaaguauuuuucaaauuuauaucaugcuuuuaaauuuuuuacuuuuuaaaaaaaauugguaaaaacauaacugaugaagcauacucgcuguugacugggggcaguggcucacgccuguaauccuagcacuuugagaggccaaggugggcagaucaccugaggucgggaguuugagacagccugaccaacacagagaaaccccaucucuacuaaaaauacaaaaauuagccaggcauggugacgggcaccuguaaucccagcuacuugggaggcugaggcaggagaaucgcuugaaccugggagguggagguugcagugagcugagguuacuccacaccaggccccccuccccgccaagaaaaggcacucacuguuuucuccucccucacacagaucacuucugugacaagugaugugugguuuuuuucccacaccaagcaguucucuaggauaccaacuggguguccuacaguucaguucaguucugacauuuaccugguguuagcauccagucccgcagguuaaaggcacagucccagaaacgacucccauuuagacaccaguagaaagucugcgcuucccauauuugugacugacuguaagucggggguucccauugaccccuccucagguuucaucauuugcuagaacagcucauagaacgcaaggaaacacuucacugguuaugguuacugguugauuuuaaagguuacaacuugaggccagguguggugguucucgccuguaaucccagcacuuugggaaguugaggcaggagaauuacuugaggccagggguucuagaccagucugggcagcacaggcagauccugucucuacaaaaaauauuuuuuaaaaacuagccaggcgugguggcccacauguguaguuguagcuacugggaagacugaggcaggaggaucacuugaucccaggagauggaggcugcagugagcuguggucacgccacugcacuccagccugggugauggagcaagacucugccuuaaaaaaaaacaacaaaaucauaugguauucauuugugaugauuuauuucacuuagcauaauguccacaagguucauuccuguuguagcaugugauaagauuuccuuccuucccuuuuaaaacugaguaauuuuuccguuguauguguaccauguuuuauuuauccauucagggacucuugaguugcuaucaccucuuggcuauugugaauaauacugauaaacaugggugugccaauaucucuuugagauucugcuuuuaguucuuuuggguauauacccagaaaguggaauuguuggaucauaugguaguuuuguuuuuaacuucuugaggagccuccauacuauuuuccacagcagcugcaucauuuuacauuccuaccaacaguaaauaucuauguuuaaugauauuuggauacauagguuuugauucauccauuuuaauucuuuaaugacuauuuuauugacuuuucuuuuacaauugauagugacuaccuagcccaaaucacagaugagauacuuuguauuauagaauguuugcauaucaaggaugauccucaaggugacaucuaaauauuuuagagucagcucuuucagguauaagugagagaauccuuaucugaauaguuuaaguaaaaagagggauuuuauuaaaugggaacugggaugugacauugaaucuaaggaugguaaugagucaggccuuagaaauaacucauuaagggacuugauucucucuugucuuugauggaucuuuuuccuucuuguacuguggcuuucaucaugcgacgaugaaguagcuucacaaaucuugagccuuucugcuucagcuacccaaagagcaaggacacucaguuggucccaauccagaagucccaggggaagggaacgauuggcccagcuuggaucgauugccuuucuuuccacccucacuacaguauggucagggagaaggagucagugcaaggacaucugugggaacuauauggagugacugggaggcagucggguggccagaaggaaagggaaugaaugugagacagagaaugaagagugugcuuguccacugucucuuaagcugagaugucagugaacagucgauugaggucacaguggggagauaauauuggagcuugaaaaguucuggauaaggaacacuaagaugacuagaggcaaauaauuuaucugacugauuuuuuaguauaccaaguucagggccacaaggagaaaaugacugaaauucuuaaagauaaaagguaaaaaucauugacugauuucuggaaugauuugaauuagaauuacaagguaguuaaaaacauucuuaacacugcuauuuaggguagaaaauaaaaaauucuauuucaaacaguaauuuuauaauucuaagaaguuuacaaauauaucagggguuuaauauaaaauugauggaugauagcuauguaauaggggcauuuagaagaaauuagaguauaguguuaaccuuuugaagccauggaaggaauuauuuccccaucaggcaucagcgaugaugauaaaacuuauaauguauucagugcuacuugugucaggcacugugugaagcauuuuucuauguauuaugucauuuaaccucccaaaccauaggugcucacuguuuguuaaauugaauuuucuaaguuguguuucaacagaugauuaauacuuugcuuuuccuuucagagaugugguacuggaucuuccucugggcucucuucucuucucuguuuguccauggugcugcaggaguguugauguuugugaugcugcagaggcauaggcagggaagagucaucucugucauugcagucagcauuggauuucuggcuucuguaacuggagcgaugauuaccaguaaguugauuuucuuuugucugaggauguaaguuuguauacacuuaccauuuugguagcuguguucuuauuauacauguaacauuagugagaucuuuuauguagauuauuuuucaacacuuaacacacuccaucuagaagauaaagaugagcugauuuauucauugaacagacaagucguuguaauucugcugugugaagaguccuuuuacaagguuuugagggaaauagaaaaauucauaaaaauuggcaagaggcaaggcaggucaaugggaaaauucacagugauuauaguuucugcuuucaaguugcucauuuucuaggaaaaaacaaaggcauaaaaauaugucagugauaauuaucauaagcaaaaguauagcccugagguccuuaaugucaucugccugugacuacaaaauaaaauugcacuuucuucuuauauacacauuauuauggccuacuagaaaugagcugugcuagagugucuucuagugcuuugcagguuuccugcugugcugccucaugagcuuuuuucagacaaguuuucagguucauucccucuggacuucucuguuuaacacuguacuuaggcccaaacuccagccuugacuucaaagaauuaguuuaugguuuuguuaucagcagaagguauccaaguuaccagcagcaaauccauacaggucugcagcagccucaguucuuaccuccucagaagaaauaauucgacugagggguguaagacagaaaaagacaccaaggcaagcuucagagcaggaguggaauuuaaaagcuuuagagcaggaaagaaaggaaaguacacuuggaagagacacaaaugggcacuuuggaggucaagugccccauuuaaccuuggugcuaugacuugcuggcccauuuccagugucuugcaccccuuuuccuucauucuuccuuuagggugagccacccgcaugcgcgguguccucuuuacacuugggaggcgagcaugcgcaguguguuuaagaaguuguauucaugcucaucugaggcuuucuuccguuuuccgguggaaugcccccaaaggucauacuccaccauuuuguuuuaaugcacaugcuugagcccacuuacgcauuuccugagauuuuauuggaagcuacugguuaccaauuucaaguguuuuuauccauugggaaauugccucucccuggugccugugaccaauuaucauuuuagugugacaacugccggaccaucaccugauggucaccugacauuccuggugggugggggcagcccucuccugccccacuccugacaaccuaccuauuguaacaauuucugcagccacugguugagcagagcuuagguguguacccuguugagacuggagcgugccacaucuacuugcuuagugugguugugccaggaaccgggugccucucugagcugcuguugauucugugacugccaaugcagaguacaugugucuguugcccuucacgucuggccuauucccauaugucaggggcagcucacugcuaccacuggaucuguuuugggacucucugacaguuucuucuuccuuucuaguugauucuugccucagagauaagaaggcaaccuugucuuuaugaugcaagggauucccuucuuuacccuuuccagagugauugacauccuuugucuugagaggaaagcccuacucccauguuccuggguauguccuauggcacuaauaagacaaccauaaaauacuugugggaaauggggaggagucuguuuucuuauccuucaauugcuauuuuuuguuaucuuguguuaaguuuuuauaguugcuuuuguuguuucugcauucaaccuauaauuugaugauauggaugguaccucauaugcuuugucauagacgggguuuuaaacagguacucagguuuagcuaaagcacauggucugcuuaauaggaguaguaccagauucaguaggaaagauagaaccgagccagauuccagagggccuuggaaagcuaucugggaaguuugggcuuuauucugccggccauggaaaacaaauggauauuuuugaaugcaguuggcaagggacaagcaguucagugggaaauuuuguuuuauaguugaauauagaauuaauguaaagaagcaagagaaaacccugaaagagcagagaccuggucugucuucaucacugcucgauccccaaaaauaaaacaguaccuagaacauaauggauaugcaaaacauauagguuugauggauaggagugagagaggaagagagggaggaaaggaaagaaagaagaggggauagggagagagaauaaagaggaaggaagaggaauuaagaggcauuaacuguaaucuaaacuugaggccagguucugaacuagaguaauggccguagguugggaaggaaggaguuaauguaagaaccauacaaaggacaaaaaaucuaaauuaguuauucauugugguggcauacaaacagauaugaaaggggcugccaguaguuuuugacauggccacuguuguaauugugcaaccaugaacagagggggaaggaagaaggagcagcuuguuuggaaguuuaaaugguauguguauauauauauauguauuuauuugcauauauuauugcaaaaguuuaaagagagcaugagaaauggaauucuuccauuuaucucugaugauauguguguauauauaacccauuuucaauucagucaagaauaaaguaagccagugauuuuagaaacugcaguguuauauuuuuaaauccuuaaaaauguaagucugacacaauuucaaguaaaaauuuguguccauauuagcaauaaaacauuuaauuuuuuucuggcuaauuaucugaccugcaaacaggugaauuaggaaaacuagccaaugugaauagugauauuuauuuucuuaauacaaguugugaauacuagugcacucauagcuguaucuucaguucaguuauugauugcuaaauaccuauauucaguaagaugcugacugaauauaguuacauauucauuauauuuugcuacuucuuagauuuuauuuugaaacuagagugauuuuucauauaguguuuuuaguuaauaccagaauugggagaaacugguuucuauauaaugucuaauuuuagcuguuuaauuuuagccagucuaaaaguguaaaguaaguucucauuguugguuuaauuugcauuucugugauuauuagugaauuugagcaucucuucuuauguuuauuauauauuuagguuuucuuuuuuacagauugcuucuuuaaauucugugguuuucuuuugguauucuuguuuccuuuuuauuagguuacagauauuuuuauauauuagagauauugaccucuuguugguuuuggacuuugcaaauaauuuaucucagucuuuuaucaguuaccuucauccaugauaucauuuacggagcagaaauccuuaguuucgacaugaucaacugaaaggguuuuugucuuaugguuuauacuuaaagauuuuauuaaagaaguuauccuccauuccauugccaaaagauauucugauauauuuucuucuauuaauuuuacaguuuuuccuuuuguauuaaggucuuuaauucaccuguagcaggaaguggcaaacauuuuuguaaagggccaaguaauaaauauuuuagauuucgcaggcuaguggucucugucacauuauucaguucugccaagguagugcaaaagcagccauagacauauguaaaugaaugcucauggccuguuucaguaaaacguuauuucuauuuacaacagaggcaucgggcauucaggccauaauuuauccuccauauagagucuaccuuuguuuuagguauuagauaggauucuauguguuuuuuucccccacugccauauaguaaaucaguuuuuaucaugccaaacacuaaaaaauucaucauuuccuuguugauuuguagugccaccuuuauuguauauuacauucucaaaguacagggaucugucucugaacucuauucugauucauuggucuuuuuaucuauucuuguagaaaggucacuuuuuuuuuuuaaucccagugguuuugugguauaucuuaauaucugucaggaauaggucccucuuguuacuuuccuuucucaaaguuaacagcuguugaugggccuuuauucuuucauauaaauuuuagacuaugucuacuggaucgcucaaaaaguaugauaaugauuuuuauuaggauuuaacugaauauagaggauaauuugggaagaauugccauauuauaucacccaagaacauguaguguagcucuauuuauugagaucaucuuuuacgucuuuuauuagaguuuaaaaaugcuuuucucaauaggaaguuuguauacuuuuuaugaaguuaauucccaaacuccuguuauggcuauugugcauggauaucuuuugauuacauuguuuaguuuuauugguguggagaaauacuauuaagcuuuguaagucagguauaugaaagauuaacaaaaaacugguucuuuggagagauaagaugaauagacugcuggcaaacuaagaaaaaaggguuaaggcagaagaguaaaauacagagcauaauagaagaaauacuaaaucucaauaauaaagauagagaauuauaaaaauaaaauaguuuuaugaacagcuauaccuaaauauaaaaugucaaaauuugacauaaggggaaauagaacauaugaauaggaaaauaauuauuuuugccaauugcaauauuaaaaacccuucuuccaaaaaacuccaggcccaaagggguuuacaggagaauucuaccaaacuuucaagaacaacuaguucauauuugauccaaguuacugcagaaaauagaaagaauaaaagcugugcacagcuuguuugcagaggucaguguaaucuuguugcuaaacaagaugagggcuacaccagaaccuuaggaauugcuauucuuggaaugcaaagauaauucaguaucagaaaugagugcagcuguauuucaagaaaacauuauugauggacacuaaaaucagaauuucauauaauuuucauguaucaugaaauguuaaucucuggauuuuaaaaaaucacuuuaaaaaugugaaaacuauucuuagccugcaugcuguacaaaauaggugggugggccagauuuguggauuguaguuugccaaccucgaucuaacuaugcaaacugauagaaucaacacauuaucaaaacuaauucuugccuuaaccuuguucuauuuuuuuuucuguuuuuccacccauagcucuuugugccucuucacccuuaaccuuuaucauaugcuugcuuuuuuuuuuuuuucuuuuuccauuuuagagauagagucuggcucugcugcccaggcuggaaugcagugacacacucauaccuuacuguacccuugaacuucugagcuccagugauccucccaacucagccuccugagucgcuaggaccacaggcuaucauuugcuuucugucaggaaauacacagggcagaucacaucacuuuucauuggaaugcucaucugcaggcacuugauguuguguaucaguguuuucugucugcugaugacucuccuguuccccuucguucuuguaguuuuguauauuuuacucaccuucagaucaucuuggcaguauugcuuucuccacuucauuugggaucuuuccuuauuucuaauugaucauguuugccacuguugacaguggcagauccgcaugcguuauuuauuucaagaacccuaucccacuucucugcaugccugcauauauuagccucauaaaucaccaagaaaauaaagaucuuaauguacucuuucaacuagcuguuguucagcaagacacccuaaggagagugaaaacuaaagaacaaacugggguaagauauuuguuaaaauaauauauaacuucauauaauuguaaaaagauuaauaucuagacuauauauuuuuuaaaaacccugugacucaaguuauaaaaagacaacccgguagaaaagugaauaaaggacuuaagcauuucauagaaguagaaacccuaauggcuaauaauaugugaagagaaacucaaucacauuaauugccaaggauuuguaaauuaaucagauagauaauaucucuuacccacuagauuggcaaaaaaaauuaaaaaacaaaaaaggaugucaccugccucugaggauauggaguaacugaaauacacauugguacagcuaauuuagaaaaauaauuuggcacuaucuagucaaguugaaaaggcccauaccauagggcugagcaguucugguuuuacccgugggucauggagaaacucuugacugcaugugugugcuaggggucguagacaagaacauucacaggagcaguguuugggauuguaaaggacugaaaacaaagacauguuguuggccauagaauggauaaauaaauugugguauauucauacuuggaauucuguauggcagugaaaaugaauaaguuauagcugcauacaaggaauauaguuauuuccuacuauauuccauaauauauuuaugcccugcuauuuuaaaucaagaguuuauuuaacuuuuucauuguauaccaauauuuuuauuugauaaauaggauugaaagauauccuggcauuuaaaaugaaauaucuuucauauccugacauuuaagaugaaaguuucuuggaauuuuagggguguuuuaggcaaguuagguauagaaguuaaguuagaguuuaaaaauuuuauuacgugaguaauauaugauuauauucauuauguaaaacucaaaacauuauagauagagcaaagccccuuuugaccaacacucucaaacuagugcucuucucagaaguaagcccuauuuucaguuugguauguauccgccagauauuuguugaugcauuacauucauucauacauauuuacauacauaccgcauacauacacacauacauauguauguauguacuaguagagaauauguauuguuuuauguuuuauuuucuuuguuaccuaaaugauauaucuaaguuauuuuuauuucaguucauacaaaucuauauuuuccuuuugaaauuguauggguucaugguauggacuucauauaguuuaucuccaacugaugguggacauuuguuuuguuuuuguuugauuacagaaaugcuguauugauuguguguguuuaugcauguauauauguguguuuauauucuaaauauuaaucaucaguuuguuuugcauauagcaaauauuuuuccagucuguucauugaugugaaaccuuuauggguuuuacccuuuuuuuguggucuuaagaucucuuuuccuaggaucauaaacauaauucucuuacauuuuaaaguuuagauguguacuuuuguuuuuaacauuuaguuauuuaauccaucugaaauuuauuuuggggaauggugugaagcagggaccuaaauuuauuuuuuugaaauggcuaccagucauuccaacaccauuuauugaauggugaaucacugauuggaauuaucuuuauccuuuacuacuaugacgacuacuagccaaaauuuguugaguacauacuaggaucguccacuguuuuaagcacuugacaagugucaucucuuaaucuucgugcccaccuauuuuacaguggaggaagcaaggcaugggaggcugugauuguccaguguaacacaguugcuaaguaguggagcuuggauuuuaauccaggagccuggcucuacaacccaugcuccucaccuuauguaagcaugcaacguuugaauugacacaguuguuugccauuucgcaggcagccugagcuaguaauugcuucgauuuuccccuugcuguggaucaugauugaaaacuuaguaucagagggauggaggcuaaaaugugguuuuuaaaauggaagauagucauauaaaucuaggaugaauccaaagagaaagaguauuacucuaguuuauuuuaacauaauuucugauaacaaagguguaggauacuuaauauuuuuaaagaaugucaucuaauccuaaaauuuggauaugugaccaauuauacaagugauuucauuguuugguuaaguaaauguuggugcuacuaggaguuuugagaugcuuauuagcuacuuuaucauucucugaauucuucguucucauuuucacuuaguauaaauaugaagugauagaaugauuuugggauuuauagccagacuaaccuggauugaaaaaucccggcucuuguacuugcuguauuuccuggggcuaguaacugaaccucucugaaccucuguuuuuuucaucuuuaaauuaggugauaauacugagggggugguaugauauuuaaauaugauaauauuuguaaaguuccugcaaaauacauaguauaugguaaguacacuauuuuaauuuccuuuuauuuuaaaacauguauaugaaaguccuuggcuuagguuaguaauuugcuuuuccuguuuacaucucuuacagagcaauacaauaacuuuuauuuggaagauuuugagugaaguacaaauaauuaaucuuuagcuaauuuuuuucuaaguugacaaguaaaaauuauauucuaauuuucaugaguagguuuccgucuuaauuguaauugucaauucaguauuuucagauaacuucucgucuuugucuuauguucuuuuaucuaaccauuuuaggauauauagacaguuuuucuagaaaaagaguuuucaggccaucuccaucugugggauggcauauuauaauuuaaauguuuccuccuuuaugguuccuaaauguacuuuuaaaguuagccgcuuagauaccacaucauuauggauggucugugaagaucagauguugaaucagaugagcacugagguuccucauacacugagauucucccguucucagaaguguacauuaccuaaggaaccucacuagaauagaugucagguucauuuuccauucuuauuagacgucaagauacuagucuccaaauaacuuagagucggaugguuuauuuaaaaagcaagaacuauuuuguaugguagauugugagauggauuagucagguauuauauuuuacaugauauuuaagaauucauauuauucagaaaagauaccuuuaauauuaaaauauuuauuaauaauuuagaaauuacauuaaauuauguuauuuuucugcauuaucacuuguaauuaucaguauguuauacuguauguuuacaaaaaugcuaaagaggucuaguuaauugaaugcccaggugagagguugcaauaaugaauuauucauuguuuaugaacauauuugcuaucaaguaugcagcauauaccauaaauauauaucuuuugguugaauagaaaagucuguuuuucaaauaaguggcuaaguguauuaugguaaguuguaacuuucaccaaucacagggaaacuuuuucauagaaaguggauaaaaugagaaaaaaaugaugacuuauguuuugaugaaaugaaaagagcucuuaaggugcagcaugcaguguguuauaaaacgagugacuguaucccuucauuuuucucccguuucuccuuaggugcagcaguagcgggcauuuacagaguagcugggaagaacauggccccuuuggaagcgcugguauggggcguuggacagacuguacugacauuaaucaucuccuuuucaaggauccucgcuacacuuugagguuucugugggaaugucuuacuucacauaaggaaacagauguacagauucccugaaaacggcauuguuaacaaguggaaaugaaauugugcaagaauguggacugagcaggucaaagcauaaggaagaccuugagcuguguggaaggauugcccucugguguucaagugauugcacuaccgcacugcaccuuaugugccucugucucaggcaaggugcauuaagacacuauguaaaguuacaagaaaaagcaccuuguuuagcugccuaucagguuaacauugguguugaaaucaucguuccuaacaguguuauguuaaguuacagggacguuuugagguauugauauaugugccaaacucuuuucuuuuuguuaacauugaucaugugacaauuugcaaguguagauguagcugagugcugugaacauauuugacaugaauucagguaauguacuaagauuuuuguucgguaacacuaa

SEQ ID NO: 17267 - RNA, 6205 nt, Homo sapiens
ugauuauuuuuauuauguacaggccugaaauuguuuucauguguucuuuauauuccugauguuuuuacaaauuaaauuuaggcauaacuuuuccaagucaaucugauuuuuucuuuucugccagacuugaauuguguucuucuuuuacuuuggcuauucugucaauaauuuaaagcauucguauucuuccagaggaauuaccaauagcauguggaaauuguuucagaucuccagaaugaauacuuauuuuaacauauguuuauuuuaugauuuaagaaaguuaugguaaaguaauauggagcaugauucauaauccaaaauuaacaagaaaauaacuuggauacauuaaauguacuaauguguggaccaaagagauuuaaacuauuguuuuuacucuagaaugaaaguauaauugaacgguuaauaauuaguuuguagaguguccugcaguuauuaucaaguugcuuuacauuaucaauuguguguguauguguauacuuuuaauuuuagggguuauuuuugguuucuuugcuguuuucaguuauuuccauugagauuuugugcaacugucucucuuuugauguuuugagaugcaguugaauaguuugaguuugugaauugucuuaauagcuauuuauaugcugaaauuuuuaaaaaguuaguagcuuuccuauagacacaagaaauguuuaaugauauauauacacacacguauauaucauuauauagguauauagagagcugcuauauaugaauacagucuacuuggaaagcuuuuuuucagugaacacuuucauguucuaguggaaaauuuguucaguguaaugaucuuuuaaauagguuugaggauguuugaaaauuuugaauuuugggaaaauuuucuucacuuaauagagcuggagacccuuguuugggacaugacaaaaguccuuauugauguauuuggguuauauacuuuguuaaaauucguaugugauuuagcaguacauuuucuucgugacaaaugcaagaagggagggaggauccucuauaguggacacuccuuuauuuaaaaaauguuuaauaaaauauuguuuauagugaaaucagcuccccaaagaaggaacuccuacaugcccaaacuaauuacaguugaacauacugauuaaaaaugccauagaucacagcuagucaggaggccucaaauaaacugcaaauaaugcuuaaaacuuuaaaagaaggagaaccagcagucuuccgaaccaugggacaguuccaagguaauagccuaccuugccuaggauaagugaaguccuaaaugauggcuaucuucagggccuggagcagaauuauucuuuagaucuuaauguuuaccaaacaguguuacaguuuguuacccaauauacuuucuuaguauuugcagcauacauuucacugcucaaaaaaguauaaggguuuuguuuguacuuuaaaugagagaaauaaagaaaugaguuggccuguauaucuuguauuugugauaugagcaacgggauaauuugaaaucacagaauguugugggaaaggucuuuaaagaaccucuaaugaagaaaauguggcugccacauugauguaccuaggcugccacucauacagcaaauaauucuauuuuguaaacacuucguguggauccacuauguaaagugcucuaccaaguauuuucucuaguaagaaguacaagaauuaccaagauggaauucuuuaccuugaguacaccaagagcuagcaagaugauuuuuaaauccuaaaaaguuugggacaacauuuugcuuccugauuuuaguugagaguuagccuguuaucccuccaaauucucauuuuccugguucauccacuaaauagaauuuccauaacugagauaucauggcugugacauagugaagagaauacgagacuccaagccagcaacacagauugaauuaagacucugucacuugucaacuuuuugaccuugagcaaaucacuuaacuucucugagccucaguucauacuccguaaaaugugacuaauaccucauguaguuauugugaggauuacgugagauuguuuaugaauggcaaagcaguauguauuucacaguaaaugaucaacugauagucucuagaauuuuuuuaaauuacauuuugcaauugcauuaccaauugaauauguuguuuuguaaaauucaucaauuuuguuucauuucuauauuuuccuuacauaugcuuuaggaaagaaacuaaaaacguuuucuuauaaucuugcuucaucuccuuuucacuuuuucuuuuuaaaaucagcagaucuuuaagaaccuuuugugaauugguggugguggaaauggccagugcaagcaggauuaaauuaggaguucuguugaccacugguuaaaauaggaaaaggguagagagguagucagccuugacucccuuaucuauucccacuuacuucccuuggauucauucagccauguugauuuauugacuuucugcuauuugcuaauuauucuucuugaaaaguaagagcgauauauaacccuucagucuucuauaugucuguuucuucugccggcccugggcccuuggcucuacaguguagugccaauucuguagaaaaauagaacgauauucagugucuaccaaguucuuucuuccacaggccaagggugcuuaagcccuagcuguuauuuuguuucuuuuauuuauuuauuuuuugagacggaguuucgcucuuguugcccaggcugcagugcaauggcaugaucucagcucaccgcaaccucugccucccagguucaagcgauucuccuuccucagccucccgaguagcugggauuacaggcgugcaccaccaugccuggccaguuuuguauuuuuaguagagacagauuucucuauguuggucaggcuggucucaaacucccgaccucaagggauccacccaccuuggccucccaaagugcugggauuacagguguaagcugccgugcccagccuauuuuuuuuuaacuucaaauacuauuauuuuaaauuuauguucauuauguaauucagggaguaacgaugccuggagcaauuucugaaauauucucaaaccacuucacucuugacacuacagauuuuucucucagucucaaucagaaucucugcagucauuauuuguuuuuaagaugugagggacgaggaaaauuacugaagaaauucuagcagauuucgauugcagagaaauuugguaacacuuuuuggguaacuggguaaauuacuauuucuuuuaauaaucgggugaaacucugaauuguuaaaacggaccaauaaucaaaugguuuuauaaucuuucuuaacuucccguccuuguuauaacaucuuggaagaagacucuucaggauaaaaaggauauuauuugauuaaaaauuauagcauuuggagagguaacacacaaaaacaaaaacauauuugacaaagcgcccuacauccuguguuuuguuaggacuagaaacuauacuggaugaguauguauacugcauguuuacacaugcuguguuucuuuauaugugaggcuucacugaccaccgugcauuuugaaauuguauugcauuuuguguguguguguggugacagguuugcucuucucacuuaaggagcucuggucuguguaggcaguacaguguuguuagggagguugcugaauuaucuaaaaauguauccaugaauuugggggaaauaaugcuuaauaucugaaguauuuucaguaaauguggagauauaucagauaauacuuuuaaauuaguggaaacacauuucugagugaacugagcuaugaacuauaaucaucucuuccccugaguuuagggaaguuguuuucacauucuuuacauuuauugcacauauacugaacuuacauaauaacucuucccugauuuugagaacgaauuuagcaauuuccuaaaaaucuuccuccucuuuccauacagaugucguauguuauaguuuaaacauauguacaauuuguugauagaauccaaggagcugguuuaggaaagaauacucuuaaccccuacaguuaugcagcucuaaucuuacugaaaaguaaauacuuuaggcaagucaggagagcaugaaccucauacauacauuuuuacgauuauguacugcacccacauguaucuacucuugguaguaacaugacuccacccuuuuugggaauguauuuagguggauaacugaaacggaaaagcaguuugacacaaauacacagaaagaggaauugcggugcauaaucaaucgucugagucccauaacuguaacacuuuuucucuuauaaauugguaguuccuaaaaaucaccacuuuaaaaauuuuauucugucuugcugaauuaagcagaaaucacuuuuuuuagagccuuguuuaaaggaacguuaacucgagaguacuacugaugaugacgcuucucuuguuuuuaaaguauuuacacaucauuguuaaguauuuuuggaauggaacauuuuaaaguuuucuccauagaaagcaacauaguggcacuuguugaguaaaugaucauaaaaaugacuugcuuuuaauagcagaugaguugauaguuuaacuguugacacuuucuuaauguuuuugauguuggaugcauuuacaauggaagaauuuuuuugaaagauuuggcccucucaccaauacacacauucagacuugagcugcacgcauuuagaugaacaaauaggaaauucacgguauuuuuuguuuuagccauccaaaauucauaggauucuaccaaaaauauuagccccugacucuaguuauucugagaugagggaaucaacuuuaucuugaaaguuaacuagcuaaaaugucuuuauuuaaauagcaaaaauauaguuuaccugacaaguauuaaaagucucacuuucaaauuguguuaacucucagaccacugaugaaucuuuugguaaaucacaggcagauuuuaaaagcuaaaugaagccuuagugccuugaaaguuaagauacuugugcaaaauggauuuagcaagauucaggauuggcaccagugaguuggcuagauacacaucaccagugacugggaauucaaaguuuagaaagccuaacgaauaguagcuacuaacuucauaugguucaauguaaaucaguuacuuagucauugacugugacagaugacagcuacuuucacuauauuuucaugaugugguauuuuucucuauuuuuucuuuuuccaaguaugaaauggaaaaaaauguaguuaagaaaauuaagugugagacuuuaaaauuuaguuuuguuguaaacuagagauucuagugaacaguguuaguuuuauacuguaguacagggcacacacuuuaaccuuuagaaauauguuuaccaucagggauuuauuuuuacuauagaaauacuaaauguacugugaagcuuaaagacaggagaauaaauguuggagggguaauacacaaaaacaaaggcauauuugaugaaguacccuguguuaugugaacacaauuuccccuucuguuaagacuauaaacuauaugaguauguguacugcauguuuacauaaaacaguuuaauuuugaaggauuauuuuaaaaacuauguuuauauauaauaccuaacaagcuguaaauauuguauauuauugauuuuuaauuuuauauaagcaauuuuuuauuucccaauucauguacaaaucucauuauguauauagcauaauuuccuggagaacacaaauuuugcagugaauuuuaaguaauuuuaauugcaguaagcaucaguuuagccuagagauguugaucuuuauuuuaaauuauuuuucaccauucucauuuucuucaaagggcagcaauaaacauaugcaaguuauuuuuaauuauagaaaguaggucuacaaagauaagaucuagguuccaauucauugcuuuaaggaaaagaugcacaauuacuaucauucagugucuaaucacaggaccauuucugagguccacauguggcucuccucuuuguaauauacagggugaacucuuuacugauacacacaagacaacuguuaaaaagugaauccagcacuuaaaugucauuacacagaauuuauuggauuaaaaauuuguaauauacaguauuuuaauaaaguuucuguauucaauuucaugcacuuauauauaaauaaaccugucuuugaaagcuuuau

SEQ ID NO: 17268 - RNA, 988 nt, Homo sapiens
uugaaagaguugaagagacugaggagggagauggcaaaacaaggaccuucucuauauaaauggacuuggaucuuggauugggagaggaagauaaagggcagagcugaaaauucagaaacucaagaugagaaauaucuaagagcuaaggauccacgugacggacguguaauacaugggcaaguguaauuacacuaucaagaggacuaccaggaaaugcucugcagaauuauuccacuggcugguaauccaaggaccuggaggugggaggaagacagaggaauuggacaaauucaaauuuccaauuaggcauaaguggcuucuuaguaggcagagaagaugaugagaccaggaacaaggugugggggcugguugagaaccugucagaagcucccuauucaaggcaaggacggaacuccacagccuacagcgugucugccucugggguuauuaagcaaccagaagcauggcagggccuuuucugugcuggcuauuuaauuaggaagaggagugucaguacuaaccuggcagagaaggcgcucucauccgcccagcaggcugcucucggggauuuuucacgucugucuugagaucaugggaguuuggcucuuuccuuccacuuagauuuuuaguuuuugcucuuaguauuucagagagauuuaggaucuucuguuaugaguuucuccagccugguuauucuccagcaucaagucauucuucccguugggguguuacacaugguugccaaggaugugagcacugguugauucacacaggagagggacucaccagcaagcccucaaggucacugaauaauuuuaauuacuaaaauuccuaguaacuucucagaagacaucuauacuuuuuugaucacuaaaaaccuuugaccuugauugagaaauuagaauuuuuuuuuuuacugguuuucuucuguuuaaaaagcagccuguugauaauaggaaaucacugaauaauggaauuuuaaaaauau

SEQ ID NO: 17269 - RNA, 3561 nt, Homo sapiens
agaugguguggaggcugggucuuggagaaugaauaggaguuggccagaucauuuggguggaggcuggcugaauggaggcaaccauggaaauaaaguagugacguucaaguuuuggaggauguggauauuuacaaggaccaaguuaucucagggugaccuuaacagucaggagcagugauggaggggacggaguggguguugaggcccgggucuuggaguggguggguguauaucguauuuugguuggaagaggagugccucauuuucacuucuugcagguuuuucaucuuucaaaguucaguauguauuauuugucuuguuaaucaugccacauucucauaauuuuugagcaccuuuuuugguugccuggcuauuuaguaaacauaaguguagaaucaaaagagauguuugucugugucaguuucuucguguguuugcuacuguggucauucauauauugaucagcgaugauuuuccugagaccguuuauugcauugguggcaaaaauuagauuuucugacucccaaucugugaaaccauauuccuuucugcauuuuauugcuggacuguagguuauguugaauauaaacauauuuguggauaauguaguuguauguggcugagagguugcacuggauauuauggaaaagaauuuuguauaugaaauagauaguagcagugaguguuuuccuguuuucuuuuuaaauguucuucaacagggagaaugaaaucuaaaugauaauucuguuuauuguuuuuuccuuuuuuuuuguagggucuugcucuuuugcucaggcuggagugcagugguguaguuguagcucacugcaaccccaaacuucuggggacaagcuaaggcuuguccccuuccugcuuuagcgucccgaauagcuuggacuacaggcacaugccagugugccuagcuacuuuuuuuuuuuggcggaggggaggggaguuccucacuuuguugcccagacuggucuugaacucccagccucaagugaaccuccuguguuggccccccaaagcacugagauuacaggcaugagccaccgcaccuagucugugguuuuucuucuucuuauuuuuaaacauccugugcagaaaaaaauuaaggaaccugauguaucuguuagacauuaauaccgugcaaauucaguauguuuuaguguuuugaucuauugauauccuuucuauugaaggcaaggaacaauaguuauucggggcuuuauuagauuuuauuuaaugcuuucauaaagaagcacagauauuacuauuuaucaacuguaauuuuuaauauuugagaacuauauuuugguguaauuguuuuuuuaauccuguguauuuuaugcauuuuaaaacauucugaaaagggguccaucaauuuggcuaaacugcagaggcauacaggguacacagaaaaaguuaagaaucauccucuggaugggcgcgguggcucacgauuguaaucccagcacuuugggaggcugaggcaggcagaucacgaggucaagagauugagaccauccuggccaacaugccgaaaccccgucuguacuaaaaauacaaaaauuagcugggcaugguggcaugcacuuguagucccagcuacuugggaggcugaggcaggauaauugcuugaagccaggaggcggagguugcagugagccaagauugcgccacugcacuccagccugggcgacagggcgagacuccaucucaacaacgacaacaacaacaacaacaacaaagaaccaacaacaacaacaacaaagaaccaccaccaccaccaccaacaacaacaacaaagaaucauucuccauuccccaaacccuaaagccaggaagggaguaagauuaacuuuagaaauuaauaaauagaguuuuggaucucuacucugccuuuuaggagcucuguggaugggacguuuuacuucugacugucauucucuguguuauaaaaugaguauaauauaucugucacagauuugugaugagaguuaaaauggacacuuuauauaauauaccuggcagaguaacaggcacauagaaugaauguuguuaccccuuugguccuuagucuuaucaugaacuagcuauguccuuagccaaauuacuuaccacuuuuugaucuuuguuaccuauuuaucuacacugaaaggauuuagauuuguauauuucuacuucagcuaaaaaaaaucugugauuauguaaaaaaccaggauuaccuuuuucaaauuggaaugcuuggucagcuaagcuuuuauuuuguugauuaaagacaugcauauaucaacaggcauugucuuuuguguccaugccaccuaacuuuucucuaccaguuuucucucauuaaauguuugucagucacauuugguugaaaccaugcuguuuauccaacgucaugacuuaaaguaaaggacaauuuacuuaauugucuuaaauaccagucagagccauguggaagcuaugcagguaaacaagccucuuuuugggguuggguuguaggaacccugccuuaggucuaaugaaagugauauucuuguguauuuucaggggucauccucuguccuuaccuucaguuccaguagcucuuuaaaccucauuuguucuauugacgccaaguugguuagaaggucauagcguugguuuguguguaggagguuagagggagguccuggcagaggcuuauaaucaaguagaagcguaaagccagaguucuugauugcaaagaguagaaguagccucuuugacucagggaacgaccucauuggaaggggugucagguugcugucauaacccccaacacagguggauaucuguguuuaaaagacagugaggaacaaggggaagaagcuaugcagccaggacaggggauaucaccacccaugagcagccuggaucuuggaugcugccuccacagggagcacuggaccccugugagcaccugcagugguucccuggccggaguucaggcagggcgggcaucuggccuggcugcccugcugagcaggacucaacagcaguggaguccccaacuguggggcgaggauucugaugcugggcggucgaggggaaauguaagcccaacaacagaugaagguuuucuauagaugggcucagcaguuguuggaacugcuuauuaucuguguaugugugugugccugugugggcgugcaugcauaugccugcauuuuggagaggaagggaucugggcuuuuaucaaaguccugaaaggucuuuugauccaggaguuaagaaacacuguaauaaagagauuuaacuguguucgaaucuuugcuuuuccaccagguggugcaaaucuuuuaugauguucauagagguuaaauccucaaaaauaagaauaauuuaaaauuguguaauuuucucuaagaguuuaguccugucacacaaugugaagcauuguugaucugauucuugcuuuccuucugucuuuaauaaagauacagguagauuuacauaucuuuuuaaauacguaacuauagaucuaaauuaucuguagauuuuugaggcuguacuacuguuuuguuuuuuguagaaa

SEQ ID NO: 17270 - RNA, 10906 nt, Homo sapiens
cagaggucagacggucuagcgcugcgugggccauggugcagcuccgaccgcgagcgucucgcgccccggcgucggcggaggcgaugguggacgagggccagcuggccucggaggaggaggaggcggagcacgggcuguugcucgggcagcccagcagcggcgcggccgccgagccccuggaggaagacgaggaaggggacgaugaguuugacgaugaggccccggaggagcugacuuucgccagcgcccaggcggaagcgagagaagaggagcggcgagugcgggagaccgugcgcagguucggagcccgcugcccggcggggagaaccgcccuuucucgucccgcuuguccuucccuuugcugacuuaucacccuuccucccagggauaaaacgcuccugaaggagaagaggaagcgacgcgaggagcuguucaucgaacagaagguuagaggcuagggaggaggugucuuauuaaaacaacucggcucagggagaauuccuaugguggauguaauuuggguuggcaggauauuggaguggggaaacagucaccaagauugccucugacagugguggaaagaugcucgggccgggcgcggcaguacuuuaguuggacgaggugggcggagcccgggaugucgaggcugccuggagccgagaucacaccacugcgcuccagccugggcgacagagcgagacccugucucaaaaaaaaaaaguucgucuccuuuaguguccaccaacugaaaauaagagguugcugugagaauuaaaugaggugauuuguaaacuguaagggcuguacagacuuaguguaugguugcuuugcugucugauacucgacacagagagcuggcuccaggcagacauuacuuaacugcuuucaauuuauaacagugaccugaggguuagaauaccgugggcacccuuucuaguuuucaucaagucuuucagagaauguggaguuuuguggacccggucuucccauagcuuagagguaugggggcaguuuccagccuaauucauuucuuugccuagauguagggcauucuuaaaagcgguaacuucagaagcaacuccggacauacuauguacaugacuuucuauuaauuuuaaacguuuucauuccaaaagaaaagaaaacuccuuccagacacuauuuuggagaaguuaaccacagcuucacagacuaaguaaguaauggaucuuuuuauauuacuugcuuauauacacccaucuuugaauuauauacugguacauuuauuugaauccauauaacugaaggaauuguagaacccaaauucaaaagcuaccuugguauaugaauuugaugggaaagacggagguaacguucuacuucuuauuuuaccauuuauuuuuguucauucccauagcuagcuuuugaauuccugaucccauuguguucauucaguacauuuuguugacugccugucauuguacuagggcauagugggugguggugaauaaaaaguguuuugaaucauuuagugggguagcaggcacuuauccacaggcucugaaaacuugauuugucccauacuugccuuaccugccaccaaccuguccuuccuguuccccacuucauuuagcaucuuugguguuuuaugguuuaaagcgaaaagcuauagucgucuuugggaauugaucaaacccuacuaaauuuagccuucuaaauuuuuuuuuuucuauccucuuuuucuccccuuaaggcuuuaaauucagaaauucagcccccuuuugcuuaggccagugacucucaaguuuucaguaaaaaaacuuuaccaaagaguuacucagauccugaauacauuaaacguaagagcaaaucuauuugguggcaaauucccuuucaucuuuuaaaaccaagcucaagugucaccuuuaccuucucauuugcccccccccaccucccaucacuuccgcuuuuguguggccuuucuccugugcaaaugcuucuguauuguauucuguccauuuacauuucucucuccauugggccacagcccccuugaggcuguucccugucuccugugccuaaacuauuaaauuaauccuuugugauuucuccaaaugaaaugaggcagaccuacucccauucacuucauauuucaaauacuuuauaacuuguucugaacaaguguuucacuugaacuccauugcccacagcauuuugcugcuuugaaagccugcuaauaggcucucagauuuuaacugugaagaucuuccaaugcuugagaguugguggcaguguacuagggagugacuauugcuuuccaaacugaugagagcuccugaguagaaauugaggguguugguaaugaaagggggugucuuacuuguaaaggcaaaugaaauaauauaacauguuuugaguaaucuuuacugccauugcagucagugguuuuguuuuuuuuccuuagcaucaagaaaucgccaggaaaggugaaagaagguaugacuauucuaauuuaacuaacuucucauguaagugucaagugcacuugcagauguuuccagucaaauaugaauggcccuuagaaagccagcaugggccuggccaagguuagcuggggccuauucccuguauuucauacaaauaaaaacugcauccacauugguguguaguggaugcuuaaagugaacuccaguaaauuuccugauuuauuuuuacgugaaugcuaauuagaaaauguaacucuauuuuuuaguuaauuugcaaaagaaaaaugaagacugugaaaaaggaaaugacuccaagaaaguuaaaguacaaaaaguacagucugucagguaaugagucuuuuguuucauuugggauguaaaggagaccuuuaagagaguuaaaguauuggcuaacaugggaaaauauuuuauuuuauuuuauuuuauuuuuauuuuuuuauuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccgggaaaauauuuuaauuaguaguaauuucagauugucgucucuguggaaaaaccaauuuugggccgggcauguuugcuuacacuuguaaucccagcguuuugggaggcugaagcagguggauugcuugaguccagaauuucaagaccagccuaggcaacaugguaaaacccagucucuacacaaaauaaaaaaaguaagcugggcgugcuggugugcaccuguauucccagcuacuccagaggccaaggugggaggaucacuugagcccaggaggucgaggcugcagugaggcgagauugugccacugcacuacagccugagcgacagagugagacccugucucaaaaaaaaaaucgguuuucauaaaaaaauaaagaucaguugaacacuuugucuuugcagguccugcagguuaaguucaaaaacuuuuuuuuagugguuuuauuauugagaaaauuucauuucaccucucccaauagauagauguuuauuucaagauacacugcagccuacugucagcacuucaaacuugccagccuacucuuauucaggcaguuuaauuuuucuggcugcugaauguuccuccagucaccagcccuuauggugcauggugcugaugcaaagacagucauuccaauggaaagguuguucaccacuauugccagucauggcaauucuucaaaaggagucauuuuucacaaaauucaaccuuucccugacaauauggccuuaucuucuauucuuauggucuacagaagucacagagaaagugccuauugcuguuacuggaauuuuggccgauacuguggacgaugucuguaguaucugucuugaaguccacaggcauucauuugaguugcauucaguacagcuuggugguccaaaucauuacuugcaaaucgguguuuuagccacaagaucaaauauagaaacaaauguaaagcaaagugcaagaccaugagaggaauucaucacaguauguuggacuuuucauuuggaaaaacuuauuuggcacaaucgauuuggaaaucaugcugucaauucucuuuuacuacauguauccgaacaauuuccuguuaacuaauguuuugacuuuugguuuuaguauauuuuaguacaaaaguccaggaacaaguucuucaguuggaucuaucugagaugcugauuguucaacugaugaacaaaaccaccaugugcucuacuaaaauaugagugucuguuucuuguaguccuuguaauuuaguuuuauccuaucugugcauauauaaaauuaguuucauuuaucacuaugagacaaaugauaaaaauauuuuaaaguaagcauguagccugggcacgguggcucaugccuguaaucccagcacuuugggaggccgaggcugguggaucacaaggucaggaguucgagaccagccuggccaacauggugaaaccccgucucuacugaaaauaaaaaaauuagcugggcaugguggcaggcaccuguaaucccacuauucaggaggcugaggcaggcaaguugcuugaaccugggaggcagaaguugcagugagcugagaucgcgcagccugggugacagagcgagacucugucucaggaagaaaaaaaaaagaaaguaagcauguguaauucuuauuuaaccuuuuauauugaucaacagccagaauaaaagcuacuuggccguaaggcuaaaagaccaagaucugagagauucaaggcaacaagcagcacaagccuucauacauaauucauuauaugggccaggaaccaacaggacuacugguaauuuuuuuauggacuauuuuucucacuuuuuacugcaaauaaaacugugaaaugauaaauaccuuucuuuucuaguaaauaaguuccugucucuugccaacaagagguuaccagugaaaagagcugcuguccaguuuuugaauaaugcuugggguaagauccagcuuuauucuccugucucuaauagcuuuauauguugaauaauguucuuuugaaggagauaguucauaauuauacuuuucccccuuauaauggcuuauauauuaaguuacuugugaaaaacaggucaauguaguauguauauacaucuaaaguauaauaagcccacccaguuuuaguaauuacauucauauagaguaauuaaaaaaauuuugaauuauguuuuucuaauauacuuacugcagaaaacuuuauauucuaggaauccaaaaaaaacaaaaugccaagagguuuaaaagacgguggauggucagaaagaugaaaacuaagaaguaaaucaaugcuaaaugaagaaucuguacuuuguauguauagaauuuaucuaauaaaucauucauagaucauuuuaaaggaucauuauaaaaaucauaaaccuauuugaggaagugcucaaccacauuucauucuucuggaguagaacugugccuugcaauccuagaggaaaaagugguuuaagaaggaauuguuuucuuuuuaauauauuuaacugaauucaagccauacccacaucagcaacagcaccucuucuacucuccccggguuagagggguggcaaaaauggcacggacuaaaaggagaaauggauauuccagcaaagucucuaacugcagccuguagacaauuugcuauuaaagauucagugcacaaaauauagcuaacagcuuuuaaauuuuuacuuuuaaccagucuggggauuugcuugccuggugagucucauaugccauauuaugaauaugaaaauaaugaaguuaauuuccuguugccuuucugugucagccacaauaucaggucuaacccuaauccagggaugccaguaaacugaaggcaauuuuagguuguagaacucagauuaauuguagaaaccauuaauuuuaauugcucuaauuuucauaguaaucauaaaaaguaugcaaguaccuaauauauaaacucaauugacacuguaucuguagaaguaaauuuuuaauggcugguuaauuauaucacuacauuuuauugcaauauaguacucauuuaagcacuuaaaaauggaagguguacaaagauuaaauuaagacacgguaaauugacuaaauauuugguuuuuauauaaauaaaggucauaaccacaccguugacauguaauacuguuauaauacaacaguuaaacuugugagucuacaacagaagucaucuguaguuaaacaggaaacaaaguugaaaaagaccauguuaaaacaaaacuacugggacuaacaggucgggauuguaaguagcaacaaacauauucacucagcuccugaguauuucaaguuuuacaguacacauuaaaaaugauuucuuccaucaacacuauaaauucaaacugucggauguuuaugcauuuugcaaguuacacugauugaaugcuuauaugggagugggggucggaacaucucccaauuugaaguuuacaucacccacaugcuaacacaaacacaacuuguuccauuuccuuccccucucuccccccucccccacaaagaaggcaggauuuuugguuucuuuuagguaauuguuuuaaaggauuugugaugaucaauuugaacgucugaaauucaguaauauuuaacucuuagacaacuaagagguuaaagauggaaaauaauuucuccuaacacuaaguuagaaaaucauuugcaucaugcuguaaacuaggaagcaauguaaagcgacaaaaaccuguccccaguacauaauuuaaaaaaucuaaauuucaaaucagcagagcuggucuacuuccauguugacuauaugccacaauauaagugugagcucuugaaaugcauagcuaauguagguagucuuccacuguggcaaaugcgcaggauccaauuccugaucgagccaucaguccuagacauuguguggccugucccauugcuagggcaaguggagguugcuuuggcagauuguggguuucugaggaaaaauaauuuaaaaaugagaacagcaauuagcaagacauuuuaaaaaacauuucaaucaggagaauacugcaaugacuuuaaaaacuaccacucccauaccacucugaaauaucagcaaaugaagguuucuaagcaaaagacagaugccgccuuggacauacuauucugacaagguaguguggguauuguguauucaacuauaagauaaacucuggcagaaucagacuuuuaaaguaucagauacuaaaauacuuccauauuaacuaugaugggaaagguacaauuuuuuaucugauauuuggaguggagaguaaggaauuauuucccuucugguugaucaaagucaguugauacuaacuaaaacuaaaaaaggcaccagguuuucauuacaaguuuccacugauggguucuuccaccucuguggauaggaccaaacaggcugccuagccaucuccaaggcauauauagguaauguuauuugggcugguggggaguaaguggugguggugacagugagagaacauacagcagagccaccccacaguuuuggaggugcuaauuuacaguggacaguucagacauuuaaaaaaaugccaauaaauuuucaggguccugcauaucauaaguuucuuugucagacauuuguaguacaaaugcaauaauuaacaaaauuuguuccuugccagagauggaaaaaaaugaacuaaugguaaaaguggccagacucagaagcugguaauuucucuuuaugagaaggcaauguccaaacuaaucaauaaaauuacuaaucaguucuuuauaggcacaguugacaacaaagggcaaaaacaguugacacauggcuaggaaggcuucauaugguuuaacuccacucuugguucagaggaugcaauuugaugguggaagaaagaagaggaaauuuccaaaagggaaaaagcacaauaucagaaagaagcaaauucaggacuuaaagguagaagagaaaacaaaaacaggauuaagaauaaacgugugcaaaaaagggcacauagauugaugagaaaguguggugucuugaggguucacagggaagaccgugcucaaagacaaacaucuacagggaauauuuuuuuaauuuuauuuuggccaaaggaagcaucuggcgaugcaucuuuaacuuuuuuggauguaugaaauuuucauaacacuauauagauggaccuacauaauauagcaugguauuuauaaacauauacaugcccaucuauagcaguuuaauaauugugucauuaauuuuacaggaaucgcauacauuuauauuaauaagauuaagcacuauuuauggcugaaucuacauaauauagcacaauauguaagaguauaugugucuauagauaauggugcucaacaauuaaauucccuugaagaacucaagaaacuaaauuguaagaaaacuggucacuuuaaagauuaguaucaucuaauaauuaggucuuaaugauuaccuacaauauaacuucaaaaagacauuuauaguaaaccauaauuuuccuuacaauuccagcauuauuacuaaguuacuuuuaccaacggagcuaaaugaauuuuguagaaccaaugaaaauauaacacauuaaccaaagaaaauucacauuuauauacaaauccuaaauuccggagaacuacaacacugaggacacuacuccuauucccaaacuucaguauugguccuuaacaaauuaauaaauuuucuaagggcaaagaaacagacugagucuuaaauaugaaugcuuuucauugcuuccuuuacauucuugcuguaagaguccuggcccucauugcaagucucccuaucuaaacuacucuuuaaucuacuuuuuguggcacugcccucaucuuccuaaacuaguuugaaauaugugacuaaaagucccugaaccuugcagggccaaacagcacagcacagacuucuaaacuagacuggagucccaauuaccugggaauuagacucugaagucaaaugaaaacucacucuuuauauaaauuaccuuugaugagaacugcccaaaacucaaacuuguuuuauguaaacaaucgacccuaucacauuuauauagaaaugcacaauaugugcaguuacacaauucauauaaaaaguacuuguucaguauauaaauacuauaaucacaaacgcuacagugagcugcucauaggaauggcaaccaaacgaacaucgaauuagcguuucgcacuugaugcucaccccuggcuaagccucgccuuuuaaauugcuuuucucuuccucacccacccuuuuuauuggguaagggcauguaguugaauccggcuaauauaaaugcaaauagaaugugacaucaaggcuugauccugccggguacucacaagucaucaggaagccccuugugcccauauucauaagcauggugggagcugugauaccaguggcuuaggcugcugcuacccauugcaaauuuagcucaagcaaaaugguugggaaccagguaacaggggaggaccagcuaggaauccugcccucuacuggaucaguuugagcuucucugauauucaagcucuucacucccuuacuuccauuuucauucucuccaucaaaaccuuucuugaccucuuuucuucaaauguacccuguucccuucuagccuaacucuugugacaauuauuaaucuauguucuuaacguucuccgauuccuucuacagcagccaaacgagagaaugccacccaauuccuagccuagaaaucaguggcagaaaaugccuuucacuaaagagggcuguaaggaaugucucugguaggguaguauuuugaauuauacacaaggaccaccaaaucucucauucuaaugagagaaguagacauucguggcuaccagaaaugcuuacauacaugcacacaaaaacuucuauuucccaaacaucccaaguuguaccccaucuuacuguuuuuauucuauuuaaauccacuugaaucuggaauuaaaggaggggguuucuauauuuuagguauuuuuauauuuuaaaaauauagaaaacauuuuccugaugauuuuaccaaaguguaaaugccaguacaaacacccucucuuaaauuuucagagaaucuaacugaaauugugccuuauuuggcuuuacuuaccuaauauugcacuguuaagagcugagcacacagguucucucugaaucgggucaagcugauuuccaacugggcuguuccagggaucugaauaugcuaguagacugaaugcauccuguugaaaacacaucgauuugguuuuaauucaaauaguucaacuauuaugcucacaaauguuuccaaguugagagguaaaauauggcuuccaggcacagacuaauaauguaaacuuuaaacccauuuacucccagcacugggacgcucuacauuuuugaacauuaaauuaugcagcaaagccuaauuuauuuucauuuuuccuguggacagccauucucauucaacuuccucccaucccuaaacacaaaacaggaaaaaaaaauuucaaaggaaugaacuaguacugguguagggagaguggaaggcaaaacauucagauguuuuacuucacaauuuauuacuacugauaugaaugugacagucaaaggacagggccugucugcauuuccuuuuuucaacagauuuaggaacuggacacaucucacugggaugucaucuucucaaauucaguuaugaaaaaauuaaa

SEQ ID NO: 17271 - RNA, 5266 nt, Homo sapiens
cggucuagcgcugcgugggccauggugcagcuccgaccgcgagcgucucgcgccccggcgucggcggaggcgaugguggacgagggccagcuggccucggaggaggaggaggcggagcacgggcuguugcucgggcagcccagcagcggcgcggccgccgagccccuggaggaagacgaggaaggggacgaugaguuugacgaugaggccccggaggagcugacuuucgccagcgcccaggcggaagcgagagaagaggagcggcgagugcgggagaccgugcgcagguucggagcccgcugcccggcggggagaaccgcccuuucucgucccgcuuguccuucccuuugcugacuuaucacccuuccucccagggauaaaacgcuccugaaggagaagaggaagcgacgcgaggagcuguucaucgaacagaagguuagaggcuagggaggaggugucuuauuaaaacaacucggcucagggagaauuccuaugguggauguaauuuggguuggcaggauauuggaguggggaaacagucaccaagauugccucugacagugguggaaagaugcucgggccgggcgcggcaguacuuuaguuggacgaggugggcggagcccgggaugucgaggcugccuggagccgagaucacaccacugcgcuccagccugggcgacagagcgagacccugucucaaaaaaaaaaaguucgucuccuuuaguguccaccaacugaaaauaagagguugcugugagaauuaaaugaggugauuuguaaacuguaagggcuguacagacuuaguguaugguugcuuugcugucugauacucgacacagagagcuggcuccaggcagacauuacuuaacugcuuucaauuuauaacagugaccugaggguuagaauaccgugggcacccuuucuaguuuucaucaagucuuucagagaauguggaguuuuguggacccggucuucccauagcuuagagguaugggggcaguuuccagccuaauucauuucuuugccuagauguagggcauucuuaaaagcgguaacuucagaagcaacuccggacauacuauguacaugacuuucuauuaauuuuaaacguuuucauuccaaaagaaaagaaaacuccuuccagacacuauuuuggagaaguuaaccacagcuucacagacuaaguaaguaauggaucuuuuuauauuacuugcuuauauacacccaucuuugaauuauauacugguacauuuauuugaauccauauaacugaaggaauuguagaacccaaauucaaaagcuaccuugguauaugaauuugaugggaaagacggagguaacguucuacuucuuauuuuaccauuuauuuuuguucauucccauagcuagcuuuugaauuccugaucccauuguguucauucaguacauuuuguugacugccugucauuguacuagggcauagugggugguggugaauaaaaaguguuuugaaucauuuagugggguagcaggcacuuauccacaggcucugaaaacuugauuugucccauacuugccuuaccugccaccaaccuguccuuccuguuccccacuucauuuagcaucuuugguguuuuaugguuuaaagcgaaaagcuauagucgucuuugggaauugaucaaacccuacuaaauuuagccuucuaaauuuuuuuuuuucuauccucuuuuucuccccuuaaggcuuuaaauucagaaauucagcccccuuuugcuuaggccagugacucucaaguuuucaguaaaaaaacuuuaccaaagaguuacucagauccugaauacauuaaacguaagagcaaaucuauuugguggcaaauucccuuucaucuuuuaaaaccaagcucaagugucaccuuuaccuucucauuugcccccccccaccucccaucacuuccgcuuuuguguggccuuucuccugugcaaaugcuucuguauuguauucuguccauuuacauuucucucuccauugggccacagcccccuugaggcuguucccugucuccugugccuaaacuauuaaauuaauccuuugugauuucuccaaaugaaaugaggcagaccuacucccauucacuucauauuucaaauacuuuauaacuuguucugaacaaguguuucacuugaacuccauugcccacagcauuuugcugcuuugaaagccugcuaauaggcucucagauuuuaacugugaagaucuuccaaugcuugagaguugguggcaguguacuagggagugacuauugcuuuccaaacugaugagagcuccugaguagaaauugaggguguugguaaugaaagggggugucuuacuuguaaaggcaaaugaaauaauauaacauguuuugaguaaucuuuacugccauugcagucagugguuuuguuuuuuuuccuuagcaucaagaaaucgccaggaaaggugaaagaagguaugacuauucuaauuuaacuaacuucucauguaagugucaagugcacuugcagauguuuccagucaaauaugaauggcccuuagaaagccagcaugggccuggccaagguuagcuggggccuauucccuguauuucauacaaauaaaaacugcauccacauugguguguaguggaugcuuaaagugaacuccaguaaauuuccugauuuauuuuuacgugaaugcuaauuagaaaauguaacucuauuuuuuaguuaauuugcaaaagaaaaaugaagacugugaaaaaggaaaugacuccaagaaaguuaaaguacaaaaaguacagucugucagguaaugagucuuuuguuucauuugggauguaaaggagaccuuuaagagaguuaaaguauuggcuaacaugggaaaauauuuuauuuuauuuuauuuuauuuuuauuuuuuuauuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccgggaaaauauuuuaauuaguaguaauuucagauugucgucucuguggaaaaaccaauuuugggccgggcauguuugcuuacacuuguaaucccagcguuuugggaggcugaagcagguggauugcuugaguccagaauuucaagaccagccuaggcaacaugguaaaacccagucucuacacaaaauaaaaaaaguaagcugggcgugcuggugugcaccuguauucccagcuacuccagaggccaaggugggaggaucacuugagcccaggaggucgaggcugcagugaggcgagauugugccacugcacuacagccugagcgacagagugagacccugucucaaaaaaaaaaucgguuuucauaaaaaaauaaagaucaguugaacacuuugucuuugcagguccugcagguuaaguucaaaaacuuuuuuuuagugguuuuauuauugagaaaauuucauuucaccucucccaauagauagauguuuauuucaagauacacugcagccuacugucagcacuucaaacuugccagccuacucuuauucaggcaguuuaauuuuucuggcugcugaauguuccuccagucaccagcccuuauggugcauggugcugaugcaaagacagucauuccaauggaaagguuguucaccacuauugccagucauggcaauucuucaaaaggagucauuuuucacaaaauucaaccuuucccugacaauauggccuuaucuucuauucuuauggucuacagaagucacagagaaagugccuauugcuguuacuggaauuuuggccgauacuguggacgaugucuguaguaucugucuugaaguccacaggcauucauuugaguugcauucaguacagcuuggugguccaaaucauuacuugcaaaucgguguuuuagccacaagaucaaauauagaaacaaauguaaagcaaagugcaagaccaugagaggaauucaucacaguauguuggacuuuucauuuggaaaaacuuauuuggcacaaucgauuuggaaaucaugcugucaauucucuuuuacuacauguauccgaacaauuuccuguuaacuaauguuuugacuuuugguuuuaguauauuuuaguacaaaaguccaggaacaaguucuucaguuggaucuaucugagaugcugauuguucaacugaugaacaaaaccaccaugugcucuacuaaaauaugagugucuguuucuuguaguccuuguaauuuaguuuuauccuaucugugcauauauaaaauuaguuucauuuaucacuaugagacaaaugauaaaaauauuuuaaaguaagcauguagccugggcacgguggcucaugccuguaaucccagcacuuugggaggccgaggcugguggaucacaaggucaggaguucgagaccagccuggccaacauggugaaaccccgucucuacugaaaauaaaaaaauuagcugggcaugguggcaggcaccuguaaucccacuauucaggaggcugaggcaggcaaguugcuugaaccugggaggcagaaguugcagugagcugagaucgcgcagccugggugacagagcgagacucugucucaggaagaaaaaaaaaagaaaguaagcauguguaauucuuauuuaaccuuuuauauugaucaacagccagaauaaaagcuacuuggccguaaggcuaaaagaccaagaucugagagauucaaggcaacaagcagcacaagccuucauacauaauucauuauaugggccaggaaccaacaggacuacugguaauuuuuuuauggacuauuuuucucacuuuuuacugcaaauaaaacugugaaaugauaaauaccuuucuuuucuaguaaauaaguuccugucucuugccaacaagagguuaccagugaaaagagcugcuguccaguuuuugaauaaugcuugggguaagauccagcuuuauucuccugucucuaauagcuuuauauguugaauaauguucuuuugaaggagauaguucauaauuauacuuuucccccuuauaauggcuuauauauuaaguua

SEQ ID NO: 17272 - RNA, 1268 nt, Homo sapiens
gaugguucuucaccaggguugacaaauauaugacacaaauguugcaacauacagcaaccugcugcccucccaugcuggucugaugcccuggcagacauugcuaaucggucacuacacucuuccuaaauccaucccggaucgcagagccucacugagacucaggguugcugggugguaccacuccaggaggcaccaguuguauuauacucuaugggaauguaccucugcugucauaaaaugggguagcccugccguugugcauagaacauaguagacacaaaauaaaaauucauugaaugaaccagauaugaccucugaauccuucucaacauaacacuucaaacagccacuacaaauugauuggauuuggcaugcaaguugaaccuauuugcuauuccugcuuuaaggaaacacaguaagaggcugccaacaugaaacauauuuaaucaucuuugcacaaguguguguuggguacaugcauaauguguaugcaaauacaguuugcuuagaacaugcaacucucuccucucccucccuccuacuccaucccuaaauauacaauuucauaaaaaccacaccugcaacugcuuauuggaaugggaagggcuccaacuuauguucucaaauuuauaacacuugccuguggauuucuaaaccgcgguuccucugauaaacuacagugccuggcagaaagguacaaaauauuucuaucugggccuaacgaaguuuuccuuggcuuuccaacccggguugauuaaacccauguuuguggacauugcucuuuucuuucucccuccccguuuggcuucauaccugucccuuccacugcucccaucgcauuagacuaagagaagaaccagacacguucgguaccaaagaggucaucggcaaauuccaaaauuuguuaaaauuuuuguaaaaauuaguugaaaaaguaacaggaaagagaggcaggauaagcacguuuuguauucaucucccaggguuugcaguguugcucagcuucacgaugaaaugggagaugcacuauuucacuggccaugaaauagaaaguuucaaaauccuguuguaaagacaauuucaaaauagacaccucucaaucccauuccccauuuaccguuuuugaaaaauagcauuaauuuacaaauguucuguuccuaaucagucacacggaaaaccauccugccuucacauuuauccuuuuaccuuauguccccucagaaaccauuuaggggaaaaaaggucuuaaaacaauuccauuccauuac

SEQ ID NO: 17273 - RNA, 2333 nt, Homo sapiens
uguugaucaauuuaugacaaccaucuuguuucuuacaauagcccaugcugauaaauauaaaguugcaaaagaggaccucagaauagcaugaacagauucucaauuccacauuuaguuucggucacgucaaucgaaucacaacacuaucacucagacaaaugccaaguaacacuuaguuuguauagcgugccacuuccaucucccuaugucagcaugaaaaaaaaagggguguuugcaucuuguaaauucauauugcuuuuuaauucaagagauucaaagugcuuuacuuuuuucaauuauugcuccuuuuucugcgguaguuuagcggauauuuguuguuuauaccacucacucuccacucucccaucuagaggcagcagugcccuaauauuauugggcguauauccaccaacucuuagucuauauuguuuucauucagccaacuccaucccccaggcuugagagugaagcauguaaucuaagauaauccaaucaccacacucuaccugccgccuguccacagugauuuguucaugagugugcaugugacccaaagucuggcccaucaagguuaaugagauucaagucuaggaaucacaaauuucuguuucuccauuggguaugaggcucagagaaaggcacuauggggcugcagucccaacccugaugaggagaguagagcuaaacccaggguaguagagaaacaagccaucaugauaucuaagcuucuaaaucacagugcaucugaaaccagccccuuuccuggacuuuucaauuauaugugugucaaaaaucccauuuuacuuaacccaguugugcuguuuacugucacucacaaccaaaauaauccuaauugauacaggcaaccagcagacuuuggguaugauuacgucuguuucuaagauaaagaaaugugagcaaaaagaaaugaucuccagucaguaaaagagcugugugaauuaaauacagaggcugaagauaccaaauauucuaaaacuaaagugcccuauaaauacaugaguuuuaauaaaacuuaaaacucaaaagccagaguuucugaucacauccagucucaaauauuucugauucuucaauugauucagcgccagagaaaccaaaucucccaguaggccaacagaagcuucaggaaaguagcagggaauucagggugaggcgaaaaggggagguauagggagucuaugaaaugaccaauuucaaauucagaaaagcuggcaagagucuaaaguaaaaucuaagaagcuagaucuguaagaaucucugauacuugugaaaucuaguuuacugugcacagcugaguaaguaagugugaggaaaaucaaauccugggggcuuggaaaaugccauuuuucuucucugcacccauagucccagcaccccaccugcugcucucugcagugcuggagcaugucaucugucauggucccccagguuagcacuuugaaugcagucaaaacaauagggaccaugcccucaucugcuaugggcgggcugguuucugcaauuaagcuaaaguucagguuuuggcuaauaacaggcaaggaaugugacagggaagggaaugcuuacucauuaacucaugcuaaugggugcuagaaccaaccaaccaccagcccacuagcgugagagugaggcacgcugugucacucugaucguggaguguuugcagguuuauuucacaacauuacuggagucuggcaguuaucuaaucaggagcgguuuuaagggaaaagaaaaggauaauuuuguuuuaagugccagucuuaggucucaauauuuuaugaaauagucauuaauuuucaauacaaggcugauggugauaugaugaggacugcauguuuaugcagaaaacguuccuuggcuaucucuaagaguuuggugaauguaggggaaacaauuaucucuuauuuuuguaaggcaaaugguaauuaucacaccagucucagcucucugagaagauaggucacugcaaagaaaggggcggacugacaguggguguaacacuggguaacaugggaagugggagaaugaagcuauuuuacuuguggcagaaaccauagaauccauucauuuaaucaaucauucccucaacacaaauguauugaguaucuacuaagucccaggcacaccacuaggugcugugccauucaauacuaaaugaugcagaggcuguuccugcccucugggaguugacauucuuuuggccacaaggacuuaggucucaggagacccaauuaagucuuuuguaugcaggaaaaauuuuaaagcagcaauuucugccacccaagucugacuacuucucacacuugggucac

SEQ ID NO: 17274 - RNA, 1317 nt, Homo sapiens
uggggaguguguccccucaaagaaagauguaauacugucuccacccaaaagacaauuuguauucugauggcaaaaacagcauauuuccaccgugggcacucugggcuuuuuuggugaacuguaauacaaaacaucagccagugaugucugggguuguacgaauuguaucugugccucaguaguaccccuugcagcaaugaaagaaaugaucuuuagaugaaagacgaaaagauaaauacucuuuaagcauuugcacaagcuuauuaucauuacuauuaauuauuaauugaggaaggacuaacacgagcuugauguggguagagauuuuguuuaagcaccagcccagagaggccuggaaaggaaaccaaaggaaaagcaugaauuauaaauacagauccugccauaggaagaugauggaagcacaggcgccuggaauggagaaggggucucaaggcugcaggcuccggaacugucacauggaguuaaugugcaccucaggaacugguccgcaguggcgugguaauguucauuagggggccagcauccagccugcuggagaaagacaaucagugcgagagcaggaccacaacuuugaggaucuuugaaggaacuuacauuucuuuugacacgcauuauguagggagaaaacaaaaaucaaaggccuagaguuuuguauuuuauuuaauugcuuugaagaucacgguaaacagauaguuagaccuaggguauucuauaauuagucgguaaauugugacaacaugagcugguauucuggaaagcauguauuuggaauguggcagauaaaggaaugaguugcauaauuuagguauuugaauauugaaauguaauaaacaauaguaauaauaaccauaauaaucccagagugacaaggaccuugcaaguuauagaauguucugguuagguuaccagauggagaacuguaauuagacucauuuuuuugguaauuuaagaaaugaaggcagcaucauuuuuggccucucaccaccuucccuuuauuucucagcaucucgaugccuucuggcuguagcaaaaaauuucucucuuuuucucugucucugucucucuuucuccuucuucucacaccccuauuuuuaucucuccuggagccugagccguuaguguuuugcugcugggaauccuggcacugugcauguuccuuacauguuucuuacacugagugagcccugugccaucucucuugaaucuucuuggugggggaugucaagacauuagcuacagcagaaugagucgucaaggaaguuucuaaagcuguagauacguuuuugcagugauccu

SEQ ID NO: 17275 - RNA, 2640 nt, Homo sapiens
auaccuacacugguguuugaccaaauaucugggucccauggccuagcuaaguuggugcaucagauuaaccguggggcuaaugagauguacuacauaagguugcuuuguggguuaagugagcugauauaggugaagaauuuagaacugugucagguacagauaaauucuugauaaguguuauccaucauuccuuccaaaaggaaucauucauucccagggcagacucucccucuguggcuuggacaugucauccuggccacuggguccaugccccugaagucagcaggcuuugcuucucuuccauuuacuucuuguggcugcgaagagucucugugccuugaguguggcagccugugucugggaggagagcgagcuuuccuggugcccacaucagugaggacacuaggugcugccucuuaguaaaggcccaacaggggagaugcugcaaggagaugucuggggauggaauucuccugagaggaucucuguuguugcuuauacucgcggcaagaagcaaacacaucgcucuuucaucuuggcaggaugugcugcugcugccagccugucugccccgccccuggaucgcccccacccccccgacucagguggauggcccuucagcaaaugccuuucuuggaaaaaaaaggagaacugcaccccuugccgcccaccuccuuuucaguucaaaacucugcucuaucuccuuugcccagccacaccuuucguggcccuuccuaccugacaaagggagauaccuuugagagucaggccugcauugcgagcugagcgaauguucuuuuuggaaacaaaggaguguucuuuuggcuuugguugaugaaagcagguggauuaagaacuaggauaaaugcaaaauauccuggaggacaauggggaaggaaagcugcgggaaggagacauggaaaggaggguggaaugggagaugggaaggggcuggcaggaccagggaaaggguaaaccacgcuuucaucuuggagucugaucuguuucugaacucugaagaguaaggccaugaauuuuaaaaggugucucugcaguaucucugcagcugacagcuccagucacagaaccagcccucucugaagcucaggagugccacaggaggcugagcccagggagucuggagaccaggaggcugggggagcccagcuggcccuugucaggaagcaggaucacucacaacuccaacgcacuggccugggcaggcuucuggcugcacuuggacguggcuggggcugaguauccccuggcagcuccuggagguguccacagggaugguaucagcagauaacuuucugagcaggucucaaggcacugcuggaugugcuugucaaugacaaagucacgcagacaccugcugcagucccuguucaccugugcugacugcugagaggacagcaggccucccggggacuggcuguuuucucaacaggguuuugagaaagguccucuucuagaaagggcugggggacccugcuuugagagcugcucccagagggggaagccagguaguuccaaagguccuggaggaggcucagagucugcaagucacccaguagagggagggaugugaagguggccugcugagugcucugggcuggaaaaguggcagugaguauuguccuuggagcccugggagaagugucagugcaucuuacuuuaugagaaaugcaugcucuugagaaauggaauguggacauuuaaaaaauauguauuguuauaucuuuaucaauaugucugauuuuuuuucgaaacccuggaguaucgcaaucaugacuucucuguuugugaauugagcaucaggaauauugaguuuucuaaaagcagggauauugguaauggaagcaaauggacacuucuggagcugucagguagcccagagcaggaccccaacagccaccaaugacacagcuccuuagcucgcuggcugagccaggaaaacagagguaguagcccugggcagagggacgccacacacagccaauccuguggagacacugggaggcaucuggaagccccacaagaaccuaccccuccucagcucuguguccugccuaguuacauccucagaauugugagguaccccuccagcagcuggaggccuguggaggggacucgccgugucucagcuuugggacuccugagcccccguuacaaaggagacucuuuuuagaggguguguggggcaaaauaccuucuuccucauuuauuaaaaauuguucauuggaguaaaauauacauaacauaaaauuuaccauucuaaccauuuaaaauguacauuucagugacauugagcgcauucauaaccuugugcaaccaucaccaccauccagcucuggguauuuuuucaucaucccuaacugaaacuccauaccuaugaaacaccaacuccucauucucuucuucccccagccccuggaaaccaccauuccacguucugucucuagaaauauaugaccacucuagguaucucacauaagugcagucacacaguauuuguccuucugugucuggcuuauuucaccuagcgugaugucuuuaagguauaucuauguugcagcauauaucagauguuauuuauuuaucuuuuuauuaugguaaaaauaucauaagauguaucau

SEQ ID NO: 17276 - RNA, 414 nt, Homo sapiens
agggccugaauccaguaccugucagaaugagauuacccuccagguuccaaaucccucagaauuaagagccaagccaccuucuucuuccuccaccugcaccgacucggccacccgggacaucagugaggguggggagucccccguuguucaguccgaugaggaggaaguucagguggacacugcccuggccacaucacacacugacagagaggccacuccggaugguggugaggacagcgacucuuaaauugggacaugggcguugucuggccacacuggaauccaguuuuggcuguaugcggaauuccaccuggaaagccagguuguuuuauagagguucuugauuuuuacauaauugccaauaaugugugagaaacuuaaagaacagcuaacaauaaagugugaggacgguaa

SEQ ID NO: 17277 - RNA, 1587 nt, Homo sapiens
gugguugcuuugaacuuuauuugagaaaaacagaagauaaauguaucaaaagaacacacagguggcgggggaggcacagccaguggcggcagcaggggugggcauccgggcuaaggcuuuacuuggcggcagucucaucggauuuugcagcuucugggcccccaagcugggcccgcgacucgaaggugacugggauggugaucucguuggacugcguggcuagcuugggcaugggggccuccacggucagugugcccucaggggacagggaggaggaaacuugggugggguccacaccggggggcagccuggacgugcagagaggaaaggcaagcguuacauuacacaccgggugggucccugugcccucuucccugaccccacccccacgccacccacccaccccgaccuggcgccaggacucacguguauuuccgcgugaagcaccgggagauguagccaugcucguccugccgcuccucgugcuugccuuuggggggaagagggaaaucagacugcgggggaggggacugccuuucggccccgcuaggccagaggccccaccuccugcuuggaagcagccaggacugcaggcugguagggauuaacagaggggguuggggaugggggcgugcccgccggucugggcucucagaaacuuccggaaaguucuucgauucagaguuuugggaggaacggagcagggcgcggagcuggggagugagcaguacgcaggcgcacuuggagccgcgcacacgcccacucagcggcuagaaacuggcaccgcgccagggaacuccccgcuuaucuggggauggggcugugggugggaaggggacucuguagaaaagcgcauuuucucucuucaucgaugaucuuuaaaaaaauuuuuguuugcuuuuuuuuuguaauggcgcggggucggggcgggggggcgcgucucgcuauguugcccaggcuagucuugaacuccuggccucaagcgauccucccgucucggccucccaaagcgcugggauuacagagcagaaagcgcccuuagaagcgacccgcacucccaauuccugagcaagggaaucaggaguccuguuuuucccggugcugggccaacguuuaacuccccaggcccccgggacccccguuucaaccgcacgcccccggcccugcccgcccugcuagccuccuccucuccccugcaggagcaggggggcucaccggugaucuccaccacgccauccuuggucuugaccgucagcucguccggggcgaagugguugacauccagggacacgcgccagcgguccgcagugugccggaucuccgagaccccgcugcugaguugccggcugagcgcgcggcuguaggcgggcgcggccacugcggggcucucgauggcggcggggggcagggggcgcacguagccuggccagcugcugccgccuaaccacugcgaccacuccuccggcagccggggcagcccgaaggccuggucgaagaggcggcuaugcggguaccagucgcggaaggggucccagcuggggccccgcaggagcgagaaggggacgcggcgcucggucaugcuggcug

SEQ ID NO: 17278 - RNA, 2933 nt, Homo sapiens
aagcacucacuuugaggaguacagguaauguuuuaaaaaauugcacaaaagaaaaaugaaugucgaaaugauucauucaguguuugaaagauauggcucuguugaaacaaugaguuucauacuuuguuuguaaaaaaaaaaaagcagagaaggguugaaaguuacauguuuuuuuguauauagaaauuugucaugucuaaaugaucagauuuguaugguuauggccuggaagaauuacuacguaaaaggcucuuaaacuauaccuaugcuuauuguuauuuuuguuacauauagcccucgucugagggaggggaacucgguauucugcgauuugagaauacuguucauuccuaugcugaaaguacuucucugagcucccuucuuagucuaaacucuuaagccauugcaacuucuuuuucuucagagaugauguuugacauuuucagcacuuccuguuccuauaaacccaaagaauauaaucuugaacacgaaguguuuguaacaagggauccaggcuaccaaucaaacaggacucauuauggggacaaaaaaaaaaauuauuucaccuucuuuccccccacaccucauuuaaauggggggaguaaaaacaugauuucaauguaaaugccucauuuuauuuuaguuuuauuuugauuuuuauuuaauauaaagaggccagaauaaauacggagcaucuucucagaauaguauuccuguccaaaaaucaagccggacaguggaaacuggacagcuguggggauauuaagcacccccacuuacaauucuuaaauucagaaucucguccccucccuucucguugaaggcaacuguucugguagcuaacuuucuccuguguaauggcgggagggaacaccggcuucaguuuuucauguccccaugacuugcauacaaaugguucaacuguauuaaaauuaagugcauuuggccaauagguaguaucuauacaauaacaacaaucucuaagaauuuccauaacuuuucuuaucugaaaggacucaagucuuccacugcagauacauuggaggcuucacccacguuuucuuucccuuuaguuuguuugcugucuggauggccaaugagccugucuccuuuucuguggccaaucugaaggccuucguuggaaguguuguuuacaguaauccuuaccaagauaacauacuguccuccagaauaccaaguauuaggugacacuagcucaagcuguugucuucagagcaguuaccaagaagcucggugcacagguuuucucugguucuuacaggaaccaccuacucuuucaguuuucuggcccaggagugggguaaauccuuuaguuagugcauuugaacuugauaccugugcauucaguucugugaauacugcccuuuuuggcgggguuuccucaucuccccagccugaacugcucaacucuaaacccaaauuagugucagccgaaaggagguuucaagauaguccugucaguauuuguggugaccuucagauuagacagucuucauuuccagccaguggaguccuggcuccagagccaucucugagacucguacuacuggauguuuuaauaucagaucauuacccaccauaugccucccacaggccaagggaaaacagacaccagaacuuggguugagggcacuaccagacugacauggccaguacagaggagaacuagggaaggaaugauguuuugcaccuuauugaaaagaaaauuuuaagugcauacauaauaguuaagagcuuuuauugugacaggagaacuuuuuuccauaugcgugcauacucucuguaauuccaguguaaaauauuguacuugcacuagcuuuuuuaaacaaauauuaaaaaauggaagaauucauauucuauuuucuaaucguggugugucuauuuguaggauacacucgagucuguuuauugaauuuuauggucccuuucuuugauggugcuugcagguuuucuagguagaaauuauuucauuauuauaauaaaacaauguuugauucaaaauuugaacaaaauuguuuuaaauaaauugucuguauaccaguacaaguuuauuguuucaguauacucguacuaauaaaauaacagugccaauugcagaugugugucuuugccuucuguuggguccucaaggaagaggccaggaaaagagugcuaauuccuccuccuuauugacccccgcucacgaguucucccuggguaggucggagguagggaggugugacaugaggcauugccuucgcugcuaauguuuuggggggaagaguacgugugagaugagguucuaagauaaaaggcacacagccacaccugaugucuugguuucuucaguucauguuuaugccuccuagcugaacacugcuguucacaagagguauacuugucuuuaaacaugugguagcuucaugcgcucguguggcauaaucuauacacuccuuacagauuugcucuaaacugguuaguggucuguaaguggaaaauuuauuuuuacuuccuguaauucaagcucauuagaaauucagcgagcagaccgggcacaguggcucacgcccauaaucccaacaguuggggaggccgaggcacaaggccugcuugagcccaggaguucgagaccagccuagucaacauaguaagaccucaucucuacaaaaaaugaaauuagccgggugugguggcacauaccuauggucccagcuacuuaggggacugaggugggaggaucgccuggggccaggaggucgaggcugcagugagccauaaucauaccgcugcacuccagccugggcgacagagcaaaacucugccucaaaaacaaaaaaaaaacccaacuccucgagcaggucucucagcauguggaggaacuccccguuuaccucaagaguaccacauuacagcuuugcacugggcccagucuu

SEQ ID NO: 17279 - RNA, 11430 nt, Homo sapiens
ugacgccugcgguugcugcgguggugacggggcuguuggggaggggccauugggggagggaaacggagcagugacagguaucccagagggugcugcugaggcgacgauggccgaggggcccgaggaagcccgaggccacccucccgggcaggacgauggcggaggggaccacgagcccgucccuucccugagaggcccuccuaccaccgccgucccaugcccccgcgacgacccccaggccgaaccccaggccccgggccggcccacagccccgggccucgcggcugccgccgcagccgacaaauuggagccgccgcgcgagcucaggaagcgcggggaggcggccuccggcuccggugcagagcugcaggagcaggcgggcugcgaggcgcccgaagccgcggcgccacgagagagaccagcucggcugagcgcccgcgaguacucccggcaagugcacgaguggcuguggcaguccuacugcggcuaccucaccuggcacagcggccuggccgccuucccagccuacugcagcccccagcccuccccgcagagcuucccuucgggcggcgcugcagucccccaggccgcggcgccgccgcccccgcagcugggcuauuacaaccccuucuacuuccugagccccggggccgcggggccugacccgcggacagcugccggcaucagcaccccugcuccagucgcgggccugggaccccgggcuccucacgugcaggcgucgguccgggccacuccagugacgaggguaggauccgcagccccuucgcgaagcccgagcgagaccgggcgacaggcaggugagaagcgcgagguggaggcugggcggaguagaaggguuuucgggggccugugggguagagcuggcacgcuuuuuagaccuguaacugcugcuucuacucugauugacuauccugcccguucaguucacuagcuaucguuuguccaggcccuaaauucccaaaauguacaaggaggcaauacaguuucuucuuccuuuagaccuggcacuccaaauugacucccuuacucaugggacuaguuguuuauucgugaaaagaaauugcucuucaaaccauccucuuccuuugguuuucacgcucugcagugagggccaaagcuaaauucgcaaauggcaaacccacuuuuggaggggcucgacugguaaugcugaaaauuauucagacauuggcuacuuaggacaguggaacugaacggauauaaaaggagaucgacauggauacaaguggaguuaggaaguuuugauugggucaaagcuucacuucauuugaucaauaucuuguauauuguguaauuguuuuugcuucugugugugaacuagaauauuuugaauuaguuacacuucuuaguuuacuauuuaaacuauuagacuuuuaguuuauuuuaguuagccacagauagaugggacaagaacuaguugaugccucugaucccagucagaauuuaggaugacagauugauacucacuggguuuauuuuaaagaaagcaaaacaaacuaaaaaacggguggggggggauuacagggauuuacuuuauacuaauugccaauauuuaaccuugauuuguacuaaaaaauguuuaauuuugugugacuuagaugugaucaccuggauucuccucauuagaauuccuagugaaauguaguggguacccuaaucaaauuuaucugugaaaucaguuuucuagggggaaaguggggaggguggggacaaggucugcuucuaucgcccagccuggauagugcaguggcgaucuuggcucccugcagccuccgccucccagguucaagccguccugccaccucagcuucccuaguagcugggacuaaaggcaugcgccaccacgcccggcuaauuuuuguauuuuuuguugagacgggguuucgccauguuggccagggccagacuggucucgaacuccuggccucaagcaaucugcccgccucggccuccuaaagugcugggauuacagacgugagucacugcaccuggccgugugaaaucaauuuuuaaacguuaaggugaugaaagcaaacuuuaagcucaguaaauaguggauucucuguuacucuauuuuaguaacauggauucuugguggaaucaauaucaauaguugcugcacgguuauaaauauuuuuuauuaaguuguaccuugacuuucuuuagcaauucauuacauggcuuguguuccaaggcuuaugugaaaugauucguuuuuccuaacuuuuuuuuuuuuuuaauuuacaggcagagaauauguuauuccauccuuggcccacagauuuauggcagagaugguggauuucuuuauucucuucuuuauaaaagcaaccauugucuuaagcauuaugcaccucagugggauaaaguaaguugaggacauuugcagaaggguuuuaauuucuacuguuuaaugaucuuguuuuauuacauucuguuugucuacacgugacuauauggauaaugggcuugucagugucaugauuucuuuauaagagcuuuguuagauuuauuguuuucuuguugauuuuaagaaauaacuagaaaggaaaaaaaauagcuuacugaauucuauaagaugugugggaaucucaccuaucaaaaauagguaaaaagagccuccaaaccugcuuugauuuuauucaccuauucuuuuaggccaggaacuaauuuaccucucacuauccuguucccucuugcuaucuuguggagucucuaaagacaaagguauaaagagcuuuugguaggugaauuaauaaucaacuagauggcauuuccaaaugggauugcacauacuguggggcaagucccaagugaacuucaaagugagacguuuauuugaguaauccuuccagauuaacaauaaucauaauagcaguuaccacuuccugaguacuuucuauaugccauguauugagcuugcucacuucuuuauguggauucuuauuuaaucuuaauaccaagaugagguguagagauuaauaccaccauuuuauagaguuugaaauuuggguuuaugaaaaguugagcacagaaccuaaaauguuacaaagguaguaagugacagagucaagauacaagccugugcagucaaauuucaggguccuugccagaaaccuguuacugugauuccucccugucccucccucucacuccacuccacauccagugaaauaccaacuccuuuauguucaauuuucugaauagcuuucaaccccagaccuccucacugccagaucauuuuucuuuuuuugagacagagucuugcucugucacccaggcuggagugcaguaguacaauuauggcucacugcagccuugaucuccugugcccaagugacacucccaccucagccucacaaggagcugggaccacaggcaugcuccaccaugccuagcuaauuaaaaaaaaaaauuguuuuuuguagagauggggucucccuauguugcccaggcuggucucaaacuccugggcucaaaugauccuccugccuuagcuucccaaagugcugagauuacaagcaugagccaccacaccuggcccauuuuuuaucaucauugcuucucccuacuccgauuacugucgucucuugcuuggauuauagcagaagccuucuagugguaacucagucuccuguuuuaucucaauccagucucugauauaaaaccaaagugaucauaaauccugguucuguuccuuuccuaccuuaaaacccuucaaugguuucucuuuuuaaaauguuuauuguuuuuuuagagauggggucuguguugcccagguugcuuucaaaauccuaggcucaggcgauccucccaccucagccucccaaagugcugggauuacaugcgugagccaccaugcucagccccuucaaugguuucucuuuaccagcaggauaaagucugaauuucaucaugugguuuauacucaggaggcugucucaaccucccaaguaggugggacugcaggugcauaccaccacacccugccuuuauuucuuaaucacugccaccucucacauuuaguauaugagccacaccaaacugcuuacagcuucuaucauauucucucuuucuccaagacauucucuccugcuguucccucuuucuggaacguuauuuccucuucuuagucuggcuaacuucucuucauccuucagagccucaucuaacugucuuuucugggaaaccuucacaagguuaaguguaucugguguauguuuccauaguauccuagguuccccaucacagcacucaucccacuuuauuauugcuauuuauuuauuguucuguuuucuuugcuagguuagacccuccacgaaagcagggaccguguaaauucauucacccuuauuucccccgugcuaguacagugucugcucaugauaaugcugcuuauuuguugaauaaacuaaugaaugcuuuaugauacuagaugguugggaaucuaaagauuaguuuagaauuucaauuaaaauguaugacuugcacuaaugaaaaaaaagucagugcuacuguucugguaacuaauuauuuauaaccccaaacuauuauuuuguguagggauaucucuaaguuugcuaugcauuauauaauagaagaaauagaugaagacacaucaauggaagacuugcagaaaaugaugguuguggcacuuauauacagauuauuaguuuguuucuaugagguaagcuacugacuucagcaagaauuaauauuuaacaaucuaauuuuauguuuuuacauuuauuuuuuugagacagagucucgcucugucacccaggcuggagugcaguggugugaucuuggcucacugcaaccucugccuccugaguucaagugauucuccugucucagccuccugaguaggugggacuacaggugcauaccaccacaccuggcuaauuuuuguauuuuuaguagagacaggguuuugccauguaggccaggcuggucucaaacuccuggccucagugaucugcccaccuuggccucccaaagugcugggauuacaggcaugagccacugcaccuagccaacaaucuaauuuuagauuaucagcccaagacgaaaaaguaaucgaaauuuauaauuauucaugucuuuuccacaugucuacuuuucuguuuuuuuucccaaauuuuaacuaaucauuaaguaaaaacuuuuggaagagagacauuuuacaauuucuuuguaauauuuuucagucuuagaaacucaaauaaaauuucacuuauagauugugguccaaaaauauacuuguaaauugcaauguaguuuucugcagaagcagcuuacuagaaaguauaguagucauagagaaauauuacaggagacagacaucuugugguauuggacauguuagagaccuacagaaaugcauaaaguuaaaugguuaacuuuugaguauucuaugcaauucuuucaacuugaaaaauuuaaaacaugaaauaauauggugggaaaaguuuaucuuuaaaauugguauaguugagccaguaauuuuuaaaucauccuucuuuccuuagauaauuugcauuuggggagcagguggagcuaccccagggaaguuccugcuggggcuucgaguugugacaugugauacaucagugcuuauugcaccaagucggguuuuagugauuccuuccucaaauguuagcauuacaacguaaguccuuuucuuagcuuaaucuacuacauacuuaaugaaaauaauguguuuuagaauauugggguuuuuuucuucauaguagauaggcuuauauuuauuaaguuaaaacaaaguuugaauauuuauuucaguuguguuacaugauuguagaccucuuuuacaguacacauuuucaagaugauuuuuuuuuuuuuuuuuuugugagacggagucucacucuguugcccaggcuggagugcaguggcacagucucggcucacugcaggcuccgccucccagguucacgccauucuccugccucagccucccgaguaggugggacuacaggugcccgccaccacgcccggcuaauuuuuuguauuuuuaguagggacgggguuucaccguguuaaccaggauggucuugaucuccugaccucaugauccacccgccuccgccucucaaaguguugggauuacagacgugagccaccaugcccugccucaagaugaucauuuuaugaauuauaagucacaauacgagaggaugauuuggguguugaugguguauuagugcuccacaaucagcuuuauuauucuuuggaccuguggauguuaggucagguacuagucugccuugagucuccauuuggccaugccugucauuauuccaucuugaauaggcagcagaguuuugacagcuaugcauucgugcauccuucuccugcuguuaggugagagcuuguaauacugccaguauucaagguuagcuguuggcaucuagcgcugggggaagguacaaccagugauaauggaaacuguggaggucaguggcugguagucaguugagccaaacaagguauuggcugcaauuuuugccagaaugauucagagcuggauuguuacaucaagaaauauaaacaagugauucuagaaaccuugguuuugccaucuucaaauuuuucuuaaaauuugguaguuauagccgggcacaguggcucacgccuguaaucccagcacuuugugaggcugaggugggcagaucacgaggucaggagaucgagaccauccuggcuaacauggugaaaccccgucucuacuaaaaauacaaaaaauuagccgggcgugguggcgggcccuguagucccagcuacucaggaggcugaggcaggagaauggcaugaacccgggaggcagagcuugcagugagcugagauugcaccacugcacuccaaccugggcgacagagcaagacuccaucucaaaaaaaaaaaaaaacaaaacaaaacugguaguuauaaaccuaccuacuucuuuuaauaagagucaguaauggcuaauguuuauugaguacuuuuuauauaccugcacuguuaauaacacugcauauguauuaauuuaaugcuaacaaccucauaagauagagacuauugaucuauaucuauaguaucauaagauacuauagguagucucuaucuauauacuauagguaguaucuauauacuauagguaguaucuauauacuaucuauaguaucauaagauagauacuauuguucccuuuuugcagauguggaauacaacuaguaauugguagacgauggaucugaauuuaacuagucuggauucagaacccacacuccuagccacuguacuuuucugcagcccuucagugcacuaaaaggcagaaaucuaacauaaguaggauaauucuccauccugagugauuguugaaagcuuuuaaaagcuuugcuuaaucacuggaucccacaaaggaaaaugcugauuaaagaacacacaguacuuuaaaaugcauguuuuuucuauaagguagacaaaugggacuacaguaagcauacucagaaaguacucagaauuaauguucauuucuucugagaaaauacuagaaagcucuguaaaccauuaauucaauauucugagacauguuuauuacugcuuuuuauguuguugaagucuuauuagaaauagcccaggugguuugaucaugauacagugcuacuugaaaauauaucaaagguaaaaauucucucaacuauaccuugaaugucuuuuucccuguagacuucuguagagaaguacaauuguguuuuaaaugucuauuuugaacuugaugggauaccauuaaucuauaugugguuugauguguaacuuaccugauauuuuuguuuuaacuuuuuagguccacuauccgagcuuugaucaagaauuuuucaauugcuucuuuuuucccugcuuucaucacacugcuguuuuuucagcauaaucgaacagcuuaugacauuguagcaggaaccauugugguaaaaagaaauggggucagaugaugccccccaaaacccugauuuccacacacuaagacuaaauuauguaucaaggccaucaguaucccuggguuacacuaauugaugauuuagaaauuaaagcagucacuccagugugaugcaggugacuacucugaaaguauugauuauacuugaaugccaaagaacuuguccagaagaaaaaccuguuaaauucaaguauuaaaauuuuuagaucaaaaaggcaaaugauuuuauaaacaauggacaauauauacuuucuuaagaucuaagguacuuucuuaagaucuaagaauuugcugaaagcauuuucagcuuugaaaucuccaaaugaaacuuuaaaauuuauuuugguuuaucccaaaauaauggaaaauguccaguuguguuuuguaaacaccuauguaacucaucuuuuaguuuacacuuccuggggaaauugucuuugguguuuagaggagggaaugagaacacaaauuggauaauccacugucucccaucccaggagguggugaguuggcuacaagagaaagggacaagugaggcaggccuagcaguucccuuaccugaaguuuucaaauccauacugcaguucccucucguaaugauguaacuuuacaacuauucuuaaugcuugaacauguauuuaggggcaaguuucucaugaugaugaaaaaguaucaagucauauugcuauguuaauugguuuuuuuuuuuaaaagguaaguuagugauuacuguuaauggugggggaguaaguuuucacuguaaauugaacuuauaauuuaugugcaaguguuuucagugcccugaaucaaacuauaaauguggggagaaaucaccuccaucaaacaguugcauauuuacuguaaaaguauucccaguaugugugcagcaugaagaaaguauuagugcuucucaguguucucaguguaaauucuauuuauauacagcauauucacauacuacuuuccuuauauuuuauauaguucuaugacuguugaaacaucaaggaguuaaaaaaaucuuaauauuucaugauuaacucuaaguacuauuaauuaauagcuugcgaaauauuagcaauuuucccauuauggacuauucucucuaaagcaagagagacuagcauucccagacaucauucuagggucuuuaagcucauuuugggucugcuaaaguuuggggggaaauguuacgcaaagugauacuguguauguugccauuuugcuuuauucuucuguugaagcaaaauugugggguuuuauuaugugugugugcuuuuccuagaugucccaguuagcugugcugagauauaccuguacuauuuaugguuuaaguuuugauucuuagguauuuucuccagcucugacauuguuuuccaaagacacacuaaacugcauugcacaguucaaaauuugauuacuuaagggaucaaucuaggugguguucuuggucuuaaauuuaacagcaaacacagcacauaucuauuaucacuauauuaauuuucaaagguuuuucuuugacguuuaaaacugugacaacagauauucacauuugauuauagaaacuuaaugucuauuaauaauuuuaguacaaaauuucauaaaccguguuuuucaaaauaaguuuaugucaaauccagcuucccagaaacacuaauaauuaaguacaucaauguacuaaauaaaucauucaguugcacccauggggaagauuguguuacugcccuucacagugaaaaaaagaaaaaucuuucauuuuuaaaauuaggagauguuacguaacuuggcacuuuaguaguguauacacuagcauuaguuuauacaccacuuuugccgcuggggaauucaaguugaaaugucccucaaucauauaggucuggaauacaucuuucauucauaauuucugcucagauaauugaauaguuugccaucgagauuauuuucauuuauacuauaaaacaaaagcaaacuaguccaguuuaauuuuuuguacuuagaauauugcacauuuucuauauaugaguuauucagauuaguaucuauguagguucagucagauccaaccauggauucgagguauuauacuguauaacccuacaaaauacauagaaguauuauuugccuucauaauagaacccaagagucuguuucaauuuaugaauucaguauuugcaccgagauuuugauucccaaaguuuggaaaaaaaugacaaaacaacgagggaagaaggaaccagaccuuagugccacauauuuuucucuugggguuguaagguagucuccugcuuuccagaacacuuuauuauauuucacuuauagaccugauuuucugugucaaaguauaauucucaugcugaagcuguagccuaaaaagccaaaagaaaguugucuucauuguacaaacauauucaucacuuuaacaauaagggaacaaaauuuaguauucaagcugagugagaauacuguuucaaugagcaugucccuaagauaaaccagaauuggcaguuaauuuaggcgucuagaaaaucucaguucccaccaguaaaauuauccugaguagcuaaugcaccuugagaaaaaucuggcauacugaauaaauaacauuaacuugggagccaagagcuggguaagccuuaccuuuagacuacucugugacuacagaaauaaagccagcacuuuuggaacuaauaagccuucacuugucaguaucauaaagaguauugcccaacugaacuuugcucccacugguuuaauaguuacuuauuucugccuaagcacucaccuuccgauuuuacccaaguauauauauaggauagaaaaaaaugcauuauauuugagagcuacuucgcccaaauuacaaaaugaguguuuuuagauucaagugacaguaaaaggauuuguucccuucagugacuugaguguuuuaguuaugcauaaguauuucuagcaaaggaaggguagaaaggaauugaaaauuaauuuacacuaguugcuacuugggaauaaagggcuuuuugagggggguauggauauuaaauguuuucguuauauacuuaucccuauuaaaacaggcaguuguuucuuugaauaugccuaaauaacaguauucuuaaaaucugacagacaaguaacaugucaauuacuugauauuccuugucuccaguaccacaggccacucuugacaucccauguuugccuggauaaaguuccucauuucaaacaguauacauacuucuuugcaguucauuauaguaaggcuuaaccuguaaacaguaucugauggcccaccuauaaauaaaauucagcauucuauuuuuaauaauuuguaugccaccaauuuguauuauuugucucaauaaauacuuagucaucaaugcaucuguauuuugucu

SEQ ID NO: 17280 - RNA, 2355 nt, Homo sapiens
cacgucccaccccgugaccaugacugugaccgugaccgagagcgucgcuggggcacggccaggcggcgcggcgggagugcacaggacgcgccauggcggccgaagccucggagagcgggccagcgcugcaugagcucaugcgcgaggcggagaucagccugcucgagugcaaggugugcuuugagaaguuuggccaccggcagcagcggcgcccgcgcaaccuguccugcggccacguggucugccuggccugcguggccgcccuggcgcacccgcgcacucuggcccucgagugcccauucugcaggcgagcuugccggggcugcgacaccagcgacugccugccggugcugcaccucauagagcuccugggcucagcgcuucgccaguccccggccgcccaucgcgccgcccccagcgcccccggagcccucaccugccaccacaccuucggcggcugggggacccuggucaaccccaccggacuggcgcuuugucccaagacggggcgugucgugguggugcacgacggcaggaggcgugucaagauuuuugacucagggggaggaugcgcgcaucaguuuggagagaagggggacgcugcccaagacauuagguacccuguggaugucaccaucaccaacgacugccaugugguugucacugacgccggcgaucgcuccaucaaaguguuugauuuuuuuggccagaucaagcuugucauuggaggccaauucuccuuaccuugggguguggagaccaccccucagaaugggauugugguaacugaugcggaggcagggucccugcaccuccuggacgucgacuucgcggaagggguccuucggagaacugaaagguugcaagcucaucugugcaauccccgagggguggcagugucuuggcucaccggggccauugcgguccuggagcacccccuggcccuggggacugggguuugcagcaccagggugaaaguguuuagcucaaguaugcagcuugucggccaaguggauaccuuugggcugagccucuacuuucccuccaaaauaacugccuccgcugugaccuuugaucaccagggaaaugugauuguugcagauacaucugguccagcuauccuuugcuuaggaaaaccugaggaguuuccaguaccgaagcccauggucacucauggucuuucgcauccuguggcucuuaccuucaccaaggagaauucucuucuugugcuggacacagcaucucauucuauaaaagucuauaaaguugacugggggugaugggcuggggugggucccuggaaucagaagcacuagugcugccauuaaugaauuguuuaacccuggauaagucacuuaaacucaucuauccaggcagggauaauuaaaaccaucuggcagacuuacaaagcuugggacaguuauuggagauuaaucuaccauuuauugaaugcauacucugugcaaggaaauuugcaaauauuagcuuauuuaaucuguacuauccagugagguaauuucuucccccccaagauagagucaagcucugucacccaggcuggagugcagaagcaugaucacagcucacuacaguuucaacgucccccgcucaggugguccuuccaccucagccucccaaguagcugggaccacaagugugcauuaccacacucagcuaauuuuuguauuuuggcagagaugggguuucaccauguugcccaggcuggucucaaacuccugaguucaagcaauccaccuuccucggccucccaaaguacuaggaguacaggcauagccacuugcucagccauaauuuuuauuauuaaucucauuguacaagugagaaaacugagacccagagagcuuaagugacuuccucgaggucauaguuacuuacugccuuagucccaauuugaauucaauucugauuccaaauaaguugcgcuuaaauaagacaacagaugugggaaaaauaugugaauguguaguguugcuauguguacugucuuuacaaguagcuaauuauuuuagcacaaagaugugcaaagaaaggagacuuuauggagaguucaggagaaaaaggauuuugugguggccaucacuuucauucaauuugcgacugcucugauggcacauuagaugaaguuacuguugauccugaguuacgugaauaagaaaaacaauugaacugcuuauuaaaaaaguaaacaugucuuuuaacgccuauaucuucuccacuauacaaacucagaaaauaccacuugguuguuugagaaaggccuauauuuguguaaguucuaaacuauugcagaacacacuacauacuagcgucaaagggcugaugacgcuccuguua

SEQ ID NO: 17281 - RNA, 2324 nt, Homo sapiens
gugaccgagagcgucgcuggggcacggccaggcggcgcggcgggagugcacaggacgcgccauggcggccgaagccucggagagcgggccagcgcugcaugagcucaugcgcgaggcggagaucagccugcucgagugcaaggugugcuuugagaaguuuggccaccggcagcagcggcgcccgcgcaaccuguccugcggccacguggucugccuggccugcguggccgcccuggcgcacccgcgcacucuggcccucgagugcccauucugcaggcgagcuugccggggcugcgacaccagcgacugccugccggugcugcaccucauagagcuccugggcucagcgcuucgccaguccccggccgcccaucgcgccgcccccagcgcccccggagcccucaccugccaccacaccuucggcggcugggggacccuggucaaccccaccggacuggcgcuuugucccaagacggggcgugucgugguggugcacgacggcaggaggcgugucaagauuuuugacucagggggaggaugcgcgcaucaguuuggagagaagggggacgcugcccaagacauuagguacccuguggaugucaccaucaccaacgacugccaugugguugucacugacgccggcgaucgcuccaucaaaguguuugauuuuuuuggccagaucaagcuugucauuggaggccaauucuccuuaccuugggguguggagaccaccccucagaaugggauugugguaacugaugcggaggcagggucccugcaccuccuggacgucgacuucgcggaagggguccuucggagaacugaaagguugcaagcucaucugugcaauccccgagggguggcagugucuuggcucaccggggccauugcgguccuggagcacccccuggcccuggggacugggguuugcagcaccagggugaaaguguuuagcucaaguaugcagcuugucggccaaguggauaccuuugggcugagccucuacuuucccuccaaaauaacugccuccgcugugaccuuugaucaccagggaaaugugauuguugcagauacaucugguccagcuauccuuugcuuaggaaaaccugaggaguuuccaguaccgaagcccauggucacucauggucuuucgcauccuguggcucuuaccuucaccaaggagaauucucuucuugugcuggacacagcaucucauucuauaaaagucuauaaaguugacugggggugaugggcuggggugggucccuggaaucagaagcacuagugcugccauuaaugaauuguuuaacccuggauaagucacuuaaacucaucuauccaggcagggauaauuaaaaccaucuggcagacuuacaaagcuugggacaguuauuggagauuaaucuaccauuuauugaaugcauacucugugcaaggaaauuugcaaauauuagcuuauuuaaucuguacuauccagugagguaauuucuucccccccaagauagagucaagcucugucacccaggcuggagugcagaagcaugaucacagcucacuacaguuucaacgucccccgcucaggugguccuuccaccucagccucccaaguagcugggaccacaagugugcauuaccacacucagcuaauuuuuguauuuuggcagagaugggguuucaccauguugcccaggcuggucucaaacuccugaguucaagcaauccaccuuccucggccucccaaaguacuaggaguacaggcauagccacuugcucagccauaauuuuuauuauuaaucucauuguacaagugagaaaacugagacccagagagcuuaagugacuuccucgaggucauaguuacuuacugccuuagucccaauuugaauucaauucugauuccaaauaaguugcgcuuaaauaagacaacagaugugggaaaaauaugugaauguguaguguugcuauguguacugucuuuacaaguagcuaauuauuuuagcacaaagaugugcaaagaaaggagacuuuauggagaguucaggagaaaaaggauuuugugguggccaucacuuucauucaauuugcgacugcucugauggcacauuagaugaaguuacuguugauccugaguuacgugaauaagaaaaacaauugaacugcuuauuaaaaaaguaaacaugucuuuuaacgccuauaucuucuccacuauacaaacucagaaaauaccacuugguuguuugagaaaggccuauauuuguguaaguucuaaacuauugcagaacacacuacauacuagcgucaaagggcugaugacgcuccuguua

SEQ ID NO: 17282 - RNA, 1265 nt, Homo sapiens
aucaucuucgccaaaaucuauaaaggggcugauuaacucagcucuguaguaauuguuucauauuaaaucaguccaaaaguuuagggcauguuucucaggaacucuuuaucuagcaucagguauguaucuaaacaguauaguaucuguuaauuuugaaguuauauaaaaaaagaaaaugugcauuuucacacgucuuaguagaagcucuuuacaguuuauauaauccaauguugauagaguaaaauuuuuuuauucuuuccaguaaucaaaaaguagucaaaauaaacaaaaguuucaacuuuuagagguaucauuuuuuagauuagauugcuuauaugguuugaugcuuucuuagaagguugaaugauucuaaaaugcuuuuaagaaaaacaucaagaauaaaaagaauuacuuaaaaccaggucaaauaaaaaaagauuaucagagaucucauaaggcuugcaauaucauuucaagauuuauuuuaaaaguaagauugcacuuuguucacuauucuuccccugccaaaagacacagaacuuccuugugaaacuguguuuaggauccauaccauaauaucaucuuuuccaggaaacugaaucauaaagaggucuauagggugauccuaggaaugaaaucccaaaauuccgcaggauggggcuaagguuuguauuuucaaccugagaacuucaggcugcuucuccuucagcaaccuccuccucuucuccacugcagcuccccccagccucccugaagucccagggagcuggggccuguccuuccuaacacaaacuuucuuucuucuggaagugcuggaaaaucucagagagacucacugucucccacauccuguaaauuuacccaggagagaagcacugugcacacuuugugaggagggucgcgcucauuggagagacucggugaaagcaacgaggagacuguacaagcacacacgcagccucuucaccucacacuccacagcuauuucucaugcacucuggccuuaacuuugcugaccuugccaccgcaagguuuuauaucacuaaauaacagagcacgaggcugccaugguggacaaucugccugcacuugccccuccacaucaccaaagcuccuuagaucccauucaucaaauauuugcuuuuacacuuaaacacacaauuuaugaaacacaauuucugguucaccuaacccuugcaugacgugaguuuugaaaaaccaguaaauuuuccugcugacauuccucaaguuacacgcuuuccugg

SEQ ID NO: 17283 - RNA, 609 nt, Homo sapiens
uucugaagugucugcucccuucaacauugugucugaccccccaagacucauccuuugggccaggcgaaggucuguuccuccuucucuguucccuucuacccauucuacugggucaccuugaugugggcugaagaauguccuagaaauucugcuuggccucuuucuuaaugagcugucggggccuucugucucuccacuuucuccuuuuucacuagagcaucuuggagcuucuaguuggaagucaccuccugcagaugagcuugggaagaucugugugggauggccacuuagcgcauauugucugaggagcugcgagcuagaaaaggccaccagguggggaaaacuuggcuggaauucuguucuaggcucugcuagagagaaagucuuggucagaaucaccacaggugaccauggauuguaauaccugcccagcaguuuucuucagauguucacaacaaagacuuaucuuccaacccacaagggcacauuacaugcucuauugcagcacagaaaacccacacuacaaacuaguccuaucagccaaacuaaaagguucaaaaaagcaucacaggcagcuucagcucuauaaauugcugcaaguagaguuac

SEQ ID NO: 17284 - RNA, 3657 nt, Homo sapiens
accgagcccgauugugucauaaaauauuuuauuggaaaaaaagucaccgucuucgcaagaggggguaggggccccagcgacaucggggacccggccuccaggccgagccgacggguugccccggggcaaucucaggccguuguggccugagcccaaccgcuggguccccgacguccagaagcgggugugugccuggaggcuccccggccgggagggcaggccccagacggggugggggugcaggcgaggagcggggcgugaauacgcguggagcgcucugcgccacggagcucaggguagagacuguagcuuccgccgggcuggaugcgagucucccagguuagagcccagaagcgcgcugggaccugggucuggcuuuugggucuguguccuuccucguuuggccccaauuguccgcauucaagaucauaauaaaaaggcuuaggaaguaaacuucuuggacgcggaagggccggcucgcggguuuccgccgagugagggggcugcggguggcgcgggcaucccaggccccgcaccguauaccgcccucaguccucgcggcuccugucgcugggcucgcccggcaccuccgccgguuucucugcauccuuggcgcgcuccugcucaguaagcugcucgcucguuggaauugaguucuucuugggccgccccuugggcuuggugggagacuccaggccgccgcccugcagcaccugcacgggggaccgccagcaccugggugagccagcacguggacuggggacccccgaggagacuugaacccagguaggacuaaggagugcaggguccauaugaggaaaugguggggaaaugucccgggaaauggcggccauuuguccaaaugccgccuggggagcggcccggccuggggagcauaagacugccaggaggccugaaggugccgcgggaaaggacgaaauguuggcuuacccaaggggcagaaaaaacugagaggauuccggugcguaccaggcaccgagggaaucgggggguugggcagagucucaguggggagaaagaggagagcagcucugcaugcaccggggcauggcccaggaagcugaggggugggaagccaccaggcacacucacuauuuucuuccacuucauccuccgauucugguaccacgucuucaccugcaacuggcucaggcccagggacucagcaagaucuauucuggaaagagcagggcgcacccucagcaaggcaagugaccacacucccacagcccgcuggccccagccuuguaccgcccuaccuguccggcguggaaagguacuucugcuucucgaagcguuucuccaggcccaucagcugcagcucggugaacacagugcggcuccgacgccccuucuuggcuuuggugccuggcuccccagggccugccgccuccagcuucccgcggagcugcaacucgagcggcagguguggcgcacccgcggcgccgggcagcccgggcccugccgccagcaacgcagagcucagcccugaacagcccagcggcgccagugggaacuugaacaccgccgccugcucggccuucagcacggcugcgaagaaagagaaugaggacccgggugagcuacggccgcgcuccucugccccagggacugccgcaccacgugccgcgggggugcucgcgcuuggccagugccucccagcgcaaaaccuccacgcccugccggucggcgccgguggcgcagauggagacccuccucaacguugccguuccccagauuugggagggaguaucuccucgacccuguccguguucuguccuggaguuccccaggccucagcugccucugagaucucgggguuccugaugaacauguuugcagcugcgagaaacucggagugugucuugucuuucggggaaaguagaaaccaaaaagaaaacggcagcugguccuaagaagauggcguuugcuccaaccaaaucagccuugcugcguuagaaaaagaacaugcacggagcgugcacauuugcucuuccgugcguggcacaacagccaugcgguggccaggagucaucugggccggaguugggugcuucccggaaauuccaaaguacccugagaaccuggaaauuauuguucacguuuucuauuuucagacgcuuccccaugcagauguuuccauuuucuucaguccuaaaaugauugugugcccgcuucaaacgaauuaguagcaacagagcagauggagacgaaagguagccgaauggccgagucccagcuggacuuagaaggagcgcgcuggcccugccgucuccaggcuagggagcaccgacuaggaggugggggggugcagggaaggcgacuugaagggcuggggucccggcuacagcguaggagccucccuuccccgacaggccugucacugaggugcgaguccuagccuggcuggagucggaaagggcagggcaaggcgcagguaaauguggggcagaggacccguagggaaaaggugggagaugggaggcaggccgaccccaaugagagaagcgagggaggccgaccggcagacgguuggaaagcgagauagggaaagacaagacgaggguggagugcgauggagacagcaccaucagggcagagcaggccccgccaaauuagaagaaagggcagaagcugaaaaggucugcgcaggccguucaagcccugcagaggcccagccgaccugaaaccagaagggacagccaggcagcugcucacagucaggccucuggccccaaggcaaggccgaagcagguccgcacugcggccaaggccgcguuccucgcccgcuggagcucccggggacuccgggccggcuugggcccgcgucagcacccagcccucgggagcgcaggccuccuccccagagguccgacuucccuggguugggcagccgcggccacucccggccaucccucugcggcgaagcccaggcgcccguggccugaggucgcuuccacccacgagaguccguagccuggcagugcgccugcacuggggaugcucacucgggguccccgggcuggaggccgaagggaagcagugaaggaaagagcgaacacccuccccgggcggcccgcgggcacgaggccugguuucugugaggccuggagcuugcacccuccgccucccgccuggagggcuccgagagacggucccagaaccugcgcucccagagcagcuucccggggcugcuucgaugccggaggaggcucggggcgcccccgcgguucagcucgcugucucccgccaagcccggcccgcgaccccgcggccgccacacguacccagguggcuguggaagggccgcgccgccagcagcgccugcacgccgaacuucagcagcucgcccgccgcggcagcggcggcugcgggcgcggcgcccuugggcccggguggcuccgugaggaucuccucaaucaugaagcugcgauagcggugcggccggugguccgcgcagcccucgggcgggccgaagcgcgcggcgcccggcucccccggccgcugcaucgcggcgcccacugcugcgcccgcgguuuggcggcggcggcggcgacggcuuggcuccggcgcggggcccgcgcggggcucuaggccggcccgcagcucggggcggcgcgcgggcgccggcucaug

SEQ ID NO: 17285 - RNA, 680 nt, Homo sapiens
uagucccgcuagcgcaccgacuacaaaacccguccagccccgcgcccacccguccccguccgugauuggccugcgccgccagcgucgagccggauguaccggcgccuugcaguccccuggacggcggucgagugggcgcggccccgcggccuuccccacacucagagccggggacacugcucggucgccgggccucgcgcuccccugugccucuggcagccggcggccacgcgggguggcaagacggcugccgggagaacccccagggggaggcgggugcggggcggcaggacugggcucccgaccgugggacgaacaacgcggacagagcccgggaggccacgagcuagaagcgcauccgagagcgcgggugaacggcugcugcuggaaacccguggacggugugacgcaugcucugugcagacgucugggggcgggaggaggacgggccagcagggggcgcccaggggccagcgggaaccucagcaccgccccucaguccuucaaggucuauuucuugggaauaaagacauuuccauuaauacagggucauaaacgugguaaauauaauuguugucuccgcaucuauuuuuaggccugacuuaaguuguuugaaagccagucguacccuucgccuuggcguagguaacacuucuccguauaugguggugugugagaua

SEQ ID NO: 17286 - RNA, 54368 nt, Homo sapiens
cucacacaccaccauauacggagaaguguuaccuacgccaaggcgaaggguacgacuggcuuucaaacaacuuaagucaggccuaaaaauagaugcggagacaacaauuauauuuaccacguuuaugacccuguauuaauggaaaugucuuuauucccaagaaauagaccuugaaggacugaggggcggugcugagguucccgcuggccccugggcgcccccugcuggcccguccuccucccgcccccagacgucugcacagagcaugcgucacaccguccacggguuuccagcagcagccguucacccgcgcucucggaugcgcuucuagcucguggccucccgggcucuguccgcguuguucgucccacggucgggagcccaguccugccgccccgcacccgccucccccuggggguucucccggcagccgucuugccaccccgcguggccgccggcugccagaggcacaggggagcgcgaggcccggcgaccgagcaguguccccggcucugaguguggggaaggccgcggggccgcgcccacucgaccgccguccaggggacugcaaggcgccgguacauccggcucgacgcuggcggcgcaggccaaucacggacggggacgggugggcgcggggcuggacggguuuuguagucggugcgcuagcgggacuacuguccccacagcccccugggccacauuggcgucaguggcugcgcccgagggcccgccccucacagagcaugggccaaucauagccgggggccgggcgggcgccgggcaugauggaccuuguggucggagcgcaggcaggacuccagcccccagcgggccccgcgcgccggaggggaggagccgugcggcggcgcgggcgggcgggcggccgucggggcagggcggcggcggcggcggcagcggcggcggcugaggagggcccggccugcgagagccucagugggagccggcucagcccucggccaccaugucggcgccgucggaggaggaggaguacgcgcggcuggugauggaggcgcagccggaguggcugcgcgccgaggugaagcggcugucccacgagcuggccgagaccacgcgugagaagauccaggcggccgaguacgggcuggcggugcucgaggagaagcaccagcucaagcugcaguucgaggagcucgagguggacuaugaggcuauccgcagcgagauggagcagcucaaggaggugagccgagccgcccugcccugcgacccccgcccggcgccggggccugugggcgucgucccuggcaccagggcggccaaggucagcuugccaagcgggggccggcaggggugggccgccggggcggagggggcacgggcaguaugugggagugggcccggccuuggcuagcaggccggugccgcggccguugcagacgccgcuaaugcagggguccgggcgccuugucgccuccugcagcugcccgccugcuucugugcggaccugggcggccccggcggggcggggcuucguaagggcugaugcuuugcgguggucgcuguuccgggugugucugaguguggggugggguugggagggcaguggcugagccgggagcugaggccacggaugcuggugacccgcugggagaggccgagggugggccugggucuggguggcugcggcucugucaccuucagagaaagcacuuccccucucugggcgcagcuacuuucggagcguuucugcuucuuucaugagugccuccgagguggggaaaggucguggacagcggccuaagugaguaggggcucgggguugcacguggagguugccccuggcaugggucccccaguacccuugccccaggcccagcgcuguguccucauggccgggauugcgcucccaccagcuagcaugacuucccuggcccacuuccuguccagccccgcuucucgggcccuuccccucgcuguggcuugcuguguuccucuuggacggagaccucaguggucugugucauucccacuggggggagaguagguuagaccaccaggcuggucgagggucuccaggcggcagggcagcgggagucuuggacaguccuuccccagcuucucuucucccguucccugacuccauagcguuguuugcaggaauugcuuucugggaggauacaccaggguuuggauccaggcugugccccuugcuagugauguggcuuuggguagaggcccuccgugagucuuaguuucccccucugcaaaaugggagugcaguacugcgugcccagaaaggauuguugugagggucauguauuuggaaaggacuggugugcggucaggaguauagcuugguggugugcucccuucccccacuugaguguguccuggugagcccuuggcucuugguuuccaggcuuaucaccuggcaccucugcucccagucagcccagacaggugccuaaaucauuugcagccuuccuugccucccccgugucugaggagacccgucuguggagagcagagaaugaauccaagcagaugcuuggaugucugggcagagcaggugcucaguuaguaccagucaauggcugacccugggccagcaggagcuggguccucccccaucgcccucaggacucgauucuguugucugucagcagguauuggcaccuucugcaaugcaugcuccaguggcgcuggagcuacaagaggggugagaugcagcugcucuugcaagaguccccaucuuaggguggggcgugugauagggaggcagggggcucugagaauauggagugggaguggacucggccaguuucuggucuccuguagcggggcucacccucuccagcaggcagcacuaucuguuagggcgcuuuucccucugcacacagugaagcagcccucuuccuccuaccaagugcaucgugagccgcuccugggcagccucuacagucccugucucuguccacagcuuggguuuggcaguguccucugugagaaggaauugucgcugacuuaacuuguccccgcuuuggugcccuucauuugucaggucuuugcuauucugacacaaacguuuuggcacagugaagaaucuuggcauuuucguggcauguaucuggagggugagucccuagcagaaucaggaagaggguauaccuguuucuguggguacucuuuaggcgucugcuugcuuguuuuuugucaccaccuggcuuccauguacuggccacauggccuuggacaaauuacugcucuguucugaaucuaguucuccuuuguaaggugggauaagaauguuucugcucggucucuagcagagucuagaggaaugugcaucagcguuucaguuucaguagauguugccagaaaguuuguaccaguucaccccccaucaacagcaugcguguuccucacacccaugccaacacaggcucuugcuaaccuauuuaauuauggccaguauuauaguugaaaauauuaacucuucauuuaaaaaaaaccacaagauuuaaggagucaauaauugugggguuuuuuuucuccuguagagcgguguaccgccuuaauucuuuagaaaacuuuauuucuugaacuaaagugcauuuaguuacuaauaaauugugcuccaaauggaguugcuuguacuucugcccugcauuuguagauaauaggaucguugagggaaggacgcuggccugcuggucccaguguguggguuucugaucagagcugaggagggucuuguggugaugaaugggagacagugccaguccuguugccuuucucaugggaugggggaagugucuguguccugcugacaacauagcacggugcuggcugagaccacaagugaggugggugcccccugguugauuuugccuaaucauucugcuagugauuucuugagccugacucaguuaagaccauaucuguccccguucccacugugcccuuucccuuccucucccuggaaugguggggaagagaauuagaugggcuuuggucagcaaccugguguuccugguccugcguggccgugagacacuuuguucuguguucuuagcuguagcuuuaagaggacaggugugcugagguggcagcuccugccuucagggcacaggcagggacuguagcuaggugggcuaaggcuaggugcccaugugguccucauggucaggggaggguaaugggggaggucugagaacagucuugacuccaccugagcucaggcucagagaggaggucuggacacccucacugccuuggugugccaccuuggugucauagugucaagcucuggagcaccauuguccuugucugagaggugcacguggguggaauuggguguuggacugggcacagcacccaacacgcagcaagugcuucguaggucuucugcggacugaaucucaugccucacucaggucucugucuccuugcugcugcaccugcagcuucuccccguucuuauccuugucccugcucagucucaaguggcuuccauugccaccucccaagggcugcccuaagcauugucucaggccccuacagccuggcuugggacugcccuaccucuccugugcccacauucacccuuugucuuagaagucccaccugcccuucaagcuugggugucucuaaaauuccccugccugcugccuucuggacuugcugagcccuguucccagcaccugggcagcugcaggaagugggggcaauagggugauuggcagaggacccuccaggagguuccucugcagaguuacugggggugaggcccagccucuuugauuguuugcuuccagagcaggaaaaguccuggucuugguuaaagcaagugugggauucucccauucgucugauaaccccugagaacauuguuguguccauuucugaacagaaggcuguugggagcaaggaggcucugggagacccaagggccuuucagggggcugggugguggcaguggucugcuguugguaugaggaagccuggcuugggugggagcuggggcccugugaauaccugaagcacagaugggucugacaguuggggagaggcagcuauaggcauccaaagaugaugaccauguggcuacacuguugucacuaauuguugggcaauucucuccccgcugggccucucuuuccccacuuuuagaauauggggcagggggucaugaaggaaucuuuagggacccuuacacuuuuaaaaaugucugaaacucccacaucgagcccuggugcuguuucuuccuguagggccuggcgacugggcacuuguguaucucaaucauccugggaccuggccagggaaucugcccagcccuaggcaugcggauggugugcuccaggccagcccugccagcauguggaggcguggaccuggccacccuccaugggauucaaggcaggcacagcugugauggagcagcucgucuuuggggaugccaagcgagcaugcuuuguggcuuagcagguggauccagaggaaggccaggcccagugcugggagccccugggccccugggggugccuggcaccaccugagcaggaccgacuguauaugaugucugucccugugaacuccauacugacuccacagggggagucugggcccugccuggucucccaggagcuugcggcccuggaugagccgcugccugucugggccgugauagguuaaugaugaugccuguuaccuuggcccagugcucugugagcccccaaggucagggaguggugucccugugcccuugugucugagcauccggcccagguccauauaggauuccugcuaggucuccccugucacuuagggaccacagucccuuccuuugagggaggagaucaguuucuucuuugucaguuuugggcaucccccagucagucagaccugcuuccccacauagguggaccagaugaaacuguuacacacaucggggguaagaaagauuugguuucuucucagacaguacaccagcuguuugagguggugguggcugguggccagggcuggccaggacuaugcaggcuuugacagguaaagcauuggccuuagacccuguguuguccaguguucagaguguggccucugaagccgaacucuggagcaggagagggcccaauguggcugccuagcugccuccuugggcucaaacccugcugucccaagcugggcucugcucugcugugggagguggauggagagauggggacugaguggcaggcaggcuccccuugccacccucagagcauugcaggccaggguuaggguuaggaggaggucacugggggcccagcuucuuuuuuagaagcuacuguguuuuaaaaaaucauacauucacuuuaagaacagcagaaaguggagagaacagugucaauaggaccuguguagauggcgcaggacaaauguggggagcacuggguguuucucucugccagcucuucuucccuugugagugugugauguguacaagacaccaucaaacacaggggaaaggcuuugugcaucuguaauaguuguuuuuuguuaaaguuaguuuguugcuacucugagauacauaaaagcagguuuaauucaaguagauaaagacaggaagguuucuguggauccagagguucugugguacuucuaacuuauacuguuguguuacuauaugaaauaauugucaugguuugcuuuuuauaguuggcuuuuuacuuuuuaauuuauuauuauuauuauuuauuuauuuugguagagucagggucucacuguguugcccaggcugcucuugaacuccugggcuugagcgauccucccgccuuggccugcaaaguguugggauuagagaugugagcuaccacgccugaucuauaguuugcuuuuuuuuuuuugagacggaguuucgcuuuuguugcccaggcuggagugcaauggcgcgaucuuggcucaccacaaccuccgccucccagguuccagcgauucuccugccucagccucccuaguagcugggauuauaggcaugugccaccaugcccggcuaauuuuuuuuguauuuuuaguagagaugggguuucuccauguuggucaggcuggucucgaacuccugaccucaggugauccgccugccuuggccucccaaagugcugggauuacaggcaugagccaccacgcccagccuuuuuuuuuuuuuuuuugagacggagucuuguuauguugcccaggcuggaguacaguagcucgaucuuggcucacuguaaccucugcuucccgaguucaagugauucucaugccucagccuccugaguagcugggauuacaggugcgcgccaccacaccuggcuaauuuuuguauuuuuaguagagacgagguuucuccauguuagccaggcuggucucgaacuccugaccucgggugaucugccugccucagccucccaaagugcugggauuacaggcgugagccacugcgccuggcugcuuuacucauuauuuacuuauuuauuuauuuauucauauuauuauuauuauuauuauuauuauuugagacagagucuagcucuguugcccagcguggagugcaguggcacgaucucgacucacugcaaacucugccuuccagguucaagcaauucuccugccucagccucccgaguagcugggauuacaggagcccaccaccacgcccggcuaauuuuuguauuuuuaguagagaugagguuucaccauguuggucagacuggucucaaacuguugaccucagaugauccacucgccucagccucccaaagugcugggauuacaggcgugagccaccgcgcccagccuuuacucauuuuuuaaagccaccuucuuuguuggauguuuccacauaaucaaagguggagagaguaauagagugaguccauguaugcuccugcccugcaccugcaguuugcagcuguggccggucuuguuucuaccgcaguucauccuguguagcugugucuguaaguauaucaguuguuuugcuaagaaaauagaaucuuuucuuuuuuuuuuugagauggagucucacucugucacccaggcuggaguacaauggcgcgaucucggcuuacugcaagcuccgccuccuggguucacaccauucuccugccucagcucccccccgcccccccgcaguagcugggacuauaggcgccugccaccaugcccagcuaauagaaaauagaaucuuuucuuacaaaacuuaaccauuguugaacuuucacaccuaagaaacuaacaaaaauucuuuagugucaucuguuguccagucaguguuuggauuuccccaguuuggcucauaaauuucauuuuacaguuacuuuguuucuucagaagccaagcaggaucugcagguugcauuugguugaaggccuucucaauuuuuuuuuuuuuuuuuuuuuuuuuuuggagacagucucguucugucgcccaggcuggagugcaguggcgugaucuuggcucacugcaaucucugccuccuguguucaagcaacucuccuaccucagccuccaaaguagcugggaccauaggugcacacugccacaccuggcuaauuuuuuguauuuuaguagaggcgggguuucaccauguugcccgggcuggucuugaauuccugaguucaggcaaucagucugccucggcccagcaaggugcuaggauuacagaccuugucauuuuaaagacagcgccauguguggccuguccuguccccuuucauacugcacuggcauuagcccuggcuacucuauuuuuaugcuguggagggugccgguaggcggagauucccacuuuaucugccccugccagacaccuuacucuugucuuucucuuuuauuuccuuuuuuuuuuuuugagacggagucucacucuguugcccaggcuguagugcaguggcgcgaugucugcucacugcaaccucugccucccggguucaagcgauucuccugccugagccuccugaguagcugggauuacaggcgugcaccaccacgucuggcuaacuuuuguauuuuuaguagagacaggguuucauccuguuaggcaggucuugaacuccugaccucaugaucugccugccucggccucccaaagugcugggauuacaggcgugagccacugugccuggccucucuuuucuuuuuuaaaauauuagccaggggccgggcgcaguggcucacgccuguaaucccagcacuuugggaggcugaggcaggcggaucacgaggucagcagaucgagaccauccuggcuaacacggugaaaccccgucucuacuaaaaauacaaaaaauuagccgggcuugguggcaggcaccuguagucccagcuacuugggaggcugaggcaggagaauggcaugaacccgggaggcggagcuugcagugagccgagaucgugccacugcacuccagccugggcaacagagcgagacuccgucucagacaaaaaaaaaaaaaaaguagccagggugccuccuucagcugaugcaucauggcuuggcucuugcauugcugcauugucaucaccuauucugguucaucugucgccccagccuuuacuguggagcucugcccaccugaggugauguugucaucuaguggguguagaugccaagcccuucuaaaccagaagggaggaacuaguauugucacuguccuaccauugagggugcugaggucauagugaggaccacucauacucuuacuagcauggcaguggacucagccauucuuggcuugacuucugugaccuggagccagucucuccccucucugggccucaguuuccuuguuuuaggccagugcauuccugacgcccuuggagguggaucaauuucucccucuagugacagcaucauggcgggcucaggcccaggacgcagcugcuuugcaggcauguguugccugcugccugggcuccccaucugcuuugcucugcccuucuuccucacacccauguucccucaguaccacccucacaacaugcugggguguaagggcugguugaugacaagcauguccauaagccuaggggauuccuuggguguccuaaaaugugaccuaagauaauuaucggggaacaugccccgauauucacguaaguucuuuucauuuuccuuaagugucggccagcuugagaaauaaagggacagaguacaaaagagagaaauuuuaaagcugggcauccgggggagacaucacaugucgguagguuccgugaugccccacaagccgcaaaaaccagcaaguuuuuauuagggaguuucaaaaggggagggagugugcgaauaggugugggucacagacaucaaguacuuuacaagguaauagaauaucaugaggcaaguggaggcagggcaagaucacaggaccacaggaccgaggcgaaauuaaaauugcuaaugaaguuucgggcaccauuguuauugauaacaucuuaucaggagacaggguuuugagaucaacuggucugaccaaaauuuauuaggcgggaauuuccucuuccuaauaagccugggagcgcuaugggaaacuggagucuaucucaccucugcaaucucgaccauaagagacagguaugccccaggggggccaguucagagaccuaccccuaggugugcauucucuuucucagggacguuccaugcugagaaaaagaauucagugauauuucucccauuugcuuuugaaagaagagaaauauggcucuguucugcccggcucaccaguggucagaguuuaagguuaucucucuuguucccugaacaauugcuguuauccuguucuuuuuuucaaggugcccacauuucauauugcucaaacacacaugcuguacaauuugugcaguuaaugcaauuauuacaggguccugaggugacauacauccuucucagcugacaggauuaagagauuaaaguaaagacaggcauaggaaaucacaaggguauugauuggggaagugauaaguguacaugaaaucuucacaauuuauguuuagagauugcaguaaagacaggcauaagaaauuacaaaaguauuaauuuggggaacuaauaaauguccaugaaaucuucacaauccacguucuucugccauggcuucagccggucucucuguuuggggucccugacuucccauaacagauaauggcaucucauugugguuuaaguugcacuucccuguucacugauuggaucaggccaauuuuauuacuucugugaagcacaguucugcuauaacgugucuuuugaaaauguaaauuuguuccagacugauugauauaugagggaacaguuugaacacgaugagaauuuuguauuugccuacguacaguuuucuccucaaaaaacacuaguguacacagagcccugcacccggccuaccugagcuaugugaggauacacaggauacacgcaccuacagcuucccauuccauuucagaacacccaccuucuaccaccucagguagcugaugaguugccagccgugacaucacacccacuggcaaaccucagggcuucuuaagauaaagugucauguguauuguagcacuuaugugucuuuuuuuuuuuuuuugagauguagucuugcucucucgcccaggcuggagugcaguggcgcgaucuuggcuuacugcaagcuccgccucccggguucacgccauucuccugccucagccucccgaguagcuccgacuacaggcacccgccaccaugcccggcuaauuuuuuuguauuuuuaguagugacgggguuucacgguguuagcugggauggucuugaucuccugaccucgugauccgccugucucagccucccaaggugcuggaauuacagacuuaugugucuuuaagccauugaacguguauaaaacugugcuaccggccgggcacgguggcucacgccuguaaucccagcacuuugggaggacgaggcaggcggaucaugaggucaggagaucgagaccauccuggcuaacacggugaaaccccaucucuacuaaaaauacaaaaaaauuagccggccuugguggcgggugccuguagucccagcuacucaggaggcugaggcaggagaaugaugugaacccggaaggcggagcuuguggugagcugagauugcgccacugcacuccagccugggcgacagagcaagacuccgucucaaaaaaaauaaaauaaaauaaaaaacugugcugcccuuuuaucauuaauuuuaaaaaaugaacuacuuuagaaaauuuuuagauuuauagaaaaauuugaaaaauaguacagaguugcuguauaccccacacccagcugccuccuuauuauaacauuguacauuagugugguauauuuguuacaauggaugaaccaauaucauggcauuauuaugaauacuuuauucagauugccuuaguuuuuaccugauguccuuuuucugucccaaguauugucuaggauaucacauuacauuuaguuguugugucuccuuaggcuccaguugacugugacaguuucucagaccuucccuguucuugaugaccuugacaguuuucaagaagauugaucagguguuuaguagaauguuuuucacuuggaauuugucugauguuuuuucucgugguuagauugggauuauggguuugggggaggaagaucacagaaguaaaugcccuucucaucacauaucaagaguguguauugucagcaugaccugucacugcugcuguugaccuugaucaccugaccgccacucuaaaguuauucuuucucuuccuguccauacuguauucucgggaaggaaauuacugugcauaacccauacuugaguagggaguuugcuccaccucuuugagggcagggugcuaucuacauaaauuauuugcgauuuuucugcauggcagacuuuucccucccucccacucuuguuuauuauaucaauguagacucaugaaaguucauuuuauuuauuuuauuugggacagggucucacucugucgcccaggcuggaguggaguggugugaucgugacucacugcaacuuugaccuccugggcucaagugaucuuuccaccucagucuccccaguagcaugugccaccaccccuagcuaauuuuuugauuuuuuuaguagguacauggucucauuauguugcccaggcucgucuuuaauuccuuggcuuauguacuucuccuaucuuggccuucuaaagugcugggauuccaggcaugagccacugugcccagcccaugaaaguuuauuuuauacuuuggguuauaauccaacauuaccucauuuuguugcucaaauugcuccagcuuuggcucuugagagcucuuucagauggcucuuauacccccuuuaacauaccacaucauggugccucuuuuuuuuuuuuuaaagugcuuccuuccuuucuggcacuacaagauguugcaggcuuaucuguuuccucccucaguccuagaaucagcuauuuaccccaagaagcccugguuucuuuaguugagaaagauguuagaaaccaagaucugguugcuaugugugcucauugcuauuagggugucuuugauuuaaggccugucagcaacagaacaaggagauuguuuugaacaugcaguuaguuaguggcugggcgcaguggcucaugccuguaaucccagcacuuugggaggccgaggcggguggaucacgugagguuaggaguucgagaccagccuggccaacauggggaaaccucgucucuacuaaaaauacaaaaauuagcuguucgugguggugggcgccuguaaucccagcuacccaggaggcugaggcaggagaauuacuugaacccaggaggcggagguugcagugugccaagaucgcaucauuacacuccagccugggcgacaggagcaaaacuccaucucaaaaaaaaaaaaaaaugcaguuaguguauacuaacccauguauauacauaugucaauaaauacaccuguauguauauuuaguuaaccaugaguucauacugauguaagaacuguaauccauuaccacguagaucguucuuaccaccuucccuugcuuaucuguaaccucccacuccaacagugagacaccuggcucccaccauccaccauccaguaacuuaauuguuucauuccaguucacauguacagcaguaacagaauuguuaaccuggguccccaugggaaacaauuuuaucaacuagaguuacagugcuuuuguguaauucuuuugccuuuagucuuauagacucuacuuauuuccaaaguuacuuaaguuagggcugggcucaguggcucacaccuguaauccuagcacuuugggaggccaaggaggauagaucaccugaggucaggagccagccuggccaacaugacgaaaacccgucucuacuaaaaaugcaaaaauuagccgggcguggucccaggugucugcagucccagcuacuuggaagacugaggcaggagaaucacuugaacccaggaagccgagguugcagugagccgagauuguaccacugcauuccaaccugggggacagaguaagacucugucucaaaacaacaacaacaacaacaacaacaacaacaaaaaaccaaccacccuggccaacauggugaaaccucaucucuacuaaaaauacaaaaauuagccaggcuugguggugugugccuguagucccaccuucuugggaggcugaggcaggagaauugcuugaacccaagaggcagagguugcagugagcugagaucucgccacugcacuccagccugggcaacagagcgacucuaucucaaaaaaaacaaauaaaaagaaaaaguuacuuaaguuaguacuuuauucccccauccccuucagugagguuguuugauacauuuguaauacaauuagauuauuuugucacauucuacauuccagcccaggaucccuugaucucccaaaugaauuuuuaaaacaauucacauacuaauauuaagguucacuuuuuguuuuuauaaaugcaguggcauuuaucuaccauuacaggaucauacagaauaguuucacugccuuaaaaaaaaaacccuaugcuucaccuguuuaaauccacccccgucaaccucuggcaaccacugaucuuuuuaccaucauuacgguuuugccuuuuccagaaugucacauaauuggaaucauacaguauguagcccuuuucagacuggcuucuuucacuuagcaauaugcacuuaagauuuauccauguuuuuucauggcuugauugcucuuuuuuuuuuucuuaaaucacaauaauaugggugaaccacaauuuaucuguucaccuauugaaagacaucuuaguugcuucuacuuuuuggcaaauaugaauaaagcugcuuuaaacauucacguacaaguucuagugcagguaauuaccauuuggguaauuaccugaagagucugaucgcuggauuguaugauaagacuguauuuagcuuugugagaaacugccagacucuuccaaaugcgaauaccauuuuguauuuccgccagcauugaacaagaguucccucuccucaggcuccacccucauaguucauccuguggugggaagaacucuggggauugcgaggagauggcguaagauucuccugccacuugcugacugugaaccuuacuggugucucuuucuaaaacagugcuaauaaggugaagaagugugaugaggguuugagaugaagucaggagaaaacccgggcugcagccaugcucuccuguggcuuucagcccagccuggcccagacugcugugcccacugugccauccuccccucguuuggaacagaugccgucuggacagcugcguggcagggcccccaagcuguccccucuugcccugacuacaagcuguugaauggagauuugugucagggcagccagcugccauggaagaugagggcugguccccaggccccaggacuggcuucugugucuugggcgggguagcuagggucuguggggaccuuugccagcccugggugcagcuggccagaagccugucugcugacacuggggcaauuaggguguaaucuucucuaaauggcacccaauucuggcuaaaucccuccugcccagggaugaauucccaguuuucuaaaagcagcuuagcauuuggacguugcccagggcagcugggguucacgguuggugaugggauggcugcuuccgauugaugugggccucacagaggaggggccaugggugggcagaggcuggugacaagcaccacagcccuacaguguucccugugugggugccucucagcccugaguccuagcgauccccgcauccacaaguguaaguccuccuuggggaaaugcaguuccaaagccacccaguaggaagggugggccagugccccucagccuccuguggugugagggacagaugggccugcagaggggcuugggccugggcugguccugcagcguacagcuugauagauauaggcuggcagaggugggcgggcgcugccuccuggccuggaccccaguucccaggaggccccacccucuuuuccuggccuggaccccaguccucaagaggccccacccugucuugcagggacuccugcagccuucccaggcuccugcuugagugcuccugggccuccucccuccucccugucuaccugccaggugaggcugucugaguuccucagggaccaacuccaccuccugcccccucuccuguuacccccuugccccucccuguaccaucuccucugggaaccacccugcugcaaagaagaaaaauggauuuuggagugagaagccuuauggucccacucagaugaaucaucucaccuuguugauccucaguuuguucacccaugaaagggaacaauaaaaguuuuuacuuugcagggcuugugugaagacacaugauucacacccaccucuguccgcuccugggggcccuggaccccacauccuuuguugccuguaucugcuuaggaaguaccuuuugaauaaagagaggagggaguugguuuagugaugcuggagcauccccacccagcuggggauggaugggaagagcuggcugaggggauggugagguagggucucccauauaacacccaugggaucccacugggugggucauugugucugugaggggcccagguagucaacaggucuauuucuggcuucuuagcugacuuggguuccaguagaagcauguggagcugacuagucugcuuguaccccagggucacugggggacuuucaaaaauucuaaagcucaggggccacacucagaccuauuaaaucagucucaggaguguuuacacuuccagaaugaucccaggggaaagaugagugugggagcacuauccugucauugcaguuuacacccggggguuugaauccucccugcugugcacaucgugcgugauucagcccuggagagggguacaaccccccaaguggagaaccugggaugccucucuguaccucucuggagugugcaugagcuaaggggaagacccaggacaggggcaagccugggagccauuccugcugcugagucacggggguguguccccuccacuggcuggagagagagggaugaaagaggagaugucccaaaagaaccugcaaugccugcccacccuguaccccuggaguucccugcaguccuagccucacucagccguauucauacauauggcauacauauucauacauaugcagccauauucauauucugcacucucagcaccccagcaucuggcuaugcccuugaccugccaugcugucagcccacuucggguguggggccugucaccucccagcugugugcauagguucccccugucugucuuccauucaugccacagaugcuuccugagccuugccacuugcugggcuugggcuccucacuccguuccugcacucaccaaggaggugcagaugugugguggacgugggcguccaucugcccacaaggacaggccugaacccuucccgugugagaggccuugccccacccacacuguguguauaucuggauggucggcccugccuucugccugagcuauuucucagcaucagugagcuaaagugaugggggugcuggcugaagugaggguaauguuaggcuggagggaauucugcuguccugggacagcugcuggacuuuuccauccugcccggugagucuggcccucccuacugacucccuggugaccccccuguccugagccauaucccuggagcuguugccuacacuuguggcgaugaaagagaugcaggucaggaccucacccaggagccuggcggggacuuuggaagaaagcauaccagcaugcagaccugcuucccaguguagccaggggccugggcaaagugcuucuccacagagcugcccagccucucgcacuaggccgagauggcaagggucagcaccuaagagggggucaggccuguggcugcuguuguugauggugcagaugguggacagguccauuuacccucuuggcccccggugacauacuggcucugagauuuggccuacuggggacccaccagggaagucauccagaaggucugugugggagcuuggugggccaccaguuugguggccuuucccuagaagcugcugggagaccucugccacccaccuuccauauuggugugguucacugugagacagagcugagccccauuucaguccaggcugcauuuuuuagggcggccuuugaccucaacagucagacauuuccggagcagcucuggcugcugacuaguugauuguuuugugcagcucucauuuuuaaauugagguaugauuugccuguaagaccacacgcaguugugcaguugugugcucucguguggcugccccauggugaagguuacccugaagugcucagacucuuccuguccacccagcagcguacugccugccuucuacagugauuagguuucuucauacuugguguguggucuuuugggucuggcuucucuaagagccaucacgacgguuacuuguaugaggagugaguuuucuugcugcugagcaucauccacugugucaucauacuagaguuacugccguccaccuguuguugggugcugggcauugugaauguaccauacuuggcguggacauguggcaugugcuuccauguuucuuucuuuuuuuuuuuuuuuuuggagacggagucucacucugucgcccaggcuggagugcaguggugugaucuuggcucacugcaaccucugcucccggguucaagcaauuuuucuugccucagccucccaaguaguugagauuacaggccccugccaccaugcccagcuaauuuuuuauuguuuaguagagacaggauuucgccauguuggccaggcuggucuugaacuccugaccucaggugaucugccugccucagccucccaaagugcugggauuacaggcgugagccaccaugcccggccaaugcuuccaucuuucuuggguggugccugcagcaagccccucuccccacuguauucacauaucaacauguccgagcaggagggccaguccuuucacucgugcuuugccaccacagguaaccuucuagggagggagggaccaugugucaggagggaaaugaucuccauaaauugugggaaguggggcccagggaccaccaugacuggcuuuagccagaucucaguuguuaggcaguccccacauugaguccaagcuuucuagguuccaggccaagaccaggaagggccgagucccagauguucaugcaccugggaaugggaguuugcaguucuccaggugauuuugaggagcaggcgugguuggggcacuggucagacaauugagcacugugggccagggucuaggcccaggcccagccacuucuggaucaucagccucucuuucuugcuuucucuucagacccucuuggggaaacguuuauggagauguguguucucggaguucaguuucucaccugugagaggagcuaauaccuccugugagagaagcuaaugagcuuacauuggugcaaacugugaagugcagcgaugccuugggguaauugcccucccuccccugggcacccagagucuucuugcuuaucuguuaacagcuguguuguccucugucuuccucccucugggcccacaucaaagcuggaggggugcugacggcagcccaaggcugggaaaaccuggggguggagagggaucaucuggacagagcaggcccagugaagaugccucaggacaggggaccccccuccccuguccccacccuuaguuagguggauccccuucuccccucaccgcacugccucuacaccguucuuggaucugggucauuacugggcugaacaguaggcagagguuccagcucaucucacauccaucucccaacuauaccucccuccuggcccuggaacccucccaucccccaucccagugugcccugcgacucuguuucugcugguguuuguagcuacuguaaguuguuuuccugaauugcuagcaaggcuguacaucuguuuguggggugaucugaagcaucuggcccuguguaaaucugaaguccauuucuugccaccauuuccugaccugacccuguguucuuauaucagguuuuugcugaaguucauuuaugaaaauuugaucuuucaucuuguuucugauauuauccauuuuaugaauaacaagcaauuuaacucccugugauauguuugguuugggguuuuauuaaucuuuuaaacuagaauuacauauaguaaaauguauagauuuuaagugcauguguguauguuggcaaauaugucaucccuuggguacauuugcuauucugcagcuuuuccuuuuuuuucuuuuuuuuuucugagacggagucucgcucugucauccaggcuggagugcagugacacaaucuuggcucacugcuaccuccaccuccuggguucaagugauucuccugccucagccuccugaguagcugggucuacaggcgcgugccaccacaccuggcuaauuuuuuguauuuuuaguagaggagggguuucaccauguuagccaggauggucuucaucucuugaccucaugauccgcccgccucggccucccaaagugcugggauuacaggcuugagccaccacgccuggcccaauaguuuucauauuacacuaguuuuuaauaaaaauaagcuuuuacuggaguguaagguaaauauggaaacuauaaaaaucauaauuguauaguuugauaaauuaucaaaguaaguacacccauguaacuaccaacagaucaagaaguugcauguagucagcuucccagagcugcucucugagcccugucaaggugugaucauucuggcuuuugacaccaaagauuauaucuugccugguuuugacuucuuauagauggaguugcaccguacuuuuuuuguguguucacucagcaucgugagacugguccucauugcugcuuguauuuguagguuauuggcacucguugccacaugggauucauuuguguggauauaccacgccuuccucacccacugucagguagaccgacccugggguuguuuucagcuuggagcuguuagaacgcucaugggguggcuguugccugugucuguuggauggacuggcuagggugacauagggcaggcuuucuucuagaggagcacagcaguguguggcgagcuccuguccucuccauccucaccacgggcacuugauguguuacugauuuauguacuagccauucugaucaguaugucacaguagcucuuucugguguaaguugcauuccccauggaccuuuuccuguguuuacuggccacuuggagagccucuuuuauaaagagccuuuucaagaccuucuuccaauguucuucuugggugucugucuuuuucucauguacguguaggagaucuuuauauauucaggauauggagcccuuugccaucaggcaguaguucugacccagcgaugcagcagaaggacccagcauggagcaggcagagauggcucucuuccaucugugcuucugcccugucacaauuuuggccuuuuggagccuuaguuucuuccuccauaaaaugggaacauggguucuccugagaacuuugagauaggcguuaagugaaauaauauacuuaaggagacuuauagagugguggcuauuauuguuacuaauacuuuuuuaaauaaaauggaaagaggcugaacacgguaucuugugcguauaaucccagcacuuuuggaggccaaagugggggcucacuugagcccaggaguucaagacuagcaugggcaacauagugagaccccaucucuuaaaaaaaaaaaaaaaaaaaaaagcuggcaugguggcacgugccuguagucccagccacucaggaggcugaggcaggaggauugcuugggcccaggagguuaaggcugaagggagcugugaucucaccacuacacuccagucugggugacagagugagacccugucuuccaaaaaaagaaagaaaaugggaagagaucucauauccacugggauggcuguaaccaaaaaauagacaauaagaaguccuggagaggagugggaaaauuggaauccuccuauguugcaagugggaacauauaaaaugggauagcccuuguggaaaauuuggcaguuccucaaaaaaaguugaagauaccacaugaccuagcaguuccacuuauaauagccuaaaaguggaaacaacccaagugucugucaaaugaugaauggauaaacaaaugugaucuguucauacaauggaauauuauuugaccaugaaagggaagggaauucuuauacauacuacaacaugggcgaaccuugaaaacauuaugcuuagugaagaggccagucacaaaagacugaaauguccagaauagacacauucauagagauggaaaauagauugguuuucaggauggcaguggggagagcugaagagugacugcuaauggggacagaguuucuuuggggggggugauagaaauguggaauuaggccgggcacaguggcucacgccuguaaucccagcacuuugggaggucgaggugggcggaucacgaggucaggagaucggaccauccuggccaacauggugaaaccccaucucuacuaaacauacaaaaaauuagccaggcaugguggcaggugccuguagucccagcuacucgggaggccgaggcaggagaauaucgugaaccugggagguggagcuugcagugagccaagaucgcgccacugcacuccaggcugggcaacagagcgagacuccaucucaaaaaaaaagaaaaaaaaaaaaaagaaauguggaauuaauggugauguucacccaacucugugaauguacuaaaaaccacugaaugguacacuuuaaaagggugaauauuaugacguggauuaugucuuuuuaacauuuuuugguggagguaagcaggagagucuuuuugcuugcuaaaucuuugagauaaauuucacuauuauucugaaguaauccccagaagauuugaggcagcuuccuuccaggucuguagcugugguacccauaucacaugaaucuacaugacaacucaaggaaucuuaccuuccaacuuacauucugucuuucucauuaguauuuuuauaauuuucucauuaguauuuuuauaauuuucuuuggauaaaucuuauguuucuaguuaaguuaauaucuggggguuaauuuuuuaggucaagauuaugaauguaauugcucuuuuuuguguucauaacucaacaguuuaauuugggaggauuuuauggguaucuugguauauuugaaaucucugaccuuuuugaggauguuucuuggugcauuuucuagacaaaaucaucaccugcaaaaaauaggaauuuagcaguacgcuuuuuucucuucugaugucuuuuaaguguggugagaguguaguccugccuucuccuuuuaaggggagaguggguaacucaaaugcaucuucauuuaccaaugcuucuccauuauuuauuaaugcauuccauuauuuguuauguuugcuuuuguuuuaaaucuauccagguaagauuuacucuauugaugcucuuuuuaugacauaaagaaaaaaaagaaaauuaccacauccacuuuucaagugcuucaguugagaagaguucaggcuaaauuauggugaaagcaucuuagcauagaugacauuuuaaauuccuuuaaaaauauuaguuuguggcagaaauauugguaguuugccucaggcaaucuauaugguuuacuuacuuguuggcuuaucuuguuucauagcagaugcugaauauagauuuuaaaaauugaauugguuuacccugguuuuauguuccugggcaaggucuucugaucacagugaauaacucuuaagguaaaugguuacuucuguuugcugagauuuugucagguuuuugcaucuguguugggcguggaguugguccaugagucccugcccuuuggaagggaagaucuguugaaaccagcagauaaguucaugacauaccugcugaacauucccguugaguuuguaaugucuuuucuucucccuuagagaggacauuacaaacucagcaaacugaacaggaguguucaacagauacaucaggaacugauagggcaugucuuucuguuuuccuuucucauuauuuguuugaguggauaugguuguggacagggacacuuuaggccgagaccugagcucaagaccugcugugcuacacagcacccagacucccuccugggcaugcacucccugggucaguucuccugugaggcaggccugcuggugccgaugcccaucuugccaauggcugugggguggaaccagcaaugcaguagcucaguccucacguugccuguggggacuggacagguugguaaguguucaguucccugguuuugggguauguacuuugcacagacuugccaaccugaauacagucauuagcugguuaaaaaaauacacaaacaugguugcuuuguuuuuucuuuuguuucuggguuuuuguuauaucacuuccccuuugugagacuucugcuuguuacuuuauucaguuuuugcaauccccgucuagagagacuguuucuuuuuaucauuauuuauuuuuagugcaauccaccacaacgcccccccuccccgccccagcacaguacugcuuuggccgugauccugaaguuuugauaugauuuguuucuauuuuuuguuuauuugauuucccguuguuuuguucuguauaccuucucuaauacagauauauuuaagagaucauuuuucaauuuucacauguuugaguguaugcuaacauuuuuacagcauauauuuuuuagaacaguuucagauuuacagaaaacuuaugugaaauacugucuuuuacuuuguuccgugguacaccaacacauaaauggaauuucuuccuuuuuuagauugcucugaugucauucugcauccucuugugauaucauuuccuuaugcccugaguccugguauggagacuucaugucucugccaguucugauuugcuggcuauugcagagccccccaucucucucucugcgugguugacacuuugauguauuuuguacuaggcuguuugggucacgauagguuugauuaaccuaugagugaguuuaaugucauaaugcuguaaauucuuuaucucauaauaauauuguugagcuuguauuuaugucagcuuaauaggccugagaacccuggugacuguaauaaggcuugaugccacuuggucuccugcggaguccuggcuaugcagggcaggacccugaacagcacaugcagaccuucccggaguggagcaaggugucugaggccuccagguccucuccuguccugcagaccaccccagcuccuuuuaaggccucggaaacaccugauuucccuuugacuccaucaaguguugaaacccuguggcuuguggcaguuuugggggggcaagucugccauuugaucaguguuuacugaccgcaugauugugaaggaggugggugcuggacuugaauugcuguuuccuggcucugcagauuucuuugccuauuaccccucucaaggaguaaaaucguggucgggggucgggucuugcuccaaaggcuuugccucccugccugccaagugugaacuucugauaggaauacugcuucaaaacaguaaaguguugaccgagccuucacgggcuccucacugugguuguggggaauagagagccugggauacugacaauccguaaucaagugaguuuuaucauccugugauuccccaggaugggaggauuuguggucucagcugacugucugggcuacaggcccucggacuugggucuugggaggccugauagucuguuguccugguaucauugguaccuaccagagaccaggcaugcaguaagcgcuaauaagugcuguuaguaaacauugaggggaugguaaagccagucccugggauuuuucaacaagccuggguggaaaggugggugcugagcagaagguauucacagcccgucgaguggaugaggaucagaccuucccccugcuuggaccagcccugacaaggagcccagcagugucuccaccuuagcagguggugggagggcccaaccgaggcagccaggcuaggacuagugggauuccugggaugcccaggcccgccguucccaggaggcugggcccacccuggggcaggcaucauggcccuucagggacaagugugggaccagcuggcuaugaguggguggugcuggaucagccuagcagaugaaggaauugaggcucccaguuuuguuguggaaacugcauccuggaacaaguccugccucauuggaaugcugcggcuggcucuccuggcuuggcaaguguuguuccuguuguaucagauggccaaacugguuuaggaugaaagagaauucccugggacagcccugccuggaggccugguuccccugcccuggugguguaggccuucuccagggagccagagcccaguggaaggucggcaagugggguugguucucagucuccugugcagaccuguuucaacucccuguacagguuuguccggagacugaaggggcaaccucuacuagcuagggcugauggccagcucuuauuguggagauauccacauucucucuugagaguggggagggaggggggugacuuuccuuuguagcugaggaaacuguaauuagguaguugccacagagccaggcagccccacuagcuggcuacagaguaaggacaucuuccauaugcagaaggacagugaggccacuuuggaaccagcaccuagccuuggggggaccaucagggaccaaucuuguggcagcaggugggagggugcaggcacuggccuggggcugcucuucaagcccugccacuucucauaaaugggcugauuguggaugacccugaccuggugcccaugcugccuaagcaucagggugggcuuacacacgcccaaccaugggaacuuggccccguagccccauugacaggcacagugagggcggagcucaccaagucauagcugaccaguggcagagccaggacgugggcccaggcagccuggcuucaggugugcacauacccguuggcucuccugcugugccgccgggaagugggcagggcagugggugccucuugcacaguggggcaccucggcgaagcaggaggccuauguggcugaggagggagggaaagagauucuuguccagggguucagaggcccuggugugaggaccuaguucuccuucuggccccaccuuguccuaccuuuugcuuugcuguuccuuccaccuggcgcacuuccccauccucccaggcucugaucaccugccacuguuuccuccucugcacuaggcacaggucaggguuucagcccuuccagccuauauguauaguuuuacuuucacagaaaguaacacuugaagaguuguucuaagguggugggugugcccaggugauaacugggagcuuugcugguacuggcgucaggaaagaaugaaaaccgcaaagguaacuguaaccuguuguuggucguaaucuuuuacucuuccuucaucguccagcuucuguuucuggaucucagccucuauuuggggugaugagggccuaagcgucugguaugggcucauucuaaagccacccagucucccacgcgcugccccacacugggguugucaggaucucagcauguuaacacugguccauugacaauagccucaaccacauccugagucagagauaugcugacucuggaggaguugccuccuucuugggcauccgaaaggcagugggaugccuggagaggagaacaaggaguaacucccugaaccuguauuuuaaagcuccuaucgucaggggguggguggaguaggaggccacauaggcucugguaagugaauuauguuaacugacuaaauccccauagcacuaagcucagauuggugacauuauuaacccagguuucacaugaggaaaucgaggcacauugugauuggcgcccaccacagucacauagcccugccccugcagcuuauuucagaggugcuagcaggggauguuggcugugcuucccugagauggggguggugggcacagaugggcccgugcucacagguaccccugggaccuggccugccuucucuaucuccuagggguuugggugggguggggcacugggcucaucuguuggacaggauccuuacugcccuguuuuccauccugaggccuauucugccagccuucugucuccagcccugcaccaucccacgcuacagccagacugugcacccuuggcaagcauugagcucuguugugccucaguuucucuguguguguguguaaagggggaacauguucagggcuccggucauggagcugcuaaaacaaucuaacacacagggugugcucaguucgaggcagcugaagauauuacuggaaaguggugcugauccagaucccaagagaggguucuugaaucucacgcaagaaagaauucaaggcgaguccauagaguaaagcgaaagcaaguuuauuaagaaaguaaaggaauaaagaauugcuacuccauaggcagaacagugacuugagcugcuggcuuaaggauacuuauaguuauuucuugauuauaugcuaaacaagggauggauuauucacaaguuuucugggaaagggguguacaguucccagagcugagggucccucccauuuuuuagaccauguagguaacuuccagacauuacacaguggguaccucgggcuguggcaucuguaaacuggggccaucacagggccauggcaucuguaaacugucaugguccugaugggagugucuuuuaacaugcuaauguauuauaauuagcauauaaugagcagugaggacaaccggagaucacucuccuugccaucuugguuuuguuggguuuugguggguuuguaguaauuacugcaaccuguuuuaucagcaguuaguguuuuaucaguaauuacugcagccuguuuuaugucuuuaugaccuguaucuugugccaaccuccuaucacauccugugacuaagaaugccugucuuccuggaauguagcccaguagaucucagccucauuuuacccagucccuauucaagauggaguuguucugguucaaacgccucugacagagucacaugaucaguuccacagcuaaugggugcugcuguccuuuaaggauggagucuggaugugggcaguucaccugagcccuuacggugaaugaagaggggccacccagagccugcacugcccugacagggaccggcagccucuuguccccaugggacucuuagaaugagacuuagggccugagugagcaaggucccagugacuccagacccagugugcugugugcccgugaacagcaggccauuacuguuucugccaugcucguggaugaggacagggagauaacagagaugaggcacucgcagaggucaggugcuguuugcuucacaggcccccaggccugccccucccugccccgacuugcccucaacuccccauuucguccucugcuugacaaagcccuggggucugguugcagcugcccuuccuccccaagcccucuccauugucuucaaacuccccacugaccucaggguggcuccuaaugcuucacagagagucccugggaccuccugcccccaugucauugcucgugcuauucccucagaugaggcuggccuucccaccccaugugguuuuugaaaucccuucccugagccccugugauuucucccuccuggccagagcuuaccccgcccauccccacuuuugauagacccagcgucuguccugcagccugucccgaggccaugccacugugcaggaccuggccucccuaauggugucugguccuggcuccccuuaggcacagaugauugugcuauagucacauggguguggacaaaccugaagacagcauucuuggcggucauguguuggccaaaagcaaggauucuccccaaggcgccuggcugguggugaccucacacccaggcucacccaguguguuagauccugcugggccuaggcagcuucagagcaguggguagagagugagccgggagcuugugucaagcacaguguucgcccauagccagggcagccccuuggggguuaucaccaaggugcugcuuccuccucaaagcccagaugagccuagucuuaugggccaggaggguaggaacuugggccuuccaccugugugucccuuuuguuccccagagcagcuggagaaguugugggcacgggugggauggagggcacaucugggauccccuucccagacuggauccugaugguagguugggcagagagcccuccugugggugggcaggggaucauacccugcagggcaccagccuaggaggcccacagugaggcaggggaaggaagcugcaaggacaagcccacggcuggcgaccccuuaaucagauggugaacuccagugcucuucuuagugcuuaauugcacuccuggaccagugcuuccuccugaggagacaagauggggcaaacagccugugggagggggaggagggaguaacuccagcuguccuggguugggggugggggagguggauuuugucuucucucuuuuuuuuuuuuuuuuuugagacagggucuagcucuaucacccaggcuggaguacaguggugcgaucaugacucacuggaaccuccgcuucccagguucaaaggauucuugugcaucagccucccaaguagcuugggaauuacaggugcaugccaccacaccuggcuaauuuuuguauuuuuaguagagacggguuuucaccauguuggccaggauggucucgaacuccuggccucaagugaucugcuugccuuggccucccacauugcugggauuacaggcaugagccacugugcccagcugccaacuaugcuaacuucuaacagcauagauuaacuucacuuauucauggaaguuuauauauaaacagaaucgcacaacauauacucuuuuguguguggcuuuuuucacucaacauuguuagauucaucucuguuaucuguauagcaguaguuuauucauuuuucauuucuauauaguauuauguaaauaguuacauagucacuguuuaucuuucuccugaugacagauacuugggaacucugguuugagcuuuuuuuuuuuuaagacggagucuugcucuguugcccaggcuggagugcaguggcacgaucucagcucacugcaagcuccgccucccggguucacgccauucuccugccucagccuccccaguagcugggacuacgggcgcccgccgccacgccuggcuaauuuuuuguauuuuuaguagagacgggguuucacuguguuagccaggauggucucgaucuccugaccucgugaucugcccgccucggccucccgaagugcugggauuacaagcaugagccaccgcacccagccuaucuucugaaaguuuuauaguuuuaguucuuauauuuagguauuugauucauuuugaguuaauuuuuguguauaaugugagguagggguucagcuucauuauuuugcauauauguaucuacuugccccagcaucauuuguugaaaaacuuuuuuuuuuuuccucugucguccagguuggaauacaguggcgugaucucgguucacugcaaccucugccuccuggguucaaaccauucuccugccucagccucccaagaagcugggauuacaggcacccgccaccacgcccagcuaauuuuuuuuuauuuuuaguagagacgagguuucacuauguuggccaggcuggucucgaacuccugaccucgugaucugcccgccucgaccuuccaaagugcugggauuacaagcaugagccaccgugccuggccgaaaaacuauucuuugacaucaaauuauuuuuguacccuugccaaaaaucaauugaccauauauaugagguuuuauuucuggacucuauucuaucccguuggucucuguaucuaucuuuacacuaguaccacauuguuuugaucacuguagcuuuguauuaaguuuugaaauugugaguucucucacguuguuauucccuuucaauauuguuuuagcucuucuaggcccuuugcaauuccauaugaauuugaaaaucaccuuuuccauuucugcuaaaaaggcuuuggaauuuugguagggauugcauugaauuucaaguuaauuaucuuuuaaagagauuuaaauaagaaaaauaaguacuuuauauuugccuauuuaauuaucauuucuuccauguagauaaagauuuccauaugguauuauuuuucuucugccugaaggauuuuauuuagcauaucuuuaaauaccaaugcauaucugcuguugauaaauucuuucagcuuuuguaucucuaaaguauuucaccucuauuugugaacaguuuucagugaguauagcauucuaguuaaguuuuuuuguuuuguuguuuaaaagauguuguuccacuaucuccuggcuuguuagagaaaucagcugucauuuaucuuugcuccucuugagucauguauccuuuuucuucuggcugauuuaaauauuuuuauuauauaauugguuuuaaacaauuuuauauuaugccuugguguaguuugcuucauauuucuugugcuugguguugacaagcugcugauaucuguggguuuauaauuuucaucaaauuuggaaaauuuucagcuaugauuuauuucuucaauuacuuuuucuauuuuccccuuuuucuccuuuggguacuccaauuacuccuuacauaaggcuucuugaaauugugucauacuucauacuucaccaaugcucuguuugagucuugcuuuugucuuuuagccuuuuuuucucuguguuucauuuuggauaguuugcugugguuuuucaaguugacugaucuuuucuucugcauuguuuuaucugcugugaaucccauccacuguacuuuucgucucuagaaguucuaucuggaucuuuuucugucuuccucauuugugcgccuuugccugcucagugguaagugacgggaugccagccaguggaccucaccuguugggagauggauguuuuuguauuccuucauguguucuugagcuuuguucugggauguaguuaagugacuuggaaucagauugauccuuucagguuuugucuuuaugcuuugcucugugguaucagagcagauuuaauccagacuaauuuuuucaggcccugggagugcuccccagcugccugugcaucaggagggcucuccucugcuguugggagcagguacuguuuuuggcugguauaaaugguggggauugcuuucucugcccccucagugguccuucagugacuucuucagcucugugcucccugguccucaguggagauucuggcccugugugcaggucugccuagcuuggcugcccugcugccaucuuccgccaucuuccagucccuccuugacagggucugccacgccuugccucagucucccauuuuuccauggcugggaaguucuuuugguggagggggcuccuggaacuccccuccuccugucucucacuaucuagugcccaugaugugaaaaccacugcuuauuauuuauuuauauucuaucauugccugguuuuuuucuuuuucuuuuuuuuuuuuaaguuuucacacagaagguaguucuaauuucugcaacaaucucaucuuggcuguacgcggaagucuguaucucaguguguuugaaaagcugcccaggaguguuuugggccccaggcugggagcuuaagcagaggaaaagauccagggcucaggccaggaggcuaggacuugaaugucgugucauggcauuuagcugucauaccuggaggaagcuucugaggugaugucugcauccccagcuccaggcucguggguguguucugagcagccaugugugcuggacccuucauuugggucccuccugcuugucaggaggcccagauggucuggcgcugcccaugccgccugcagccggcgggcccuucacccaaugagggacuuggggccuggcugccacuuggguggggagccugcagcuggggccaauuccauguccgguuucccuucuuguggcccgggguggcuggccaggguggaugaggugcuguguagacauuaugauuuggaccuuccuugggacuaggauaaggaagaacagagcagaaaucacagagcugacccgauugccuugaagaaaagcggacaucuuccacguaguggguguuguguugaugggugggggcaggugagcaagacccagccuccucaggagugugggugccauagacaucugugcauccgcagcaggaguguccaugucaaucccgaguccccccgugcagucccauugccagcaccagucuuccugcugggcuguguuguccuguuagccuuguuuaggggugucccccgcaacaccacgagacacacacacacaacacauacaucacagcacaugucaccacaccugccauagcacaugugugcucuuccaggcaggauccugugauccucacagugcuguaagaucaaucagucugucuuccccuugaguccccuguuggucccaugagagucuauacucagacuagacccugguuucuuuuaccagucuccuguugggacgaaaugaguuacucuuuguuuugauuucuugaaauuagaaacuguccugcucaguaacauccuuauucaugguuuuuuacauuuucccuauuuucuuggacugaauucuuagauuuaauauuaaauaguaaaugagugaaaaaugcuccuuuuucucuuuuaggaaaacaaagccauccgcuuucagucaccucucucuugaucuuguuuucugccaugagccaggauuaauguaaaaagauaaggucuucugcaagagcucugugguggaguggccagugagacgggcugcugggggugacacacugcggcccgucugcccucuacccauggaagcccuguccugccacgccagcuauguggggguagugggcagugggagggaaggagagggauggcaccugcuuggaggcugggccacucgccugggguguacacgaugggaggcuggcuggccuggauuuuggggcauggacaugacacagcugucgacucucaggugcgugggcaggugggcguccugggcuaggugagcaccccuuucugguugaucucacccauaaggucuccucccugagccccaaggcccugcacuucuuugccacgugcagcccccgcgccccuuguuccucaccccucuggaacaugcugguaucuuggcuucugagccaggaacugggcagagugggugguacacugugcuggccucugucuaguucuuaccaucacugccauccucgggccuggggcucugacugcucagcccaggucucucccagaaggagugaaggaugagccagcaucaggcagcaggauggacagacucccucugccuuucauaugugguggccggcgugccaucuggaguggggagaaggugggggcugugugggagcucccucugccggcccccagcugcugucacacaugcccacuguagcucccugacuccagcacuugucuugccagugcagacacuguuccucagagaccaggcuuucucuuauuuuggugaagcagaugaaccuugggugcagcuuguugcauuugcauaugugcacaccacagugcacgccacagaugcaccucccaggucagggggccucccuucaggcccacaguccccguuguuguugcuguuguucugcagcaugaaugucgccugugagcugggucucuauccuucggcgccccugggaggcccaccucacgagugucuugucuucugaugcaggccuuuggacaagcacacacaaaccacaagaagguggcugcugacggagagagccgggaggagagccugauccaggagucggccuccaaggagcaguacuacgugcggaaggugcuagagcugcagacggagcugaagcaguugcgcaauguccucaccaacacgcagucggagaaugagcgccuggccucuguggcccaggagcugaaggaggugagggggugaggaggggccuagucuguggcugcagcagugccaccagugucacauagcaggugugccugguggguggcugggcugggcuggccucuggggacgcugcagcuggcuggucugucuugcuuuccuggucucauccuccacugcacuccacugccacuguccuccacguggcagaagggagagagauggacccacaaguuccacugccucuggcuugcuucugucucacucaugaagcgagucccaugagcaaguccagagcagaggaguggucagucagggaggggugcaguuagccccuuguggaggcuaagggcugaugcccauggggcacuccucgucauuggacuccccccugcccugggaauguuuugugucacucagggccugcacugugcccagcuguaauaagaacacaaaccccaaauauuccauggagacucgagguagggugugcgugucugagaauuagggguggagaccaccgccaguagccccagcugccacaccccugccuuguucacagcagagugcccgcagggagggucuggguggguggucccuggcaccagagccuguuggaguccuggguacccauggacagccauugguacauggcacaggcucuacaucuggaaaugggacugugguguccguccaugaauccguccaaguccgugcaugacuugugaacaugaagucagaggaaccagcuuggcucuugggcccugauaggggcaaaggccacaggaccagcugcucauggcccugacacuaaggcccuggaguuguggaggacuggggagcccaggggaacgauguggccaaagcaggauuugggaagguugcuguggugccuggaaccuguguaguuugagcccagcaggaggaggagagccaggagucuccauccacuggggcaggugggaggagagucucgcuggcuugaacaggaggcucagggaagguugagugagcaccugagugucuuuucucacugacuggcacauauuuuaauugagcccugccagggccucggugucuguggaaccugaggaaacagugugagcaaagccucauucuccuagaaggcauguggcagauaucaggggagagcaguaccccgugccugucccuggggcaggggcauguucacuguggugcugagccaagggcaggaggagugucaggagaguccugcaggccuggguggggcccugaaggaggcaggguccagcuuggguuugguggcuacacggggagugggcuguggggacaaaagugaggcugagacgacugucuugggggcaagaggggccagugccuucugaggaaggaugaggccccaucaccaagauggaggugggauggucccuggggacugcaaguggagcuggaaguuggcacgugagcugcaguccuccuggccguggccuuugagggucagccccagguucucauugggaauggcuggaggaguggagcaugggucgguugagaaugggcugauacuggcuuugccuuucacugagccuuggggccugggcaaggccuuaucuuuaguccuggccucaguuuccccaucuguaaaccggcagucucugaagcccguuguagaggaugccccacaggucuuucaccccacauugugggagcacuuauggacccuuguuccugacacaggagcaccacccucugcagcagauaaucuuacgggaggucagcagggcauaggcccugaggguaugcagugauuagggcugcugcuguuggcuuagcauuccaguacugaaggaugcugcccucggggucagcagcggagugaggggucagagaucgcugaggcccuaggggcccagggaggagcuuggcuuagacucaggguggggagucucagauccugaagcggcaguacaugaucucauuuccucucacaaggagcccucuggucggugggaggaggggcuguguguauggagagauguauccuuggcugccccagcugccaucugucuggcccgucuauuccugaaaagcgugugcaggugcugucuccccagcccagcacauucugccccuucucucuuccaagaggccuaucucugguggcagaggccaaagagggcugggugacccugcuggcuucagguaagacuggaaaugagcacagcaaguuaaagaugcugcaggucuuguggggaagagaggauuucugugguuccuguuugugcuucaggaggaaauccugagacucccugcacaccccucagccuucccugucucuccugaggguccccaccuuggucccugggucugcugugucccccaugacugugucccugcccuggguugcugcagagcugugggaaccaucccaggucuucgccuuggguaccugguucggguggagcaucucuaggacugaccuugucucaccaccaccagucccagucaugcauagcucuugucuucugcugccugcuguucugcuggucugagccacugugccaagcuucucugugcccacccccagcguggcuuuccccagucacugcccaaggcucacaccccaugggucagaaaggguacauuugacgauaaaacagccuucauuguauccuuugacccaccacccugcuacccacaacagccccuccccuuuuuuccucccuugggucaacugguugucugucccccuccacaccccaacacaccaugaggaccugugaagcuuuacaguaacaaacauauuuggcauguguuggacaguucugauugccucagaccugguccuucuggugacccuacugguaucucgucagaugugaagaaacagagguuugcaagguuccaucaugugccuaagguguccuggcugguagggggugaggugcuucucagauccugacucuaaccgcuguguaugugugggcccuacaugugggcagccccuccagcuucucuccugcuagugagagcaucuuuccugccugggccccugggagguggguaagcuucugaggacuggccuggauugggccuugguggggauguggcuccauuucccagauggggaaucagaggcccagagagccacaggaggccuggggucagagcugggucucauacacacaccaagaucuuucuucauauuugccccaagaaggaguagggugaaggggcuggccuaggccaucaaggcagagaugagaguuuccugguguugagguugucugguggggacaggagagagggcagccgacccccugcacaguggcuccuugaaacaggcaauugucacacccugcuugcugaugagcagucugagguguggggaucccacaaaggggaguugagaugggacccugguggucagcuacaggccugugcucccaccuccuucauuugggcugcccagucacacgcagcagagcuuguccccuguacuucuuugggcugacaucagacaggcucacugggagaaggugcuuacuugagggaaaacuaaaccccauggcgaccagucagccuguuugagcccuuggcaauuggccgugugcuggauggaggugcuagguggcaggccacaugagccuggcugccuacgcccaguagugugggcauggaagcacaguguuugcguccuacuacagcaucagcagagauggugccaucaucacccaugacaugguauggccaggccagcauuugaccugggugugccucuguguucuggguuuggcaguggugcaaggacagaacuccuaguacaccuugccugggccaggugaugaaggacccugaggacucacaugagcacugccaagggaacagcagucucgugugugccucugggggacccuaaugguaugaggcaucuggccaggcucucugcuucagucuuuaguugggcaugucacuaucucccugcccaggcacauggaagcuucugggcucucacuucccacugccuggagcaccuucuagguuuguugaucuugacuggcaggccugggagaguuggugggacucagaccuuccccucagcuuccacuccgccugaggagccggcuggguggccgcguugaaucaaguggcacauguuugcacaccugcugcagaccacuugcuugccaguuagcaaggaaaaagcaggaacugggcaaaccuuucuggcagagagguacccaagucuccagcugggguguggagagccugggugugacuuggcuugugcagcuccccuaagcacacuccuggggggugcugcacucucacuagcaggagagaggcuggagagccugcccacucccuauccaccccccguguagccacuguggggcccggcccuggugauggcugugcuggugcugcuuucucccgcuucgucccagcaugcaccucgcucacuuucuccucugguacaaggcuuugccaggccuucucuuccucccugugugguaucucuguuucuuuuggugucagcuuucugucacuuccuugggucacuuauaaugagagggccaugucugcguccauuugcuguagguuuuaaauguaaucuucauuguaaauaguaagcauuugucaguaguacuugcuguauauuguugacucuccuccccucucuguugcauuccuuuuuuccuuuguuuugggagggauguccuauuucauuuugccaguaugaucguuuuguguguacuugcaugggaucuuggaaucuugucuauaaaguauguuccauucagaugagugcacacaugugaccaggagaaaccauagcauaagccaagagaacagugugagaggugggcgaagcuauggggcccgcaagauggacagggcuucuggccgagaguccaagagggcuuuggagcagggguggugauggucuggggagccaggccuuugcagauacacagggaggcagcugggucagcagaguacagggaggggauagagaguuugucaaggggaugauuuugccccugggggacauuggcaacgucuggagagauuuuucaguugucacaauggaggaggcagccgugucugguggccagaggucagggagcugcuagacauaugauguacaggccggcucccaccacaaagaagaaacgucccugaauguugcuagggcugcggcugaggggcccaggucccuggcacauggcagcaaguuggaaauucugucuugauugcauccuguuugccccaacccugcacuagccucucccaugacaucucuuggcuccuuaugggcaacuuagagccugaacuaauuuuuaacagcuuuauucaggugauuuacaucucauauaguucacccacauaagguguacaacucaguguauuuuaugauagucacauauaugugccccauuccacaaucuuagaacaguucauugcuccaaaaagaaaacccauuucagucacuccccaucccccuccccagcuccuggcagccacuaaccuacuuugugucucuaugaauuugccuauucuggauauuucauggaaauggaaucauauaaugcauggccucucgugacaggccuucuuucacucagcagaauguguucacgggucauucauguuguagcaugugucaguacgucauuccuuauuguggcugaacaacauuccauuguguggagagaccacauuuuguuuauucauucaucagucaaugggcacuugggcugcuuccaccuuuuggcaaaaugaacgcugcugcugugaacauguguggaccgguuucugugugggcauguguacauuucucugggguagacccucuguguuuaacaguugcagcaccugcaggcuguuugccagagcacuauaccauuuauaugcccaccugcgcacuacuguguacaugcccaauaauagaaggcaggaacuacuuuuaaccccauuuuaauuuaaagaugaagaaaccaagggucggagcaggcagucacggguucccaggugagaagggcugagggaauuuacucuggaaccucugcaguccgcugugcacucuggcauacugcucugggcucccucuccucuccaggcagucacacuggcaccugcaggccagggcucuugaguucuggcuguauggcuggccauggcgugccuggcugcacugagccccucucgugcccuguggaggcugcucauaccugccuuucccucucccccaacagaucaaccagaauguggagauccagcguggccgccugcgggaugacaucaaggaguacaaauuccgggaagcucgucugcugcaggacuacucggaacuggaggaggagaacaucagccugcagaagcaagugucugugcucagacagaaccaggugagucuugggccugugggguggagguggcacguggguuaacugggccuugaggaccucuugcucagccccucucccuguugggaagggguuccugucuuauuccacacacccgaggcccagggccagcuuuaccacuguggaggcagggguauacuuggugggacccagacucuccaaaagaugaaacucuggcugcaguguuugcugacauuggccaggcugaggugucccagccaacaaaaaugaaaacaaaaaucugagagguaaugaagagguuacaccagaaaaccccagauuggacuuugagacucccccaucaggugcugaccaugaggccugcaauauuccugugucucugccugugacagggacaaggaagguccucucugucugugacggggaugaacaggaaccccucugucucuaauggggucucagagggaccccugacagggacgaguagggucucugccugugacagagaugaauaaggagggucccuucucuuugugaugugacuaaauugucaugugcucugcuguucugccacucaaggccugaacuugcucuucucucugcaagagccacacuccugcaugguggggaaugggagucuuuucucucccaaaacuuuccccagaaugccauggaugucuuccuugcuuuccucaaauccucuaccaccaaaauccucugagucucaccaucagggaaugugguauuuaugcccggaggaggaagcucauguguuuaugcagagcuccuagccugguccuucugugacagcucgagcucauuaacagucuuagccacugucuacauuguaaguaccauuuggucauuggugcugcuguuggcagagcccagcgcaugguggccuuaggagaagggaaacugaggcuugaggcgacccuguccucagguuggcgcuuaguggagucugacucucucucccucucugggauuccucaccuccgcauuuguggugcugggacugagggcuccaugcccaccuccugugagcacaccuuggaugugguaaugggugucccuuccgacccaagacccacagagaugugcucagcacuuccuguuacugguuuguuucuuauuuuuuucuccaaauauuacagaaaaauaagaaauaguuuuagcaauugcccacaaauucugagccuccacaucaggcaucaguuucuaucugcuuuuuccuugcccaccugcagauacaauuuucauguagacaagacuuugauguugcuuuucccaccuaccuucgagcuccuccaggucugggugucaugugcauguggagguuuagugguugagauguucugccuugcggggaguuucuguuccuucauuuugaacuaugauuagaagucaugaucauagcacacauugaaauauauuuuuauguaucuuaagauauuuaguuaacuguuaauguuaauuaaauaacuuuauagaauuuuuaaucagcaugcacuugguaauauuugugaaugacuuaauacaagguuggcagccuucuauggauggauguguguuguucuuggugcaucuccacacguacaguccuggcuuggggccaccucagacauuugugcuccccuugcugugucugcuggucccagcggugggugggcugggcugagcauuucauugcauucgcaucucaugcccuggaaccuucuuagcauccacaucucugagcagaggaagcagucuuggccuggacgggcugccacccuucccaggauggcaccucaccuggcgcuucaucuuuugcuucauaguggccggaguuggugugcugguguguuuucuucauuuauggggccugaaaggagcuuccacauugcauugaugcaagagcguugacuucucuucccagguggaguuugagggccucaagcaugagaucaagcgucuggaggaggagaccgaguaccucaacagccagcuggaggaugccauccgccucaaggagaucucagagcggcagcuggaggaggcgcuggagacccugaagacggagcgcgaacagaagaacagccugcgcaaggagcugucacacuacaugagcaucaaugacuccuucuacaccagccaccugcaugucucgcuggauggccucaaguucagugacgaugcugccgagcccaacaacgaugccgaggcccuggucaauggcuuugagcacggcggccuggccaagcugccacuggacaacaagaccuccacgcccaagaaggagggccucgcaccgcccucccccagccucgucuccgaccuacucagugagcucaacaucucugagauccagaagcugaagcagcagcugaugcaggugagcaggcaguggggccuucggcacgcuguccccacuccaggucugcagggcuccccgagcagugcuuaccugacacucugcugauguuaacuuucccuuuuccuuacguugauuuuaucuccugcaucauuacgguaaauggaacuccaggagcacacauagaggagucucagagaagugguuuccuggcacugcagcacccacauugcuccccuguuaacuacguggugucagggugaagugaugagacacuggcccacaugugaucccugcacgcaggccaggugucaggggcccaccauggucaugcuugggcucauccccugggacauggaucccuguugauccaaggcaacagaguccuguccuccgaagcagagggcuagggugcuaauauucccgacuacacacccagccagccuagagcuccacuuucuuagcccagauccccuguagcaugguuggggaaagagccugcguugagggugaccaccauuacuggugacgguuaguguucugagggcccagcaugaauuccauucuuuccacacccugugugucuuuguccaccucacugacagcauggccaaggaaccuggggcugacagccugcccugacauggggugggaugucacuaggccaucuuggggguccuccaagcucucgggguccauagcaacugacaugguguccugcugccugugccuuugcagauggagcgggaaaaggcgggccugcuggcaacgcugcaggacacacagaagcagcuggagcacacgcggggcucccugucagaacagcaggagaaggugacccgccucacagagaaucugagugcccugcggcgccugcaggccagcaaggagcggcagacagcccuggacaacgagaaggaccgugacagccaugaggauggggacuacuacgagguggacaucaacgggccugagaucuuggccugcaaguaccauguggcuguggcugaggcuggcgagcuccgcgagcagcucaaggcacugcgcagcacgcacgaggcucgugaggcccagcacgccgaggagaagggccgcuaugaggcugagggccaggcacucacggagaaggucucccugcuagagaaggccagccgccaggaccgcgagcugcuggcccggcuggagaaggagcuaaagaaggugagcgacgucgccggcgagacacagggcagccugaguguggcccaggaugagcuggugaccuucagugaggagcuggccaaucucuaccaccacgugugcaugugcaacaaugagacacccaaccgugucaugcuggacuacuaccgcgagggccagggcggggccggccgcaccagucccgggggccgcaccagccccgaggcgcguggccggcgcucacccauccuccuacccaaggggcugcuggcuccugaggcgggccgagcagauggugggacgggggacagcagccccucgccuggcuccucacugccaucaccccugagugacccacgccgggagcccaugaacaucuacaaccugaucgcuaucauccgugaccagaucaagcaccugcaggcagccguggaccgcaccacggagcugucacgccagcgcauugccucucaggagcugggccccgccguggacaaggacaaggaagcgcuuauggaggagauccucaagcugaagucgcugcucagcaccaagcgggagcagaucaccacgcugcgcacugugcucaaggccaacaagcaggugaggugccaggcagcaggggcacaugucaccuacuacuggccuaaggguguuucccccuuggccuccuuccucccccugccacggggcccccccaggccugcgucaccaccagacagagccagccccauaguagcucgacugccuacccuccccugcucagggcccccagcugggaggguggagcaggcaggugggugugagggccccucagcagagcugcucagccagugagaaaugccgcugcccuugacucacugugacugccucguagugcuuccugauacuggagggaaaacaugugagagccauagucugagcuguggagagcaauuguggggcuucguggagguccuguuggcagguuuaggggcagucccuccucugccagucagaaucagcaggugggacuccccauggcguagcugcuggaguccauccccaggguuugucacagggaggggccucccaggagcuuucuucccaggcacugccaccacuucagaccggggcucccgauccugcucccagagcaccucuaggcugacuucacgccuuucacuuuuccacccuacacaucugucccccagacggccgagguggcccuugccaaccugaagagcaaguaugagaaugagaaggccaugguuaccgagaccaugaugaagcugcgcaaugagcucaaggcccucaaggaggacgcagccaccuucuccucgcugcgugcuauguuugccaccagguaaccgugcugcugucgggcccuccccuuccacaaggccagcuguccucagcacuugccucuggaacccuuagccucucacugccucaugcugaggccugcagcccugacuagucaguggcugugcccagcuccaucagggccagcaugguacgagguuggggaagcauggccccuggcacaucucuggcacacuggugcucaaguuggugacaagaaagggugaggcgauaugggggccacaugggguugggggccccuagcugcugcaccucagcuuccuccgaggucacgcaagcaguugcuggagcauagggcaugccuggcaggugcccacauguggccggggauagcagagcgugugugauccuuuuaauguuccuuuugcaccuagcccagcccccaggagccugguucuguggcgccgguuccauuuugcugugaaugaaaccgcagcaggcccaggcuugucucugcuuugcauauauggagacugagggcagaagggcugaggagagcagauccuggaguggaugggccagaguugcauagcuucaggggaugcuugggcucccaccccuugaauccaacauuuacagggacuuaacuuggggccaacaggugacagaggaguccuggccuuuccucucaugagguauuugcccccaagaacuuggccauauggcacaaguguguauuuauguuuguagauucagaaggaagauuauccuccuggcuggagcaggucacugcugggguccacaguucgggucccaccucugugcauagcccuguaccucugcgucauugugaccgcuggguacucaccucccauccucuacuuugccaaucuggggagggugaggagagggccggggcuuggaggagaccagcuuucuuucuuccucuguggagggcucuuaguaaugggcucugaggugggcugccccuggugggugcacaccccucccuggcugggacucagaccccaaggcugggaaucgaggcucccuaaguguucacaggccucuguggggcagguccugguuucagcaucuucccaggugcccccugacagguaccgcugucuuucacuuuccaaagauggguagcgccaccugcugggucauguugggauagcaccauggggucagcccugcaugggggacagccaggcccaccaugggcccagcagauaaccuagauguuuccuuuuuaugggugagcaagcugaggaucugagcuggacagggugggaacugcaugcacauagggccugcuucucucaagccuggugccgugcacucccaguuucucaguaucccugcaggacgugccagagcaggguacagacaaggaagagucccaggauuucucuggaagcguccugucuuccuggggcuuggggaaaaaaucccacaguuucucaguaucuggcauguaaacccuaccuuuuaaaauuuguuuuauuuaaaaacuuuucagauggagccaagauuuugaaucugcagggaucacagcucugugugcccucaaaagggugggcagcagaguccuuggagagggugcuauccaagggccggcuccuggcagguggggacaggcagaguagggugcgugugggcaggguggggcugugcucagugccugcacagccucaccgcccugggagcccugggauuuaacccgcccuuugucucuaccaagccccacccauaugggacauguggaagaagggcauccagggacagaccacacccucccacagcuccgcacccggguuucaggaugaagcuguugauggcguccacacacgugguuccuuggcucuggucagugcucagcacagacugacgaagcaucgaccuugggaacaagcccaguccugcuuagauuuacauccacacccuagaagccauggcuucuccaugucuugaugccccaggccaccucgaggccuuuaagcggggagagcgccuccuagaagaagcccagucgcugaggggcauagccuguuuguaagcacuacaugcagcugaaagagcaaagcagccccucccccacaaaaccacaaaacucaagccagccucauagggcugcccugccugggcccaagccucccucucacccuuaucagggauuuguccaagcaaagccugugcuaaaauaagccagaauaauucuuccccagccacacccuccaguccagaggccacauugaaggauggcucugguauagggcugucagagggccgugcagcuuagcccugcccugcccugcccuccucugcucggcucugcccgccccucagucauguuuuugguacccacaggugugacgaguacauuacacagcuggaugagaugcagcggcagcuggcggcugcugaggacgagaagaagacgcugaacucgcugcugcgcauggccauccagcagaagcuggcgcugacccagcggcuggagcugcucgagcuggaccaugagcagacccggcguggccgugccaaagccgccccgaagaccaagccagccacaccgagcguaagucacaccugugccugugccagcgacagggccgagggcaccgggcuggccaaccagguguucugcagcgagaagcacagcauuuacugugauuaggggcuguggggcgccgcacgcugcagcuaacaucugcuucaccucaacuaacccagcagcagcgggacggcggugcuaggucaaucuuaacgugacuaaugcacagaggguaggagucuagccgaggcgccauggggcguugcaucagcaggacacuugugagagcuuugugucgcuucucacuccucaaagcccccucaggagcacccaguccucagcugcucucuuaggugggggucagagguggggauagagcugcacauucuugcagcagaugugugaugaaagcaucuucuaagcccugcgcacccguggggaaacccaagggaggaguccugguccugcucccucagcacccaaaaggggcagaaccugaguugagacuugcauguuccucgcaugugucuaaugucagcacuagaaagcaguuuuaggagguuccagccugcagcauagguacgaccucagaggauggcuuugcacuuggcauaguuucauggaaaggaguacguuguaguuuaugcaguaucugacugcaaaucauauucaggaaagaagugcagaauuucuuccccaagcccagagaagagcagcccugagccccuguauucugcuggccagacacacauggcacagacacagcugaccauaacccaggaauccagagcucgguuucucauuucugagaucaggaugcuuguauaguggccugugaggugacagauuggcagggcccaaggccccagguuuucauuuuucaugagaaaagcuuuccaagugccuggccagaccuugguccuuagugcagagcccguccuuuuguacuuggggugaccccagcagccaauuauccggccuuccauaggggguucagucccaaagacauggggcuuugaaaacccuagccugaagucugagccaccaagggcuuggcuggguuggacacccacagguguauccagagcccagcccggugcugggaaagcuuugcauagggccagggccacuugucaggauucacagguaggagauguuuaggucucuuuauuuagugcaaucugggggauggcaacagagaaagaggaaagguagcuguaggguucucccauuuccagaggcuccauccacaccugccuucccacauucugagcagaacuuuucucaguacuuuuuucccgaucacccugugggaccagcuggaccugaggcugcagucuucucuccugcaggcugcuugccuugucucucaugcggaagaggcauucgaguuaccuggugagagaccguguugcccccucccacagcucucugcccugcgcguucuucccuuuggugccgaguauguuucgguccccuccagacuccaggacacgcccauguauguccccugcguguucauccugggcccagaucccccugccccagcaagacucgcagugggauggcugcuggcaugcccacccugcaugcgcuuugcccucuccuugcaagccuggcacauagcuucucuccauacuccuaagggacuuugcagacacccaagccacugggaccccugcuaacacaugcaggucuucucuucugccaacuaacgugcucgcgcccucccagcacguggagagcuucaauugucagauaaacaggaagcgacagaugaccgcuuucuaacgcucucuuuucucccguuuucagcuguagaguagcugccaggaggacuuggccacccggcccugucacacugcagccccuuccccuucccucucguggcccacaaggaggaaggaagggcaaccuaaaagcccacuuagaaacuuuuuggauaugccacugcaauucuuuucaaaauagcauuccccagguuuuuaaugggaggaaaaaaagcuuuaauguugagcaugcugcgagcugcugcguggaaaggccucuguaugggccgaagacccuucuucccuggcugccaggcucgccaggagcccacuggaaacgcccaccacgggggcuccuuguuacacauguucuuuuuuuauccgaucaaccugugcacuuuugauauuuugauauuauauuugcuuccuuaauuccucgcguagagacggucucaggugccguggucuaugcucgugguccuguagcuguccgccucagcucccaccguguuugucuggugucagcacgaggcagagcugugugcuccauagcguguagcuuuagacucggagaugagugcuuugacccagcgaggagcucagcuaaguguauccacgcugugguucagcagccuuuagaucauacggcauugugguucauguuugaaauuacagauuuuaaaugccauguucauuaagaaauccaggguauucagauucugggguuuuucauauuguauuauuauuauucuuaggaauaguucaauguaacaagaagaaaacuugaccuuugcucugguuaaaacaguaauaggcacuugaaaaaaaaagauaaauuauugaaugaguaguauuaccuacaaauuccagaauuuucuggguuuuaggacguugugaagcaugacugauuaacagaauuuuauacaacuguaccaauaaaauuccaaauuggaauuguuuuguuacucugguuguugugccaaauugugguacacuuagaaaauucuacagucgucgauuuuuaggguguucucuuucaacaccuuuuuguuaguaaucauugccaguagugccuucaucaguuaagggaggugucccagcacagaucauucucaaaagcgagcagggaagagcuagugggcaugcugaaggccagcguggacagcaggugaggcaggugcuccucacacccagaccugggcaucuucauugagggaaagaaaacagucauugugcaaaauucuguuagucagugauucuuuacuugcaaauucaggggcuuagaaaaugaaagcaaacacaaaaccuugagugugcuuugggaaccaaauggaccuucugggacaagcugagcaagcuguaugaacgccacguuugugaagagcugaggguaucaggagggccgacgcuguguuggcaugcgcaguaggggaugaggguuagccauaguauucuuugcaaaugugaaagcgagacauuauaucuucucuugcuugguguaacuaaucacuguuaauuucaggaaacagaacucauuaaaacuccuuagcaaaccaggucuacauccuguuuuguuugcugagugagguuagugggaguggucaaauugguacucuuggaggaagaaaaacuguccuuccuucuccaaaaaaggaaaaauuauaauaauauaaaugacaaaaauaaaagaauucuguuuccuggaauaagcauuucuuauuccuaguuguagggacuccuauuuuuaccuuccguuacaguguugauucauaagaaauauuguuacauuugagauaacuucaucuguaugggguauuuauuugcaaugaugucugaguacuguauuuuuucugugcauuaccuuagugucagaauguuggucuuuauuuuaaagucauaugcauguucuccugccaaggaaccuuuacacagacccaaacaaaaaaauaauaaucaaaugccuucaauuucugagaaaaugaggcagagcauggaaaaggaauaggaaggagaaauuaauugagauuuucaggacacagacauaugaugugaaugccuacaaagccagugcgcauaggaacagugggccuggguaaagagucacauugguaggaccaauaaagaauaauaaaaagacaaagcacau

SEQ ID NO: 17287 - RNA, 2917 nt, Homo sapiens
ucuuuaagaauauugcugcucauucgcucagagccacaggaggaggggagaggccuggaggacaccaacaugaacaaguugaaaucaucgcagaaggauaaaguuugucaguuuaugaucuucacacaaucuagugaaaaaaaccgcaguaaguugucuaucucaaaaugacuggaaguuagauguugcaacagauaauuuuuuccaaaauccugaacuuuauauaugagagaguguaaaaggaucacuggaaaggaagaaguuagaacaacuguacaauagagacaaagauccucaaaaugagaauaaaauuggaauagaugguauauagcaguucugugauggccuggcacucaauccagccagcauuaguguguugauuauugcauggauguucagagcagcaauacagugugaguucuccaaacaggaguucauggauggcaugacagaauuaggaugugacagcauagaaaaacuaaaggcccagauacccaagauguaacaagaauugaaagaaccaggacaauuuaaggauuuuuaccaguuuacuuuuaauuuugcaaagaauccaagacaaaaaggauuagaucuagaaauggccauugccuacuggaacuuagugcuuaauagaagauuuaaauucuuagacuuauggaauaaauuuuuguggaacaucacaaacaaucaauaccaaaagacacuuggaaucuucuuuuagacuucaguacagugauugcaaaucacgugucuaauuaugaugaaggagcauggccuguucuuauugaugacuuuguggaauuugcacgcccucaaacugcugggacaaaaaguacaacaguguagcacuaaaggaaucuucuagaacguacauagucuguacaauaaauacaacagaaaauugcacaauuucugcuggcuggacugaacuaaagaucaauucucacaauucagacugaggguugagacaaaacuuuaaggauacaucuuggaccauauuguauuucauucuucuaauggugguuugggcuugucuucuagucugggcugcucuaaacauuuauaauuccaacauuguggauuucaucuuacaucuguggaccauccuacuuuauucucccauaaguccuagaagcuuuauggugauuauuuugagguuuccauucuugcauaaagcacaaugcugucuucaucagaaaacaguuggcauaagaauuaaacauaugaacaucacaaagccauuuauaagaacuucuuaaacuacgcuuugggcuaguugcaaagacuauguuaacagcacuuccaauaagggugauauauuuaaguauacuggaucuggaaugguauuuugguuuggggggaauuuuuuuuuuuccuggcaaaugacauguguuguugaugugacuagaguaucugaugaaaaaacaaugucagaauaaccaacgugaaaaauuuuuagaauaacuuggugccuaccugaaaaauguauuguguuucagacucuugauuucaaaagguuccacagaacuagucugcgcuuaccuuacccauguuuauauauaguuguccuguggggagcuuuuauuuagaaaaugcccgcauaauguaagauucuacuccugucuacauuaugcacuacauaauuggacuucauuaugcuuuugaaaugcuuaucugccugucacauaaguuaaacuauuuaauguguuuugaauguuuuggauugcuacacaauacaauauucuaaauuuaggcaugaggguuuauuuuuuguuuuguuuuuacuuuuuuuuuugucauugcacuauggaacacaaaugaaauucucuuaauuuauaagaagauaguaggaguuaaauuuugaaaaugguugugaugagccacgaaauucaaucuuuauaauauagguacugcucuuucagacaaacaguccauuuuuaaugacuucuuauuuuguugaaauuacuuuaacugcuaaucacugugguugccaaauauuuacuucagaagcaaagauuuucaaacaagcauacacgaugcaaaauaccagucuggcuucuagucuauuuacuguuuuuguuucacucagauuagcucaguuuucucaucaaagcagaaugcuaucuugcguguguguguguguguguguguguguguguguguguauguguguauauauauauauauauauauauauauauuuuuuuuuuuuuuuuuuuuuaaauuacaaaagccaugagcugcuuuuaugcugaaaaugaucauuucucuguucacuuacugacacucaaagaaggguuucuugcuuucuuaaacauugccguaaggcaggcuagaaauguaauacuucaaauguuagaugauuauggucuuuugauaagagcagauucugcuugguauauccaggcacucucuaaggucuaggguugauauuaacaaaggaauguauuucagaauagcaguacauuuuaugcaaauauggaaauuauuuuaagaaacaaugacacauuaaaacugcuuuucauuuacaugauuuugaaauagacuagaaagcuuucccuauaaacauauuaauauuccaaucauaauuuuaauucaagaaugcaguuuuaccaaaagaaaaaucugaaaauuuauauucaggcuacuggaauugguuauuaaaagaaaaaggaaaaagaagaauccugcugcuuucaguauuuccugauuucauuuuuguaaauauaaaggagaauuucaauuaugaaacacuuuuaaaagauacauauaucucuauacauauguacuguuuuguuuccuguuuugaagauuuugaguuauaguuauuguuuucagacugauuaauucacauaugcuguguuuugaaauaagaucccauuagcuguuuuuuuuuguuuuguuuuuuuguuuuugu

SEQ ID NO: 17288 - RNA, 26353 nt, Homo sapiens
cagugauggaaaacacaugagcaguaacaaguuuuaaucuugcuccucaguacuaacauggacuaaucugugggagcaguuuauuccaguaucacccagggugcagccacaccaggacuguguugaaggguguuuuuuuucuuuuaaauguaauaccuccucaucuuuucuucuuacacagugucugagaacauuuacauuauagauaaguaguacaugguggauaacuucuacuuuuaggaggacuacucucuucugacagguauguuucaugucuaucuuacaaguaucgauguauacuuuacagucaauacuaaggagacauuaauguuauuaauaaaugcuuauaaauaauaggauaaaguccaaaguuuaucucuauaauuucuuaaaaaucagcauuuaaauacaaaccuaaauuuguaccuaaaauuauucuaguuuuaugucuuaccuauaaugaauguauuuuaaauauaauuaugugacuuuuuuuuucagcuaagugaaaaccugucauuaugccuuaccauaaauguuaacaugauugauuuuaaaagucaucuaaauaaacaucuuguauguuuaucuaggaaaauaacauugcuauaauaaugaucaugaaguuuggggauaucacagcuauauuaaaugaaacaguaaauauauuuuucaauauuuaaaauauuuucuaauguguauuuaaaaugugugaauuacugaaaugucaauuuuacuuauacauuugaauauucauuuuuuuccuugauaaaugucuuccuuauuauaaugaaauggcacugaaaaguucaaauggaaaucuauucaauuccaagaaagaauacuuaucagcaauaguuuagcuagcacuauauucaauaugaaagauuaggaaauuuucacagcauguauacagucagaauuuaacacuuucaaagauuuccuuugucuacucccaaaguaaauuucugauuaaauuuuagauuaaaaaauuuaagcaauguauucaauauucuacucccuaguaaucuaaauagcgcacagcauucuuucauguuaaucuauucagagguguggcacccaggaaacaguggccacaugguguagggacugagucauaaagaaccugaggggguuguauuucccuaaaaauaaaguuguuuaaauccaagaaucaagcuguuaaaagaaagaaaugaaaaaagaaagaaaaaucgagcacaagcccacacacauaaaaggauccugauguuuuuaguuuguuuuuuggcauuaaggaguauaguguaguaguggaaagaacagaggauauauagucuucuguuacaacuaacuacucaauuaaaaacaaauauucugauaacugaucugagguuugagacaaaaacaauuaacuuuacaagcacaagucuugaggcacugugggaaacaucauaaaaauggagaggcaguagauuuuguuuuuuaagacaguagcuugauugcuagacauguggagaaauuaaugaagggcaaaauuaguauaaaaggaagaacagcuagaaugcuuugucagaaugcuaguuauacuucuaagguaaaauuaacuacuuuuuaaggaaagugcuaucuuuaucaguauccaugaacaaaugguacugugaauaaguuuccaaaugcauguuggacuuuuaacucauuuguuagcuuacaagacuaugccuugauuacaucugaauuugguuuggauuccuucggugaaauauauggaguauguuauaucacauuuauaugcugaaaucugcuacugguaccugugaacugauaggcauguuuaaacccaggggaaaaguugccaagcgggccuuuaaacaugggauuuaaaagcacagugacuuauuuaccuaauaauagugucugagaggaaauaccauuucacuuagauaaacuuucuaaguuuguagaccaguuaaauggaaacaagaaagcuuaugugcuucuuaagcuuuauuuccaguccauauguuaugaacucuuuuaagaacuuggccaaaccuccuuaccuaggcuuuuccagaggaaagucuguuuacugucuggaaguaacuaugagauuaaaauccauuuaggaggacaugcagucuagugcaaagcacaaccaacaagcagugaggaagccagcccucagcuccaccaccuccagccaguucuggacgcucacugccucugcuuuuucucaguaaaagagggccauggggggaaagucucaaagaccucucuuagcucuaggcuacuaugauuuauuaguaauagcaguagcacuggaagaauacuccaaacacuacucugauuaagagagacuugaaaccaaaauccaaagcuuuccaugaguggaaaacacuggcaaaacuggucuaaaucagggaaauauugaguauuccugagaagaagauuuaauauuuuuaaaggguuuaaaaauagaguaaccugaauacugccaaaacuaauaaaacagagguuguaccucauuaauaaacucaaaauaaaacagccaaaagucauaucauuuuaaaugacauauaauauucucuacauucuuucugaauaauaagaaaaaaauacugcuaucuaggguucucuccuagacauuccauuauuuuccuauugguaaacaguugcacacugaacugggggagguuuaggaccuauacuugauuguacuuauuaacaaagcaguggaagagacccagcaagagacucagguaaagaguguaaauaaugaauuccucaugguaucaagguuggccugacuuuuuucuuugcaagcaaccaggauacacaaaugcaaaagauuagauuaauuguaaaaggcuaacagaagacagaacuagcagagagaaaugaauuuuccagaaggcauuuuugaguuuccauauaaagacuuuccuaacagccauggauggacaacuguggaagaugcugccuugagguaguauccucucccuggagcuauucaagcaggguggauaugcucccuguuccagaauguucuggaaccuucaccaccaggaggaacuccuguuucaaaggucuucaucucuuauucuccaggaaagggccuaacuacuauauaaaaguggcugccuccacugcucagcaacuggaaugcuucccaacagcuaaagauaaugcuacugccuaaaacuugcaggcagaagucuccauuucauauuuuaauuuuaccgcaguuuugauuaaaggcagggagggucuccuguaacuuaucagucucagaaagaggagagacaaaggaaggggccccggcugaugcuucuccugaugccacugggggacuggucagcagcccugaggcagggauguggaaaaaagcaggaccacuacuguucugcucccugccuucccugcccugugugccuucuccuucuccucucaacucucaguucugcuccucauaccugauccaguuccucaucucgaaccucagcucaguacuggggaagccucucuugacgguggcacgaggcugaaggcaucugggaaaccauuacguggugugcaaaggagcugaggccaguccuugcucccgcugccaggccacaaggaacaccacgauguguucuuggcaccccacuuuggaucucuaacacauuccugguguuuuacuuuuuuuuuuuaaguuccauaguuuuuuuguuucuacauuuuggauauauuaucuguuaaauagguuuuuccgguccagacugggaaucuaaagcccauuugguucaaagauucuaugggaaaaaacuuaaacuaaaacauucaggcugggugcaguggcucacacaguggcacacuuugggaggccgagauggguggaucgcuuaaggucaggaguucaagaccugccuggccaacauggugaaaccccaucucuacaaaaauauaaaaaauuagccaggcaugauggcacaugccuguaaucccagcuacuugaaggcugaggugggaggaucacuugaaccugggacguggagguugcagugagccaagauggcgcaacuguacuccagccugggcgacaaagugagacuccaucucgaacaaacaaacaaacaaaaaaccccaaaaaaacaaacaaaaaagcacaaucaaccaacuuaaaaaauaaccuugucaaaaucuucauuucccauugaccagaacaaauaggauuaagccucaagaaauugugaaccccaaaacaauuucccaaguaggugcuauuguuugacuuuuggguagaaauagaugagaauaguguguaugagaaaccuuugauuacaccaauuccuaccaaaagugguaggaaaagacagcaguauaugcagaaauaaagcaaagaaaauucuguuggcggacugacauuuaaaauauuuuaaaagcaacauaauuaagaaacuaugcaugggaagaaaaaaaaaaugcuuugcuuauaaucccauuaucccucuuaccagguuuguacauucuauuucaaucuuuuuuucaugugaauauauguuuuuauaaaugucuuuaguucuauuggucucaaacaguaaacugaggguuaugcguagacagacacggugaagaauuuuacuuucaaagcucuggguaccacacaucuaguguuaaagcccuacaccccuguuccuaccccauaagucacaguauauacaguuuacauugucuauuuacuaauccaggcauuuuauuuuuuaguuuuucuauuaauguaccugacauucaaguguuaacuuuacgaucucguauuaccugacaguaguugauuaggaguugcggguuuuuuauuuuugaguagggaagugugggagagaagaggauggggaggaaggugugcucuacuuuaagaaauucagcauucugacgagugacacugcaugggguacagugggugcuugguaaaugcccacugaauaacuccagcaaccucaaagaaagccagaaacaggaccuuaaaugacauuauaauucuauagcuccuuguugccaaggucagacaaggucaagggcagcuaugcaccuagaagacagagcuguaaugcaagaauguuacagaauaaacuggaaucaggggccaacuuugauuuagcuaaggaccaagagcugaauuuucuagggaaugaguauuuugaagguugaggcaaagcugggcacuaaaccuuaaggagucaggagccacacaacagcccuaagucaaaacacauaaugagucaaaguuagacagacagcaaaggcacagagacaaugugccagggacaaagugauauugagaaggaagcccccaguaaccuuuaccaggaccccauacagcauucacaggaugacuggaauacgaaacaucaaccugccugccagcagggacaccccaugccugcuacagaacaguagucagccacaguuggugauuuccaccuggggcucuccaaaagaagccacugaacccuguguugccagcacaaucucucacccaguacuacacaaaucugaucacacaaucauucuguucucuaccuuccaauccaagcuacacaggugcuucuuuauguacagauguguacagaacaguaauuuguauacugguuagauaagaaaaaaugacagaguaugcccaugaagccacgagauuucuggauaaaacaacugaguccccccacaugagcuggagcagaaggcagcacagaacagggaguugggacacaugagcccuagcucuggcuccauuuauauuugguaggugacuuugggcaagucacuuaagcucuuuacgccucauuuccuaugagggaugagucuagaauaacaucugaauuaacaccuccacaaaguaguguacagaugggaggcuagggcuaguuuugaaauuggaaucagcauaggauuauuaaaauauaaaaaacucuugccauucucagaucuguccuguaaccuccuuccuagcauaaguuaguguggauuaucacaggaauaucacacauaccugaccagugccauccagcuacccagugggcaaauguucaugccaccauuuagauuuuuggagcauaugagaaauuaaauaaaguaauuaucagguuaauaacuaaugacaguaggacauucuagcccucgucuggugauuaaaaaagacauaccauauauaaaugaagauauuuauuaaguuaaugaauucauucuugauuuuuaaauccaggaaaaagcaggcccauggagagauguuaaagcugauuuuuugguucugggaaauugcaaccaguugggauuuggagggguaggucuucccgaggcugggccaauccuggcugacuauagaagucuuuugcagcucagcugcucucuggcacucgggcaauggcaggccuggaggacuauuuaggugacuguagccugguggacuauuagggucugcggagcccucugcugugguggugaguggaugcccuccugccaggacucaguuucaccagugagcaucucuaggaugcaucuauuuugaauaauuucauaauguuuuuaauuuuugaaauuuucaaagaauauacacauuucacagguaauaauuuaaaaauuaggauauguaaauauggcaauaaaucuaugcucugaagguucucauuuguauaguucuguuuugugugcauuuuaaaaaugcaacugaaaacaaccuggccccccaaaaacaaaacaagcaaaccgaacucaguggaaagaugaguaagaaagaauagucuggacaucagacaguuuggaucaaauauuagacaauggaacagauuagaaggaaaaagauaccaauuguggaaaaagugaccaacuaugagagugagguugggaaagguggagagaaaucaguuaaggaaaaauuccagauguugucuaaggagacaaugaagauauuccuccuucagggacacugaauacauuaaggcaauagaaagauuuugggaauacagaguuagguaagauaaucuguuucuguuuuuacgauguuuauuagcuuuuucauuauaaagguaauacucauugcucauuaugaaaguuaaaggaaaaaggaaaacacaagucaucuaugguucuagugcccagaguuuaucaucaaucagguauauuccugccagguuuguuuuuguuuguuuaugaguguuuguaaguauacaguuuauggauuuuuuauauuugcuuuuuuuuauuucacaaaagauaauaucccauauuuaaaagugucuuugcaagcauuuuguggguuccaaaauauuucauggaauaaauauacucuuuuauuuuacuauuccccuuuaaccauuauauaauugucucaaauauuucugcuauuauaauucugugaugaacaucuuugugcacuuuagaaauguuuccugagacuagauuuuaaaaaguagaauuacuaucugaaaaagagauauuuuuagaguucccaaugcacauugcugaauugcuuuccaaaaaucuuuauaaauuuacucucagauuagcuaagcaauggauuaaaaugccauuucauugcacucuugccagaacugagaaauguauauaugcaggaauuauauccauuuaaauuuaauaucccaugucuguuuaguccuagacuggucuucuacacuaagacaccaugaaggaguaugugcuccuauuauuccuggcuuugugcucugccaaacccuucuuuagcccuucacacaucgcacugaagaauaugaugcugaaggauauggaagacacagaugaugaugaugaugaugaugaugaugaugaugaugaugaugaggacaacucucuuuuuccaacaagagagccaagaagccauuuuuuuccauuugaucuguuuccaauguguccauuuggaugucagugcuauucacgaguuguacauugcucagauuuagguaagaauauaagucgauuuuguuuugaagaauaguaaugcuauucugacaauuuaaaggauggaaaaagucucauugaaauuucaaaaauaaucugaguguauaaguuuuuuucauuuaaguuuuuagguggaaaguacagcaaaccccaaaguacauccaaacuuauuuuuaaaauuaagaaaaucaaaggaaaacuaagggaauguuguccauagaacauuuccuucucuuccccaguuaaaucaaagcauuuaauuuuaauucccuucagagagaauggacaucacaugcaguucuaucucagggugcuagcagguugagacuguacuuuucaguaaaacuccaugauaacaaaauaagcugcaugucuagaacaaugaaaugaguuauagaaagcuugugaaaucucuaaucuagaccuuuuaaagauaaugcuuuauuugcuuuuuagcaauuuggguuuaaaacugccuaagaaaaaaguggauaaagucuuuuuaaaauuuauaauucuuugcugaguauuuuauuucuuuaauacuucuaaugaaggagcacucaagagcacagccaugucccguucaaggacgggacuuaaugggaaugcauaucaagaguuguugccuucagcuauuuccaagaggggacagcugagacuggccccacuguggaggccaaggucuggcacacaacucccacucaggggcugauggcccaucagggucacuucaugagucuguaugagcagaugucuugaaaagcauuagacgugcuuccuacugccauagcauucauggcaagaguuaaagcuuacaauaaucuacucuagagaccuuaaugaaguuugucauuauaugacaaaaugagaggcaaacaaaaagcauucagaaaaaggggagacuaauacgagcuagacuuacuaguaaagucuaaugaaauaggcuaggaaaaaaaaugggucuuaagcuuuaccuguggaauucucaugagaaagagauuaagaugcaaguacuguuugagaaaacuuguucauguagaacgacuguggaaacagcaucaggaacaagaaaugcagaagcugagacagaugcugggugugagaagagguuaguuagggaauaugagaauguacuauuguacuaaacugcaucucagacaagaaaaaacguuaccuaccaucaguuugcaaagugggugcauguuaaagcacuuuguaagucaaaauuccagauaaaaauauguguaucugcuaugacuccaccagauguaaacuggguuaguucuggguaagauggugaauaaggacacauuuaucuuuagugcagaccacccccacgugcuggccuccauaugugccacggcagagcagucauaugcuuccaacaugaagacccugcaugagacauugcauaaaacuacuccagaacacacuugucaccaaagacuugagaagcccaagcuaccucauggcaggaagcugguguucccaucacacacagucucccaaacauuuagcuuugaaaaaacucuaguaaacaaaauccaccuaagaauaucugugacagucagacaugccaucagcaugcugcugcacccauccuaccucccccaaaacgugaccauaaaaagggucugggcacuuaucacucuuccucccucaggagaugaaacucuucagaacuucaguuuuaacaggggcagggcaggaguagguuugucaaaaucugugcuaccaggaggaucccuucugcagaaccuccagcuuccuauaagacuuccacuucauuuucuaaaaccaaaauaauauccuguguucauaaaaauggcaaaauuaaucuauucuaacaaacaaaacugcacccuaccuugcuaauucaucaaguuaccccccuucuucuucccauauaggguuaaauuucuuaagaaaguaucaauuuuauuuuaguauuauuauuauuuuuuugagacagagucuugcucugucacccaggcuggaguacaauggcgcgaucucggcucacugcaacuuccgucuccuggguucaagcgauuuuccugcuucagccuccugaguagcugggauuaaaggcgcacaccaccaugccuggcuaauuuuuauauuuuuaguagagacgagguuuuaccauguuggccaggauggucuugaucuccugaccucaugauccacccgacucggccuccgaaagugcugggauuauaggcgugagccaccgcgcccagccuauuuuuuuauuuuuauuuuugagacagagucucacucugucacccaggcuggagugcaguggcacuaucuuggcucacugcaaccucugccuccuggguucaagcgauucuccugacucagccucccgaguagcugggacuacaggcacguguaacaaugcccagcuaauuuuuguauucuuaguagagacgggguuucuuucaccauguuggccaggcuggucuuacaacuccugaccuuaagugacccacccaccucggccucccaaagugcugggauuacaggcguaaggcaccaugccugaccaauuuuaaaguauagaaaggaaaaguacauagagcuguaggauagaauguugauauucaaauacuagauuuucaauucuucaauuuuuggcuauuaaauguaugacuacacuucaggagugaggacgguucuaucaaaaguguacugacaucuaggccaaggcaggcaucucgcuugaguccaggaguucgagacuagccuggccaacauggcgaaacgcugugucuaguaaaaauacaacaauuagccaggcauggugguacacauccuagcuacucgggaggcuaaggcagaagaaucacuagaacccaggagguggagguugcagugagccgagauggcgccacugcacuccagccggggcgacagagcaagacugucucaaguuaaaaaaaaaaaaaaaaagaauaauauaugaaucaguauguggaaaucaaagaauuuacaacuaauuagagaaguuaauuacuuaaaggaaaugggugguaaaguuuuugguaauauacaugaaaaaaaucuaauuuuuccauuuucuaaacacaacuaucuaaggcuucuuaaaaugaucaagacccggcugggugcgguggcucacgacuguaauaccagcacuuugggaggcccagucaggcgaaucacgaggucaggagucugagaccagccugaccaacauggggaaaccucgucucuacuaaaaauacaaaaauuagccaggcgugguggcacacaccuguaaucccagcuacucaggaggcugaggcaggagaacugcuggaacccgggaggccgagguugcagugagccaagaucaugccacugcacuccagccugggcaacagagcgagacuccaucucaaaaaaaaaaaaaaagaaagaaaaauuaucaagacccauaugcuccaauuuagcacuauaacagccugaaaauuugcaaagaaagcuaacauuccucagccaaagguacaucaacagaagcugcaccucagugguuggucaccuucucacagccacuaaggccacuccaauuuaucuccuuuuauuccaccuuagaggggaugaguagugacaacuauaccaaucuagacaccuuguaaaaauuaauaaguuacucaaaaagguccugaggucuucccccaaaacaauguuuuuuuugucaucuguuaugacuguuaagucaucuguaacuugaugauaaucauggguuuuaaaaaauguauauuucuaccauauuaguaaucucaucuucagcaugauucucuauuauauaauauguuuguuucuuucuaagguuugaccucagucccaaccaacauuccauuugauacucgaaugcuugaucuucaaaacaauaaaauuaaggaaaucaaagaaaaugauuuuaaaggacucacuucacuuuauguaagaauauauccucauacuuucaaagauuuaagugaaaacucuguaucuuugcuauaaugauuaauuauacuauguuaguauaaacaagucuuacuuuucuguaaagaaugacaaaaaucccugcauucaacagcguucuagucaauuaaaaauuauagauuucauucaauuaauagucuaauucaauggauguuuauuaaauaauagccauguaaaauguagugggcugaguuuaaugguccucaaauaagcuuacaaucuauucagguaguaacagucacuauacauuaaaaugaacaagaaaacaauuacuuacagcaaucauuagcaaacaguguaagaaaucucuacccaaacguguuaagacaccacaaaucucuaacagcagcacacagaauauaucugauugauuaauauauacauguauggcuuauuuauuggaucuuuaaagaagaaaagaauuuuuucuuuacuguauuaguaucauuuuaauauucuaggauuuaaaagauuacuacuuccauguuuaacauuuugggcugggugugguggcucaugccuauaaucccagcacuuugggaggccaaggcgggcggaucacuugagcccaagaguucgagaucagccugggcaacacaacaagacuccaccucuauaaaaaauacaaaauuaguuggcauggugguggugcacguagucuuagccaagagguagagguugcagugagcugugacuaugccacugcacucuagccugggugacacaguaagacccugucuuaaaaacaaaaacaaaccaaaaaaaucauuucgaagucuccagauuuuagcaaguaaaauuucugauuuagucugaaauuggguuuggaggagcaccucauuucccccgccaccgccuccccucagcacagcuccugccucgcugacucuggcaugguguuagaggaagagcucugguucuguaucaucugaggugguaagccaggccuggcuauuccaggccauuuccccacacucucaggcugugcuggagaaaacaaauuuaaagucugucaucucuagauaagauaaaacuaagagaacaggguagaaaauaccauaacaauauuagccccuugcuaccaugcaggccuggccuguuccugugucugagagauguggggucaccaugccucccugucacccugggucagugcaguggacccugcuggcccaucucuuccucccugucacccugggauugaggacaugcaugcugaucauacuuaaggcagacugagggaugcucaauccuugcaucaagccucccuacaaaauccagcucucacacugcccggucagguagccagcaccuugucugcucuuuucacuuucaaagugugcaggcagcucagaucugguaagccuccauuaucaauauaaaagagcaacuagaagagcauauauuuauaaguuaggucucacuaaaacauuaagacagucagaaaugacacaauggauuccaccgaggauccacccaguccaccccacuaacuuuaggccacagaaucuuuuggagaauggcaggccauuauuccaccaacagaaguuggaaauauagccuguugaugcguuuaccacuucuucaaccccuuuucagcuuagauaaccacaagaauaauaacuaauggcauauuuaauacuggggcuaugaaaguuuuaaauucaucauaucauuauuuuauuacauuuuaggagcauuccagggacuuaguccauacuuauucuuguuauucacagggaaaugagaaacuaaaugguaucaggagcuuucuuagaccuacuugauuuccuuugagaaaugcaugucagguguagagcaauggagggaaagcccccagcuguuaaguaguauuacugccaagcuacuauuagcagacugaccagguguacugauguaaaucacuuuuuaaaguacaugcuuuauacuugaauuguagguauaccacacaauuacaaaacauuuauauaauuauaguaucaccuuauaugguaccugucuuuuaagagaaucaaacuauuuuuuagacauucuacaaauucucuguguuaaguuuuagcugcuuguuuggcacuuggguucuuacacaaaggaugauacagucagagcaaaaucacugaacacaaucacagcccucccagcucacuuccagccauuaugagacacauguggcaugaaucacuguccuacuacugaauggcuaugcucuucucaucuucuguccuuacacuguuuguuaaugaugaauuggaagcucugugauaaucaagccagcacugagagugcaguuuaacuggaucacucagccagcucaccaugcagggcaggcaguccaccauguggcgcggcucuuaccagugcugcacaaaaccucuuacacaguuuuguauuacuuuuccuuccuuuuaugcaguuccaacaacugcauguuuuaauuaggaaaaacaaacuaauaaaagcccagugcacuagacuuggaucucacugacgcacagguucacuuugugguggggccucucuaacccucacuuguugcauggcauaggcaagucaccuuucuucacuuuacgcauuuccucaucacuaaaaggagaguaauaauuccugcuaaauuuaccucuuggaaucaagagaggauucacaaaccaucuugaugauccaccaaguuguuaaauuccccucaccucauuuuucaguguaaccaaaggaaaagagaagauacuuuuaguuggcaucacacacucacaaacgaggauauuuuaccaguugguaacaaaauguaguuucaccucuucuccuaggcuuacccuuucuuggugaaacuuuuagcaauagugauauaucuggaauuuccagagggugagaaaaggaaagcacaaagggccaagagugagaugaggaaacgugcagauacaaguuuacugagcaaccaaaauguguauuucugccauggaaaaacaacaacaauaugaguaauaccagugaggcauauuaaacaaagggagauuuuugugaaaugaauuugagaacaaaaucauaaaaugaaugaaucuagagcugcuccuugagaaaaucagaugaccuggauugguaaagagggacaaaaagguccugaagacgcuuaguggccugucaucauucuugguaaacacagaaauucucuuugaacaaucuggcaaagaguaaagaacugagcuaugcucauuuugcaaugaaaauccuuaucagaguuaccaacaugucccaguuugccuaggacauucccaguuuggguucugaaauccccacaucccauaaucucaugaucugggcagacugagauggcuggucacccaagcagccaugcacccuuggacauguugcaaaagacuugugcagagagcacacucacacugguacgagcucuuuuuacucucuggaguuauuagaccuccucuggaggaugcugucuuauugcccugagaaauacccaaaaaacugauaagagauugagucauuucucaggauccauuacuauauccccaauaucuaaaauaugccagaaugcugagggcacaugguaggauuuuuuuccuuacaggccucuguucugggagaaaugguaaacauuaguaaauaugaaagaaaugagguuuucaaaguagacaaaaucaugcaaaaguauauuuggugugcacuaaacauaguuuuguagaguaaauagauuuuaagauaagauaaagauaauaucacuggucacuucccugaagggaaauaggaggcugaguagagguugaaggcuuagccauaugaaaguauuaucuauucaaagauuaaaaagaugcacuucuaucuaaaccaauggcacaacauuaauuauuauagcucugcacuuuucuaacucaguaguaaaauuuuuuuaaaagcuuagauugggcugggaaaguuuuuacaugggugaucuaguacaccacugauauaaauuguacugauuuccaucauuggcuaaucacuguagaauacugguaaaucaaauccacuuccuaauauuguguaacuuucuaugcuugaucaagggucugauccugaacaacaacaagcuaacgaagauucacccaaaagccuuucuaaccacaaagaaguugcgaaggcuguaucugucccacaaucaacuaagugaaauaccacuuaaucuucccaaaucauuagcagaacucagaauucaugaaaauaaaguuaagaaaauacaaaaggacacauucaaaggaaugaaugcuuuacacguuuuggguaaguuuuucaaaugaaugggacaucuugaaauuauaacaaacaagcagauguagaacacuuuaucgucacuauuaagaauaauuuccaaaauuaauuuuugaauaaucuuugccuagauaagccauuuauaaaccaauuaaaauguccaacaaaauguuuagcacuuaaagaaaauaugaucuucguaauacugucucucucucccugaagaaccuccuuugaggccaggccugguggcucacgcuuguaaucccaacacuuugggaggccaaggcgggcggaucuccuaaggucaggaguuugagacuagccuggccaacauaguaaaacccugucucuacuaaaaauacaaaaauuagccggguguggugacaggugccuguaaucucagcuacucgggaggcuuaggcaggagaauugcuugaacccaggaggcagggguugcagugagccgagauugcgccacugcacuccagccugggugacagaaugaaacuccaucucaaaaaaaaaaaaaagaaccuccuuugaaacacuuagcgugguuucuguuucugaccagacccuaauaaaauauaacuuauuauuuaauuuaaagguaguauuuuuaauguauugcauaagcuacucaaauauaauacacaaaauuaguuuggauauuauuuggaaugugcaccuaacauuugguuaucugcuuuaagauuaucgaugugaggaauuuuuugucuuauauuuaaaacucuaccugauuuuauuucugacaccuaucauauaaccaugccaucucccuauaauauccauucaaaauucauaaccaagauacuaauucauuuauucauuuaauucaaccaagugccuggccucacuuacuggcauuucuucaagguuauauuucugcuaacaaaacaacaauuucuaauugacuuacaauuuaaaaaaaguuuaagacacaaaaauguacacagaaaaacauaaacauuuuggauuauaugaaggaugaucuuuuuugaugcacuauuacaauaacaaaaccuuaauugugcucaugguuggaggagagugaaaaugucacugauaugguaauucaaagugaaaaauagugaacuucucauauauuccaguuuacauaauacaaagccguauuuuucugaugcugacagaaaggacaguagauagacagaagcagauauaccgagugaaaaugagccuaaaggaugaagcucacgcuucuugggauauucauucuugggaugugucucucugcacugugaguuuccuuuauauacaaccuaugugugcuaagucaugucauucuccccugacagaaaugagugcaaacccucuugauaauaaugggauagagccaggggcauuugaaggggugacgguguuccauaucagaauugcagaagcaaaacugaccucaguuccuaaagguuuguauuuacuuuaucuaagauaugguauuuuaaaguugucaccuuucaauaacgauucaaucuaauauuguaaacugugcaguauacacugcaacuagaaaucuuugcaccaguaaaucuggucaauauagucuacacacacauaaaaugccauauguagugccuuuuuccugacagaauuaagccacaauuuuuuuuacuccacuaagaauaaacauuaagaagcaaugaacuuuuaguuuuccuucucuuuccugacauuuacucauuuauaccugucauucugugcaguaccuguuagagguagagaauucuauacagaagaaagcagagaaagauagauggggcaagagacccuguccccaggcauuuagccacaguuugaggugaagccuaugagcccagacugggcagccccuggcucuggcaggaauggacaugccauucaaggcaaggcauuuuguacccagcuucuucccagguguacugugaagacuaaugggccaauacacagaaaggucugaggacaacauccagcacguaggaagugaccaccugugacauaaucauuaccaagaugagcacugugcucuuuaucauggcuuugugugacccaaggcuagcaccucaaguagaaugcuccuuaagucugccagaugaccaguguucuaacccauuacuuccaagcucccugucugaugauuagcugcauaggauugccuuucuuggaacucuugcucaaagucuugcuuuccuuauucccaacaagggcacaugcucucuuugcuuugaugacuaacugggccaaaaauaaccccuaugauuaacaacauauuuuuacuuuccaacagcuccgucuuucaguauccaugaguuaaagcagcaacuucaucacgacccccucuaaucuacucaccugauccagaagaucaauaaaacaaacauauacagauaauuuaaaagacacaguaaagcuguuauuauuaaucaagaggugaccuuucacuuaggucaccuaaagaucaucuaaaguaaaagaggaaaaauaacuuuucuauccaggaaaacaacaguuuaauucagaacuauacaaauccaaaaaaacaccucaguguagcuuuaaaggagguggauguuuuucuacaagaaaccaaaaauguuacauuuaccuucccauuuuagaaaaacaacaaaaaaugcaaaugcuacccaauaaguuaaacauauaaaaucccuuucaucugcuggaagauaacauccaguaaaggagagugaagacaaggaaaagaggaagguagagggaggagaggaggacagccuacagggcuggaggagggagcugcuguuccaggccacaucuccugacauggccauucuuuauguucacaccaaaagucuuuccuacacugcaaaauucuauuuaaauuucaaaguguaucuuaaaaguaaagguuuaacuucucaugaguuuucaagauucuuucaaagccaaaaggaaucuuuagaaauuuaaauuggaaucaaaucucucaacuuaaauaacuauuccuucaaauccccuugacauucagaauucacuaaccugugaaagcugacugccugcauggcauaauccagucaguauuacccccuguggcaagaugaaaggaugcagguauccugaggguccuuaccagacccaacaaguuaucauguggacaggaugaaaaugucuucuuuccuauucguucaggaaguucuacugcauaauauuauguggggaagaggggagaccuguuugaagacagggugggaacagaaauuccgguacaaaagugugcuaacauuugucagcaguuacugagcuucugccaaauucacaccucugcucguuuuauccuagaggcuacacuucaaucuucucucugguuacccaccuuccccauuuccuaagggacacaacaguucccucaacuucuacaaguccucucccagagauuauucucuuccaacuuuguacaaccuauucuagauucgcuggcacguugcaccagcuauuuuucuagugauuuuuguauguaugauggaucugcucuaaauuagcaaauaaugucuuugaggacagaaccuuuaccuuacauacuggaggguccacauaaucauuccauaaauacaauuaagcucaauuaaucaaaauucaagaaauuagaaccuucucaguuuagaagaauuauuuuucugcucccuaguuuauuuauuuuaaaauucaaaauagauucuguuaucaaaauaaauucagucauggaaacuauuauugcuauucauaaagauguuucaauuaucuucauccgucuuuauugcuaauauagaagggaaauauuucaucaagacuugaaaaaaggagagcauuuuccagcuagcuaaccagauacuuggguugacaaauaauacuuuguauauagggcuaacaaaaugagguuugauggaaucuucuggucagucccuuucauuccagcuucaguucauuuggggagagugggggucaggauaugccccguugagaagagaaagaacgauuauucacugggcaccugccaugugcggggguacuacagauacacuuagcuuacacaaaaacuacugcuaauugaaagaauagagccaggcacaguggcucaugccuguaaucccagcauuuugggaggccaagguaggcggaucgcuugaggucaggaguucaagaccagucuggccaauaugguaaaaccccaugucuaucaaaaaugcaaaaauuagcugggcaugguggugcacaccuguagucccagcuacuugggaggcugaggcaagagaaucaguugaaccugggaggcggaggcugcagugagccaagacugcgcuacuacacuccagccugggugacagagugagacccugccacaaaaaagaaaagaaaagaaaagaaagaauaaauacugcaaugaccugaacauaucaaauaggguaaaaauccguguuuauaaugguguuuuaaaaaaaacacaaaaaaccuuaacuggucaccucugggcauugcaugaauucauuacuugaaugaaucaaguuuugcugccuuuucuauaaaaacaaucuuacaaaguaacuaaauaauuaaugaaagaaaauucuuuagagaagaauuccagcuaauaaauccaucaagaaugacaucaggaagucaccauuuuccaauuccuaaugacagaauggaucuaggcaacaaucgugcaugaaugcuaagacccucaggugaaaggcugauuugcuuuuaucugaaugucucucugcaucugacuaccagggcauaggaagaaguuaaaggauccugauaaaugauaucacauggaagcugucagccaaauccacaaaaggagugucucaaacaaauuaauauggaaauaaaucaaaagaagagggagaaaaaaggagggaguauguuguacauuaagagagauuucaagagcgauaagaaccaaauguauucuguaaacuucauuuaauccuaacuugaacaaaucaacuguaaaaugacguauuugagacaaguggggaaacuuuacuauauuagaugacaguaaagaauguauuaaucuuguuagaugugauauuaacagggugguuauguuaaaaaacaaaaaacaaaaaacaagaugaccuuaucaguuagagacaucuaauugaagaauuuauagaagaaaugacauuauguauaagauuugacuuuaaauacuccagcaaaagaaauauggcaaaauaaaaauagauaaacagaucaauaaauaauuaagaguagauaaaacaagauaggaaaaauggagauaacuguugaagcugagcauggugguucauaauacuaguuacuauuuuaugaaugguuacaauuuuaccauaauaagaaguuaauaaaaaguagguaccaggcugggugugguggcucacgccuguaaucccagcacuuuaggaggccgagggggguggaucaccugaggucagaaguuugaaaccaaccuggccaacauggugaaaccccaucucuacuaaaaaguacaaaaaauuagccagguaugguggugcauaccuguuaucucagcuacucaggaggcugaggccgaagaacugcuugaacccaggagauggagguugcaguaagcugauaucacggcacugcacuccagucugggcaacaagagugaaacucugucucaaagaaaaaaaagaguuagugccuaaaaaguugccuaaauccauaaucugaaacuugaaaaguaaacaaauagucaauugggcuuagugauacuugacuuaacauauauauuucucuucuuauuaggcuuaccaccaacuuuauuggagcuucacuuagauuauaauaaaauuucaacaguggaacuugaggauuuuaaacgauacaaagaacuacaaagguaaacguucccaaaauuuuaacuuagaaugauaccuccuggagaaugugcacagggacccugguagagaucacugucuguuuagccaguugcuguuggaacuggagagugugaagggaaaacuagaaagaaccacaauuggccgggugugguggcucacgccuguaaucccagcacuuugggaggccaaggcgggcagaucccgaggucaggaguucgagaccagucuggcuaacaugguaaaaccccaucucuacuaaaaaauacgaaaauuagccaggcaugguggagggcgccuguaaucccagcuacucgggaggcugagguugcagugagccaagacugugccacugcacuccagccugggcaugggcaacagagcgagacuccaucuuaaaaaaaaaaaaaaaaaaaaaagaaccaccguuauuaccaccucugcugauaggggcgaaucaagugaaaagaagaaaaugacuuuucaaauuucccuuuuguuaaauuuaggucaaagaauuuucugacaaaacuggaagauaguuguuacauacugaaguagguuauuaaauaaaguaaugaaauaucuuugaacauauauauaaauaggacaggcuuauauucuaacuaguuugcgguguuuucagcuaacucuaucacaccuaaccaucuguguaagacuugaugcauuuuauaucauuuuuaggcugggccuaggaaacaacaaaaucacagauaucgaaaaugggagucuugcuaacauaccacgugugagagaaauacauuuggaaaacaauaaacuaaaaaaaaucccuucaggauuaccagaguugaaauaccuccagguaaaacauucuacuuguguucaguagauauugguauuuuucuucaguuuuuauaacacacuuuagcacaccucaagcaaagaccaaguaagcagcaagggugauucaaacauaaugacucuccagguugcaugagguguuuuaagaaguaggagagcuuuaggagaaugguuucuacaucgacgucacaagaaagcucaggauccauuuccaucuuuugguuucuccuguugaaacugcugaggacauugcggcaaagccgcuggcacaguuaauuucagauuuuagggcagggguggcuacgcagaggcaggacuggucaggaggacauggagcagugucacguguccuuuugaucuggaaacauuucucaaggcagagcaagaggauuaggcuccugguauuuucgcuuucaguguggugcuaggauagacauguauauuuuuuuuuaaacauuccaaccagaauacaguauauaaccaauuuaaagucaccaucuggagcaucaugaguucccauuuuguuguuuguuuuuauucauuauuagaaaucuuuuccuucuauuugacaacucuuaacuggcuggaaggggccacagauuccuuggagaaucuaauaaagauuuagaucuucccaagaacaaaaguuuucaucuuccaaggagcuugagaacaaaacugggcaacaagccacucugccucuucucuuuuucuuuccgguguaucuuuaaacaaguuucguucacuguacuccuuugagauacaaaccaucaaaaugaauguaauauaggcaggugcuaaucucaagaucacaacuuuugcuuugacuuuuccaaaugcugcauuuggaugucuguuuagccagugacuacaacuugaguccguccucucucaagcugccccaucccugaugucauuucugcuuaauuugcuccacaacucugcuuccagcuucuggucucucuuaaaucuaccuauacucuugcuagcauuaauuaaaugaauagaauuauaacacaaacagaagaacacaugucauaagcauauauuucaaugaauguccacaaaguaaacacacugauguccagcagguuuucauucccagugagaucaguacuaugguaaacuauaccuugcacuuauauugagcagcugggggacugaacaccaaacuuaaauguuuuagcaaugccuagaauuuucaugauuggucucauaucagucuuacuaagacauaaaggcagaaucuagagguaacaacagccagggaggauaucccacguuggccagcaaaagacuucugcucuucaguacacaaaaaugcugucaguuaaguagauugcuuuuauuucccagaaaucucacuguuaccaaaaaaggccaaagaagaaauuagaagggcuguuaaagggaaugagggaaaguuccucuauuuaccauacuuuuugaguaagaauuuaauuuaaaaagacauguacacggccuguaaaauugugacuuguccacugguguacauaagaucaagugauuucaauuauugaugcuauauuacaauucugcauuuaggauguugauagaucuuucuacaaaacaacuuagaaaaauucuccuuuggucacagaaaaugcuagcuaauaauucuucacaaucaaauugugagccuaauucuuagagcauuaaauuucauucuucugaucauuucuaauguuuuaaaugcauuauuguaaauauggcacugaaguaaccauauauauacacauaaauauguauauuuaaaaauauguauguuuauaaaaguaaacauuacgcauguauguauuuauguauauauguauguauguacguauguauguaucuaucuaucuaucuggagagagagagagacagcgacccaugugaccaggcaguaugcucugggcccuggcgggaguccuuccccaacacuuuuguguacaacacaugagcuugaguuuuuauaauagguauuuaacaugcauaagugaguacaucuacuuuaccugaaaauacauucaagccaauguaaaauaaacagaugaauaaacccacaaacaaauggcgacuacagaguaucuuccguuuacauuuacuggguauuuuuaauccuuucuuuuuuccuacuacaacagauaaucuuccuucauucuaauucaauugcaagagugggaguaaaugacuucuguccaacagugccaaagaugaagaaaucuuuauacagugcaauaaguuuauucaacaacccggugaaauacugggaaaugcaaccugcaacauuucguuguguuuugagcagaaugagcguucagcuugggaacuuuggaauguaauaauuaguaauugguaauguccauuuaauauaagauucaaaaaucccuacauuuggaauacuugaacucuauuaauaaugguaguauuauauauacaagcaaauaucuauucucaagugguaaguccacugacuuauuuuaugacaagaaauuucaacggaauuuugccaaacuauugauacauaaggguugagagaaacaagcaucuauugcaguuucuuuuugcguacaaaugaucuuacauaaaucucaugcuugaccauuccuuucuucauaacaaaaaaguaagauauucgguauuuaacacuuuguuaucaagcauauuuuaaaaagaacuguacuguaaauggaaugcuugacuuagcaaaauuugugcucuuucauuugcuguuagaaaaacagaauuaacaaagacaguaaugugaagagugcauuacacuauucuuauucuuuaguaacuuggguaguacuguaauauuuuuaaucaucuuaaaguaugauuugauauaaucuuauugaaauuaccuuaucaugucuuagagcccgucuuuauguuuaaaacuaauuucuuaaaauaaagccuucaguaaauguucauuaccaacuugauaaaugcuacucauaagagcugguuuggggcuauagcauaugcuuuuuuuuuuuuaauuauuaccugauuuaaaaaucucuguaaaaacguguaguguuucauaaaaucuguaacucgcauuuuaaugauccgcuauuauaagcuuuuaauagcaugaaaauuguuaggcuauauaacauugccacuucaacucuaaggaauauuuuugagauaucccuuuggaagaccuugcuuggaagagccuggacacuaacaauucuacaccaaauugucucuucaaauacguauggacuggauaacucugagaaacacaucuaguauaacugaauaagcagagcaucaaauuaaacagacagaaaccgaaagcucuauauaaaugcucagaguucuuuauguauuucuuauuggcauucaacauauguaaaaucagaaaacagggaaauuuucauuaaaaauauugguuugaaauaaaauau

SEQ ID NO: 17289 - RNA, 9685 nt, Homo sapiens
augauauuucuauauuuaaaaagagcauaagaaaccauuaacguuuaauuuaugauucccacuugucauucuaauuuauauuuuuaaagauuuacauuauuuugaguaaguucuaauccuaugaaaugaugcagaugucaccaacaacuuaaauucaauucugaucuuauacuaauacauaauucuaaauauauuacuuugaguaauacauguuuacuuagauuuacuauauuaaguauagguuuugugaagucguaaguguauaccuauauaguuucuugcuauucuugauuuucauaauaaugaaggucaaagugcccuucugcuccuucuuguucugggcucucaugagcauugucaggaucaucgugaucuucacuuucaucaucaucaucuggaaaucuccugaaaacuugugucuuuaguuguauuguuugaccauuagugcuucguuguucaccauaauaaauaguguguauaugagggaagcagaagaagauguaugagcuuauugguucuuuuaguuuauuuugguccacacgaauguauguuaaauggugguaauguagugggucaauagaaggacacaucacuguaagauucaucucugaaagaaauaaauuaaaaauuaaucuuguauuauaguauaauccauaguuauagccauaauucuauguuagauuuuauauuguaugggauauaauucuguuaauuaaaauauuuauaaauugaauuagguuuccuuuuuauauuaaucaaauaauaaaaagaaaauuaaauuaugaguuuuauauuaacaaaauauauauggcuucauuggcuuuucugauuaauaaauuccuaguagaacaaucucaaaaaaaaauuaucuacaaucccacuacuuaggauacucauauuucuucauguacucuauuauuucucucuuuuauauauauacauauauaaaacugacaauuuauacauauauauaaaaaaauauauauauauaaaauuauauauuucuucuuuuuuucuuuuuuuuuuuccuguugcaaggagaaaaggaaacauuguggagaaagugaguaaacucagaauacgcucuguauaaauugucaguuauauauauauguauaaauuaucaguuauauauauaaaagagaauauauauuuuuuauauauaaauaaauauauuauauauguguguauauauauauauuuauuuauuuauuuauuuauuuauuuauuuuauuuuuuuuuuuuuuaagacagaguuuugcucugucauccaggccagaaagcaguggcaugaucucagcucacugcaaccuccgauuccuggguucaagcaacucucaugccucggccucuuaaguagcugggaguacaggcacaugccaccaugccuggcuaauuuuucuauuuuugguagagaugggacuucacuauauugaccaggcugaucucgaacuccuggccucaagugauccaccccacccgccuuagccucccaaagugcucugauuacaggcaugagccaccacgcccagccuauuucucaauauuuaaggcaauaaaauuuaauaaaaaggacuauaaacugaauagcacacauuucucuggggcagauuucugccauucccuuaagcaacuucaaaacaacuauuuucagcaaugucuaaagcauagcuuauugaauauuuuuuucuuuaaaagaucaggauuccauucuuucucucuucaaaacacaauaaaagucuacauacuuucuauuucauuauuuuguagguauagguguuccaaauuucuuggaauauagaaugcuugcuucaauuuguuguguccaacacugaguucuacaauguugggaagauuaaaaauauuauaugggaugucuuguaguuuguugugugacauucuuagaguaugaaguuuuggaaguuugucgaaguauuuuucggguauagaagaaauugaauuauuuucuaaagacagauacauaagugaagaaggcaaaccaggaggcauugauucuaaucuguuacugcagagguugagcugcauuaguuuuuccauuuuggcaaagauuuugucuuuuagcagagaaucaugaagauaauuauaacagagaucaagcauggucaaguuuacuagcccauccauagcauuugucugcaguuuggagauuucauuguaaccaagaaggagucuuuccagagauuuaggaagaggaaauggaaauucuucuaaauuauuaugcucuagaugaaguuguaguagauuuggaagcuuagcaaacacaccauaaucaaucuuuugagauuuaauuuuguuguggcugagguuaauuucuuuaagaugaguugcauugaugaaugaauuugcagucacagccucaauuucauugaacugaagguagaguugcugaaugugcaucggaauauuugggauagucuugaguuugcgauuaucacaguacauugaugauggaaaguuaguuggacagaagcauucacugacacagccuaaaguauacugaugaaaaggaacuccguagucuacauuuugacgaaaugggaauccuguuugguaaucaucaucuggcucuuggucauagucuucaucccacugauaaguuucauauuggcaauguacuuugacuccaaaaaagaagaaaauaacauauauuggacuuaaaaaacccaucuucuuuuuuuuuuuccuauugcaaggagaaaaggaaacauuguggagaaagugaguaaacucagaauacgcuuuguauaaauucucaguuauaugaaauguauuauaccuaugucuauauauaaaagaauauccagaaagaaugggcagugcucaaaccaaaauuuuuuucuuuuuuugugacagugucuccucugucacccaggcuggagugcaguggcacaaucucggcucacugcaacuucugccucccaggcucccagguucaagcaauucucaugccucagccucccaaguagcugggacuacaggugcaugccacuaugcccagcuuauuuuuguauuuuuuaguagagacaagguuucguuguguugcccaagcuggucucaaacuccugaccucaagggauccucuggccucggccucccaaagugcugggauuacaggugugagccaccacgccuggccucaaaccaaaauuaauguuuaaguacaaaugaagugaguuuuuuuucuuuuuucuuuuucuuuuucuuuuuauuuuugagauggagucuugccuugucacccaggguggaguguaguggugcaggcuuggcucacugcagccuccaccuccccgguucaagugauucuccugccucagccucccaaguaucugggacuacaggcgcgugccaccacgcuuggcuaauuuuuguauuguuaguagagacgggguuucuccaucuuggccaggcuggucucuaacuccugaccucaggugauccacccaccucagccucucaaagugcugggauuacaggcgugagccacugcgccuggccgagauuuuuuuuuuuuuuaagucacauauuacacugaacuugagucaaaagucugguauacuagacuuucuacuaaguaaccaucuuuuaagagucccaguuucucuugcuuacuaggguauagaucuaugauaauagcaugacaucagucaacuacagucugaucccuccacuguaaaugcuguguguucuuuggaauuaccugauccuuuaaugauggucacugccugggggaggaaagaccuuuauuuuaguuagagagcuuuugccugggagauucuacaacuucuauuugcugauaccuuuuucugcccuucagaagaacgugaaaugcucccuuuugugugauaacuucagauauuuagaaauaguauucauguuuccuuuuaauauuuucuguccaaaacuaacagcaccaucaaauuuuccucaugaaacaguuuccagaauccaauuauuuagucuccgacucugcuugaauaacuacuuuaaauccuaaagacauacaguguuuacauucuacaaaguucaagugucuuuacauuuuucuuccuagcuuccuuuuuuccauuaauauauuuaaguuuuagauacaaaaauauuauuaaaaacacacuguccuugucucccagguguuuaaagucuuguggagaaucaaauacacgugcaguagaaugcaggaggaggauauuguguggaaaagaauugcaaaagggcacacuucacaaugaacacucagugcugaaacuugaaguucuagggaagggucaauuaugucccagaugagaagccugaaaccuauauuucauuucugucacuuaacauaucugccucuugccucaucaauaaaauaagaauugcaauuauagcugaauuauaccuuggcugcuuaucuuguauguugccuugugucuuuuuuuuuuuuuuuuuuugagauggagucuugcucuguugcccagacuggagugcaguggugcgaucucggcucacugcagccaccaccuccuggguuuaagcaauucuccugccucagccuccccaguagcugggauuacaggugcacuccaccacacccggcuaauuuuuguauuuuuaguagagauggaguuucaccauguugaccaggcugcucucgaacuccugaccucaugauccacccaccuugggcucccaaagugcugggauuacgggcgugagccacugcauccagccuccuugugucauaucuugccugcuuauccgccuggucguuguuagcauuguaugagcuaugcauguacaaguacuuugcacguugaaaacugcuauccagaugaaaugaauguaucauuuaggaaaaagguuuuaaaaaauccuaccucuuuuauucugagaccuuucuacuuuucccacccaggguuucaugagagaaugaguuuccaaacaaaucauugcauauaaugaaaugacuuaucuccuguucauguagaaugguucuagcuauuuuucaucauugguauaauugagagaauaguuacuuaaguuauuuucuuugacagaaccccauuugagaaagguuaagaaacaucucaauuucuucuucuuuucuugucagaaauuauaaauguaacuauuguguguauuuggaauuugaaguaguuauucagguagagucagagacccuugagcucucuuccugcagugauacuuuccuucauucuuccucaccauuugcucccaugcacccgcauccuggguuuugucuuuucuauuacuggaacccuucauacucuucauuuugaguauuccgcacucagaccacuaucucuauguaguaacuccagcugcaauaauucuccaauuuccguggaaccucagcuauauugauucuacuguuuuucacugucccucauccauaccucccaacauugucaguuccuucuuaccaacuuagaccccauaguugaucacuaucguugcucuuuugcacaugcccuaaacuuucuggcuccuucaaucugccaaacuccaacucugguuacuccaauucucuaccuacucacagccugacugucacagcugaauguaacuaaagaaaaacaggagcauggugacuggucucacucucgauucaagaccacuaaccucaagugcuguccugcugcauuuccuuagaccauccuccuucccucucuucuacgcuacuguuuuguaacuuuccucucugaagccucuaauaccuuauuccccauuauuguuuuugggugaugaccuugcuucuuuuuuuuaagucaagaaaauaggaucaagauaucauuuauuucuauuuucuuauauguaucccuaccuacaagaaaaugccaaaauagcaaugguuuggguuuuguuuuuguuuuuuuuuuaacaauaugugcuuuugaaauucaugauguuucuuugugcaacucuauauuacauccauuuuucuuucuuuucugugagauucguggaagauguggcauuugaccuagacuuugaaggaguguugagguucucauagagggaagugaggaagaagaucucuggcuagaagagaugagcaaaaacauagaagcaacagauggugauguguuugggaaaugugguugguuaacucuugaaggagcaaaauaagacuauuaaauccagaucugaagggauuagccuaacuuuuuuuuucugagacagucucacucugucacccaggcuggagcgcaguggugcacucuuggcucacccuccaucuccugggcucaagugacucucuuacuucagccuccugaguagcugggauuacagaugcgugccaccacaccuggcuaauuuuuuaauuuuuuguaaagacaggguuuugccauguugcucaggcuggucaugaacuucugggcucaaccagucugccccccucagccucccaaagugcugggauuacaggcaugagccaccacccccggccuuggagggccuaaauucugaccugaggaauuugcacucugggaaugaaugccuaauuuaaugaauuaacauauuugggcugugauuucacacuacagucaguguucgugggugaaaaaguagagaaucuuggaaggagguagauuuaaggaguuaugguaucauaccaaagggcaguguucagagcaggcucuccuugcugggcuggaagcucccagugggucugcuuggaaaugcuuauucaccuaguguacucuacuacuuuacuguauguaaacaugcuuagugaagcacuuuacaaauauuaguaguuaguuugauuggguuacaucaguuuaccguuguccugaauuauuucuagugaugaggcacuaugcuaaguugguggagaauacagaaaugaagaagacgugaagccauagucccuucuguaaagagcaaacagcuuaguggaggagagagauacaacaaagugaacccuaaucuaaggcagaggguaauauccuuuauagcagagauaggcaaugcuguggggccaguggcuuaccucagccuuacggagacaggaaagucuuuuguagacaucauuugacccagacuuugggagauuaauaggaauggauauagaauauucuauacauuuuauacucauugaugauauuuuauguauaauuuuauaauauuuuauuguacuuauuauaguauaacauauuaacuuuuuuuuuuuuggagacaagagucucgugcugucacccaggcuggagugcaguggcacaaucucggcucacugcaaccuccgccucccaggcucaagugauucuugugccucagccuccugaguagcugggauuacaggcgugcaccaccacgacuggcuacauuuuuuuguauuuuuaguuaagacgggauuuugccauguuggccagccuggucucgaacuccugaccucaggugauccgcccaccucagccucccaaagugcugagauuacaggugugagccaccugccuggcugaaaacucagcuugaauuuuaucccuuuguugagaacauuagcuaaucaucaguuaucaaccuuacauuugagaauuagagucuguuguucaacaacuaugaaaaauuguugggaaaaaagaagaaggccuugaaucaagacaugacuggggcgucucugaaaauaaagagguuuuuaauauugucugcuuuccgccuuugugagcaccuaagaagaaagucuuuccuugaggaacaauuucucuucuaaaccugaacuuaucuuaaacauccuuguccuccucccuccacguuccuaaccauguaguacaaucuugucccacucccuuugauuaagugcaguuuucuguuuugaaauccauccuguuuucaucuauaugcucauuauuuucuaugccucuugcucuuuccccaggauaauuuccccuguuacaacaaucucuuauuuuauccaaauuuuucauuccccaacuaaucucuucugagucauuugcuaagcauauuuuuguuacuucugcuuuucauacucuacaauguaugccuuguucucuauaggauaacucacagcaauauuguauaauucauuguugaucaucucauuuccuaauaucuuuuaacagaaucuaauacaaugcaguguuauaagugcucaaagguguguugaaugaauaaguuaauaaguuauagguuaaggcuugcuagcaaaugcuucucucuacuaauguugauuauuccuaggcauuuauuucacuaugauaauuucuucaaaugaacauauucaugagagcuugacuguuccuuuuucuauugaauauuucuucaucacaauauacuguauuccucacuuuccuaguacaucguguagcaggaaaagaacaaaugugaaaaagaauguuuggagcaaaguaauauauauauauuaccaguuuucaaugugaauuuuucauauuauagcaauaaaaccaucugugucauaauauuucucuuacuuggagaaaagcacucguguucaucaagaaaaguuucaauugaaauuacuaaugagguauaauuuacuuguucaggaaaaguuuaaaguaaaauccucaacauuuuauuauguuaaagacauaauuguuuuuauuuguaugacauagaaacuagcauauaagaaagcaaauauuagcauauaauuuagauuuuuccaaaaaaguucuaaauuuuaauuuuauaaaauuuuuuugcuauuaaaaauacaauuaccucaauuauuuuuagccauaauacauuuaaaucguaauuaacuaaaacccaaaguaacuagauccuucaauagacuagauagagcaucuguauuuucccuuugagaaagaaguaaaugaaaagaaaaacauucuauaucagggauuuagucaguagagaaauuuggagaaaaucuugagugaaauuuguacaaaugcccaucaaccccccaaccggaaucacuagcauugcucagcuguaugccucaaaggcauuagcugguucuuuguuacuuauaauucauagaaaaaaagagaccuaaggaagagaaagagauugauuccuuuaaccugagaaucuuuccuuucauucaaaguaaaaaaaaaucuaaacaaagauuuuuuauuggguaaaucuuaaaugagaaaguuaaacucauuauacuacuuuauuugaacauuuugccuaaucaaaaguuuaacauaacuuuuuuaccagauuuugcuuccaaaaauugugcuuuuguaauagaugcagucuauuuuaauauuaaaaaauccaauauacuuuuaaauuuuaacaguaggaauacauucuuaaaaaauugaaaauuauuuuauuaucauaccuguucaauuugcuuuaguuuucagggguugaugaauuuguaaauccuuuaaaugaaucagaaauuccuaaauucuuuaacugagucucuuaaaaauccacaguaacucuguguccagacagggcugucucuugaauuacuguagcaauuuaagcaaauacaaucuucuuggaaaacacucggguugaauuaaaauuauguauuucuuuucauuacaugaaacuuuguggauucaaauuaagaugcuuguguucuuggucagauuuauguggcuuacuucuuucuuuuccccuuaauuuugguuugagguguggcaagaauuuccucuaaugugaaaggcaaacaaaacuaaau

SEQ ID NO: 17290 - RNA, 28189 nt, Homo sapiens
cucuuacgccgaccuaguccaggaauugguacacacagcgauaguguucaauagaaacuaggggauuuugguuuaggcucuuuugcagucguugagggggaggugacggaggcgucagggaaggugggaggacggaaaaggaaauuaaaagcucuugggaacugaauugugguaacggaaccuuaggaggcuggguuggaaaucgaguaggaaggaagagaggaugcuccguugggacacgugaccagaaguuaggggcugcagcggcgcuggcuuuaggugaacgacguggugaggaguggguuucgggcaugagaagucacagggccguuuccuagucucucuucacuucuuugggucuucucagagaaagaaggcugccguggguaggcugggggcggagacuaucgggaagagguaggccgaaguucugcccagaauacacgccaugugguggacgcugguugggagucucuucuggaaagagucugucagcucuuggggaagggaagggcgagagcugagcgccugccgggugcuaaacgaaaugagagauacuaugaugggcccuaguaccucuggaaaaguuuuccugaguccccugugauacagcaaccuucauaguauaguguuaagaauuccaaguucugaagguagaccugcauuauaauccuggauucacuaauuuucgguauggcauugaggaagugacuuaaccucuucugcucuccugaaaaaugggaaacaugcaaacuacuuuguacaaugcaggcacauagcaaaaacacaagucuguauucgcuauaucccuugaucuuugugucugaaccccacuuugcagcacuuuuauugugacauaauauugugccauuuguuuuauucuuuugugacuauaaggagcuccuagccucucuauucacuucuuugggucuucuaggaggaagaaggcugggguggguagguuggggguggagacaauuaggaagagguaggcuagcucuuuuuaucuuuuagugcguuacauccuguuucugucagacuuuguuaaagacaguaaaugaauguaugagugagucaaggaaaaacaucuaaaaacaugaauacauaaaauuaagagggauagaguguaauauuauggccauuuggaggaaaaaaacucugucuguaccugugucuauauggguaugggguugcuguuccaaagugcauucaugaaagauguggauguagggcuugggcaaaaccucgaagacuaaaauuuggaaguaauacaauaggaagugaaauacagauccaggagacggauuugauacagaagguucagaggaaguaguuguuuuguuagauuuuagaagaacuaagggaaagaacucuucucuguauacagaaaauuacuuuucccacugaaacacacccaaguauaugcccagccuucaugaaagugaacagagaaacgaagcgccuuuauguggguggccuuagccaggacauuucugaggcagaccuacaaaaucaguucagcagauuuggagaaguuucggauguggagaucaucacacggaaagaugaccaagguaauuuaugguccuucacugggcaguuauaggcagacauaacucagguuaagugcuagaaaauaaaacaaccccaagauaaauguuagcucugaacaccaaaaguuuuaagugauguuguggagguauaaugugugauguggaacuugaccagaauuuguuucugaaauaagaaaaaauuccaaauucuaaaacaucugauuucagaaacauauuaacuuccaguuuugagaacuagaauuuucuaacauggauuaagugucccguuaaguagacuaucacuagcauacaaucaaaauguuuccuuaucugacuacuggacauuuucuucuuuuuuuuuuuggaauauuuugauaauuaugcuuauuuuuauagccaauaaaaaacaagguuuaucuuugaaauaauaaguuuucaagagcuauuuuuuuuuuuaauuuagaaacaaccguuuuuacauugcucucuggauaagaauuuaaauaaauuguuuuguuuguuuguuuguuuguuuuuuaggaaacccacagaaaguuuuugcauauaucaacaucaguguagcagaagcggaccugaaaaaauguaagaucaucauauauuuucuauacuguuugccaguuuguaugacucuguaacuuggaauaacugguucuaaaucuaaaccuccacagccauuuuucacguuauccagagggacagcagugaugaagagaauuccaguaucguauaacucagcagguuuagguccauuccauuuggcaucagcagacaugguagcacuuuacugguggguuuacuuaaaacugcuauucucaaauauuuuggacaagggaccaaacuuucauagaaacugccuguuacauauaucccacugaauaucaugccacauucccccucagucugaucauuucuuugacagcuaauccuugucacuaaacacucuugagggggcuuuaaaauacacccuuguaagaccguauccuugaaauugugaaaucucuuguugauaaguuuaguaaagucaagggcaaacaguggccuucaaugaagaaugggagauaauccauacugccgcugacacaguaacauauucuaguuauuuggaggccaaaaagugaaaaaagacacggaaaauaaguaaagggaacacgcuaauagaggaagagggcaaucagucuuuuguaauuucauuugcgaaaagauugcuuuauucuauuuuacauugaggaauauaugugauaaaugugaaguugugguuaagaauacaucaacuaggcuuugugaccuguggcaaguuacuuaaacuucucagcccaaguuugcuuaugugaugaaugacaaaagauagugcuugccucauaauauuucugugagaauuaaauuaaaugauacauuugcaauacuuugggaggcuaaggcagguggaucacuugaggucaggaguuugagaccagccuggccaacauggugaaaccccaucuuuacuaaaaauaccacaauuagcugggugugguggcagacaccuguaaucccagcuacuugggaggcugagacaggagaaucaccagggaggcagagguugcagugagccaagauagugccacugcacuccagccugggcgacagaaggacacucugucucaaaaagaaaagauaaauuuguacuuaguacaguaucuaccaccuacaaaauucuguuaaugguauuauuaaggaagcugacggcagaugcucagagaaaucaauuacuacggcauaguaauucaaacaguucagucacucauaguuaauucaucugcaaguucuacagugauaauuaguaugaggugauaaauaaaauuaaggugcuguaggauuccagaguguccucugauucaccugaaaagaugauuguuuuauaguuacaggaaauauauguuuuauaguuacaggaaauaacaauaaaauauacauuaaauaucaguuauucagagguuccugacauuuguuuacaaacaaauugcaaauaaauuuugcuuuacuuuuuacacauuuugccucauuccaaucuaguaacacugugagauagggaguguaaagacucuuuugguaaguugucaagaugaaacaagagccuaggcucccucucuccaggucucauuucuuuucuuccacuuccccuggaucucuuugugauaaacaagccugcuuuucuugauacuaaauaauuagaaaaagcacaagcugaaauauauuuuuacauugccauguacuuguaauaauucuuuacuuuauagguaugucuguuuuaaauaaaacaaaauggaaagguggaacauuacaaauucaacuagcaaaagaaagcuuucugcacagguaaguuuugcuccacauggauuuaagcccuauuuuuuuuauauuguaagugguuuuauauauuauuucaaauuaucaaguaauauaguauuauauucuuaacaaauucaaacauauaaguagagcugaaaucccuuucaacucugaauccccuucaccccagacgaacaaaaaggauaauuucaugcauuuacguauguauguaauaagcuauaaaaguauauauguacuuauuuucucuguuaaugagcuauaaaagcauauauguacuuauuuucucuuuguuaacacacccuuuuguggcaauguagaucuucucccuuuauaacaauuguuaguaguauuucagaaaaugguuauaccacaauguaguggucccuucccacugaugacuguuucuacuuuuucauggucauagaugauccuggagcacauauccuauguauaugcagguguuucucucaguuuauaucagaaaauggaguugcugaaucuuagcauugucugcauuuaaauuuuaguagacuacuaaauugcauauguugauuuugacuguuaaugcuagugucauaccaaaauauaaaggaaauaggagaucacuguaugacaggcauaagagugauuaugcaagugauuuaagagcaagacaauguauuauaaaaaccauuagagcuuuuaaaauccuaaagguauuuucaggaagaaaagguauuguuggggaguuuucaaaauaggaaacaauuuaagaauauacagauagaggccgggcacgguggcucacgccuguaaucccagcacuuugggaggccgaggcggguggaucaccugaggucaggaguucaagaccagccuggcuaaaguggugaaaccccgucucuacuaaaaauacaaaaauuagcugguuguggucaugggcuccuguaaucccagcuacuugggaggcugaggcaggagaaucacuugaaccugggaggcggagguugcagugagccuacauugugccauugcacuccagccugggcaacaggagugaaacucuugucucaaacaaaaaaaaaggaaaaaaaaaaaagaauauacagguagaaugaccaggagaguugauaagcuuguuccagaccaaugaaauguaacaagaacagauauauucuaaaacgaguggcaagcaaccuacuuugaggcauguuuugggggacuggccuuaugaaaaaggugagaauuugauuuuguucuucagcugaagccuaggacugugaacagggugguuauauaccuuucauuccagcagcaguugccagccuacuguguacaggcacuagagccccaugcugagcagguugagcacacagugcugcugcuuggaguaucugcguggauaugccugagaagcaugggucugaugguuauucugggacauaaaggagacagaccagaggcaaagaggccagugaggacugcucugugcaguuguccaggccugaagaagguggcggugauuugaaucagaagagguggcauucucuucauuaggaggauauggauaaucaagaccuaacaaauugggcuccgaaagauaccuucgucauggggaagagugaauggagagaagauaauauaaaaugccaaacguauauaaauugaaaggggaaaauugagagaacuugcgauccauggucuuggucuuccauaaaggggaacugggacauccacuggagcagagcacagguauaagcgugcaugucagggauuugggagacugacuguaguguaguggaugggcuaagaaaagaacccucaugcucuggugggacagcccugacagcacagcuugucacugcuguccaaccguauagcucaguugcuggugguaagggacuggucaauaaacuacaguagauugauggaaaggcauguuguacagcaaucauagugauguuuucaaagaacguauaaguugauaaaugaaguguacccaacugugcuuaugauauuuggauuacauuauaaaauauguauauuuacauacagaacaaagaugaaguuaaguaaacaaaauauuaacaagaugagggauaaggaauauguuuuguuuucuuaacgguucugucuuccaguauucuauaauaaaaacauuguauguucagauaaguagguaagcuauuaugcuacuaagaaagcauuuuuguuuuauuuugguuuuuaauacuacaaagcuguuuauagugcucauuuaggcacaccuaaagugaaauaaccauuuuacguggcugauuauuuugacucuuuuauuuguauuuucuuuuugauucagauuggcccaagagagagaagcagcaaaagcuaagaaagaagaaucaacaacagguaacgccaacuuguuagaaaagacaggaggaguggauuuccauaugaaagcugugccagggacagaagugccagggcauaaggugagucuccucuguagccugagccaauuacauggucuuggaaacugaugccugagaucacgugauugugggugucaugucuaaaaccaguuacucuuuuccccuuucuuggaggcaauuaacauagauaggacuuuaugauuuucaaggugcauuuacaacucuuagguaagcauaguucuccaucauuuuacagagaaagaaaucaaaacucaagcagagguggacuuucaagggacauagguagcaaggaauacaggcaggucccaaguuugccuguucaaauuagcagccaguguuuuuuguaaaccaucuuacacgguuuacuugggauugauagcugcuccaaaucuuccuuuuuuuuucuuuccucucacaauuuuucucuuugguaacucuuauuucauugucagaaaacuaaacccaacaguaaucauagcccacugauuuuuuuguuguauuuaccuaauauuguuauuaaaucuuuuccauuugugucacauauaguaaauaaauucuuuuuuuuucuuuuagaauuggguugugagcaaauuuggaagagucuuaccuguucuucaccuuaaaaaucaacauaaacguaaaauauccuuuggccucucaacauaauuauuuaccacagugacggauacuuguaaaauaccuuuagcauuucacugucucuuaucagugaaucuuuagguguuuguuugcguguucccaguuucuugguacucaccuacauguaugaaacaauuagagcaugagaaaauggauugagguuuuauacaauaaguaauucaaaugaugagugccaaagaagcagguugguuuauuaauuuauucauauugucauacauggauucaaagccauugcugaaggagcuaaagaggggugagagacccagagaccaucauuaaagaaggcuuuagaauugagguagguuuugaauuaauaagaagugaugggaaguagucuugggaguaggaauaguagauaaaaauaugugggcaagcacgaggaugguggguugagaaauaguuuggagcagagugugagcaaauucuaaugccuauucagugaggucacauugucuaagaccuugaagaccugguaucauggaauucugagcagugugucuuaauguauucuuuuuuuuuaaucuuuuuuuuuuuuuuuuuuuuuuuuugagauggagucuugcucuguccccaggcuggagugcaguggcacaaucuuggcucacugcagccucugccuccuggguucaagcaauuccccugccucagccucccaaguagcugggacuacaggugugugccaccacaccuggcuaauuuuuuuguauuuuuacuagagacgggguuucaccauguuggccaggauggucuugaucuccuaaccuugugaucugcccaccuuggccucccaaagagcugggauuacaggcaugagccaccgcaccugaccgucuugauguauucuuuagcuuguaacccuggugucagucaguaaggggaacaguagcagguauuugaaacagagggauuauaauauaugcaguuaguuaaacaagugcuggaggagcaaaagccaaaggucagauuccccacugauugacaacugcaguaaaccacuaccccacugggacuagagaagcaaaaacguguguccucugagcucacagcuacugugccacugaaaccacuacuaccugaauccaggcccuaguugcaccggacauagcugugaccucugcccucccuacaaguggcucaaagucaggaaaguacugauuucuucuuuuccacuuuccagcuuuccaccaauggcagcugcugauggcaaagaggaagauauugaaggacaguagagacaauagacacuuuuuggcacaccucacauauaacuggcacauauaaguaguuauugaaaaaagggacuuucaagaguaaucgcuuaagguggggugcaguggcucacaccuguaaucccagcacuuugggaggccacugggggaucacuugagcccagguguuugcgaccagucuaggcaacauagugagacuguaacucuacaaaaaauauuaauaaaagaaaaaucaggcugggcccgguggcacaugccuguggucccugccacuggggaggcugaguugggaggaucacuugagccuggaagguugaagcuguauugagccacgaucaugccguggcacuccagccuggguagcagugaaacccugucucaaaacaaaaaagagugauagcuuaaagcaccuuaauacuugccuauucauaugcuuuagggaaucagcaaaugacagccaucauuacaacacaucgauguuaacuagaaucuuucccggauagugucgacauaggccugguaaagauuuauuagauuuuuuuuaauuuuuaauuuuuauuuuuaagacagguucucaccauguugcccaggcuggucucgaacuccugggcucauguaaucggcccaccucggccucccaaagugcugggauuacaggcaugagccaccgugcccaggccagcuuucuaauaaagaccuaaaaauguugcagagagugaguucaugugaaguggauguuauucagcuaggagaaucagaguuaggaugaguaagaacugagagaacagaaauagccaaaagaauuugagaguaaaggacacacauguggccauguccucuggguucuccugaacccagaacuuugcuuuacuguaucaguucgaugguuggauuucugugauuuacagaaaauagcccugagaccuguguaccuauaauauaaucugaauagguuugcuauaauauccacauacacuccaaguaauuucugccaacuaauaguggugguacuagacuuuaacucagcaaaugucauagaaagcucaguuucuuagacccugaaagguaaccuaguuaaguccucauuuucuuuuacaggaaacugaaaggggggggaaaugacuuauuugagauuaagcaauauuuuuuguaucaaagauugaugaguuuuccuaaaaccaagugcuuuaguuuuguuucuugacuugcguaacaucaucaaauaugaucccucaaaauacugccacaaccugaagaagauaggggaggauuucucaaacaccauuccuauauccagccugacuugggaauuagaaggagggaaugacccuaugaguaagaaacggcgaggagaguucucugacuuucauggcccucccaagaagauaauaaaagugcagaaggaugagaguuccacugggucucuggccaugaguacaaggcccaggaggguaauagagagaccacccuuaacacagcaacaggcugcacaaaaaagaacuugugauuccauuacuccuucuaaaucaucuccuguaccuguuucugauacucagaaacuuaaaaaucuaccuuuuaagacuucuggcuuggaaacugccaagaagagaaacagcauuucugaugaugauacugauucugaagaugaauugagaaugaugauugcgaaagaggaaaacuuacagagaacuacacaacccucaauaaaugaaucugaaagugauccuuuugaaguuguaagggaugauuucaaaucaggcguucacaaacugcauucuuuaauagguuuagguaucaaaaaucgugucucuugccaugauagugaugaugauauuaugagaaaugaucgugaguaugacucaggagauacagaugaaauuauugcgaugaaaaaaaauguugcuaaggucaaaaacaguacagaauuuucacaaauggaaaaaucuacgaagaaaacuucuuucaaaaauagagaaaacugugagcuuucugaucacuguauuaaacuacaaaaaagaaaaagcaauguagagucagcccucagucauggauuaaagucucuuaaucguaaaucucccucucacuccaguagcagugaagaugcugauucugcaucagaauuagcugacucugaaggaggugaggaguauaaugccaugaugaaaaacugccuucgugugaaucucacuuuagcugauuuggaacaauuggcuggcagugaucugaagguuccaaaugaagauacuaagagugauggaccagaaaccaccacccaaugcaaguuugacagaggcuccaagagccccaagacucccacuggccuccgcagaggccgacaguguauucguccugcggagauuguggcuucccuguuagaaggagaggagaacaccuguggcaaacagaaaccaaaggaaaacaauuuaaagccaaaauuucaggcuuucaagggaguaggcugucuauaugaaaaggagucaaugaaaaaauccuugaaagacaguguugccucuaacaauaaagaucagaauuccaugaaacaugaggaucccaguaucauauccauggaagauggguccccauauguuaauggcucauuaggugaagugacuccaugccaacaugcaaagaaggcgaauggcccaaacuauauucagccucaaaaaagacagaccacuuuugaaagccaggaucgcaaggcaguguccccuagcaguucugaaaagagaaguaagaauccuauuucuaggccauuagaagguaagaaguccuuaagucuuagugcaaagacucacaacauaggcuuugacaaagacagcugccauaguaccacaaagacagaagcuucacaggaagagcggucugauucaagcggccucacaucucucaagaaaucaccaaaggucucauccaaggacacucgggaaaucaaaacugauuucucacuuucuauuaguaauucgucagaugugagugcuaaagauaagcaugcugaagacaaugagaagcguuuggcagccuuggaagcgaggcaaaaagcaaaagaagugcagaagaagcuggugcauaaugcucuggcaaauuuggugaguauauuuucaauguauggauuuaacaagaacucagaaaguucagcuuuucuuucccaugaaguuaggugugcccccauagagcugauugucuugguguucaccaguuucauguuuugguucuugaguuagcuuuuucaucugguuuaucugaaaauuucuuuauaauuuucuuucauuuagaagcuauaccugguauaguuaaguaauguauucaaaugugucugaauuuacauaaaaaucacuugucaagugauuuauaccuugccaagucuugccaagauuuacuguaaugggcuuuuguucauucuucuaacaauuguuaaguacaccuuuauaguaagugccagauuuauaguaugaggauggugaucuugccuuucauacaguuuuuggcucaugguguggcaugcugacagucacaguucaguuacacagggccaggaggggguugugccccugugccuuggcagcacgcaggagacacacuaagucaguugggagcuucuguagucugagcugagugguaggaaaagauuugugggaauuggucaggcccaggugaaaggguggaaagggaguggaaaggcuuucauucuaggaaaaaggaaccguuuauacaagggugaauguuuucaaucaguguaauuaaaacuuauacagcaugagauggcaagaaaugaggcuagugguuucauuuuguucauaaaaugaaaagagagugaagaauuuuaagcaaaggagagaagauuaauugugucuauuuuggaacaggaguugacaaacuacaccucaaaggccauccagcccaugaccuauuuauguacagccuucaagcuaaaaauaguuuuugaguacagaacaaagacgauauguggccugcaaagccuaacauauuuacucuggccuuuuacagaaaaaguuugucaaccucuguuugggagagauccuucagaccaugaugaaaacaaaucgaacggcuccgucuguaaccaaggagagccuuuggggagguggaaagucaaaaccguaacaacagcaaugggaauagauugacugaauugauaccaaaaaguuuaauugauaggacuuggugauaacuggauagggauagaaagaggaauuguaaguuucugucuuaggcaaauaaacagauggugauggcauucacuagauaaggaaaaagggcaggaaguagacuuggcaggggaagggagugauagguuuagacauguucaguuugagauuggguuguuuuaagacaaugcuuuuuuuuuucuuccuuuauuuuagguucuggggguauaugugcagguuuguuacauggguaagcugugugucuuggagguucgguguacagauuauuuugucacccagauaaucagcauaguacccaauaggugguuuuucuuuucuuuuuuuuuuuuuuuuuuuuugagauggaguuuugcucuuguugcccaggcuggaguacaauggugugaucucggcucacugcaaucuccgccuccuggguucaagcaauucuccugccucagccuccugaguagcugggauuacaggcaccugccaccacgcccagcuaauuuuuauauuugugguagagaugggguuucaccauguuggccaggcuggucucaaauuccugaccucacgugauccgccugucuuggccucccaaaguguugggauuacaggcgugagcuacugugcccggcccaauagguggcuuuucaauccuuacucucuuuccacccuccacccucaaguagaccccaguguugauuguucuuuuuuuuuuuuuuuuuuuuuuuuuuacagggucucacucugucacccuggggugcagugguaugaucucagcucacugcaaccuccaucucccaggcucaagcaauucucccaccucagccugcugaguagcugggacuacagucacgugccaccaugcccagcuaauuuuuguguuuuuguagagaugggguuucaccaugucaccuaggcuggucuugaacuccuaagcucaagcaaucagccugccuuggccucccaaagugcugggauuucaggugucaaccacuguaccuggccuauugcucccccauguguacucaacauuuagcucccacuuauaagugagagcaugcaguauuugguuuucuguuccuguauuaauuuguuuaggauaguagccuccagcaccaucaauguggcuguaagggacaugauugcauucuuuuuuuaugacugcauaauauuucauggggcauguguaccacauuuucuuuauccaguccaccauugaugggcaucuagguugauuucgugucuuugcuauuaugaauaguacuccaauaaacauaugugugcaugugucuuuaugguagaaugauuuauauuccuuugggcaaauauccacuaaugggguuguaggucaaaugauaguuuuguuuuaaguucuuugagaaaucgccaaacugcuuuccacugugggugaaugcauuuacauucccaccagcaguauauaagcauuucccuuucucugcaaccuugccagcaucuguuauauuuugacuuuuuaguaauagccauuuugacuggugugagaugguaucucauugugguuuugauuugcauuccucuaaugaucagugauguugagcauuuuuuuuguaugcuuguuggccauguguuugucuuuugagaagugucugcuguguccuuugcccauuuuucacuaggguuguuuguuuuuugcuuguugauuuguuuaaguuccuuauagauucuggguauuagaccuuugucagaugcauaguuugcaaauauuuucuccgauucuguacguugucuguuuacuuuguugauaaguuuuucuuuugcugugcagaagcucuuuaguuuaauuagaucccacuugucaauuuuggauuuuguugcaauugcuuuuggagucuucaucauaaaucuuuuuaagaugcaaugcuuucgauggccucccuaggauggucauccagaggauaagccaacgcacaucaucuucgguucugacagugaaugugaaacagaggagacaucgacucaggagcagagccauccaggagaggaaugggugaaaguaagaaguucaggaugucucuguggacauucaucuacuucugcagauccacaccacaaacaacuggcaaucucaacauaaaacccuccugagagccccaaugagacccagggcuugccaggucaccucauauugagacuacaggggucuuggagauuuuuauauaugaaccuauauucuccacaacaucugcagcaugacaucaauauuagugaaacgcuacaaaaacuguucuugcauguaauaacuaccuccccaaauccaggcuucacuggagagccucuggauuagugaucccagaggccaguuagauuucacugagucaggaauuuccaccugaccugccauuuacucauuccugguagaugagucuggguuacuggcuuucaaugugagggagaagauuacguuaugaagggaaauacugcuuguuugccucugcuauuaauaaauguuguguuucuucacaggagucuauggguaaaacaucagggaagcuguuugauagcagugaugaugacgaaucugauucugaagaugacaguaauagguucaaaauuaaaccucaguuugagggcagagcuggacagaagguuagugaagacugaaaauaauuagacuugcagcauguccuuauuuuuugacauaguccuuaaaucuggguaaaugcaggcagaccuuaaccuacauuauagcaucgggguguuuauuuggagagugagucuucugugauccucucugauugguucauaaguagauggagguaggcaaacaucuuaauguagugaauuucaguguguggggagguguacauugacagucuucgucagaagcaauuucuugggaauguggcuaucaauuauguauguuuucugucuguguagcucauggauuuacagucgcacuuuggcaccgaugacagauuccgcauggacucucgauuucuagaaacugacagugaagaggaacaggaagguaaaugcuucauuguccagaguccugaugucauaucuggggacacugagaaaucaccuaguauaccuccuuuguuuaacacaugaagaaacucuccaucccaagacauuggauugaggaguuuauaaucaaauguacaguuaauacuaaguuuguuuguacauaguaauuuaggaaaauuuaauuacuuagagcugccagaaaggaaaggaaaaaauaacauccaccaaagguaccauuuuccucuaucccauccuuggcaugagaagaaguugaguuuccuaccuggcaguggaucagcagguucugggugaagccauggaagacaguuaagucacucuuggcuuucuaaaaggaacaguguucaucguccuccagugugcauaccuggugcagauuauuuuuuaaagcuguguaucacugaaugccauucuacuugaauuuaucccuguuugaauguaucuaagaguaaugaugcuaucagaagcauccuaauucuacuucuuuucacuuacuauagcauuuuucacagcaguacuuccaaucuuuuucuacaggaccuucuccucuuacccuuuuaaaaacaccuuaccucuuacgucgcuggcuugaaugagcucccuaauucccucuccuaaucucagaacuucucugcccuucuuuuuuuuucuccuuccugaauuaaucuaaucugcauuuuaauccucaccauuccuacuuccuauuacuccuuucaucacuugcauuuucauucuucuccuucuagcuucuuccuuuuucuacagacauaguuaggucuuguggucccaaaaaagccauuccucuaaccaugccaguuuucaaguuuguacuccaucucucuuucaguucuaaauuugaagugaaaaaguaaauuacaucuaauucaguagcaguuggcuuuuuacugaaaacaaucugugauuugaucuucucaauucuuugaggugauuauuaacaguguuggacuguuucaggaaaccaagguucagagaguuuuaaaaugaauucucuaggguccucccaaauucuguuucagugcugagauuacaggcaugagccacuguagcuggcccuuuuccaacuuuugaaagcacaauguuugucuauccugcaagcagcagcacagccagccuccaucaccuugagcccuuuccagcauuguauucuacuugacuuucucacucaaaacuccauguugaaaacacaagaaugaacagaaccuggagacuaaccuucauuuagaagguacauagguuauuuucuuaacuucugccaauuuugucuguuucuuuacaacucuuuggguguguguucccucaaagccguaaacaacuuguccuccaagugcaguggcauugucuccaaugacauccucuucagcuaaccuagagcauaugucacuguugaucaucccuucuugaaauguucacuuugcuuccaauugcaucauaacuuccugguuuucuuaacucuuuauuccuaauuuuucuuuugccuccaaauauggguucuucccaggguucuguaagucccuauagcuuuagccuucacuugcacaugaguauuuuucaaauuuggaucuucuuucuuccuugcuguucugcugagcucccaacuggucuuaaacgccuguuggauauuuuccacaggcuuuccugaguuuguguuaaaacucagcaaguccaaaccagcucuucuuaaccuuucugcguugauggcguguccauucuuagaaucucuguuguuguuuuuuucuuuccuucucaacauuuuauuuuuauuuuuuuggagacaggaucucacuguguuccucaggcuggagugcaguggcacagucauagcuuacuguaaccucaaacucagucucucuaguagcuaggacuacaggcaugugccaccauguccagcuaauuuuuguauuuucauagagacagggucucgcuguguugccuaggcgggucucaaacuccuggccucaagugauccuccugccucagcuucccaaagugcugagauuauaggcauggaaccacugcaccagaccccuucccaaauuuugaggcacaacguuuugucucaaguaagcagcacagccagccuauaucaccuugagccuuuuucagcauuauaaucuacuucccuaaugcuuauuagauuaaaauuuaaauugauguuuuugauagucaaaaguuguugaaauuagcaguuucaaccuaaugcaguguaaacuuuuuguacuuuauuauuucaauauauguguucguuuuguuuccaacaccuagcaugcuuuccuaccaccucuagggauucaacucuaucuuuccuaccucauaacuuuaccuaguuuauaaagcaucuuuugauucaguuaaacacuaucucaacuuccuuugaacccuuagaaacuuugggggcaucccuguagaguacuuaaauuagcauuuuauucuaguuucuguuaguugguuauuuauauccugcaguaaguugaaagagucauacaggcuuagacuacuuuuguauuucuguaauccaaacuagcuguuuaacuuuauucugugauauuuugucuguuuguaguaguugaggauaguagcuuguaaaaguccaugaugccuuaguauguguagggcauaugguuuuuuucccauaauacuuguuauugaaucaaagacugaaacaacuauccacuaauaucuuauauugucagauauaccauuaccauuuuucacucuuuaucauuuuuagauuuacguaauuuagauuauguuuagaauguuaaaaaaaucaaagagucuauaaucacuguaguuauuaguaucuugcucuauuacauuugucgaucuuuaccuuaaaaguuuuagacuugcuacugaaagccauuaaauucagacuuucauaauuaggaacagaaguaggacuuuucauugucuggucacgcagacuuucugaguuugcuaugacugagggucuuugguuauggagguuagugaaaugagguuaaaguuucuucuuccugucuuaauggauuuugaacauguuuagguacuugguaaauauuugaugauugagacuucucaggcuguguuuuccaagagaguauuaauuaucccuuuuccucaaagagguaaaugaaaagaaaacugcugaggaagaagagcuugcugaagaaaaaaagaaagcccugaauguuguacaaaguguuuugcaaaucaacuuaagcaauucuacaaacagaggaucaguagcugcuaagaaauuuaaguauguuuuauguuccaucccauucuaccauaucauccuuugccauaaaugucuucuugaacucaauuuaaaacuaggucucuuuuaauggccuggggaggcagcuggcaauauguaucagacccuuaaaaauauacuugccuuugacccagugauucacuucaaggaacuaaucuuaaauuauuucuguauuuauacacuuagaugucauagcagcaucgcuuucauuagugaaacaaaugggaaacaguuuaaauaguaacuguaaaaguauuuauauaaacguaacuguuauggaaauuuucaggcaugaaauuuagagagacuaaugaaagcccuguauaccaucauuaccuguacaccagguaaugaaagcccuguacaccaucaccuagcuuuuacagucaccaacaugugaccaguguucucuucuauaccuuuauccaaccccuacuuuacacaaugaaauguuuuaugcaaaucccagauaguauaucauuuuaucuguauguauuuuaguauguuuaaaaucauuuuaaaagcuaaaaaaauccaggaaaucucaaaaguagguaguuuaaaauauuuuuucggcugggcaugguggcucacaccugugauccuagcacuuugggaggcuaaggugggcggaucaccugagaucaggaguuggagagcagccuggccaacauggugaaaccccgucucuacuaaaaauauaaaaauuagccgggcaugguggcacaugccuguaaucccagcuacuugggaggcugaggcaggagaaucgcuugaacuugggaggcggagguugcagugagccaagaucacgccauugcacuccagccugggcaacacagcgagacucugucuccaagaaaaaucuauguauauguuauuucuaguaagauccuaguuaucuuaucugauguuauauggcuucuucuugcugcaaaauuagaaucuuccuagugcugaauuauaauuugcuacuuacuuuuuguauuaguguucuguuuuuaucucuuccaaccucccuuccuuuuuuuacauagggacaucauacauuaugauccaacgaagcaagaccaugccacuuacgaaagaaaaagagaugauaagccaaaagaaagguaaguagagcuacuucuuuuagcaauaggaucauguaaauuaaucucauuucagacaauuaaaaauguagguaggaaccaauauccuacucauuggucccacuguauuaagauuggugggguagggguagugcagguagaguuagaaaggaauuauugaugugguggaggaggucuuaccuuuuaacagaggaaucuauaaaugauauguacuccuaucauuuauaccuuuuauuuguauaaaugaugccuuuuauuuguacuaguuucuugugucuucuguagcuaccacaaacuuaguuacuuaaaaucacaaaaauuauuucuuuacaguucuggaaccuagaagucccaaauuaagauagugaacagguuauguuccuucuagagguucagggaaacaaagcuguuuuaugccucuccuaguuucuagugacugccaccaauccuuugguguuccuuggcuugagacuacauuacucccauuucugccucuaucuucacauggccucuucuuuucugucucuccucuuugugccucuuauaaggacacuugugauagcauucagggcccacuuggauaauccuggaugggcuccucauccuaggacccuuaacuuaauaucucugcaagaccccuuaucuaaauaauguuaacauucacagguuucaggaauuaggacauggacauagcuuuuggggggcaaccauucaaccaucuagugugguaggagcuucuguuuccuauagaugugcagucaguuggauaaacauggcaaauauauggagcaaccaguagcagcuugguuuaaauccuucauuuuccaacugcuaauagccacgaaaaucacaaaaggcagugugguauccugaauugaaucuugaaacaacaggacaauuuguggagaaacuagugaaaucaaaacaaugucugaguuuaguuagugguaaucuaccaauguuaaucuucuaauuuugacaauuauauccuaguuacauacacacauaauuacauuagggaaaacaaagugaaggcuauuuaggaacucuacuauuuucguuacuuucuguaaaccuaaaauuguuccaaaauuauucuuuuaaaaagaaucacauuuuagacuaaaguagaauauuaauauucccuccaauguaggauauauguguguuauuucagauaauccguauugaacaaauaggauauguuuacccccucccuauaccccuaagaagucucaucccuuuacaucagcucaaaauccaggaugucaucauucagaucagaucuaaguacagaugaggcuucucuguuauuccuugaguacaguaccuugagugcaguucuguuugauaagaccuaugaacuaaaaaagcaaguuaucuacccuuccuccaauauagagcgguggaacaggcauuggauaaccacuauagguacuguucaaugaaagaaaacaggcacaaaggagucacauguccauaguaacucugaaaucuagacagacaaauguuggaaggucuuugauuaggacugagggccuaggaauaauucuuccugaccguugacuuggcuuucuggaucauccuucucuuuucauaagugcuggcacagguuuacagcugaguaguuuuuucaaccugcuuuuugcuuauagaaauuugggaguccaaaagccuguucauuuugaaauguuccuguaccuaccaguccagucuagugguauuucugauaauauaauucucuuaaaaucuucauaaguuaucugugaaucuucuuggaauucacucuguuagaugaaagucacacaaaucauuuugagauaagccuuuuuuguuguuuuuuuaacccugggcuucuacugaaacugcugagagauaaugccucuaaccuccauagaagcccuauuguuugaacaauugaaguuuauuuucuuuuuuguauaaucuuagagacagggucuugcucugucaccuggcuggacugcaguggcacaaucauagcucacuguagccuugaacuccugggcucaagugguccucccaccucagccucccacauagcuggaaauacaggugugcaccacuguuccuggguaacaguuggaagcuucuuaucucuuuuuagggucuuaacaaagaauuuuguuuuauuuuuagaccgaggucuauaacuuuuucugugacaggcaagauaguaaauagauaagacuuugcaggccagaccaucucugcugugaugacuccacucuaccuuuguaaaagaaaagcagccauagacaauauguaaacaaaugagcaaggcugugugccgauaaaacuauuaaaggacacugaaauuuucauuucauauaauuuuuucaugaaaugauguuuguuuuucccccuaucauuucaaaugauaaaaaaaauuccuuaacuugcaguucagacauaaguaggcaguagccuggacuuggcccauggacuauaguuugccaaccccuucuuuagaccauguuuuucugaggcugucauagaguugaucuuugcuuagaagcccuuucuuaaauuucaugucauuugccuucuggagauuaggagucuucaaaaccaugaauuccuggcucccuuuaaaaaaaaaaauuccucccuuuaguuucauucucuccucucuuauuucacuguaaucaguaggaugaaaccagaauauaccuuuaacacuucgcuggacaucuccuuagcuagaucacccagcuaauuagguacauuuuccauuuuccacaguacacacaaugcaguugacaguguugcuaaacuuucuaccaccauguaacaaggauucccucuucuccaguuuccaauaggauuuaccuuauuuuucucuuaagcccuuaccugcaaccuucucaaagaccauaugguuucuacuaacaguuuuuucaagguccuucuagcuuuugcugugaucuuagucucagaaguuauaugucaucccauuuggcuuacucuguccauuaaaagagucacuaaguccagcucacacucaagggaugagggaauuaacuuccaccccuugaaggaagaaguaacaaagaguuuuuggacaaauuuuaaagccaccacauggugguuaaaugauaaucacuuggaacugccuaccauuuuuuauagagcuugguuuccuaagaggcauaucugucuuaaaaccuaacgagguugguuuauuuaccgaaauacuaaaaguuucucucuuugauauggucucuaccacuaagaaugguuauuuaggauauccuguucacuuauuauuuuacguaguacauuacaaacuuuggccuggucuucgaggaaaaaggauuuuaauauuuucuuagcucaaaauucaguauuggaaacugccaaguaacuuuuugucccagaucaaagagaaaagcauauucauuccuaaauacagagcagauuuaugguaauauaaaaauuucauuucaaaagacacuauacauauuuauaauuaauuucuacaacugauuuacaauuuuaccaguuacugguaaaauucccaguaucuuagaagucauguggcuuacaguuuucauuuugccuaugagaaaacugaggccuagugaagcuaagugauuuccuuacuuauaccuagguguauaguuuaggcauaauuucugaaauguaguucagagaaugauagaauaugauucaugcagcuguuugagauuuguguaaaaaaagcuuauugaucaagauuuugcuucuauuaguagaguucuauauguagaguuuuacuuauuuuauuucucuauuuauaaguagaguuuuauauucugguuguugauaggauagaauuaaaguuguccaagauuuuuucuuuucuugauuucuggaaauuucccaaaacuuguuucuuugugaugcacaugucuacauaugucauuucaguaaagcaaaacgaaaaaagaaaagggaggaagcugagaaacuaccugaggugucuaaagaaauguauuauaauauugcuauggaucugaaagaaauauuccaaacuacaaaauauaccagugaaaaggaagagggcacacccuggaaugaggacugugguaaagagaaaccugaggaaauccaggacccugcagcucugaccagugacgcugagcagcccagcggguucacguucucuuuuuuugauucagacacuaaagacauaaaggaagguacuuuucuuuuuucccauacuuuuuuauuuuauucaguuugaacuuaauugauugaaucugcauuaaguguaacagauuucauguuagcugaagaaaggacucuuucuucuaccuagaagauuugagauuuagugucacaggagcauaaacacgauguuccugaagcugugaaagaaacuauuuuugcauuuaaggaagcaaaucucuacuagcugccauaugaagggaagccagagaauaauguacagcaucuuuucuguuaaguaaaacgucaugaagaaguauaguaaaucacauaaagagcuuuguaucuuaaaugaagcugaagaugcuaugacuuauggaaaacuagugcuauauauaagauaaaagaagauauagguaaccuugguuuuacacaaauaugccaugucaucaauaugccaguuauugcacaguuuauccuugaagauuugccagaaccuagagagaaguauaaacacuaguacauacaguuuugcauuucauuucaagaggcuuaccucuaaaggccaacaugggccacagguuaaaaaacaccugaccuguuccucacccaggguuccagcuuucuggaaguucccacuguaaaagcagguaauaccuauacagaagaauacacacauaccuaacuacaaugauucuacuuuaaagaucagcaguuaaaauagcauacauguguuugguagauuaaaauaauuuuuuuuuuuuuuuuggagacagagucucugucacccaggcuggagugcaguggugcaaucucgguucacuagcagauaauaccaacuccgugguacuuuaaaaggaaguauaacaaucuaguaguuguucaaaaaguauugcaaauaagacuucauuuucuugucuauauaaacuguugaguagaguuggcaugauguaaauaguaacgauaguuuuucuaacuuugagagcaaaacgugagaaauugaccuugaaacgaguccuaaagacaucagcaacuugaaagauguuuuuuaaguacuugggaaauuuugaagacuugugaggugauuguccugaucuuauagcaguaguuuuuccagcaguucuagcaaaaaguuuuggguauugaaaauguaaagauauauuccuuuucucauuuauaaauagacaagagggaaaccugauuucccuguauccuauuauauuuuaggcuucucaugcaagcacagaugccaugguuauuuuaggugucauuuuuaaaaauuauauagcucauuuauaaaccuuuauuuuuuaaaccuuuuuuauauuacugcuguccuuaucagaucauucuagcaaugccaaaauuaugauaguggcuucugaaaauauuugaaaaaucuaaaaagaugauacuaccuauuuuuuugauacuauuuuaaauuaaugauuaacauauuggaacuuuagauaugucuacgugguaaaaguaaucaaaugaauguguucagaaauacuuggcuguggaguuacaaucccaucaucuuuuguugucauaacgauauagagaccuacagaguugaaacagugaaaccuggaaagauugucuggcaggaagacccucguuuacaagacagcaguucagaagaggaagauguuacugaagaaacagaucacagaaacuccaguccuggguaaacaauuuguuucuuugcaggcauaguucauaauuuguaaaaucugaauuagacauacuuuagaaauauuuuagcuucucuucacaugacaacuaaauugucuuagcuucuuuuuuuauuuuauuuuuuuuuuuugagacggaguguugcucugucgcccaggcuguagugcaauggcaugaucucagcucacugcaaccuccgccucccagauucaagcaauucuccugucccagccucccaaguagcugggauuacaggcacgugccaaccacaccuggcuaauuuuuguauuuuuaguagaggcgagguuucaccauguuggccaggcugguuucgaacuccugaccucaaguaaucugcccaccuuggccucccaaagugcuaggauuacaggcgcccugccacugagccuggacaucucaguuucuuuagaguguucucuagccuuuuuauaauggagaguguguuuccuuuuccaugagauuuggauagcacuaaggggaagauaguuugugcauagaaaagggaagguggccugacagugaagucacuggucuggaaacaggauguugcaguugacugggugccuacccaugggaggcacuggcaaaugggguagcaauggugggagugagaguaucagcaaccaacacaggaaagauagagguucuacuuaaacaagucuucauuaucaaagcuucagauagaagaauguuagagggaggguuguuuuaacucagggcaaaaugcacaaaauacaaagcagauauauuuaagagucucgcucaccuggauucuagggggaaaugaaaaaagauauauuuaagaaauaguguauuuauguuuugaauguaaauauuucuucuuaaauauugaaauuaaaccaaccaauaccuauuuuucucucuccuuugucccuuucuuuucagagaagcaucauuacuugagaaagagaccacuagauuuuucuuuuucucuaagaaugaugaacgacuucaaggucaguccauuuuuuucaucaaauuacauacauagaacagguaauaauacagcuacaguaauucacauccaggaauuuugaccguugguaaugucaugugguuuaaccccauuuguucacacugaugaauguuaacuuguaaagcugucaaggucugagagcuccccacucaccacuuucuuugcccgcucauucucaucaacaaaggguuguuuuguuccaagggcuuccuuagauguuagacauauaaaaccccuaaguuuuagugccauaaauuccaugugaaaacucaggcuguuggggagcucauuucuuaaagccuagcauaaacaaaguuacauaauaguaaaugauauauauaaacaguaaaagcaauauuauauuuuucauuuggaaagaaaaaauacuaauuuuugaaaauagguagaaacugagggaaaagaaugaucuuaacugguauucgagaccuugauaaugccaacacuuagaauauuaccaauuuuaguaguaguuugcugccucaucuuucuucuuuuuccccuaauagguucugacuuauucuggagaggaguaggaaguaauaugagcaggaacucuugggaggccagaacaaccaaccugcguauggugaguaauuguuucuccauauuauuuccuaaaauagacauguuaccuaucuagaauuacaguccuggaagggaacucaugaaugguauaggugaggagacugcagacuggcucaauugagugacuggucucagaauccagccaagccuauuaaguaacacgaaagcaucagauuuuuaaagacugaauuauaguucccauuauaaacaguuaaugccaaaaaugccaauauccccucuucauuucaaaagagcacuuucaaaauagguuuccacagcccugacagugagaauaaccuguuuuacuucuaucuacugaacaucuuaaaaacaauuuguuuauugcuaaccaagucuuuuuuuuuuccuaggauugucgaaagaaacauaaagacgcaaaaaggaaaaugaaaccaaaauaauaaaugucagcugguuuugauacugaaugugaacaaggcucaccuaaggaaacugacccagaaaacaguuuuagcugacaaagaagaaauuucagagugaaggaauuuuaaaaaucuggcugacggaauaucauucugguugccaucuuuuucuguggaacuccucugcauuucuuccuaaguaauuacuucaaaaauuaaauucaacuucuuauaaaggaagaacaagauaguccuugaaaauacuuuuuguauauaaucucuuugcccucuauccugaguaacuaauggacaucuucucaugcaagguuuauaugaagccuuuuuaaauaaaugagucaaagcacuuguauuuuccagccuaggcuuugugugaauuauaggcuauuugaaauuuuauuucugauuaugucaaauacaccuuccau

SEQ ID NO: 17291 - RNA, 1475 nt, Homo sapiens
cauuuuugacaagugcaaggucagccagcuaagauauaaauauuccaauaaugaccaaaguaauaacuucuacuggcauguccucuucugagucuccauuuucuccacugauauucauccaaauaauaaaaguaacacaauugcaauugaguuuacuauuaucaauggcacuguaaagagaaaaaaaaaaguuuguuacuauaaagaaaaaacagagaaaaaaccagaaaauaauaauuagccuccaggaacaauagaaauaucuaacaauaugucaucauaaucauguuguaaaaaguuauaacaaagaaacauucuaaaauacauuggaucaugagauccaaaacuuauuuuaaagagaacuuguauaacugggaguaaggguugcacuggaacagcuagaucaaugugaaacaucuguggauagucccggugcaaccccaagaacaugagugcacuggagccuggcagacguagacccacaggguugccacugacacuugauauuagaaauauagugcauagaagauucuguagugucauuuuacuacauuaaaaaugaacuuauuuaacauuguauccaagguugugaguaaagggagaagagguacuaauuauaaugguuuuaaauaaaagauuuuugaacucuuuuuuucuugaauugcucaaaaauauuuuccaauagaaugacagauacgaaaucucuauuuuucuuuuuucuuuucugguuuuuuuuuuuuuuuuuuuugagacagaguuuugcucugucucccaugcuggagugcaguggcguggcacaaucccagcucacugcacccuccaccucccggguucaagccauccuccugccucagccucccaaauagcuaggauuacagguaugcaccacuggcuaauuuuguauuuuuaguagagacgggguuucacccauguuggccaggcuggucucaaacuccugaccucaggugaucugccugccuuggccucucaaaguguugggauuacaggaguaaaccaacacgcccagcuuucucuuggaaaccucccaauacuguaugugauuuuacaacuuggaaacaacaguuuccaaaaggcaagaauauaauuuugucuuuuagcucugacagguaacacacaaacagauuauauguauuauacuaagcauucuauuuguaccaacuggcuuagauagaaguaagaagcaaacuaagaaaaaaaaaaaaaaaacccaguaacuuucaagcagcaaagccauguuaaagagaaaaaaaauucccacuacaaauggcauauaugguauucacacucagaagccuugcuacuuaaaccacaacauuaaaacuuaagaaugcucuauuagcuuuucuucuuaccucucaucacgguucuuacagaucgaauaagguucauuagcugugauuuaauucccggcucuucuccaaauccaccaauucccuggucuguuccccagccaa

SEQ ID NO: 17292 - RNA, 1475 nt, Homo sapiens
uuggcuggggaacagaccagggaauugguggauuuggagaagagccgggaauuaaaucacagcuaaugaaccuuauucgaucuguaagaaccgugaugagagguaagaagaaaagcuaauagagcauucuuaaguuuuaauguugugguuuaaguagcaaggcuucugagugugaauaccauauaugccauuuguagugggaauuuuuuuucucuuuaacauggcuuugcugcuugaaaguuacuggguuuuuuuuuuuuuuuucuuaguuugcuucuuacuucuaucuaagccaguugguacaaauagaaugcuuaguauaauacauauaaucuguuuguguguuaccugucagagcuaaaagacaaaauuauauucuugccuuuuggaaacuguuguuuccaaguuguaaaaucacauacaguauugggagguuuccaagagaaagcugggcguguugguuuacuccuguaaucccaacacuuugagaggccaaggcaggcagaucaccugaggucaggaguuugagaccagccuggccaacaugggugaaaccccgucucuacuaaaaauacaaaauuagccaguggugcauaccuguaauccuagcuauuugggaggcugaggcaggaggauggcuugaacccgggagguggagggugcagugagcugggauugugccacgccacugcacuccagcaugggagacagagcaaaacucugucucaaaaaaaaaaaaaaaaaaaaccagaaaagaaaaaagaaaaauagagauuucguaucugucauucuauuggaaaauauuuuugagcaauucaagaaaaaaagaguucaaaaaucuuuuauuuaaaaccauuauaauuaguaccucuucucccuuuacucacaaccuuggauacaauguuaaauaaguucauuuuuaauguaguaaaaugacacuacagaaucuucuaugcacuauauuucuaauaucaagugucaguggcaacccugugggucuacgucugccaggcuccagugcacucauguucuugggguugcaccgggacuauccacagauguuucacauugaucuagcuguuccagugcaacccuuacucccaguuauacaaguucucuuuaaaauaaguuuuggaucucaugauccaauguauuuuagaauguuucuuuguuauaacuuuuuacaacaugauuaugaugacauauuguuagauauuucuauuguuccuggaggcuaauuauuauuuucugguuuuuucucuguuuuuucuuuauaguaacaaacuuuuuuuuuucucuuuacagugccauugauaauaguaaacucaauugcaauuguguuacuuuuauuauuuggaugaauaucaguggagaaaauggagacucagaagaggacaugccaguagaaguuauuacuuuggucauuauuggaauauuuauaucuuagcuggcugaccuugcacuugucaaaaaug

SEQ ID NO: 17293 - RNA, 13972 nt, Homo sapiens
gggggacggggagaggggggcggggagaggggcgggagucgggggcggcgaggggaggggcggagcgcgggucccgccccggcgggccgcuggaaaaguuuagucucugacucgcucgggcagaggccgaggaagccgguuccggggacgggcaacagggacucagggaccagaaggcggcugcaggacgcgaccgagcaggaccccaggcccgggaacgacgucgcgagcgcugagacugccgggccucccagcccaucuggcauucgagcgcaggaccgggcgccccggcaccgccgcgcgccacccgcuaggaugccgguggccccagcgcccucagccgacggaggugagaggcgggcccgggcggggcgcggaaccaggguggggggcugggggccgaaggacccaccuuuccaacaaaauccccaccgaucccgggcgcgacggggacuugggcgcgccacggcggccggagcgcuccacaucagcaccccucccccagagccgcugcaggaacagggaggaggccuuuuccaccgcacccggagcguuuacaacgggcuggagcugaauaccuggaugaaaguggagaggcuguucguggagaaguuccaucagucguuuuccuuggacaauuaacaaguuaggcuuccacagugccagggccuggggaugcuggacgugggagaggguuguggucguuagccugggaaaaucauucuuuuaaacaauauucgccggaaaauuaguuuuuuccuaacauuucucaaacaaggcaauuagggccgucagaaucggugcuggaagacgaaguccccacagugcaauaaugagguucccacggaaaaucaguacguuguguucguaacugagauaacagcuagagaaggggcuuugggcuuuuugagucucccaauagucagucucucucucucucucucucucucucuuccucugacuuucuggcuuuggacacucccaaugguauauuucuuugugguguuuuuauauuuggauauaagagaggaacuucuuguuggauuuuuaagggaacacacuucguuuugacccuuccaauaaggaaaggggagcuacaggaacagagagcucuuuagaagguuacuuuuaaauggaggcccccccauucaugguacccacucccacuuggaccucugagaccuccagaauuaggcaucauucuaaaaucuggacauuagaagucacagacuuuguauauaaccacauauucauaauuuaucuuuucaauguuuuuuauucauagaugaaaaucuugcaggcauaguuaagaaaaauauaauuccuagaaaguacaagggaaggauuaugcucugcagauacaugacuaacaaggauagcuggccaugcccagggcugguguugguugaggagguggugauggugcggggcaugugugugugugugugugugugcgcuugaggaguuguggaaguguucauaucuguaaaguauuauuucauggaugcagaccuuaaugcuagguugaauaacuuuguugccauagaagaagaaccgcacgucaggcuuuuuucauuagcaaaccaguaagcacucacuuugggccucugaaaucacuuccaucaccuaacaccagagauacaaacugaagcuagcccuuaagagccucccccuaagauuuagagagaaugauuucucaaccaguuuucaucuuugaaagugccauuucucccuuuaucauugugauuuuuauucaaaugcaugagucucugauuuucuaccauauacaaaggguagagacuacaguuuccuauagaagaaacuucacauaguggccgaaggaucuuauuucucaaaauucaggaacugguuuccucuuucuggaaauuaugacauuaacuugauuucaugguaucucuuucaucuuccucaaugccugugcuguauguauauuuuuauuauauacuguagguauauuuuuauuaccaaaaaaaggagaauuugagcaugccacaaucuugaaaaaucugagguugcccugcuguagaacccuuuaacugccaggacuuuguacuguuucccaaguguuaccagagccaggccgccagccuuaugcagucuguuuaccuuagcuggaaccagggugcugugcuguggguucuaugaaacuuucuguuucuucauauuuggcuuuguaauuccuuucuuaucaguuuuggaggcauuuccuauuauuccucugccauauguuuucugccaaauuaauugccuuaagauuuuccuuaagcuuuuggaaauguauaauguuugagaaaaaagaaaaagaauagacugaguggaaucguaucuaguuucaguuaauaacauguuucaguugauguuacuguuauagcuacugggcauaaagucuccuucccuuuuuugaauccuauuuuugaggcauugaagcugugucuguaagagacaauaggccaguuggguuaaaucagugacgagauuguccagugcagauuggugcccagugaguggaucuucacugcucacaggccggacuggggucagcucacacagcgaggugacgguccgcuccucaagcaguggauggugcucuucggccuugcagaugccgcuccauuuuccuggcuucaaaauuuuccagauauuucagugcccccagaaugacaugcuaacauucugcuggcaugggagcaugaggcaguuugucucuaaaacaugccagagaaucucuugucacuaccuaggcaaagaaccaguggcaagguggcagccucccaaagagcucaucccuaaugugacauccuggaaucagauggcacggacaccggcccagccccuucccagcucugugacuaaggacaagugacacccccccucccccagccucggucuccuccuguguacauucagaaggcagaugcugccaugaggccaugugugcuauguccauggugcaagguggcacgcaugccgagucaccaggugagacugccgcuuugggaagggauaggaaggaucuccgguagccuucgugggcaggaugccucuuauuugaaugugccuuuagccaccucacagagccuauuuccacaucccuguggauucaucccuguggaaaucuugagaaucauuuauccuaugcugucaugaagcagcagcagaauggagaagguuuaaaaagacucauggacaggcaaagcggucaaacaccuccuggcucagacgcacuugccuucccacacacaagucuggaagcucaggaugguguucacggaggcagaugcucggggccggggccugaguuuccuggggcacagccuccauaucugggguucccuggacuaugcccagauagcucauaaugucccagccuuauuugugauggagaaggacuuggggaaaagccaccgggaagcaguaagucuaaccagggaagugcacugacuugcaugcuuugaagaagagaagggagaaaagauacaaaacccucaccugguuugucuguaacaguuguuauuucucaggggagcugcauuaaugggccaagccugugcagcugggugugugaagcaugcauuuugcaauggacugucuccaaaagcagagcgaggucacccaagaaaucuagagcaagggaaaauacucauuagcaaaggaauuuugcuggagccuuguaacggccgacucauuauuuccuuuccaaguuauuuuaaaugaaauuuuaaaaaacaucuugcuuuccaagaaauuuugcuuguuggcauauguuugguguuuugauucaguuuggaggaugaacuaguuaauuucccugggaguacaugccuauuaaaaauauagcauccugcaucugaccaagaugcuaucuuacuaucuuauugugccuaucuuuuaugcggagagagaaagggggguguugggaaggagaccagacuguggaaacauuuucuuuauuuuuucucuuuuucuuccuuuuauaguuuguuuauuuuucaacuugacauggguagagaaagcgaaucgcuaguauagaaagcacaucuggaauccauccggccuccucucucuggcucacccuccucccagcaauguuucuccuuggaaguugggggaagguaggcaccucugaccuuggcagggucuaacuuggggucauccacugcauacucaucuuccagaaggcgucuuauuccuccucgacaaaaaaaaaauguguugguauuaaaaugcuuugagguaggcuggaugaacccagcuuagugaggaugacaugaaaacccuuagcuaauggggucuuuauugaguagaacucagguaaguucagauguaagcagugucucucaguaaacaugaaaagacugaagaugcagacaaucaaauacuuaagucucuugaagagcuggguggugggcgggggucuucccagguggucagggagauguguuaguguagcacuuggaagagaguggaacgaccaggcaaggaugugccguggaggugggcagugggagcagcccagugucagcaucuguauugguuagaagaccaccgcuaaugaggaggagcgucucuacccugcagcugucuguacuccugugucuuccguaaugugccaagcucucugaauauaugcaaaacuagucugcaaaaagccauaugucucagcaucuggcuuuauuucuaaguguucagguggaauuuaagccgcgaucaaauuuacaaugucacugccagcucuggacacuuacuuuuggaauaaagcaaagagugaacacuaauacugcaucagucuugcccucuguuaggggccgccccuucuccccacaccaguuuugcaagaugggcuggcuggggucugagaaacccagugccuccgagucaugguuaaagcccaucucagacaccaacacaccgcucacaaaucaacaucgaccugcgaaaacauggacauguguucgccaagagaacauccucaaucaaucccagcagugcuacuugaugauaaucaacacaugggccauggaagaaauuaccccauguccauaaacaagaaugaauagaggguaguguaucuacccacaccaugagagcaagaauauucagcaugcaggugcaucuaugugcaugacucguacaagcaucauggggagaggaaagcaauggacacaauuguauccuguaggguuucauucacgugaaggucagaagcaggcuaaacucaccuaggggagaguccuaucccagguaguggucaugcuuggggacagguggugacuaggaggggcacaaggaaggcugcaggguccggcccaucuuguugcuggccugggugcuggucucacugaucucugugugguggggcaggucagccucccaggccugcuggugccugcagugcccagcacuccugccgugccuggcaguguuaguaccaauccgccagagugacugacuccccucuugcccugaguagggcuugcugacuccaggagccucagggcggggugggcuuugagcuuucuucuagcaaacuugaggucuguggcugguaccccucaggagcggaggggaacucuuguccaugagaugcuuuuaaccgugcgcaauaauguguagacgcauccaaaaucaaucuggccuuuagcccagcacuuaacucuugggaugaggccugcuuuguaaauguugauaauccagagaaaaugagcuuuuagauuccaaagacagccagauaucuuccacuuaugcaaaaugcagagaaucauauuuaacaaaagauguucuggacaaauaugcuucuugagggaugaauauuuaauuauaagggaaaugauaaaucaaacauuaaugggaaaauauguuugcccucaagauucaugauuuugaugggucucuggcaaaucuuauacuauguuuauugggguuauuuuauugcugguuauuaguuuuuaauuguuugcuuguuuucugcucugaucaauuuuuguauaagccgugggucuauucacccucuucucuccauucccgggagcaaguccacaucuggcuguuggaugcauggcaaaagcaaagguguggagaagguucagaggagacaggacauguauaaaaugguagggucagguugucaugggggaaacugaggcacaggaggcaagcugaguuaguacaagaacagucugaaucauaacgacaugccaguauuaccuaaaaggaugaggaacauggagcuguacuugaaucccuacgugagcuggggaaaaggggccucaggaaucacugacauuggaaccaagguuugucugcagcuugucgguuucugggacagaaacccaacauacuggaguggguaucccagcaaucuguaggauaaaccaggacacuguggugucauggauagcuggcugucugccaggugauggccccucugguugcaaugugagccgggcaggucauccauuuggcagcauggugagggcucuggccccaguugcuaugggagggaggaugcuggcacagggcacuguucacagacugccuuugcuccaugccuuuuccaugagcaugaguggcuguucgugugggaaacggcagagcccucgcgguccccaucagcacugugcagugguaccggagguggcaggagacagccugauggcccagguugucuucauacccggcuucaugccagggugcaugccgggcauagcacaugugucccugagaggccccugaucagggguggaaacccagcaaagugaaaaucagaaauagugauucuccaguuccuguucacagauaaagaaagaaagaaauaauaagcaauacuaggccuggugugguaguucacaccuguaaucccagcacuuugggaggccaaggcaggcaaucacuugaggucaggaguucaagaccagccuggccaacauggugaaaccccgucucuacuaaaaauacaaauauuagccgggcaugguggcgggcgccuguagucccagcuacucaggaggcugaggcagaagaaucgcuugaaccggggaggcggaggguguggugagccgggaucgcaccgcugcacuccagccugggugacagaaugagacuccaucccaaaaacaaaacaaaacaaaacaaaaaacaaacaaaaacaacuaaaaggacaguaucuuuuuagcacccaucaguguacaggaugcuggggaggguacugugaacuuacccauggugaaagucccuguguuaauggauaagcucaaugcucagaaaaugcugcugacugugguauugccccauuuaaagagacaguuugcaguacguuuucagaaguggcaugcagccucagagaaaagucaccaggggcuggcaugauuccagaaaauguuacagagcaaguggaauuugacuugaggcuugaaggaugggcaagauuuaaauaaaauucagaaacgguagagagggaggggcuggggggaaggcugcccacuggacuguccuguuugccuccaggagaaccuacaggcaagacauggucucuucucaggugaaugggaagccaaguagggcuggcaugggugagccacagcucgaggaggcaggccccgggcccugcgcugccugucauggcucaugagugaugggagagaucugggcaggcaaccuccucucauccugcaucaucagccuggacuuggaacuuggcugcuuuuucuuucugcaguuagcagagggccuuggccaacacauaagccuuucugccagcacuuggcauuccagcugaccucgacccaaggccucugugacuucaggaggcggcagcugggaagggucagggcaguuccaggcagagcacagacgucagcucagacauccuaccccccgccaaccccccgcccccgggguuuccagagcaaccaacaccaccaagcuccaggacacuggaaaaaaaaucuuugcaaagaagcaaggggccaucucagaaaauccaggucccccaaauugauguagggagaggagggcuuugacagcauucagcacuccagagggucacgaggauacagaaaccauuuggagccaccucugcuucucagccccacccaggcaagcccuggaucuucaagggacugauuuguaccugggaauaaacucaugcauggaugagauucagagucaaucacacccuaaaaugcagagcccauaguauuggugaguuguucaugugucucugaagcaaauuuagggcugugguucaaacaucguaaaaguuaaaaaaaauucacuggauacacacaguaggcucuuuuaaauuagccucauuugaacuuaauuacauauuuaaauacucaaauaauaaaugauggcugggugcggugucucaugccuguaaucccagcacuuugggaggcugaggcaggcugaucacuugaggucaggaguucgagcccagccuggccaacauggugaaaccccgucucuacuaaaaauacaaaaauuagccaugcaugguggcgggugccuguaaucccagcuacuugggaggcugaggcagcagaagcacuugaacccaggaggcagugguugcaaugagccgagaucgcaccacugcauuccagccugggugacagagcaacacugugucucaaaagaaaauuuuuuuuaauaaaaauaaaaaauaaaauaaaauaagugaguccacugaaagcgguuucuaccuugauaguuggguguguggcgucaucaacaucacagaaggcugaucgauauuaccaggugugguugagugcaaguguuugaggucucgugggggaagaguuuggaauucagaauccauugaggccuucacucaccacuuucccucucucgcuguguucccaaaugugccacuuuucuguuggcucacaugcacccaugcucuauuugauauucagggcucugaauuucaagccagacucagucagugugauugucacugcuuuccuguccuuccuuuaucaucuguagacuugggucccguuuuugcagguugauguucugucuucgcugggcucuggacucacugcucacgagugcggugucugcaugggcacugcccagacaugcacuguuggucccucgauggcugcauggucaggccucagggcucucugccaggccgaccuacagcccauacagaccugauuucugggccuggauccaggggaugccaucugggaagugcgggaucuucccacgaugucacuguaaaacucaccagggagguuuuagaaauugaaccggcaucauucagauuccauccugcuuuuugguccugagaaaauccugcuuuucccugaguaacugggauaaugggucaccagcucccaugcccuagaugaggacuaguuagcauuuucuagugccuggagauuuccagauggaagcuguacuugggucuguguaucuuuguuacaggauucaauaauucaugcacugaauuucccuucccggcaacuccagacaccaaaucgcuucccauggugucccccaaucacuuaggaauuuagccugugucuaaagacccucucugcagccugacguggcuagccaucccaguacuuccacguuuuucaugccuuucuccaacagcguugccguggccccuuaggcggcgaucguuuuaucaauggucgcucccucuuuuuaucuguuggcaggagcccuuuuucaacgcccucgcuggagucuggccugcacgccuugcugaaugaagccggaaccucagccccgcuucccuuugaaaugaauguuccuggggcgcccucucguggauuuuggagcuaaucgucugugaaugccaagugauggcaacugcccucccgccgcgucuccagccggugcgggggaacgagacccugcgggagcauuaccaguacguggggaaguuggcgggcaggcugaaggaggccuccgagggcagcacgcucaccaccgugcucuucuuggucaucugcagcuucaucgucuuggagaaccugaugguuuugauugccaucuggaaaaacaauaaauuucacaaccgcauguacuuuuucauuggcaaccuggcucucugcgaccugcuggccggcaucgcuuacaaggucaacauucugaugucuggcaagaagacguucagccugucucccacggucugguuccucagggagggcaguauguucguggcccuuggggcguccaccugcagcuuacuggccaucgccaucgagcggcacuugacaaugaucaaaaugaggccuuacgacgccaacaagaggcaccgcgucuuccuccugaucgggaugugcuggcucauugccuucacgcugggcgcccugcccauucugggcuggaacugccugcacaaucucccugacugcucuaccauccugccccucuacuccaagaaguacauugccuucugcaucagcaucuucacggccauccuggugaccaucgugauccucuacgcacgcaucuacuuccuggugaaguccagcagccguaagguggccaaccacaacaacucggagcgguccauggcacugcugcggaccguggugauuguggugagcguguucaucgccugcugguccccacucuucauccucuuccucauugauguggccugcagggugcaggcgugccccauccucuucaaggcucagugguucaucguguuggcugugcucaacuccgccaugaacccggucaucuacacgcuggccagcaaggagaugcggcgggccuucuuccgucuggucugcaacugccuggucaggggacggggggcccgcgccucacccauccagccugcgcucgacccaagcagaaguaaaucaagcagcagcaacaauagcagccacucuccgaaggucaaggaagaccugccccacacagcccccucauccugcaucauggacaagaacgcagcacuucagaaugggaucuucugcaacugaucgucuccaugcgcccugcucugcggcuguguucuuauuuauugcaugcgucgcuuccacaggggccccucaagagcugugacucgggagagcuaccuuacuuugaccaacagccugcccaguguggaugucucuuacagagggggcccaaggaaucaccaccccgcuucaguguaaacaacgugccuuguccacuuugggcuccagagucuuucagauguacuaagcugcugacaucauccacugccuucugcugcauccuagacacccucccuguuguucacagagagggaaggucgugggccacacaaugcugugugacccucuccgugugccucugaaugguguuuugaugauuuuacacuacauuuccugugcguagaauggaugcuuguauauucguacaucucuauguuacacagaauuuguguugcagguguuugccaugugguaccuacauagaaucuccauacaacacacagguaacagguuauacaaguggauucagacugaacccccaguacaaggacauuguuuugaacuagguggacaugccaucccuggucuccuuagacugacaugauucucauguuaaccaaguuuuaaaaguucaaauuccccaaaaaggcuuguccaaggcuggccccagaugugugggucugacccacaccagcccuguguccuguccuuucagucauuugucccugcguaauuuuaaucguauuccaaagcccaauuaugugaugguuuucagguuucugcaaauuacagaagagccagccaagaucacccaggagcuugugcccccagaugggccaaagaaagagccuaugaaggagaagcagaagcagacggcuggccuggcucaccuucccacgccaguggggcaggggucugcuucaggaaauggaagcuguccaggaaaugagcagagauucacaagacagcacuuugauucuauguugaguuuguuucuauauuagaaaagcagcaagucaguaaucccccguggcaucacagcuaaguagcuguggccaccggcaguuucacagcauccugaaagcuggcacugaucgugacuaucagugaaagaaguuuaauuuucagguuagaaaaugugaucuggcaguuuaugcauucuucagaguaauguaauaauaccuaugugaugcuguaauuuuacuuuucaacauaaguugaacccguagcagucuguuuaccuuguaaagggauuacuuagaagacauuuuuguacaugcucuuccccaaggauuguacguauuauacaaauagauggaaagaaaagugaacacguuuguagaacuuucauaagcacacaguugcuguguugaguucucuuuaaaaacaaggacaaaaccaaccagcguucaaaggaaccucccaucagaguccccuaaaguauuuuagguucagugagcauuugccugaauaaaaccuaaaagaguagucuuaacacauuacuaacuuuuucuaagagaaauugauuccuguuuugucaucugaugcaauuugcucuuauaaagagacauuuucauagguucagaguaacucaccuccaugggcugaccaaaggcuuuucuaauuuuuguuacugaugagaugaaaccuauuuguaaggagaucuuccccaggagcauuucuguugccuucuugacaucaaugaaaaguagcauauucucuuaugaaauagcaugagaaaacacagggcauuucuaggacaguaaaacguuaaaguacuggauuaagaaaacaacaacaggcugggcgcaguggcucacaccuguaaucccagcacuuugggaggcugaggcggguggaucaccugaggucaggaguuugugaccagccuggccaacauagugaaauccuguuucuacuaaaaauacaaaaauuagcuggaugcgauagcacgugccuguagucccagcuacucgggaggcugaggcuggagaguugcucaaacccgggaggcggagauugcagugagccaagaucgcaccgcugcacuccagccugggugacagagcgacccucugucucaaaaaauaauaauaauaauaaauaaaacaacaacaaaaugcaucagagagccaaaacauucaguauugcauuuucacauaggugaugaaaugacuuuggaacuuuaucuguguuauaguuaugaguugcuuugggagacuuggagcucucuguagcuauuguucauaacacuuugcuccauaacccugauguccgcaguaucuaaguaucucagccuucauccauuaacucuacuagggagcccacagccaccauuuccacuaggagguaucaauauuugugguaugacauaaggcucccuugaaauaacaagacuuuugagcaaucugaauuaaaaauacaucaaaaaaguaauagcgcucauuugcuaaaugcaaaaaauaaucaccuuugauaccaaugugcaccaauaugccuaacuagcuagccagcuggagauaauuuaccagggaauguuucaaagcccuaaccuugaaguuuggaaacagguggucuucuaugcugcagagaaacuaugcauuaggucucuuuucaauuagaaaccuuuacuauuuccaauguauguuuguuaaaaauaauaauaauaaaaccaaaagccuuuguggaaacccacucuucguaguccaugugaugggauuguuuuaucguuuucaccgggugcccuccccacugcaggggugcgcacuguuguugcaggcuugcuacccaccuguguuucuuagcauuucaggaauuaaaccacauucagaaccccaaauaaccuuuccccuuucuucuuacccacuaucauaggugguauuuuaaugaagcgucugugccuugggugcuauuuacaccaauuuugguaggucauacuauuuugagaauggucuuuugauagggagaaauuucuaagacccaugguaauaaaagugcagcuc

SEQ ID NO: 17294 - RNA, 5744 nt, Homo sapiens
ucuuuaagguaaguuaacuuccucagagcuaaaacuauaacacugaaaucaauuucaauagucacaaauuucaauagucacaaauuaagaaaauauaccucaaaaacuugaaacagugauaaaugcaacauacaaacuuuauugaacaaaaguaaacuguuucaguaaacucaaacaggcacuuaagagaaaaacugacuggaagaacuuuuaucuuaaacaucuuacaguaaccuacuugcaguugcauuuaacugagcucuguugcugugaagaauacagcucaugcacagguauggaugaaagauuuguacauuucucaaguauucacugaauacuaccuuauauacacauauacauuaaauuugaaaaagauuugacgauccccagauaaacuucauuuuuguugaucuuuuggaagaggucgucuaaagagaagaauaugugguucuguggaaagaaaauguuuugaaucauuuuaauaugauuuucauauacucaacagaaauucaaaaguauucucaacuaagccagaauaaaauaaacuaaguccacuauuaauugguuugagguauccaaaaugauuuuuuuuucacaguuacugucuacaguaaauagauuaaaaguaaaaagauuaccucuuuauagggaaaaacaccuccuucaaaucaccuacaggaucucauacuaaugcucauccccauagauucuguuucaauagguggggcacagaaaucuacacuuaaguucuucaguugcuuuuguauuaucuggacugaauucuaauaggauuacguaucucaaucccaagaaagugaugaguccuuuuagaguuuucgaugcaaugcuuuucuuuaacagcagaguagaagauaguuuuaauuccaccuacuucagcuucuauaguaugucuucaaauuuuguucaaagcauuauaaaugcuguuagauuuacugauaauccaaauauaaaauuuaacccacacuguuuuagucuagaaaacccacaaaguuuuaguagaguuuacuauuuaacaccugaaaaacuuuugguuaauaccacauaauagcauaagguacccauaagcacaguugaguucauaugcuauuaccucauuuaaacuucaugugguauauauccuuucagagggcugaagaaucacuuuaaauuaaaucaauuuccacacauagauaagaacacuugucuuaggauauacuuaugauaaaaugcuuugggauacuguuaacaaugauacagauuuuaaaauacauuuuuuuuuuuuuuuuuuuacuucuuacauuauuuuccaaguagaauaauguguuacuuucacugcugugguauuuuauuuaccauaaaauuggaacucucuccagagucaagaaauuagucauuaaaaaaaaaaacuuaucagaacaguuacuuucagauaucauuugaugucaaugauauuuuuaaaauuuugacaaccauaaccaccaauauuucaacaauuacugcuuuacuauaacauagcauagcuuaccuggcucaugaaucauguaaugaacccagccuagacucuguuggacaccaagucuccuccacuccucuucagacaucagaugaguuuuagguacuuguuuggaaaguucucuggguaacauaacaugccuguuacaagauacagccaaguguuaguccagugccuuuucuacaacugucgcuuuauacauguaccuuaaggaacucuguugcuuuaauauugagaacugcaaucuacuaccuuuaauucugauaugauggccuauguucaaauuagggagcuaagagugcacaauccaaaagcagaaagcauuuuccauaggauuaaucuuuuucucuuaucacagaaugcuuaccaguugccuuaaucuucuucaggaagagaaccccaaaauauaaguugaacauaugguuaccagccuccaaaucauaagccaacaagauauaagaaaauguguaacuuauuaugaaaaguguucucaaagggaaagaacaugcugaacucuuuuucuccuucuuguugaaugcacauuaauaugaucagggagccagagcaggaaucuaggaccauagaagcaacuguaaauugagaacgguaaagcaacaagagguaaggacccagccuaguccuugacuguaaagcuguuaucccugccccagauuauuagacuuuuauguaacgaaaaaaucuaaguuacaguuaauuuggguuuccucuuacucaacacuagcuuuguaguagcuacuaguccuuguaugcuccagaaguugcuuuauacuucaaguacuuuguucaaaauuaaaaacagaaaaccacuaacuguacauacacauugugugcaaccucaccguuuuccaguuaauuuacugaccuauauccaaaacuuacauuguucaguuucuuaggcaagcauggaauaaccuucaaaguuaaaccaucaauauguauaauuguagccuuacgagauucucaaaaacaaaucuguaucauuaacaguaucccaaagcauucuaucaaagauuugccuaacaaaucucuuuccccaaauugaguaagaauuuuuacucaauuaccauaaaaaggacuuuaugaaagucacaauucucagcuccauguuuaccaccugcaguaguagcaacaguuuuauacugaaccauccauaaccaccaacccaaauuuuuaaccaguauaagauaucugucugugagucagcuggcuggggaugaaugaggugcaaucuggucacuuucugagacacaguaaacugaaucccuaacccgcuauaagcacccagcugucaucaacuuaaauuuuagucugugguuaaguaccaauuuauuugcagggcaaagugagccucagaaaaauucuacuguguuguuagauugccuuaaggccaccaagucauagcuuacuaccauaauuuguagaguuuucaucaauuccagugaacuauauagugauucuuuguaauucuuaccaguuaucacccacauucuugaaaugcugcuuuaacaucuaacuucaaauaaucuguuaucuuauuucuacguucuaucuuguugauuauucucaaagagaaauguagugcuuuuguaccuuuucuaucaaacuuacagaguacauaaaucuaccaacaaguuauuuagauagaaguuaccacccuucuccauaaacacggaaacaggcucuccuccaucaggguuucuuuauaaaggaaaaauguuuaaguagcaucaaccccauaugaggauucuaccuguauuuugccacacagagauuucaaacuaacuacauguaaggaaaauuauuuccaaaaucuaacguuuauuucaguugaaaugcaaaauagugcaaguauuacuaauuuguaaggcugcccagaaaaauuaacaguuuuucucuugugaaaacagacuuccaugaugugggggugggggcacccacuguuaugcccuuagaaacauuaagacccucacguaaaaggacuaggaaauuaaguuuguaauuaagaaaaaucaaagaaagauagagauaacugcacacugggaaaaauaaauacuagccuuugaaauuuacauugcaugcugcaccauuacauauuaauacaaaccacccuagacucaugccuuagugcuauauuauuacuaguuuccccuuuaaaauuauguguggaaauuacuauccuguuucauaaagguuacuggcuuggccaauuaauaccagcucuaauuuuuauuggauuaaaauacaucacuucagauauguaaacuuucuucuauacauuaccacacacaaaucauuugaguauauuaaaacuaaaaaaucgaccuacugccaucagaaagaagucugagaaauagcuucauuuauuuucaauauuauacccuaaaagaaacuuguaccgacccuuaaauccuuauccuaaacacuuggcaccagauguguuucagaauaauuuucuagguuuuaguaagauuauuacgguuuacauuguguucauuauuggauauccucaauagggcucuugauuaacaucgcauaauugaacacugccagcauauuacacgaguauaguuuauuauuacuauaagguuaacacaaucuacuugaaauuuaccuacagccagaaaaacaugcuauuuuucuagcuaggaauacaaaagggugcaauuacuacuacccauagaaauauucaguaguccucaugugaaaacagacuuccaugcuacuagggagggggagaaaaagagaaaccacccacuguuuuguucuuucuuccuuaaauagcauucggagaaaucuaaccuacaaaggcagcagacagaaaacaaggucacaauuuggccaacgauggcaugggcuuuaucuccccuaaaucuugguaguaucccagaacgcagcguucuagucgcuaccuaguuaagaaaaagggguugacuguuuucugaagccacgcccuaaaugaagugucccgcauacaguaaggacaacaaauuuuaaaugucccuacucgcuuucccccaaucuacuuuaauuggggggaaggggacagggacauuuaaaauuugucuaauuuuacugaucgauuacagccaccauguucuaguacggugcuucaggacucaaacgcaaaaguuucucaaagcccaaaauuuggccaguguauacuagcagaaaaugaugcccaaaguccacucaaguucuuaaucggccuuaaaaugaaacuccuuuaauaauacccucaauuguaugacugcggcuaaccuauaauggcccaaaucaccauacccaguaaacauuuucgaauccccaucaagcucauuuuucggggggucgccuccaaagcuuauucuuauaccacucacuucaaaaacaagaaaaagaaaaguguuccucuguguuaacagaugaaaaugaccauuugaccauucuaaaccacaaacuaguaaaagcugcaucaccccgucagcgacagggaaagugugucacgguugcuaaaggaaaaaggacggcaccagguggguuuuccuggacugguucaaagaacuggaacugagaccagcuacugaacggccuaauuacuucggccacggccgagaaaaaagugacgggauggucacuccgcgucgccgaggaccccaugacccccaaguugcgccgguuccuacccagguacuaaaugcggcccggugggcacucuucccucacccuccgcgcacaccgaacaaaggcccaaccggcccggcgcggccaggcacccaaccauguccgacugcgcggggcgccagguggccgcgaccccaaaccccggcccucgcccuccggccccgggcuccgccccccaggccccggcccccacccccgacccuacuaugccugggucgccccgcccgcgggggccccggcugagggagccggcucggggucuaagaaaggcgcccaccgguacucguaguguucgucgaaguacuuguccgaguaguagaucugcuugugggccauccugcuggcgcgcugcagaaaaugaaacgagagcgcgaagagcgggcgcagcagacaaaaccacguccagcccaggcaacaacucgccggagacuaacgaccgcagucccaacgauccggauuugaauccgacagcccgccgccgauuggacagcagcgccgaccaaucaccuucugcggaagucggccggcugccagccuaucgucgccgccg

SEQ ID NO: 17295 - RNA, 492 nt, Homo sapiens
uuuuuuuuuuccacuagaaaaaaaacacagagcucuauuauucucaacaccaauggcagcggucuucauaggccagcggagugaguucugucgacagauagguggccccuacuugcuggcgaugaguggguuccgcaggaccacgaugaccaaguccccgugcaggaacauccuggagauauagcagucuuuguugacuggcuuggacuucuugcccuugccgcucuuggguaccucaguccacgucuccuucacguucuccagcaccauguugcagugccuguggaaggccuucacguggcccaggaguuucguguuguggcgacaguugaugagcacuugcguguuguucuugacugacugugugagcacagaaaguggacccguguuaaauuccuccuccucucgcuucugcagcuccucuggggucaucucacucuuggacuuguuaaggaggcucaugauggucacuacgcucucgguucauucccg

SEQ ID NO: 17296 - RNA, 51138 nt, Homo sapiens
cgagcagcgcgggcggcagcccgggggaagcggugagucgcgggcggcaggcccagccagguggguggggaaacgcgcagggggcccggcggaggcgcgcaggcuugggcaggcucgggccgugcacccgcgggccggcugcggggagaccccgggcucggaggucggaagccccuuugcgggccggggaugccucgggccggggggggggucccugcaccuggggaucccuggcauccugcggccggacaacaccacgcuuccagcaucccgaggcccagcaucccgugggccucguccccggugggaagggcccuccgccgcguccccgcgcgccuggccgcgcugucuucggcgccugcguggcgaacucgcuccggggacaccaagauggcugccucgggggcagcggcagccagguggcccagugccuggcccagcgcuccgcgcucucggcuuugccuccuggugcugggggucggaggggagaccaccugguuccugcccuagaacucgcaauccaguagggaggugaugugcaaggaaguagauucuuggaguaguaguugguccuacagggaccuugcauuuucacgcuuuucuccugaacuuucacgucugucacaggucucuaaccugcccagaaugacaauaaacagucuacuaagugcgugccaggugacuuagguccauauacuuuuacacucuuccggcccugcgagguacuggguguuggcucuauaauccacaugagaaaacuggggcucugagagguugagugcccaaggucacacagcuggccauccauaguccaaggccaucugagucucagucguaaauacugcguucucaaagacgcuuuuccuuggcuaugcugucuaaaauugcaccccccauccccccacacacccuuuguaacacaaacucuggguuuuuucucuuuagugucuuuugucacuaguugaaauuaaagguguuuacauguuuucuucuccucaugugaacagggccuauuuuguguugcucagccuaucuauccccugcgcauaacaauugccugcaccaagaaggcccucaaugaguauuuguugacugccugaacgaaaaagccuagcucugcuucacuccagagccugggcacuuagcugcuccguaggcaacucuuuucugcgcccccauagcuuuuucccugcacauuucucacaguccuagucccucuucugcguugacuucuagauuuugacuugggugccuuuggauucucccuucuuuguccaucccccuuuuacugaucugcuucaguguucuaggcauuguuauaggugcccagggaggaugcagguaaaugaggaggcuuugcagcuccuacagcuucagacuugauauaaaagaugagagggaacuguuugggaggaugaaugggguggcuaccaagaaguucugggaccucaagcagauccuuucucuccucagcacugagcaggugucucacuuucaaaaauacaguguuugggccaggcgcgguggcucacgccuguaaucccagcacuuuggguggccgaggcgggcggaucacgaggucaggagaucaagaccauccuggcuaagccggugaaaccccgucucuacuaaaaauacaaaaaauuagcugggcgugguugcgggcgccuguagucccagcuacucgggaggcugaggcaggagaauggccugaacccgggaggcggagcuugcagugagccgagaucgcgccacugcacuccagccugggcgacagagcaagacuccgucuuaaaaaaaaaaaaauacaguguuuggcagggaggagcuaucagcucccaucucagcuuaguacguauucagagguuagauugaggcuuucaggccacauggauguucagaaaagggaugauaucugugguuacaguugucagagaggacccuauauggcaaagggugucauaauucaggaucagugaaguguuuagcuguucuuaauuuucuguaaaaguucuaugaaaccccauggggauggauacagaaaggcaccaacuggcagggaauaucccuuccugcuccucacuuccugcagagaaagcugagaggacagccuggacagcaaaggugguaagagcagacccgucaucaaacguuguuguucuggaagacuuacguugaagucaggcaucuguauccuguuguguagcaguggugagcugcauucaguuagaguagaaccaugagugugaccaauuuuuccuuugugguuaaagguaagaaaucaaaaguagugaauccauuuuuuaaaaaggggggaacaaagggcuguuguccagaaagugaaaagucauuaaauuagaccaugugucaaaccugcacuuaauuacacaaaguucaaaguuacuaaguuuuucuuuagcagcuguuaauuuguaaaauaguuuuauagacuuugguauauggcaucuccgaguugauucuuauacauggaugguaaaacuucauccaaauaugucuaaaauucuaguuuaguguuguucauuuuuugcaggcugauaucaccaucucaaauagaaaucagaagauuuuuuuuuaacuguaauaacaucacccauccuaagauacugcuuaagaaauccaugcccauaguugaucuugaggacuggaauaugagcaaugguuguaauguuacauccguguuuuuguuuuuuguuguuguuuguuugguuuuugagauggagucucgcucuguugcccaggcuggagugcaguggcacgaucucagcucacugcaaccucugccucccggguucaagugauucuccugccucaaccucccaaguagcugggauugcaggugcgugccaccaugcgccuguuguauuuuuaguagagacgggguuucaccacguuagccaggauggucucgaucuccugaccucaugauccgcccaccucagccucccaaagugcugggauuacaggugugagccaccgcgccuggcacauggguguuuuaaaguuaguagaauagugggaucugcaugggaggggagaacauggcagugggaaaggcaggaggccuugauucuccaugucuuccugaugcuaggcaggcccaacgucuccaugcagaacuauccuggaacagggaagcauaugcaacacaaauccauugcugaguggaaauagaaugaaucuaaugcuuugcacagaauucaacucucugaucuauaauucgaucuccuguguggccaugcccauaaaaaaggccacuauaugcagaugaccagcccaacagaaaucagggaauuugguuuuuaggcuccuugaguuagugugauuguccuuggcagacacaucuucucuggccuccaagggucagaauugaguuucaaagucagacagaacugugaaggcugugucaucuugggcaugguacuaaauuucuccgagcggcucuauaaaacaggggaaaagaucuuggagggcugucauaaggaguuagcaaucuaacaaugcauggaaagccuagugucuggguguuccgucauguccccuggacaguggacagcagugacugaccggcugucucacaccugccuggcccuagugaaacaaacugggcaaucagacccuuucauaacucuuucaaaauacgguaguuuugaccaacagcuuuccagcuuaauaacgcaguuaucauugguacucuuuagccaagauuaaaggucuuuguacuaauuccucauaaagcacauucccugcuaacuuguuuucuacaaaauuuuggaaaauucuuuuuuucuccagcaguuaagcauuuucuuagcaugcagcuaaaaauuugaaauaaaauuuaucuuggagauaaauucuuuuucuuacauguuucugaugaucuucaggaagcucaggagccauuccuggccccaggagcugcauuuaugcacgggacuguggccagugaggacaggagcuuccacucguggaaaaccagcuuguuaauaaugaucccacuuuuguuugguaacuuaauaaagauuaauaaaggccucuuauacucuucaguuugcugauccuaccaacucuaugagccaacucuuaccuguguuuuauagaugacagaauugaggcucagagguguaaaguaauucacccagucacaugucuagaaaggaaaugauagaaucaggacugaaaucuagauuauauuugcuuaaauccgguucucauuccauagguuaucaggguagaugcucgggaaauuacaccacagggcggggggccuccaucagcaaaaaccagccagaaaaaaacagcuguguguucggucuuuccaaacccaggaccaagccaguguugaguacauaagaggccuucaguggauauggaaggcguaaguuaauuuuguuggugaaugaauaaauaaaaagacuuugagaaaucuauugggaugaggcuccaugaaacuauauuuacucaaaaccuuaguuaaaagauugaauuuaaacaguuuuuaauuucucuaugaaauuauuuccgucucuuuuuagggguaaaauaauuuuucaacauauaucaucucuaaaauaaucuguucacucaaaugcaguauaaugucauaauuauuaacaguuccagguagccgacaucauugugagaaugucuuuaugugauaaaaccucaaagucauuuuucuucuuagcauaaguggcaucagccaaccacagaauuuuuuuaagucccacuuuuuucucauaccccaccaaaauuucuuaauaccguuaaaauccaaaaauuucuuuaaaaucauucaugaaaaagauucuuagaauuaacaccucaguuguccgagcaccaggaagccacauuacagcuagugcaauacacagagaccgucugucaccaaucauuuucuucuagcgcgucuguucuagccccuuucucuucccuccacaccccauugcaccauuucuucagcucgugaaaacugagcuugcuggacaugagaaaccugccagugugccgcuguguaaaccauaacauuuugcugcugccuuucugcaguccugaagccagcuaauaacugcucaguaagcgccucuuccacagcuucccuaggucccucugugucucugguggacuggggccugcuccccugucuccuagccucucugagugccugaaggcaccaccccagcgcuucugcauaacucucaaagccucaggugaacagggcaaagagagcacccuccccacugacugucuccgcacucucccuggcaucuuucacuugcuucaggugccgugaagcugaugaacccacacacucuggaacacauucuuuggcgucccguguagugugucccucugagggacauucuucaugauccuugccgcaucugcagugggaacgcaaacaucuuguucuccaaaacuuucuuuugaaguaucugugguuucaugauuauuccuguucccagugucagcacaaggcugugcagcaugacuuccuccagcgcagucugcagaaauccggagucgagaagccucuguccuagcacugucccuauccuaggucaugaaagacugugauugauguucaagacaccucuguaacgagauguuugaucuuuacccaguuucaaccuuccagacaagcccaggggccauaauuugccagauggauggcugcauaagccagaccauggaaaaacaaaggccauuccugcacaaucacccccaccccaugaccucguucccuccccacgauggugcccgcagcagucccgccccacaacccggcccuccugacccgucaguaccaggugugcggggcacaugcccucagcgcaucucugccuugcccggggccagcaggugcacgccggaaugcugcggaccaaccaaguggcccggccagcccugaccccugcggguggaaaagggugcacccuggggauccccacauagcggccaaggccuuaaggauaccagcaucucgcucccugaauagacucuagacacaaaauggagccagcacagggcgcgucucggcgcauccuccucagcccaggccccgugcguaaggagcgcuccgugucagcgcgcuugcuagaccccauugauuuuuagagacggguuuuacuauguugcccaguguggucuccaaccuccuagguucaagcaguccuuccaccucagucucccaaguagccaggauuacaggugcgcaccaccacgcucagugcuguugacuuuaaugugaauaggaaauaaguuuugauguuuguuuguuuuuuaaguggggcuccuguuuuuuaaaaauggaucaauuuaccuggagugcaggcugcuccugagcuugaagguggaagucaguucaugcgugaaagaagucuugccuaauugaaacauggcaucacgguuaauaauuaaaauguuaucugauuugagaucagcuguuuuugugagaaugcuaauguggcauuccugauuagucuguauguuuguuuguuugauuuuuaauucugggugcagaggaacacagauuaucaaauccaguugguauuucuuaugccacuauaguacaacuugaaaucccuuuuaaguagaggaaacaguguuguauucauuuccuauugcuguuauaacaaauuacuacauauuugaguagcuuaaagcaacacagauauauuaucuuagaguucuggaggucagaagucuagaacaagugggccuuccuucuggaggcucuagggcagagccccuuucccugcccuuuccagcugcuaggggcugcagcucacagcccagcaucacuccaaccucugcuuguucccacaucuguuucucuggcucugccucuucugccuccuuccaucucuuauagggagccuugugaugacauugggccaaccaaauauuccaggaucaugccugcaucucucaagauccuuaacuuaaucauaucagcaaagucccugcaccaugugagguaacauauucacaguaguaggugcucaauaaauagauacuaaagauagcagcauuuuuuauuagaccuucucacagcuucuggggauuagaaugagacaucuuuggcagccauuguucuccccaucauggguaacaugcagugggcgcuuccagugccaggauuucgguggguuuaacuggagugugcagauaaguaguuggcgucaagaacuccugcugcuucccuugcuggaaagaugggguggcuuugaaugacaucccagaaucugauucuuccgucugcggaaugugcauaggaugucugaaucacacuauugucgugagaaaugagguagaauauucucugauguggcaagcuuaggccagcaucuagcccaauuccuuguauauaauggaaauucuuaagauguuaggguuccccucucccucucucuccuuuuuccucgccuacaaaggaagacaucuuuugugaggccuccacagcauucuugaucacuuguacuuagaguaaccuuaagguuauuguaguauagaacuucauaguguaaaggucaaguuuuuauuuaaaggaaaaaagugggggggccuccaagauaucauuucucugcagacauuaauuggugucauacuucaagaaaaauggcuagaaaagaguggugaguggaaagcuggccagugcccuggaggcugcuccugcuuugaguucucccggacuuguuucugcugccagcaucugccaugcaaccugggcaaguuauuuccccucuggaccucagcuuccgcauaauaagcgcauuggauaaaucauuuuucagacuauccaguucuuauacaugauaauacuuauauuuuauagaguaaccauauuuuuggcugggugcagggaaucacaccuguaaucccagcauuuuggaggccagggugggcagaucacuugagcccgggaguucgagaccagccugggcaauagagugaaacccugucucuacaaccaguacaaaaauuuaaaaaaacagaaacuagcuggacaugguggcagacgccuguaguccuagcugcucgggaggcugaggugggaggaucaccugagcccaggacgucaaggcugcagugagcuaugauugcaccacugcacuccagccugggugacagagugagacccugucucaaaauaaauaaauaaauaauaaaguaaccaauucuaaaaugagaccgugauggcggcagcuugcccuaaagguugccuuauauuuaacaaauuagggauaguuuguuauuaggaacuagaauucuauaaaagcuacauauuaauuuuuguuuucauuauuuauguuaagcaugaaggaaaaauagugauagugagaauuauaguuaaaagggaagagagauuccuugguauucaauuuucugagaaaaacccauaucagaucuucaccggggaacaucacagaucaccuaggcccgagggcaggcacaggaggguaaagaagggugcagggaaggaaauggcucacggccucauguacagccacagccugguguccguccagcaugaaguccacacccagagccaugcugaaucccacgcccagccuuaugcuggaccuccuggaucagaaccucuagaaggaggauaguauuugucuuuauaagaagcucuccaggugauuuugauguguuccauuggugcagaaccaucagucugcacuagcagcuuugcaggaauaaacgguuucccaaggaggggagguuuaacguguuguuccucuugcuaccaccaucauugcuguuaaauccaccuccucccgcuucacuauccagaaauggaagugaccggcuaccaaggugucuuccuuuuggccagucgggcuaccaauagauuuaccucucaucuuucaggaugccacucucuccugguuuugcacccaccagucacuccccagcccacuuugcugugccuucaguccuuucugaccucuucacaccacaguccuuggaucucuuuauuuaccuucacuucccuggugaucucaucacaucgcaugacuuuaaauauaaucucugucugacaacucccacggauaaucuccagauuacacuucuccccugaacuuagaccuacuuacucugcugcccgcuggacaucuccacuugcugccuccugggugccucacgcuuacuccgugcaaaucugagcuuccugucuucucccucggcccucuccaccuccaguuuuuccaacuaaauaccucaggaaccaugcuuuuucuuucucucacaucccacaucuaagaugucaagaaauccugcuggcaccauugaagaaauacccagaauuccaguaccucuugccaccugcgcugccccccagcucugucuggaucucugcaguaaccuugucacuguuccuccuguguccgcucuuaucuccccacugucuguucuccacacagcagccagagagauccuuuuaaauugugcguccguucauuucgguccucucaucagaaccuuccagugacucccauuuguugcagagugaaaugcaaaggccuuacaguggcuccauaacccacaucaucugacuccaaccugagccauuacaucucuuaccuccucaucucccaucucccacuuccucacuccgccccagcucaugccuucuugcuauucuuugaagacaccagaugcauuucuuuuuuuuuuuuuugagacggaguuucgcucuuguugcccaggcuggagugcaauggcacgaucucggcucaccgccaucuccgccucccagguucaagccacucuccugccucagccucccgaguagcugggauuacaugcaugcaccaccacgccugacuaauuuuguauuuuuaguagagacaggguuucuccauguugaggcuggucucgaacuccugaccucaggugauccgcccgccucggccuuccaaagugcugggauuacaggugugagccaccacgcccggccgacaccagaugcauuucugacuucaggucuuggcaaugccuuuucccucugccuggaaugcucuucccccagauauccccaugauucaacucuucacuuuccucugaucuugcugcaguauuacuuucucaaugagacgugccuugacuacacuggacaugguggcagaugccuguaguccuagcuaaucgggaggcugaggugggaggaucagcugagcccaggacgucaaggcccugcucaugauccuucuuauccuguucugggguauuuuuguuuguuuguuguuuguuuguuuuccccaaccauuuacugccuucuaauauaaugaauaguuuacuuaucuuuuguguuuuuuguuuguugccuguuuuccuuucacucugccaucccagugucagcaccaauagggcaggaauuuuugucuucuuuguucaccgaugcggcccaagagucugucguguaguaaguaggugcucaauaaauagauauuaaagauagcagccuuuuuuuagaccuucugaaaaaaacaaagcuaacagauuuuuuuucuccuaaguauuuagucuguuaugcauuuagacuauggucuacuugaagguaggaauuauaucuuauuggcucauucagaaaugggaggaaauuaggccagauuaucugucuuauucuguuguaugauuacguaugauuacgugugacuucuaaggauagaaacaaaugcugaguaauacacguaauuguaacuucaaaauguggcucauggacaggagccagugugugaacccaccugcuugaauuccccugcacgcccugcagguagcuaauaugccucagcagagcccaagccucuguagacgagucugaagagugcugcuuuucaggauaggaacuggacucugcuuucuguaauauacuugauauauucuaauucaaaauuuagucaugucugcauacaaugacauacauuucuuguauccccaugaugguggcagcaagaagggagacacugcaaaacacauucaacuccccucuuuggggaacuguuuauuccugugaagcugcuagugcagaucgaugguucugauccaguggaacacaucaaaaucaucuggagagcuuuuuaaaaagacaaauauuauccuccuucuagagacucugauccaggagguccagcacaaggcugggcaugggauucagccugcacucuggguguggaccucaugcugaugggcaccaagcuauggcuguacaugagaccaugagccauuuccuuccccgcacccuucucuacccuccugugccugcccucgggcccagguggacugugauguuccccgguggagaucugauagagauuuuucucagaaaauugaauacaaaguaaucucucuucccuuuuaacuguaauucucacuaucacuaccacaucccuguuuccuuggaaacuacaaaguuaagauggacuugcaauguuguguccaaaaguuuccuaaucugaaacucugcaccugggcuggaaauccaggccagcuuucuaugucaagagugggauguuucacucuucacguuaugauuucagguagcaaaguuucugacccucugugaugacagagaacaagauuucucagugagauaagaaacaguggucacaaaaaaagagaacuguuaggacaccguauagcugcauucugaccuuggggaaauaggcuucccguuagcuuuguagcugggcuucucuguguuuguuaccccagccugcucuaggaauagcaggccugauuuuuaccuucucacuagauuccucacaucugcagaccuaacaugcucaguuuugauccugugguccaugauauguguucauuggagauuuugagaaaguauacaagaaugcccagcauucacauccgacaucuuaauguaccuccgaaccuguaaagcacuaagaaaguaacuuaaggaaaagugaccugaaaggagaauuaaaauuaaaacugguauuagaaauguagggaagggaaacagguauaaguaagccaugguuugaagccuuuauagugcuuaaaauccuuuggccugcuaauaucaugcaaagagagcuagucugaggaaaucacuagcuguaaggacaaagaugcauagacagggauaagcauuauaugucauggugaaaaaccaaaaaccacuuaaacauuaaagguguaguuauauauccaaaaugaacagcggccacaaggaugcucaugaaauaagugcaaaaaaaacaagaucuuaaaauauauaguaugauaucaacuaauuuuuuaaauuguauaauaacauguauagaaaaugucuauaaggaaauguaccaaaacaguaacgaugauuucagagugccuggauuaugggagauuuuguuucuuuauucucuauuuucuguaauaagcuuguauuuuucggaauaccacagugagcaucuauuacaacaauacagggcaguucuaaaauaaacauguauuacucagagaaagaaauuaauuacuuuuggaaaaaaaguaauggcucuuuagccagaaaauaaaaauuguaugaggauaauuacaugcugcagaguuacuccuauucaugggacugugcaacuguguuuuuccugcuauguuccugguagcuggaagaacuuaauuuuuaauuuuugauuggugguuuaugugcuaaacaaggcugaaugaaucugcgucuuuuuuaguuguguaauuuuuagcauuuaaaccuuuuuuuaaucauuagucauuucuccuaguaggaauaacagcuuuaguaggcguuugacguugguuguuucacucagaaaaauggguucaaacuucggaccuuguuacuguuuuuauuuauuuuuaaacuuuuuuuuuuuuuuagaggcauggucuugcuuugucacccaggcuggagugcagcggcaugaugauagcucacuacagcuccaacucuugggcucaagcgauccccacaccccacugccaccucagccuccugaguagcugcaacuauaggcgugcaccaccaugcccggauaaguuuuuaaaauuuuuuguagagauggggucuugccguguuguccaggcuggucucaaacgccugggcucaagggaucuucccuccucgaccucccaaagugcugggaacauaggugugagcugccgcacccauccuaaaacuuuucguaccuuuauuuucuccagaguaauucuagguauccaacaaguaaauauuaaaauacuauguacuuauaaagagaaauauguaggaaacuauugaaauuuaguuaagaucaauugagauuuauagacaaacuuagcuuugaauuuagauggccuuuuugccauuuauagcaaaauuaucuuuauaaauaggaagaguauguacauauuuacucaaaaauuuaaggugacuguaaaguuucuaaauacguagugacauuguaagccuuacacgaacuugccuuuuugacucuuugcaguccgggaccaugucuggagaacuaccaccaaacauuaacaucaaggaaccucgaugggaucaaagcacuuucauuggacgagccaaucauuucuucacuguaacugaccccaggaacauucuguuaaccaacgaacaacucgagagugcgagaaaaauaguacaugauuacagguaacauuaauuauuguuuuuugguuuaauguauaaauagaucaucauguuaggcugcuaucuuuaaaccuucacuuagugauuuuacaacuuuuuuuuuugcaauggaauucuuuugaccaaaaaaaaaaaaaggaagaaaagaguaaaaagaccuguuauaucccccauugcucgcccuuaacacagauaucuaggguucauauuaaccugacaaugggagucaucccucuuaguuguagauaccaaucccuuucuccuggcagcuugccuucuguucuccgauagcaccaccaccuccacuacgacauccacaaccccuccgugcauuuuucugucucugaacagaaacagcauuaugcaaaaacaaauugccaagaaucagggguagguugguuccuucugaguuauaggcccaguaaguaaaguccuguagguaggagcucagaugggaagggugcugguggcaaugccuacagggaaugcagaugugggaugcacgccaucaguugagagaaccaugcgggagggaggagaagaugcuaccgguguagagauauuccaaggcagcaguuggccacuuuuucuguaaaagaucauauaggaacuauuucagccuuuguggaucucugucacauauuauucuuaaguuuuuauuuguguuuuuuuguuuguuuaacaauccuuuaaaaaaauguaaaaaccgcugggcacgguggcucacgccuguaaucccagcccuuugggaggcugagguggguagaucacgaggucaggagaucgagaccauccuggcuaacacggugaaaccccgucucuacuaaaaauacaaaaaauuagccaggcaugguggcgggcgccuguagucccagcuacucgggaggcugaggcaggagaauggcaugaagccaggaggcagagccggcagugagccaggaucgugccacucgccacugcacuccagccugggcgacagagcgaaacuccaucuaaaaaaaaaaaaagauguaaaaaccacucuuaccuggcagggcacacaggccacgaacaguaguuugcugacuccugcacugggggaaagucaauccaaagcuggggauuggauugcuagaagcuuugugccuaaacaugcccagaagugacacaucagaagcagguccuuaaccaucaucuagguagagagagaaccgacgacagucaauaaacacugagucuggccaaguucugccaugugccaaugugcguaaagagggaauacacaaacagcagauaaacgaacagcagaacauccuggaaccuuacgagaaaauagugaagacaggcaaaagccguagaaagcagagaaguugagaugaaaagacaacugcaugguugaaaagaagauggcauaaggaagauugccaagaacguacaaauguaauugaaauugaaauguuuacuggaggcagugguaaaggaccaacaucagaaauuacacguaagaaaaaguacaauuaccgauagagagaaugaaccugagaagcuugccggggugaagaacagaggucggcaaacuuuuuccguaaagggccagacgacaaguauuuuaggcuuuacaggccaugcauucuuugucacauauucuuguuuguuuuuacaacccucuaaaaccauaaaagcuauucugagcucacaggcauagagaaacaggccaggccguggacugguguuugccaaucccugauauagauggaaaagaaggguacgaaaaagacucuguaagaggaaaagagaauggagacugaagauaaaauuaauuggugcuccuaaaagagaaacuagaaaaaugcaaauaagcaauauuaaauauauuucauagcaacagaaaguaaaauggaauuuuccucaggugaggaaaaccauuucucuaauuaaagagaccugcccuauuucaagcagacacacccacacauggcaauuuuuuuccuuuuguuuuuucuauaaacuuuuaaaacuuccagaagcauccaugaacaggaaaacaacgaaaagcuauuaaaaaggaacaugucagaaagggcucaaucuuuucaucucuacgcugaaugccugaagauaguaagcgaugugugccaaguucucaggggagagaguugucacuugggaauuucacaauagaucaucuuuauuugcgacagcaacagaaaauaugcaagugcagccgggcacagugauucaugccuauaaucccagcacuuugggaggccaagguggguggaucgccugaggucaggagcucgagaccagccuggccgacaugguaaaaccccgucucuacaaaaaaaaguacaaaaaauuagcugggcgugguggugcaugucuguaauuccagcuacuuguguggcagagacaggagaaccgcuugaaccugggaggcagagguugcagugagccgagaucaugccacugcacuccagccugggcaacaagcacgaaacuccaccuaaaaaaaaaaaaaagaaaaaauauguaaaauaugcaagugcaucaaacauaaacucuucauaaacccuucuuggguggucaaaagauaauaccaaauagaguuaaaaaaaauaagccauaauauaaggugauuccucagacagugaaacaugaaucaccgugugacccagcaguuccacuucugggaauauaccugaaagaaaugaaagcaagaacucgaacagauccuuguacacucauguacauagcagcauuauucacaguagccaaaaguuggaagcaacccagguguccgucagcagaugaguggaugaacaaaugugcucccgccauacaguggaaucccauacaaugaaauagcauucagccuucaaaaggaaggagauucugaugcaugcuacaacaugguugaucaugaagacauuauguugaguaaaauaagcuagucacaaaaggacaaauauugugugauuucauuuauaugagguaccuagaguagucaaauucagagacagaaaguagaggggaaguugccaggggcugggggaagagggaauggggaguuaguguuuaauggggacaaaguuuuaguuggggaagaugaaaauguucuagacauggauaguggugaugaccacacaauaaugugaauguacuuaaugccacagaauuguauacuuaaaaaugguuaaaauggcugggggugguggcacaugccuguaaucccagcacuuugggaggccaaggugggaggaucacuugaggucaggaguuugagaccagccugaccaacauggugaaaccccgucucuucuaaaaauacaaaaauuagccgaguauggugaugcacgccuauaaucccagcuacucaggaggcugaggcaggagaaucacuagaacccgggaggcggagguugcagugacuugagaucgcaccacugcacuccagccugggcaacagagcaagacuucgucucaaaaaaaaaaaaggguuaaaaugguaaauuuuauguuacgaaucuuuuacuacaauaaaaaaagaaacauauaagaaagucauauaaauagacaagugaugaauguugaaacacauagaaauaguuguaucucuaguaugaaauacuguauagaauaaaagagauuaaaaguggcuuuuuuuuuuuuuugagacggaguuucgcucuuguugcccaggcuggaguguaguggcgcaaucucggcucacagcaaccuccgccucccagguucaagcgauucuucugccucagccucccgaguagcugggauuacaggcacgcaccaccacaccuggcuaauuuuguauuuaguagagauggacuuucuccauguuggucagacuggucucaaacuccugaccucaagugauccgcccuccucagccucccaaaguggugggguuacaggcgugagccaccacucccggccuuaaaaguguuuuauaaaaaauuguaauagauagccaggcauggugacgcgcaccuauaaucccagcucgggaggcugaggcaggagaaucacuugaacccgggaggcagagguuucagugagccgagaucgcucccugcacuccagccugggcaacagagugagacuccaucucaaaaaaaaaaauaguaauagcuaucugaaucuaaagcccuagauuauagugucaaaaaacaaaaaggaaauggaagaauuaaaacaucuugucucaaauaggaacaaaacucagaaauauacaugauuuugcuccuuacuauauucaauaaaugcauuaacauguuucauuuuaaaguuaguagaauaugcaugaacagaaaauuguaagccuuaauaauuuacuaacauaacaacaaauuaaaaauuuuaaaaaucaaaucaaagacuuuaaaauuggguggaaacacuuaaaaagcucagugaugauaugacaucccacuuagaauaccugaagcuugcaugauguaauuguacuuacgaaauuacaguacauuuuuccaagaaucccuaaaugucucccuuuuuuuuucucuucaccuuuuuagagcauauagacccuuaaagucugggugauaaauugccuaggccuguuccaaauuagcuuugggguauuuguuagguucugugcugauagauacucuuucuuuuuuuuuuugagauggagucuugcucggucacccaggcuagagugcaguggcacaccagcucacuguaaccucugccucccggguucaagcaauucucccugccucagccucccaaguagcuggaauuacaggcaccugccaucaugcccagcuaauuuucauguuuuuaguaagacgguguuucaccauguuggccaggcugguuuucaacuccugaacucaagugaucugcccaccucagccucccaaaguccuggaauuacaggcgugagccaccaugccucgccuauauacuuuuauauauauaaaucaguaagccaguuguuaaaucaguauguaagaaauaacucagaguuuccuaccuccccaucaagagauaaaucagccaugagccuucaggggagauuaguucaagggcuaguuaggguugaagagguaucauguuuuaaguaugacugccaauauauaguucuagugggauacccacaaugcuauuugaacaaugcuauaugaaccaaaaagaaaguaauaaaaauggcuaacauuaaaaagcaggacaaagguaauugcaaauaaaaaguaggaaauuacaauucugggcaaauagauccaaauauuuugauauugauaaagauauagugaaugccgaacagacaguauucaugagccagugguguuccaucaaaauauacaaagaaagggugguuagcaauacaaauagaacuugauuaaaacacaaucacagggccgggcgcagugacucacaccuguaaucccagcacuuuuugaggccgagacggguagaucaccucagguuaggaguucgagagcagccuggccaacauggugaaauccugucugugcaaaaaacacaaaaaguuagcugggugagguggcgggcaccuguaaucccagcuacuggggaagcugaggcaggagaauugcuugaacccaggaggcggagguuguagugagccgagauugcgccacugcacuccagcgcaggugacaagagcaaaacuccgucucaaaaagaaaaaaaaaaaaaaaaaaaccacaauuguaguaggaaauucuaacauaccuuuuaucaucuuugauagaucaucuaaucacacuagaauuuuuaugcuguuuuaauucuuugaucaaaacaaaaaaaucacaaaguaaaaacaaugagaaauuaaugagaaaauuaauuauuaaucuuauuaaugagaaaauuaauaagaaacuuuaaggaauuguacucugaggaaaguuuauagcuuuacauaucucugugauuaaacaauaaaagcugacaaugaaugaacugagaacccagccuaagaaauuagagaacagcagaauaauaggaaaauaguaaacccugcaagguacuuccugagugcuggauacugacggcuuuaaucauuucacauuuacuaauuuaacccucacaaccuuugaggguagauaauguuauuuccauuuuucagauuaagaaacggaggugguaacagaauccugcugcgguaggugguagagccaggauuaaaauccagacgaucugaccgcagaguucaugcuguuaacuacuacauacacugcuuuucaaaacagagaggaguucauuuuaaaagucugaaauuaauuaauaggauuaaaaaauaaauguaagaaauuguccuuugauaaauccagaaaaggauaagccucugguaagucuaaccauucuaaagaaaacaaauaaaacucaaaauauauaacaaaaggaguaagaaagcuaccuaacagagaaauagaauauaaaaauaaagccuacuguauagcuuuuuugcuaaagauuuuaaaaaucuuagugaaauauauaacauucuaugaauacaguauauagguuaccaaaauugacucaauccaaaagaaggcagggaaagaggggaaaaggaaugaggaggagaugagacaaacagaaaacaaauagcaagaugguaauaaaauaaaaaucuuucccacaaaaaucucaaaggccagauggcuuuacacagguaaagaaagaauuuuuucacaggaagaauaucaaaccagccaggcgcaauggcucacgccuguaaucccagcacuuugggaggcugaggcgggcaaaucaccugaggccaggaguucgagaccauccuggccaacaugguaaaaccccaucucuacuaaaaauacagaaauuagccgagugugguagcuuaugccuguuaucccagcuacucgggaggcugaggcaggagaauugcuuguacccaggaggcggagguugcagugagccgagauggcaccacugcacuccagccugggcaacagagugagacucugucucaagaaaaaaaaaaaagggauaucaaaccacaaacuccagcagaaagcagaagagucaggaaacacuucauuauucauuucaugaagcuacaaguacccugaugcaaaaccagaaaaagggauuagaggaaaaaugacuaacaccccucauaaacauagacacaaaaauucuuaacagaauuuaacaaaucuacccggaaagggcaauacccaaaauaagcagaacucaaguggaguuauaacaagaaugcaagauugguuuaacauuuaaaaaucacuguaucaguagacuaaaacagaaaaccguauuaucauaucaauagaugcagaaaaagcagacaaaauccaacauccauucaugauacagcugucagcaaacuaggaauagaaggggaagguacaacuacaaaaacccuacgacuaacaucaaaccuaauggugaaaguaugaauacguuccuccuaagauuggggagcaaggcaaggauuucugcucucguuaacuuuucuucagcauugugcuagagguucuaacuagggcaauaagagaaaauuuaaacuuuuuuuuucaaaaaagacaaagauaggaaaugaaaaaguaaaacuuuccuuauucacagaaaacgugaucaucuauauagaaagaauuuaccaggccaggcgcaguggcucaugccuguaaucccagcacucugggaggccaaggcggguggaucaccugaggucagaaguucaagaccagccuggccaacauggugaaaccuugucucuacuaaaaauacaaaauuagccaggccugguggugcaugccuguaaucccagcuacuuggggugcugaggcacgagaaucacuugaaccugggagguggagguugcagugagcugagauugcaccauuguacuccagccugggugacaagagaaaacucugucucaaaaaaaagaauuuacaaaaaaaccaacuaggauaaauggguuuaguaagguuacaagauacaagaucaauauacaaaaaucaauuucauuccuaucuaguagcaauuaacaacuguaauuuugaaauuuuuaaaauaauaccauuuucaguagcaacaaaaauauuaaguacuuagagaucacuuuaacaaaauauauaaaaugccuguacaccaacacacacacacacacacacacacacacacacacacacacacacacacacaaauuacagagaaaaaaacagagcuuggguuuuuuuaaaaacuggagagauauacaguguuccuguauuggaagacucaauauuguuaagaugucaucucuucccaaauuguuguaagauucauuguaaucaucaaaaccccagcaggcucuuuuuagacacugacaagcuacuucuaacguuuauguggaaauacagggagccuagaauauuggaaacaauuuugaaaaagaaugaagcugagaaacucacacuaccuggucuuaagacugacuauaaagcucucguaguaacgacaguuuagcauuguuguaaggagacacauuuagauccacguaacagaagagaauccugaaauaggcacaaauguguauaguuaacugauuuuauguaaaggagccaagauaauucaaugaggaaaggauacucuguucaaugaauaguucuggaaaaauuagauucuuguauaaaaaauggaucuugaugcuuaacucauccuguaaacaaaauuuagcuugaaauggauaguagaccuaaauauacuagcuaacacuauucaacuucuagagaaaaugggagaaaaucuuuaugacuuugauaugggcaaagauuuuuuuuuuuuuuuuuuuuuuugagacagagucucgcucugucacccaggcuggagugcaguggcgcgaucuuggcucacugcaaccucugccucccagguucaagcuauucuccugccuaagccucccgaguagcuaggauuacagguacgugccaccacgcccagcuaauuuuuuguauuuuuaauagagacaggguuucacuguguuagccaggauggucucgaucuccugaccucguuauccgcccgccucggcccccgaaagugcugggauuacaagugggagccaccgcgcccggcaguaugggcaaacauuucuuagauaagauauaagaauggacaauuaucaauugaaacggaaagaagagaaaaacacugauaaauuggacuucaucaaaaguaaagucuuuuuaugacagaagacacuguuuagaaaauaaaaaugcaauucacagacaaggaaaauauuugcaaaacuuguaucucguaaaggauuuguauccagaagauauaaagaacucuuaucaauauugaacuauaucacuugaacuauauccauccaguaauuacccaacccaauuuuuuuaaauggacaaaagauuugaguagacuuaggacacuucaccauagaagauacaggaauagcaaguaagcauauggaacuaugcucagcauauuaguuacuagggaaaugcaaauccacaagaagaugcuacuucacaccuacuucaccuacuagacuuuguaaucacccaguggguucaccuuaccugcugccuagacagaaccgauuuaucaagacgggaauugcaauggagaaagaggaauucaugcagagccggcugugagggagaccggaguuuuauuauuauucaaaucagucuccccgacugauucggugaucagaguuuuugaagaaaauuugguggcuaggggcuugggaaguggggagugcugguuggucagguuguagauggacucauagaggguugaagcaagguuuuuuaaugucuucucuuccugggugcgauggcagaacugguugggccagauuacuggucuggauggugucagcugauccaaagugcaaaauaucucaaacacugaucuuagguuuuacaauacagugauguuagccccaggagcaauuuggggagguucagauucuuggagccagagacugcaugaccccuaaacuguaauuucugaucuuguagcuaauuugguaguccuguaaagacagacuggaccccaggcaagaagggggucuugggggguguuaucaauuuuguuucagagccagaccaugaacugaauuccuucccaagguuaguucagccuaugcccaggaaugaaaaaggacagcuuaaggauuacaagcaagauagagucaguuaguucugauuucuuucacugucauaauuuccuuaguuauaauuuugcaaaagcaguuucagaauaacuaaaaagagaauugauaaauaacguacuggccgggcacaguggcucaugccuguaaucccagcacuuggggaggcggaggcgggaggauugccugagcucaggaguucaagaccagccuggacaacauggagaaaccaugucucuacuaaaaauauaaaaaauuagccgggcaugguggcacaugccuguaaucccagcuaccugggaggcugaggcaggagaaucgcuugaacccgggaagcaaagguugcgaugagccaagaucacgccauugcacuccagccugggcaacaagaacaaaacucuaucucaaaauaauaauaauaauaauaauaaauaaauaaauaacugguacauccauccaucgaacagauuaaccaacucauauaaacaacagggugcuucucaaaaguguuaugcaaagucaaagaggucagacacaaaauacacaaaauauguaucuacucacuguaugauuccauuugugugaaauucuugaaaagguaauauaguguuagaaaacagauccauugguuggcaggaagugaggaaauaacuccagaggggcccaagggaacuguuggagacauggaaauauccuguaccacaauuccggggcgguuacaccacugaguauauuuuuucaaaacuuagcaaauuggacacuuaaaguggaugacuuuuaugguauuuaaauuauaccucaauaaagcugauuuaauuuuaaaauguuacaagaucauagaaaaaaaggaaaugcuucccgauucauugcaacccugauacaauaaaugauuuaaaaaauacaaaaagaaacaguggccugucuuacaaauugauaaugcaaaaauccaaaguaaaacaccaacacauagcauccaaccuuguguuaaaacaugaacugguagaauuuauuccgagaaugaaaaggugauuuauauuuaggacauuuauuaguguaauuuaucacaucaauaugucagagcaaaaaagccacaucuugauagaugcccaaaagaagguaaaauuauauaucuauuucccauaaaauaauuaaucagcuaggcauaaugggugguacuucuuuaauuaugaagaaugcauaucccacaucaguagugagcaaugcacgaaauaauggaacacuagagcugaacuucccaaaaagaccucuaaaggaaaggaacccuggccgggcgugguggcucacgcccauaaucccaacacuuugagaggccaaggcaaguggaucaccagaggucaggaauucgagaccagccuggcuaacauggugaaaccccguuucuacuaaaaauacaaaaaauuauccaggcaugguggcacgcaccuguaaucccagcuacucgggaggcugaggcaggagaauugcuugaaccugggagguagagguugcaguagccgagauugcgccauugcacucuagcuugggaaacaagagugacacuccaucucaaaaaaaaaaaaaaaaagggauccuauggaauacuuaaagaaagaaaagaggggggugggggaagggagagagggaucaagagaggcagagagaaaaagggagaggauuuugguagucaaauuugagaaaguuugcauuccacucuugagaaugucacauucuauuaacuguucgaaguuuccaaaaaguccaggagugaaaauaaagcugcuuaaucauuuuucccaaacuuggacaugagcccuuuguuuuuuuuccauaauguauguaauauguaugagaauacucggccaggcgagguggcucacgccuguaaucccagcacuuugggaggccagggcaggcaaaucaccugaggucaggaguucaacaccagccuggccaacauggugaaaccccgucucuacuacaaacacaaaaacuaaccgggcgugguggcgcacaccuguagucgcagguacuccagaggcugaggcaggagaaucgcuugaaccugggaggugaagguugcagugagccaacauugcauaacugcacuccagccuggcaacagagcaagacuccaucucaaaaaaaaaaaaaagaagagaccauaaccaacugaacaaccauagaacaaauuaaaauacaaugagggggcuauuuauaauagacacaaugguaguuuccuguauaaaagcaacaagcaauuagacauuguuuuuuauucacuucauaagaacaauuuuuuuugggcggggagggugcggagucuugcucugucgcccaggcuggagugcaguggcgcgaucuugguucacugcaagcucugccucccggguucacgccauucuccugccucagccuccugaguagcuggggcuacaggcgcccgccaccacgcccagcugauuuuuuguauuuuuaguagagacgagauuucacaguguuagccagaauggucuugaucuccugacuucaugauccaccugccucggucucccaaaguacugggauuacaggcaugagccaucgcacccggccagaacaauuuuuuaaaaauguaaaguacuugggaagaaacgcacccagaaauuugcgucaaugaugaaaacauuuggaaucauguuaaguuugaguaaauggagaaaugugcaguaggccuggggagaaaggcuggagauuguagaggugucaguugucuccagauuaauacgauuucagucaaauuacaacuguggucaccuguaaaacugauaaaauaauucugaccgggugcagugacucaugccuguuaucccagcacuuugggaggccgaggcaggggcaucaccugagguuaagaguucaagaccagccuggccaacauggugaaaccccaucucuacuaaaaauacaaaaaaaaaagcugaaugugguggcgggugccuguaaucccaguuacccaggaggccggggcaggagcauugcuugaacccaggaggcggagguugcagugagccaagaucacgccauugcauuccagccugggcgacaagagugcaacuccaucacaauaauaauaauaauaauaauaauaauaauaauaauucuaagguuuaucugggagaauaaauuaguauaaggcaucuuagaaaaagaaaaagaagaauagcgugugggacgguugcucuacccaagauuaaaauugacugucaaguuaaaaugguggguauuggcaucagaauauguagauaaguggaaacacaauagaaagucuagaaaucaaggcugguauucacaaacucucaacugaugcaggccagccaaaagagaaaguuaagaauguuucacauuuucuuuucuuuucuuuugagacuuaguuucauucuuguugcccaggcuggagugcaguggcacugucuugacucacugcaaucucugccucccggguucaagcaauucugccucagcuuuccgagcagcugggauuauaggcgccugccaccaugcccagcuaaguuuuauauuuuuuaguagagaugggauuucaccauguuggccaggcuggugucaaacuccugaccucaggugaucugcccgucucggccucccaaagugcugggauuacaggcguaagccauugugcucgguccacauuuucauauuaagauaaauuccaaauucauuaaaaaccuaaaugacaaaaagaaaacaacuauucugagaaugcuagaaauaucggugaacauuuguauaaucuuucuagauagaaacuuuauuccuaccugauuacauaaaaauaauaauuuucaggacagcagauaacacaaccaaaaaaauaaaaauugggguuaaucgcaguguauaaaauacgcguacaaauuacauaaauaacaaugaugcugcuguggaugguaauuuuuuaaaaaaagacuagucaaguagagaaaaaagauagaagacauagccaaaguuuuaauguuguacauagcuuuuguuccagcauauuuacucauuucuuucagaauaaucuuggauguggggauagauuuauguaugaggguuuauuuacuuccucauccuuuacaaauggaguaaaauuagaagcaauuaauaugcccaacacuaggagauugguauauauuacaguaucuuauaaucauguaggagaauacuauacaguacuuaaaaaguugguguauucauuucuuuuuuuuuugagacagagucucacucuguugcccaggcuggagugcaguagcacaaucucagcuuacugcaaccucugccccccagguucaagugauucuccugccucagccuccugagcagcugggauuacaguugccugacacugcacuggcuaauuucuguauuuuuaguagagacggguuuucaccauguuggccagucuggucuugaacuccugaccucgugauccacccaccuuggccucccaaagugcugggauuacaggcgugagccaccaugcccagccuauuaauuucuuaaggcugccauaacaaauugccaccaacuugagccucacaguuauggaggcucaaggucugauaucaaggugucaacagggccaugcucccucuaagaauccuuccuuggggcuuccaagguucuagaggcucuaggaauguuuugaugcaccuuggcuuauggguacauugcugucaucucugccuccuucauuacuuggccuucuucugugucugauugcacauggccuuccuauaaggacaccauucauuggauuuagggaccacucuaauccaguaugccguuuggcauuugaacuaauugcaucugcaaagaucccauuuccaaauagggucacauucugagguugcaggugagacaugaauuuugggggagacacuguucaacccaguauagauuauauagaagaauaucugaagacagagagaaauguuuacaguauauuacugaguaaagaaggugguuauaaagcagcaggucuggugugaugccuuuaaguaaacacaucacauuuagcuucuagaggagagacugaaaauacaugcaugaaaacauuaccaguggagaugaguagguaaagacuugagugauuuuaauugcucuaauggauuccuguuuuuucucaauuuuugacaaugaauacgugcuucuuugauaaagagaagaaguaaagaaugaggcaccuaauuuuuuuuucaucaagagucuucugaggcugggcaugguggcccacgccuguaauccagcccuuuggaggccauggcaggcagaucgccuaagcccaagaguucagaaccagccugggcaacauggugaaauccugugucuacaaaaaaugcaaaaaaauuaaccaggcaugguggcgcaugccuauaguccuagcuacucaggaaacugaggugggaggaucacuugagcucagcaguucaaggcugcggugagcugagaucaugccauugcacuccagccugggugacagagugagacccugucuuuaaaaaaaaaaaaaaaaaaauucuuccugaacuagcuuuucauucuauagguauaaaaaugaauuaauauccuugauuaccauaacuuuugucuaauuguuuaaaguauuuuagaguuuacaaauucaaaauacauuauaaaauaugucacuugaagaauauuucaaaauugaaugcuuuccuauucccuauauauaauuucuuuucuggcuuuuccaaacuacagauaauuugagaugaauagauuugauuuuuuuuuuuuuuuuuuuuuuuuuugagagggucuuucucugcccaggcuggaguacagugguaugaugacugcucacugcagccucaaccucccgggcucaagugauccucuugccucagccucccagguagcugggaccacaggcauaugccacaaugccugacuaguuuuuauuuauuuuuauuuuuuuauagagacagagucucaccauguugcuaaggcugguuuugaacuccugggcucaagcaauccuccugccucagccucccaaagugcugagauuacaggcauaagccaccgcgcccagccugaaauguucauuuuaaguguuuauuguccuguauguuuugaaauuuuuacugacuauauguaacaaauuugucacuccaucuaggcacaaguguuuuaggugagcauaaauuuuuuuuuuugagacagagucucgcuuugucaccaggcuggagugcaauggugcgaucuuggcucacuguaaccucugccucccagauucaagcaauucucuugccuuagccuccugaguagcugggauuacaggcgggugccaccgcacccggcuaauuuuuguaucuuuaguagagacggguuucaccaucuuggccaggaugaucucuaucucuugaccuugugauccaccugccucagccucccaaagugcugggauuacagacguaagccaccacacccagccagagcauaaacuuuuaaaaccuuguagccacuugucucuaggacacuggggagauauuugaaaugagcaauugccauauuauuuguuguuuucuuaggcaaggaauuguuccuccuggucuuacagaaaaugaauuguggagagcaaaguacaucuaugauucagcuuuucauccugacacuggugagaagaugauuuugauaggaagaaugucagcccagguucccaugaacaugaccaucacagguuguaugaugacguuuuacagguauguuaugaauauguagcaacaguguguuuaccauuacagaagcucaaaguauauuuuuguauguaaauaauuuuguugaaauaaguauuauuucauaaguauaugaagugacaaacaagguaauuagcuugauugaaucauuccguaauguacuuaugaaucaaaacaucauguugaacuccuuuaguauauacaauaaaaaauaaaauugaagacaauaaaaaacaaaaaaugggguauuauugauguaaaagaaaagaagucauuucacuuuuaguuccauuauguuugaauguugcuacucugggacucuuuuuuuuuuuaacccuuccccucugcuaaauagcaucuucuuaguuguucaaaaggagguugaauuuuuuuucuaaaucuuagccccaaaagagaaugaaguggagaaggaaaauaaagagucugcaggcaaauucuccuuugacuccauucauauagauauagguauagguauaaguguagauauaggcacauuaaagguguauguguagacauagacauauagcauugcaagugcuguuaggagggcccaggaccgcuuagccuacaaauuguaucuuuuuuccccaagagaagggaucuggcauuuauugaaugucuauucuguaccaggcucucuacaaauuuuaucuuacuucauccucauaguaacccucugagcuugguguuaucuauaucuacggaaugaggaaacugaugaucccagaggauaaaagcuugcccagcacacagauccuaagccuguguggccuuauggcuuucucccuuccccaguacgucuccucucugguuacugguguucacguuuucuguuccaugccgcggcugggcccagugaugguggguaugugacggaugccucuguuuuaggacuacgccggcugugcuguucuggcaguggauuaaccaguccuucaaugccgucgucaauuacaccaacagaaguggagacgcaccccucacugucaaguaaggcuacgagaauugaccacucucugcaguucuucaaccuucauuuuauuaaguggugauacucuccuguuuaaaaaagccuaugugugcauauuuuuauauuguucagaauauuauguagcauccuuuuuuguagcuuuuuucuuuuuuaaaguaaaguguuucauuuucucucucccuaucaagaaaacagucuucuuccagccugccuucucagacauuacucgugccuuuggagguacugguaggauguuaccuccuucucacccuggagcucauggcccuguagaacacauggcaggcagcaccggccuggccucugauaagugacaggcuguuccgccaucuacccugccugaguugacagacaccaacguuaagaguagaggagacaaaguguggucucugcagaaaucaaggggagaccauggcggugugaacuuuauaucugauauguuuuuaaaauagcucaucuguggaguccaaaagaaagcaaugaguuuuaauuuuuugucaccuguuaaaaaaaaaauaggcucacaagauuaguuaaccaaaaacguuaguuagcauaauuguauuacacuugaaagaaaagugcuucucuuuuuuaucacuuaaaauugcuuuugacaacacauauucuucuacuauuguuauauggaacaaaggaucuugaaaucugcagccaagugguguuuauugcaauuaaaauuucuuuuaaaagaagagagaauugcuugggcuuuauaguuuuuggaugauaagacuuaguauuuuuauacaguuaagauaucauuuuuuaaauggcagcacuucauuuuugcuuucaguguguauauuaauauuuugagaaauauuuuuaagcaaauaugccccaaacauuuagcccaauaugcauuccccuguauucauagcuuccuacacacagcuccccuccuucucacgaauacaaagucuguauguuuauuuauuuauuuuaaccaacucacuucaaagaauacaugucuacuuuuuuggaguuauagucaagauacgugugaagaaucccauuguuuauggaucugcuugcuuuuucucuagauuccccuacuuguggagugauagugaauguuguuuuguagacucuucauucugaaucaugcucuuuuauauuucccuuuuauuucuucaaauaauguugcaccagaguuuccugacaugcccucgucguccacacgauauccuuuuuucuuuucagugaguugggaacagcuuacguuucugcaacaacuggugccguagcaacagcucuaggacucaaugcauugaccaagguacucagauuuuuauuuccauaauaaagcuguuuaauuuguuaucaccugccuggcucuaaaucccucuauuauuucuuaaacuaguucaagucauauggcuuucuuguuauagugcuuaucuucagcugcauauuuuaguuauaucuuccaauaaguuugggaagaguugucaccaguaacaccuaccaggacuguggucugugccugacucuguguacgaagugcuaaauguucacccauccugacagcccaccagaggcauugcagagggcagugugccucaggccacagcucugaagagaggcaagagcaucucucucucucucucucucuccccacuccaaagcccauacuccugcaaccacacuuagcuacaaggccuuagaagcuugcauggucccagcacacccaugugggaaauauacaaauacugcuaggaaaaguuuugaaagcauucuuggccugaguuucuaugcaaaugggacucugcauuuuucagaguuuucaagaagaaauaaguuauuuccauuuacuaguacaggaaaaauaagauaaagcucuugaaauuuucuccucugcagcaugucucaccacugauaggacguuuuguucccuuugcugccguagcugcugcuaauugcauuaauauuccauuaaugaggcaaagguaagacgaauaugcacucuuaguagggacaugugcuugacaggagagucucuuguaauaauuagcuuuguugaaacuuucaaaugcuuguuuuaauauguauaggugaaauuauaugagaucuuggauuucuuuugaaauacucugggguuggggaugaggaugggcgucuugagaaaacaagcuuagcgaugaguuacugauuauugaagcagacugaggagugcggggagggggcugaugcuggaauagucuuucuauguccguauaauaaaaaguuuaaaagauauaucucaagcuuacauugaguugugcuuggguuggacaaagucuauccaaagaaaguuuauucucuaaaauagauuccuuuuuuuucuccagaauuuucuuuuggggcuuaaaguacauuauucuauaucuuuggaaguauuguuguagaacuggcaaaaauuaaaggagaagaaagaacaacaaaagcauuuuggaauggauaacgaaaaacagggguaacgguagaaguuauacuuaguguuaguaaauauaguuaauaaauauacaguagggccaugugcgagugacuguuuccaugucagcauauuaaguuuguugacuuaauaaugcuguguauuauaucuguuucucauuuggaaaguugcucaaauuugcacaugagcauagauugaaguuaguguguccacccuuugaaucauauuguuccugaaaaagguacacccuguuuuaaaaguuuacuaguguuguuuuacuuuuauuucuaucaaaggaggauuaaacuuauccaugguauuuaaaaauagaugugucugcugggcgcaguggcucacaccuguaaucucagcacuuugggaggccgaggcgaguggaucaccugaggucaggaguucaagaccagccuggccaacauggcaaaaccccgucucuacuaaaaauacaaaaauuggccggcacacugucacaugccuguaauucuagcuacucgggaggcugaggcaggagaaucgcuuugaacccgggaggcagagguugcagucaguggagauagccaccacuacacuccagccugggcaacagagugagacuguaaaaaaaaaaaaaaaaaaaaaaaaaaaacagaugugucaguaccaaaaaugacacuugaguggguauuugaauuaaguagaggguugaucuuucccaacauaguacuauuucaggacguuuauugaaggcauugguggagcucucuguauguguuuugcucugcagggaacucaaaguuggcauucccgucacggaugagaaugggaaccgcuugggggagucggcgaacgcugcgaaacaagccaucacgcaaguugucguguccaggauucucauggcagccccuggcauggguuagcaggacuuugucauuuauuccauaaauacagguugaaccagcguucacggauccgugaaccagaaaacaaacacauauaucacaccucuuaguggaaauugccuuccacuggggguggcagaaaauaaacaaguaaauaaaguauguaguaugugcaguggugaugagggcaagggggcaauggggcuagggcguguggguagggcagccggggaagagcacuggguggaggugugggagugagccaaguggguaucggugaugaauauucuggcagagggaaccacaggcaggaguuugccugguguguuacaggcauuacgggugcaggugcagcuggggcacagugggagggguggggagcaguaggaagggagucaggaggccacagacggcagagcguggauggcagcccuggcguuucacaccuggguuuuagucugagagguaagaagccaggcaggguuuugcauacaggagcagcacagucugacuuagguuuuaucugugugacucugggugguggguugagaauaggcugaaggagaaugagaauauucaguggaggcugugcggggaggcugccucaguaauccaggcaagaggcagugaugggcuggaccagggccauacagugggaauuugaccagaaggaacugauggagcaaauuggaaugguuagagcagcuacugauaaaaugugugccaagcaacugcucagguuucccuauagggacuggggucagaaugaccaaaaauagaaagucuacauuguauuuaguucugcugagaaucucuaguccacccuaaggcugcuuagagcuaccuucagaccaggggccuaaagaaaguucucagacugagaaaucagagggccuggcaguuagagugcucuucacagaaaaaaaacagaaauuaguauguuuaauuuucaucaucuaaacugaaugcaaacagcgcuuggcaauuaaaaugaagcucuccaaugaaguauacuucaucagcugcugucaagucauccauugauacuguuuugcgguuuuuaaauuccuuuugucacugugacugcucaucagcaggcaaggaagagcaggcaacaaaaguugaaaagugcaugaaggaaaacuuugaggaauaugauauucacauuccagcaaauugggggaaaacugcuauuaucugguuuaacacaggagugccuuggugcccugccugaggcuaauguguucuguagggguggcugcacagccacaguccugaaacaugggaaagcaucuccugaguccagggaccagcacguuugucacuaaccuaaaaggaggcuauggagcccaccccgguguuccuacugagcccugauuuccagauuugcugaaaucgagguugcggcuccagcuucugcccuggguuugguuuguuguugucgucguuguuuuugagacaggauauugcccugucccucaggcuggagugcaguugcugugaucauggcucacugcagccucaacuucccugagcucaggugauccuccuaccucagcuuccccaguagcugggacuacaggcgugcgccaccacacccagcugauuuuuguauauuuuguagaaacaggguuuugguauguugcccaauuagucuagaacuccugggcucaaaugauccacccaccccgaaugcuagguauacaguugugaaccaccauguccggcccuggguuugcuuuugauuguggucuuuucuguuuugaauugccuuacuccucuuagaguucagccaguccagacggacaaauccauuucuagugauuugguuauuuuaaacacuauuuaguccccagagaagaaauacaaucuuucuguccuagugcaauuuauaagaguaauugacauauugaaauaguggauaugacaguuuagccugauaaaaguugucagcaaaugaacgaaugcuguccaccgcauacccaguguuuuacaugcaguauugucuccaauuuccuccauuuuauagaaaaagaaaacagaaagcugaggcucagagaaguuagguaacuucuccagggucacccagcuagcaaguggucuagcccagcggucccaaaccuuuuuagcaccagggacccauuucauggaagacaauuuuuucauggaccaggggucagggggaugguuucaggaugauucaagcacguuaaauguauuguguacuuuaguucuauuauuauuacauuguaacauauaaugaaauaauuagacaagucaccaucauguugaaucagugggagcccugagcuuguuuuccugcagcuagacagucccgucugggggugaugggagacagugacagaucaucaggcacuagauucucauaaggagcgggcaaccuagaucccuuguaugugcaguucucaauggaguucaggcuccugugagaauguaaugcggucgcugaccugacaggaggcagagcucaggcguaaugcaagcaauggggagcagcuguaaauacagcuaaagcuucauucacuugcccacugcccuccuccugcugggcagcccuauuccuaacaggccagagauccauaccaguccauggcccagggguuggggccccuggucuagccuguacggaagcaguuucugccugacuccaaggcaggauucuuuacaccauccucccugccuugugcccuuuguuuuauuaauauaggaagaaaaaguuccugauauuuuuauuuuugucuacuuaaaccuaaaaguaaaguucuuuucaagauuauaaaacuuucuggcuggcagaggaugugauauuacuguucaaaaauuuagaaaaucagaacaguuuucaaucuaaugaauucaaauguaauaauuuaaagaauugcuacaaacuguuuuuacugugacaguggaaauagccuaaaagugacagaagcuuucugucaaaugguugaaaaaaaaaguaagcugaaaauuggcauuaaauaaagauuuaaguggaucuaucuuuauuuccagccaucccuccauucauuaugaacacuuuggaaaagaaagccuuuuugaagguaagcugugguucuuuugucauuuucucaacccuuuuuauuucuuuucagauuucaaaccguauagauuauuugcuaccuaaacaguaaagaagccgaaggccaguuuccugggcucuuacguaaauaaaaagauguucccaggaagauuuuauuucuaaucucagauauuugaaaaagcuuuuuguaaauaaagacugccacuauugagagguuguaacucaguuacacacacagucaucuauuggaugccugacuggguaaaaaugaagagaugaugugaauuuggaaugacauguguacaagucaguagucauccuaucaggaaugaaaaaaaucauucggaguagcagcuucauggggucucaguuugggaacaguuagcacaguuccucucaucucagugacaaacacugaacagaagacauaguugggcauguugcauaaguuucuugcugugacagauggaaauuucuguagauguacccuggcauuuucucaugcgaaggagcuggaaaaugauaaaagcaguuagccccgucuuagcccaccauugccgcauuguuccaggcuguuacacaaugauaagaugaauaacuauuguguucuccccacuuucaucuuaagcugugguuuuuuuagcuuugcuugauauuguacccuuugaucaucauuuggaagugugcugccaugccuacucuucccaccgaagcccccuaccugccccacgccccacauggaagggcccacugguuucagaaccccauugugaagguccagagagaugaucaggacagcucauggcucaguccuggcaccucacuggcuacaagggagccugguuguagguguacuccuucagaccucaaugagagauauugcucugaaaaaguaauggcuaacuaccauuaagguacccauacauaccuaccacuccccaaguucacaguugcugguauaugucgguguugcauuucacccauguagagaggaccauaggacagaaaugauaguauagucauugcuaaaauagacacagaggcagcuuauauuaaaaucccuacuuuuccacguucaaaacacuuucacauucuauugugaaggcgggcuucaccaugccucuuccgcaaaggcugaagaggucacuuccuuggcagcucaugaugcccaugcgguggugugccuugguuggccuuccgcuuguucccacugccccagggccaggugugccuccucugcaaggagguacuuaucugggcuuuuaccuuagaaaugaccagacuccuccgcaaacaugaaacuaauugaacauucugggcuuuuuuaaacggugaugcuuggggagcauucagcaugacucauccaucccccuacgccuuaucucuccccaaguggagagcuggaaaaaacacaucagcugugggcaggugacucacggaaauuuuugcaguaaaccaagaaguucaccgccuaaaaucuggugcuucugugaacaguuuucuugaagaauaguuccuguugucucuuuaaacuugggucauucuugauggcacuuucauugggagugaaauugauaugguuuggguccuaugcuaguucuuguuccuuaaguucuaauucuuuuauauucccuuuuauaaaaguagacugcugugucuacucaguaggcuuucaggacugcuaauugaaugggaauguaacauuuauuuguucauucauguuuuuuucagcagcccuuugcugaaugcuuguuuaugccaagcaauaugguagacacuagagucccagaaagaggauacgaccccugaucucagggagcauguagcaugauauggggaagaggcgcaagacacauuguuaaaauacgcagcguuuaaaguuuggggcacagagggagcgcauaggagguaucuuacccaacugguguaggugagcagagacuucuuugaagaggacuggcugagggccacaugcucuacagaagcucagcaaguacacagagcaugaauuguuggaaguuuguggaugguuagguuggcugggauguaggcaauguguaaggaauugacuauaccauauauaaaaauuagcucucagugauucauagaaucuaauguaaaagucuacaacuguaaaacuucuagaagaaaauacaauagaacacgggcuaggcaaagacuuauuagacucaacacaaaaagcacaguccauaaaagaaaaauugaucaauuggacuucaucagauuuuuaaaauucuguucuuuaaaacuauacagaaaaugaaaagagaagaaacagcauggggaaaaauguuuacaaggcacguaugugauaaaggacuuguguccagaauacauaaaggacccucaacacuuaagcugggcaaaagguuugaacagacacucuaccaaguacauacaguucucaagcaccuaaaaaaugcuuagugucuuuagucguugggaaaccuagauuaaaaccacaggagcugccacuaaaugccuauuagaaugucaaaaacuaaaaagauugaucauagcaaguguuggugaggaaauggaagaacugaaacccuccccacugcugguagaauuaaugugguacagucaugugagaaaauagugaggcaguuucuuacaaaguuaaacagaugcugcccuaugauccagccauuuccuuccuagaucuuuaccuaggaaaaauagaagcacauguccauaaaagacgaauauucauagcagcuuuauuuguaauagccaaaaacuagaaacagcucaaaugccaauaaaaggaaaauggauaaacaucuugugaauacaagggaauacuuagcaauaaaaaguaacaaacuagugcuacacacaacaugaaggcgucucaaaguaauuacacaaaagaauagauacuguauaucgaguccuagaaaauguaaacuaauaucuagugacagaaagaugagagguugccauauaauggggugcaggguuuauggaagagggaggaacugcaaagugguacaaggaacaagaaaaacauucgggguggugaauauuuucauuauuuugauugugcuuauggcuucacagccauauauguaugucagaacuuacauuaaauaugggcaguuguaugucaauaaagcuauuagaucacuggggaagaaagaauuuagagucacuaacuuuucaggggguuuuuugcuuuuuuuuuuuuuuuuuuuuuuuugagaccgagucuugcucugucaccaggcuggagugcaaugacauaaccuuggcucacugcaaacucugccucccggguucaagcaauucuccugccucagccuccugaguagcuggaacuacaggcauguaccaccaugccuagcuaauuuuuguauuuuuaguagagacgggauuucaccauguuagccaggauggucuugaucucuugaccuugugauccaccugccucagccucccaaaguguugggauuacaggcaugagccaccacacccagccugacuuuugaguuuuuuacuucauugaauauauauauguacauauauauauauacacacacauauauauauuuauguaucuuuuaaacauauaauuacucucuuuaauucauuuggacuuuucaucuaaacuugcucuguuugcacaguucuguuagguaagauauguuccuaccuugagaaauguugugaauaucuagcgaaacaccaaacauccucagcugacuaaugugguaucagacuuucugguugcaagguaggggugaauaaggcaggauggggugcggggguggugcuggaagaagacauggcaucagguuggguuuugcaggauacugaaauugucuaggggccuuggcugugcaaagagccuuuccgucaaaacccucugcaugagccacagucagcacguaguuugcacaugcccaccuccaagguggcacacagcugcucucuuuugaguaacagguuagcccaguuugcugcagaccagagucuacuuacaaugaggaggcugcucucacagggucaagagcacaggcucucgcuaaguacuauguuuacccucccaucaccaaaucugucccagcccagaugucaccuggcuaggaagcgcuggggaguauuuagcaucuccuuaugacaauccuucaucaucaaacagagacaguugccaaagauacaguguuuuccuuuucauucuaucuuuugaggagaggggccccucuguguaaccugugaagacuaguuuccuugacgaugcugcucccuuccucuccaauccaucccuuucccccuuacgccaacccuccugaugaaccuuuuccccagaggagucucuuuggggaccaggguaugccucccaugcauguugucuucuaacagcuuguguugacuccuaacuaagcuggcugauuucauuacaaccagcucacaccuugguugcagugauuucuguggccuuauuuauauaaccauauaucucaucacucuuuauauuguguauuuaaguaccacuccuuuuuuaaaacuaaaaaucuaacagcauuuauucuccagaagaccaaccaacuuguucauuuccauuaaaaaaaaaaaaagugugacuagcaaaaauguuuuaugccagaaauaguuuuaaccauacugacagcaacuaaaaccaagaaagacgagguguaaaguggggugagggaugguaagcauuuguuggguuucugauauguuccagccaccauacuaggugcuuuaugaaugugaucuggcauaucuucauccacacacuuuuaggaagcuguuagugauguucauuuuguaccaucacaaggaaacggaagcuuggagaggcuaggcucugccugugguuccccacagucaggaacuaaccagaaggcgggagacuugagaccuuggcaccaggcuguccuaccuccccagccaggggauucauuacaauuaaaugacagcuacuuccccaccuccauuauauacccaagcagugcucagauuaaaugggggacugggaggaaaaauagaagccacuugaucuuugcgugugugcugauuuacagaucaaagaagguuacaggaaguuaggcuaacacccuuguugcagcauuucccccaaauuucacuaaccauguucuaucugaaucuugaaauguggugagagguuccuuccaguuaaucagaagauauugccucuaagacccuguauaaaaaguauucaaagccauuuauuucucaacacagagguucccauggaugagugcacccauucaaguuggguuaguuggcuucuggugaguagaaauuacuuuuacauaauuaauuucuuuuaaaauauaaauacacagcguaugaaaggugacuggguaauaugggauacaaauuuugaaaaugaggccaucucagaacaucuggaaugcauggccccaaauaauuaaauagaaguaaacugucuuuagagaaaccuacaacauggggggcuauucgugugauucuuuuuuaaauuguugucucugugacuuuuucauuauuuuggcaauccuagguaauaaaacuuacacaaacaggacuuauuuuuguuagacaacacagaacguaaugcucugaagaaagaagggauuguuauaaaaguaaaauagaaaaauaagcugaaaauuaaccauuuaaaauggucugacuuuuuuuuguauuuuuuuuaaguuugguguuugcuacaccccuguguugugcccuguuuccucagaaaagguauguauuuguuauucgucagaaucaucaugaguauuaauccuaaaaaccaauugaaggugcaggugccauuauuccauuucauuggcagggaaguugagacucaaaagauacugaagccagggucucuuaaaaggaagggauggaggcagaaaucaaacccacaucugucuaauuucagaugcacccagcucuuuucuacccccuuccauuaaauuugaaaaugcuuuauucuuuugugagaaucagauuaacucugaugcaaauuugcuuuuaugaaaauuuaaaauaugguccaauccacuggcaaaugcaucuguaauacagauaugauaggaugcaaguuccacccccagggacagcaauuauaugcacuuagcuuaggugguugguauauuugcuuccuuucuucccacuuaguuuuuugccuuaaaagcuuucuugugcacgccucucaucgcaaacugcccuugaauccugccuuugaugugagaacaggacuaacuggcguuaaaucggcauuuucuacaucaggucuccagccugcucuugaccugacuccaacacacaaagcagcggcauuuuguugucugucauuuucuguaaguguuaccaggccccuugccuugguaauacccuuuccuuugugggccaguaggucccgaacauauggucuuuaaucccccagccuugcggaguugguuuuggaugagguguucuguucuagaacuaaugcugucagaucccucuaccugaucgagaacuccaccuuguaucugcucucccacucugucuccgacccugcuguucuugaauagaaauuuaaaccucauggacaggagcccuucaucaccuuggagccuacugaagagccccccuugaagagggcaggaccuucagaacuugcucugggagccugauucagaugaauuuccucaucucuacagugggauaaugauaccugcuuaauuguacaaaccccagagucuuggggcucaaccugagaauguccauuucuguaguauguggcuuaugaacacugguguucagcagcuggccuugauuuagcaguuuagacuuugagcacauaaaaugccaaggggugugccugauaccaaguuguaaaacaccuaagaaauguagcuguaauuauuuucagauugaaaggguuuuagauuugaaaacccauagagaaacuuucuacuuuggccuuuuuucuuugagugcugcaagaaauaaaauauagcccaacauuuauuuuuuaugauucauugaaacucuagggguagaaauggaaagcuuucuguaacuacuaguguccuuaggucaaggcccucagaaagcgugugguuuuacauuugagaaaccaauccucuuuuguuuuacuguauuuuaaaauagcuucuuacucuguuuuguuguuuauacauuguauguuuggcuucuugaggucucuggcuccucaguuuuuccuuggcucauaacauaguauccucauugauccaagcaugacccuguuuugcuuauuuuuauuuuacuuauacuaauaauauaaugaauauccacaaauucagugcccaaugaggcaggagaaucgcucgaacccaguaggcagaggcuguggugagccaagaucacgcuacugcauuccagccugggcaacagugcgagauucugucucaaaaaaaaaaaaaaaaaaaaaaauauauauauauauauauauauauauauauauauauauauauauaucuccaauaaguuacaucuuauaggcuccucccaaccugugucccugccuccccugcagauuuaaccacuaugcugaauuucaugcucuugcauuuuauauuuguguauguaucuuuaguuugucuuaggaacuuuuuagacaagggugucacacugucauaagauguauagucuucuaguacuuguucuuuuuauucagugucagaacuaagauucaucuacauuauuguguguaccuauaguccauucauuguuguuguuguauaauagugcauuguaugaaugcaccacaguuucccgucuccuaugugaacaagugauaaugaaaacauucuuuauuaacauuuuugagaagcagcaaauguguugcuuugagagauauuuauagcuuuaaauguuuauauuaugaagaauagcugaaaaucaaugcacuaaaugucccaacuuaaaaaaaaaaaagcacaaaagaauaaacaucagaaaagaaggaaggaaggagaugaagaucagaaaucaauaaaauaaauaacagaaagaguagaggaucaacaaagugaaaucuugguucuuugaaaauagaaacaaaauagacaguugucuggugagauuaaucaaaacaaaaagagaaagagaaaaguacaaauaauaugaaugaaaaagagguauaacuguagguucagcagugauuaaaaauaauaccaacauuauaccaacagauuugaaaacaagcaaaauagacaaauuucuggaaaaaauauuagcaaagcugaaaaauuagaaagucagaauaggccagauagucauuaaggaagcugaagcagcauuuaaucuuccuccuacaaagaaaacacaagaaacagguaguuuuacagguaaguuucucccaacugucaagaaacagauuauuccaauuucaaacaaacucuccuggaagauaaaaaagagaauacuccccaucauccaccaagguuugaauaacuuuaauuccaagaucagacuugggccuuuaacauacauucauaguaauuacagauacuuagagaucaguggcaaaacagaaagaccaagaggugguauagcagggcuuugggaucaagaaagaucugccuucaacaucucaguugcaccucagguuuccuuaccuguacaauuauaauacuggacuuacagaguuuuccuaaggguuaaaaugcauaacgucuggcccagcaagugagcuguaagucauagccauuaucauuaccaucaucagugucgucaucaucauuuaaaaucacucaaaggcccacuacauaaacaauagccaucaugggauuuuuuuuccuaccuuuuuucuauauucguaauuuuuaaaauuuguuuugcauauuuuaaauauaagcuuauauccugacuuuuuuuaaccuuacagucuaucacaugucaacuauauuaaucaauuuuuuuauuguuuuugaggcagggucucacucucuugcccaggcuggagugcaauggcacagucauagcucacuacagccuugaacuucugggcucgagcaacccuccugccucagcauccugaguagcuggagccacaggcauacaccaacacaccugucuuauuuuuuauuuuuauagauacaaaaauuugggucucaccagguugcccaggcuggucucaaacuccuggccucaagaaauccuccugguucagccucacaaagcuccgagauuacaggugugagccacugcgcccagccucaaauauuuuuuuuaaacuaauuacauaucaaaauauuagcaguuuuucugguagguauucuggacaauuuuucuuuauacuuuaaugagugugcguuucucuuaaagaauaagcuuuaauauauauacacccauaauaccuucaaauacauuuuuaagcacuuaaagacuaacagugguuaucucucagcgggauuauaaauguuuugguuuuuuuuuuuuuuuuguacauuuuaguauuuuuugaaauuuuuuuaauaagcguguauuacauacaguaaacaaaagcacauuaauguaggcagauuaucaauguuaugcauuucacugauugcauaucucuuuuuuuaucaauggugaacauugcaaaugauugauacguuuuucuuaggaaguggcauugccacaaaugguuuuuccaacaccagcagggccugagagugucaucaccauacacucuugccggcaauaagagauuucaccuuuuaaugauaugagagggaaaaguuggguguuggguucuccagugcauuucuuucauuaugagugacauuuuucugaaaggaacgugaucucguuuucuagccgcaugaagcauuucuccaacaagacccacuguaccaguccugggaucuccacaccugugccuucucccugcucuuucuagguccugauucucaccucugccuguguaauaacccugucauuucucccuuaucccaguuccaugucugugacaagcuuggaggccgaguugcaagcuaagauccaagagagccauccugaauugcgacgcguguacuucaauaagggauuguaaagcagggaggaaaccucugcagcucauucugccacugcaaagcugguguagccaugcuggugagaaaaauccuguucaaccuggguucucccaguuacggaaaccuuuuaaagauccacauuagccuuuuagaauaaagcugcuacuuuaacagagcaccuggcgugggccaagugccugauacucccuuacacugaaucauguuaugauuuauagaaauaccuuuccuguagcuuuuauagucauuguuuuucaaagacgauauaccagcccucacccagguuuuaaaaaagcacugguaggcauagaauaggugcucaguauauggucaguaaauguucuauugauuaucaaucagugaaaaaagaaaucuguuuaaaauacugaauuuucaucucacucccauugcaaaucaaggagaucucagcagugaacugggaaaauacaaaagcucugggcuaaucuauaaaaacuuacccugaaauauuaagggcaguuugcuucuaguuuggggauugcgcuagcccaaugaaggugaugaagcuuuuggauuuggaggguaaaagcuccuucacaccccuuccaaaagucagucacagaccacugcaacaugccuucccugcuggaucauuauauacauucagauugugaguggauugccuugguugacuuuuaauuuauuguuuuuuguucuuauaaagaugauaaucuuaccuugcaguuauugacuuuauauucaauuauuuacaucaaauaaugaaauaacugaaauguacaaaugucaaauuuuggaaguauauucaauaccaaugcuguaugagugggcugaauccaguucauuguuuuuuuuuugguaagaagugagacuacaguuccagcuaccuacaugucuuuucuugucauccuuauagaucucuuuggcuuucagaaagauacagugauaauguguguaugaaucagucacaaugaauuuuacuugaauauuguauguugcauuccacuucauuugaaaauaaugaaaccauguaccacuguuuacaucaucuguagugauuucauagauaauauauuuaauaugacagauuauguuucaacucuguagauguuuaacgucauagacaguuggcccucuguauccgugagcucuauaucugugaauucaaccaaguuuggauggaaaauuuuuuuuuuuuuuuuuuuuuugagacggagucucgcucugucacccaggcuggagugcaguggcguagucucggcucacugcaagcuccgccucccggguucacgccguucuccugccucagccucucugagaagcugggacuacaggcgcccgccaccacgcccggcuaauuuuuuuguauuuuuaguagagacgggguuucacuguggucucgaucuccugaccucgugauccgcccgccuuggccucccaaggugcugggauuacaagcgugagccaccgcacccggccugaaaauauuuucuaaaaagauaaaaaauauacauaacgaugaaaaauaauacaaauuuaaaaaccaauacaguauaacaacuauuuacauagugcuuacauuguauuagguguuauaagcaaucuagagaugauuuagcaaguauacaggaggaugugccuagguuauaugcaaauacugugccauuuuauaucaggaacuugagcaucugcagauauugguaucggagggcgguccuggaaccaagcauccacggauacugaggggugacauuucaugaaguguagaucauuguauucagagauuguaaaugaaaaaaauauagaaacuauuuaguuuugguagauuuuuuuucugacaaugugaccagacugaauuuccucauaaagaaaaaauggcgugccuugugucuguguuucucuuuucucugaaaggauuaauagaucugaagcuuugggccacucagagccuuccuugaugcugccagagucuucuuauuuagauuuucugucuuaaaccauuggaagcaaaacgguuuucccaugacauucuggccuuggacagauucuguuguccucgacgcgucucuuuauaaagugguaaaagccugaaauucagggcagcucuccaugaggugcugaagggcucuuuucauaagaagcuaaggcacugcugccugccccaggugucccgcuccucucagaguccucccccuaccagguaguguguagcuccauuucagaauguuaaccuccagugaagagcuaaugacugguuagaagauugacaaacuaaccaaaauuuuacacacuccgguuaugugugugaaagguuauaaaaggaauggccgggugcgguggcucaccccuguaaucccagcacuuugggaggccgaggcggguggaucaccugaggucaggaguuugagaccagccuggccaacauggagaaaccccgccucuacuaaaaauacaaaaaauuagccaggcauggaggcacaugccuauaaucccagcuacucgggaggcugagguaggagaaucgcuugaauccgggagcuggagguugcagugagccaagaucgcaccauugcacuccagccugggcaacaagagcgaaacuccaucucaaaaaaaaaaaaaagagauuauaaaagggaugaugaacauggagcugcaucuuuuuaaacguuguuuuuugaugcuucagacucuuaaugcuuuuauauaaagcuaucaacuguauguugaucacaguuuauaagaaagaacaaaucaagauuggcaauccuugccgaucuuuuagaaauaccuuuucuggagaaaaaaaaauccacaugaagugcaauaagcuuauaaagcuaaguaguuauuaauauuucuauuaacaugauacaaaggaugaugauuguaaguguuuacugacuggcagcuuuuauuucaguauuagcacagcgucuugccaguguuggaggccauguauuauuucaguucaacuggaugaaauguuaaauaaacucagaaugaaaauaaauuc

SEQ ID NO: 17297 - RNA, 8336 nt, Homo sapiens
uagugcgggacugggucugggugggugggcgcggccgcagcagucgcagcggggccaucuucggcgggcgagugggcucggccugugcaacccgcaccugcgucccucgcccggcccgauggcgccgcggccgcugggccccuuggugcuggcgcugggcggcgccgcggcggugcugggcucggugcucuucauccucuggaagaccuacuucggccgcggccgagagcggcgcugggaccggggagaggccugguggggcgcggaggcugcccgccuccccgagugggacgagugggacgugagugccgggccgaggccugcggaagggcgggcaggcugggcugcgacuccgcgcauguggccaaggggugugaccacggaacggcccugcuggugccgggagcuuggggggucgagggcuuggcagccgcagcgcacaggccccgcgcgggugggcggucagagcccgggaaccgaggaacgggugggugugcuugggugcgugcggcgccuuggcgccacgccgucgcuccacgccaugaggcucggguguuccagcgggggccggaguuuggagggcgcggcucgggagcaucccggggcccagccgggucggcucgcgccccuccggcgccugcgcagugcaccccgcccggggguggggaugucgggagaaaccccauccccucccgccugcggucgggacuccgagaccgguggaggaagcggggcgcgcgagcguuuaaggaauucgccaaggguuuggaauucaggacugcaaaggcggcguucgucccacucauccagaccaugccugccugucccaggacggguggaaggcgggccugggcccucuggugccuucggucuucccucgggaaagguccuucgggaggccgccagccgcaaccuuaccuccgcuuccccgcagcccgaggacgaggaggacgaggagccggcgcuggaggagcuggaacagcgcgaggugcuggugcuggggcuggauggcgcaggcaagagcacguuccugcgcguguugucggggaagccaccgcuggaaggccacauccccaccuggggcuucaacuccgugcgucugcccaccaaggacuuugagguggaccugcuagaaagugagcggacacccuaccccaucuccccgucuccucuacuggaccaguccuggauucucugcagggaagggggcuuccaaaaugcaugucuaagcagcacauuccccucuacgaauccuucccaccgcucuccggggcacaggauucagcccacgcucugugcucugacauuuagggcccuucgugaucgggccucuccagcugcaccgccugccccaucaccccuaccaaagucgauaggccuaacacagagauacuaacagcuaaggguucauaugccaagcacuugacgggcauugcuuaagaaaacuccccuaaacaauuacauaaaacuagaaucggucacuacccucguuaucuccagaggaaaaugaguuccagcaguaguaucaugaauccaaggucacccaccuuucuagucuuuuuuuuuuuuuuuuuuuuuuugagauggagucucacugugacacccaggcuggagugcaauggcgcugucucggcucacugcaaccuccuccucccggguucaagcgauucuccagcuucagccuccugagcagcugggauuacaggcgcccgccaccacgcccggcuaauuuuuguauuuuuaguagagacggggguuucaccacauuggucaggcuagucuugaacuccugaccucaagugaucugcccgcuucgaccucccaaagugcugggauuacaggcguaagccaucgcaccccaccauucuaguuuuuuuuuuuuggagacagggucucugucgcccaggcuggaauggcagugggcaguggcacacccuccuccacuauugccugucuggcccaaacuagugucaucuuuccucucagcaccacagccuccucuuuggucuuccugcuuccccuucugucccuagugucagcuagagaaaacccaugucagguaaugucacucuugcuuaaagcccuuggggggcuccccacccccucacuguggucuuuggccccauguggcccgccccagccagccucacagccaucucuuucuccuucuugcagugccucagcaccccagccuucuuucuguuucccagacacuuccagcaugcucuccccucugucuggaaugcuuuccucugccucuucccauggcuggcuccuucucaucaucccacucagcucacaugccacuuccuugaugagaccuacccagaccacccaauccagggccaaccccuguuccaccucagccacuuucccuuuuuucuguuuuauuucuuuccuuuuugaaauguguugaugucauugccauguccuucccaguuagggagggagcuccuuggugcagggccccugcuugccuugcucaccucuguaucugcagcacccagaucagugcuuggcaccuagcaagcacucaguaaauauuuguugagugccugcuaugugccaggcauugugcugagggcuuuguggggauucagagguaagugccucugacucucacagcuuagaauccucaagugucagaaacauagccagaaacacuagggugcggggugaccaaugggacugugcagaggagcagagaggaaaagaaaggugauccaggcugggggacuguguuggcaaccauguguucauaggaugaaauaugacauuuccaagggaaaagaaggggaugggggaaacugaauggagaauggcuguguauaggcagggcaggggguccugaguuuucuagacaauaggacuccuggcuccugucacagccaucacugacaguuuugaaccuguaggagaaagcuaggaauuagcaagaggcaaagccagacaacccaggggagagaacugaagacuuccauuuacugagcaccugugugucagucccgugaaagguacaucgcacgugguaccuguggguuuuacugcaacaacccguuaggaaaguucagugaggagacuggugcuuaaagcuagggacuugccccaagagacccgccuaucagagcuagagcuaaauccagucugaguagcugcggaaacugcggucuuuuccuugcccccggcugguggaagcucacuaagcuagaagcaggguggggugggggcugugggcagugagcgggggcccgggguggggugggggcugugggcagugagcgggggcccgggguggggugggggcugugggcagugagcgggggcccgggaggcucugagcuggccccuggccucuccucaguugggggcagccagaaccugcgcuucuacuggaaggaguuugugagcgagguggaugugcugguguuugugguggacucggcugaccgacugcggcugcccugggcccgacaggagcugcacaagcugcuggacaaggacccugaccugccugucgucgugguggccaacaagcaggugagggcugugagagggcagcucgguccaggugacauccacucagagaugcuugggcaggggcaaggagcgcugccugggcccauggccuggagaggguggcugagaugcugcccccaccucuucuaccuaugcccuguccugaucccugccucugucuuccuuccucuuugccucccuaucaucucguacucuggagagaugagaaaaauaauuauuaagugccuccuauaugccaggcaugguguuuuguuuuuguuuuuuuuuugagacagagucuuguucugucgcccaggcuggaaugcaguggugugaucucggcucacugcaaccuccaccucccggguucaagcaauucuugugccucagccuuccgaguagcugggauuacagguaugugccaccacacccagccaauuuuuguauuuuuaguagagguggaguuuugccauguuggccaggcuggucuugaacuccugaccucaagugauccgcccgccucagcuucccaaagugcuggaauuauaggcaugagucacugugucuggcccccaggugugguuuugaauaacauuucuucuuaugcuucuguugacccuauaaaguaugggaugcuauucccauuuuauagaugggacaggcuagucuuauaaucuuuccaagguuguacaucuugagaguaauagaauugguccaggcgugguggcucaaaccucuaccuccaacacuuugagaggccaaggaagguggaucauuugauuccaggaguucgagaccagccugggcaacauggugaaacuccgucucuacaaaaaaaaugcaaaaaauuaacugggugugguggugccugccuauagugccagcuacuuuagaggcugaggcagaaagaucacuugaacccaggaggucgaggcugcagugagcugugaucacacuacugcacuccagccugggugacacagcgagacccuaucucaaaaaaaaaaaaaaaaauaguggaauugggacguguaaugcuaaagcuguaccuuuuccacucugcuaugcccuugcaaauucuggcucuagaucagagagcugaagcugguaacugaugagagguagaacagguuaaauaacagcuaacauuuauugugugcuuacggugugccauacaugugguaagcaccugacaaucaugaccucacuucccucuaaauaccucgugauaggcccugcuguuacacuaaauaccuggaguugcagcuggcauguggcaaagcccaaacuugaacucagauauucuucaaaguuccuccucuuaaccagugugcuguaccucucuugggugccagagagucgccuugggcccaggaacccucaguaucacagaccuugggucccauucucaauaucaggugaaacugccagaguacagagucugaucauauuuccuguggccuaaacucaggugccucugagagcugugggaccuguuuccaacuugacauggagagagacuguaugucuucgaccucagauuccccaaccuauuaggaaacauuugacaauuauuuauaaauagggugacuguauguccuuuucuguccaagacaguccccauuuacgacucuuguucuggcacuauuaauagugcccgcucugagccucagauugccccaguuuggaccaggaaucacaucauguccuauuuauaaacuaauuuauagcaguuuugaaccuguaggagacaacaucuaaggucccagcagucucugaauugcuccaggaagaaucauuuaaaucuugggccaggguugaaauuacaacauaccaucaccagucaugcuguguaguggucccuuguuuuccuccagcuaguuucuagaggucuugucuggaagugauccuacuguaucaucucuccaugacugaguuuaggaaacuugguuaucaaaccaaccugaguuggcaccuggcucuaccaccuaucacuguuaccuuagcucaaugaugucaccucccugagcuacuuuucucaucaauuaaguguggacugugaacauuaaauaagcugaaguauauacgggccuaucuacaaugcuugacacauaggaagugcucuauuucuagccgggcgugguggcucaugccuguaaucccagcacuuugggaggcugaggcagguggaucaccugaggucaggaguucgagaccagccuggccagcacggcgaaaccccgucucuacuaaaaauacaaaaauuagccaggcgugguggcucacaccuguagucccagcuacuagggaggcugaagcaggagaaucgcuucaggauuccaccacaggagguggagguugcagugagccaagaucgugccacugcacuccagccugggugacagagcaaaacuccgucucaaaacaguggcuaaugaugcaaugaaaagagguugguacaaaggagagcccagggugagggagagagcauugaguuuaggccaagggguccagaggcuacuucugggaacuuggggccugauauucccggggauagccuaagaacaguguguuuccugauauucccggggauagccuaagaacaguguguuuccugauauucccggggauagccuaagaacaguguguuuccugauauucccggggauagccuaagaacaguguguuucaugaacgacaagggugucaguguguuaggaaaugcugccagcuguguucggacuucugugucucacccaggaccugagcgaggccaugaguaugggggagcugcagcgggagcugggucuacaggcuaucgauaaccagcgggagguuuuccucuuggcagccagcauugccccugcaggacccaccuuugaagagccuggcaccgugcacaucuggaaacugcucuuggagcuccucuccuaggcuggagcucuccugcuugccaccugccugucaagaccauaguuguacugcugcugcuucauugccagacugggccuggggcaagagccacauggcagcauuucccuuuuccccuccuuugccuuucaagagcagggccugggcaaggccaagaaccaugcagaagccuuccuggugagguggccgugaagccgaagcagggaggugggugagacagaggguggggaggauagugucuggcucauuccaggcuggaauguggauccagcuuucccuucucuuaccuguacagugagaugcucagugggcucaauccuccacuacaggucccgguaccugaggaaccaguguaggugucagaaauacuccuagagccucaaggucucccaguccagaaacagucuggugacgucaugcccuucucaugugggcagcuucugaguggugacacagcaagccuuuguuccuguccugcauuguccagccccagcuccaccuaagugacuuguggccuugugcaaucucugccucucugaccccagggccauuauuuuuaaagggaggugguuuccuaauucggagaugccuuucccagccaugggagugugaagugcuaggaugaaccuggccauccuagcaaggagcuuucugaagaccucccugccuuucccugagcccaggccuggccugccagccucucuugacuacagaauaacugauauucacccaccaaacagaaaaagugaaggcuggguuuuuccccucuaaucuggagacaagcugcugcucucguacuaacugugccagugcccauguuuacagaagucaggggaaggaaggagccugugucccugggacgacagucaacuggagcuagguguugaccucagaacugcauuuuauuuauuaauuuauaagcagaacaggccagaguucuaggcucuguuucuaggugcuguuuucaaaaccccagaugacagucauagaaaauuuggaacuuaggaaaauagcuggaaucaugaaugacaaugagauaacauacagaugucaguggagacaaaguuguggguuccuccucccaccuggcuuugaggcugucgucgauaucauaguacuuuacauggauucacaugaacugaaacgccaccacuuggcccaggauguugaaagggugcaaauuccuucuggguagauaagaaaugacucugggagaggauuucccuuaugugaaucuagguaaaaagauggaaaaaaauuguauuaugugauccuaaggacaggaauagcagaccagccaacgggauggccuuggguacaucacucagccuuucuggacccaauuuuuccccagugaaagccaaguuggacugaauuucuggaguucucaucagugcacauuccauaguucuccagugcuuggcgaucagcccaauugaaggacuggcucuguacugacacuuauuaucgguacaggcaaagaggagccuguugucuguuagggaccacuaaaucaacaaccacaaauggauuuuuuuuuuaagaggagcugugcaccucaauuugcugucuaguugagaauagagauugugugccuucauuucauuugacauuuacccagcaugccucaguuccacaccgugaccaguguaagaagaggaacuaugauaaaaacaguucaacaagccgcaaggagggugggaaauucugaaguccagaagcgagugugaucuuuggaauaguggcugcugugcccuugggcgccauuugaagaaucacuguucuugaaagugcugguucacuuucugcaguaagaagugauuuaugggcuuuuauguaaaauuuuaagaaugacuuggguuucagaguagccuuugaaacuuugcugg

SEQ ID NO: 17298 - RNA, 997 nt, Homo sapiens
caccgggaggcugaggucggagucccgauuuucuccugcugcuguggcccggacauggcgacucccggcccugugauuccggagguccccuuugaaccaucgaagccuccagucauugaggggcugagccccacuguuuacaggaauccagagaguuucaaggaaaaguucguucgcaagacccgcgagaacccggugguacccauagguaagugggugcgguaggaacugcacaaggagaggacagugaugucggagggaaggaaguagagaaggaccagagcgcuagcggggagcggaaggagagcggacuagagaagagacgagggggcggggcggugaggggcgaaacugauuggagcgggagcagcggguuuagggggcgggauuuggggccuaagauugggaggacucuguaacuaggaagaccucgacucgaccuacccucgccgcccucccuccgcugugauccagagaucuuggcuuuggggaagcgagacccaaagcggggaaugaccugcggggcccgaccugcuguuucccaguugcuuuguccccuccucagguugccuggccacggcggccgcccucaccuacggccucuacuccuuccaccggggcaacagccagcgcucucagcucaugaugcgcacccggaucgccgcccaggguuucacggucgcagccaucuugcugggucuggcugucacugcuaugaagucucgacccuaagcccagggucuggccuugaaagcuccgcagaaaugauuccaaaacccagggagcaaccacuggcccuaccgugggacuuacucccuccucuccuuugagaggcccaugugucgcuggggaggaagugacccuuuguguaacuguaaccgaaaguuuuuucaaaaauccuagaugcuguuguuugaauguuacauacuucuauuugugccacaucuccccuccacuccccugcuuaauaaacucuaaaaauccacuuguauuuaau

SEQ ID NO: 17299 - RNA, 997 nt, Homo sapiens
auuaaauacaaguggauuuuuagaguuuauuaagcaggggaguggaggggagauguggcacaaauagaaguauguaacauucaaacaacagcaucuaggauuuuugaaaaaacuuucgguuacaguuacacaaagggucacuuccuccccagcgacacaugggccucucaaaggagaggagggaguaagucccacgguagggccagugguugcucccuggguuuuggaaucauuucugcggagcuuucaaggccagacccugggcuuagggucgagacuucauagcagugacagccagacccagcaagauggcugcgaccgugaaacccugggcggcgauccgggugcgcaucaugagcugagagcgcuggcuguugccccgguggaaggaguagaggccguaggugagggcggccgccguggccaggcaaccugaggaggggacaaagcaacugggaaacagcaggucgggccccgcaggucauuccccgcuuugggucucgcuuccccaaagccaagaucucuggaucacagcggagggagggcggcgaggguaggucgagucgaggucuuccuaguuacagaguccucccaaucuuaggccccaaaucccgcccccuaaacccgcugcucccgcuccaaucaguuucgccccucaccgccccgcccccucgucucuucucuaguccgcucuccuuccgcuccccgcuagcgcucugguccuucucuacuuccuucccuccgacaucacuguccucuccuugugcaguuccuaccgcacccacuuaccuauggguaccaccggguucucgcgggucuugcgaacgaacuuuuccuugaaacucucuggauuccuguaaacaguggggcucagccccucaaugacuggaggcuucgaugguucaaaggggaccuccggaaucacagggccgggagucgccauguccgggccacagcagcaggagaaaaucgggacuccgaccucagccucccggug

SEQ ID NO: 17300 - RNA, 24892 nt, Homo sapiens
cucccgccgcggcgcccgcaccgcagugacagccagccgggcccgguggcggagaggaagugcgguccgcgccaagcccguccccgccgacgccggcucccccgcggcucgggugacagcgucgcggccgccggacgcagcgcggggcaggcgcgggcagagccgagcgcagcggaggcuccggcggaggcgcggggaaaauggcugaugacuuuggcuucuucucgucgucggagagcggugccccggaggcggcggaggaggacccggcggccgccuuccuggcccagcaggagagcgagauugcaggcauagagaacgacgagggcuucggggcaccugccggcagccaugcggcccccgcgcagccgggccccacgagugggggugagucagcgcggggccuggagaggggcucagggcgcgcacccgggggaccccggccggggcccaggggcacagggaagagagccugcucuaggccacccggggcaggagcugggagacguggggaagaaucuucuuggagaucuccauguaggacuuccgagcuggggaugaggccucgccuggggcuguggaucuggugacucccgggacaggaauucggucaugacauuucauccccaggccagcuuccccacugcccggcucuggaauccaaccccaccucaguuuugagagucccuccugagccuccuaauagccugggugucccaggcucccagcuaagugugcaggugugggcagaacacagcccuccuggccccucaggcuuagcucucuccugcagcugggaaaaaagaggauccugggugcuccaggaacucacuaaccuuccccggugaccgccuggcauucggcagucgcugggcuaagcgccuugguuacauuuaaucacuucauacacgugauugaacccauuucagagaugguaaaacugaggcucaagggaguaugcuauugaaauaacuaguaaguggcagaucaagaauuuaaaccuguuucuuuuucuuuuacauauauauuuuuucuuuuccuuuuuuugagauggggucucgcuauguugcccagacuggucuugagcuccugggcucaagcaauccucccaccucugccuccuaaaguguugggauuacaggugugagucaccacaccuggccgugaauuuaaaccuguuccugucggacuugaagcccucuccaccugaccacacugccuaccaagugucuggcucugaguuagacaccggagugugggccacaaagaggcaucagucagaugcgguagggcccuucaggguuuuguaguugucgacuuaaugguuuuccaaaggugguccggggcuauuaugauuuacugugauuggcuucagaccucaguguucagggccuagucccugugaaaucaucuuuaucaaugauguuucugcccugguucuggcuagcaagaaugauuuuguaaaauauuuaguaaaaaaguagauaucaccuucauggguacauccaaaacagguuuuacuuccuguugaugucauuuuggaaagguuuaugggccuguuguaguaagugcuaacauauauacauauagacauauuuugguuaaugauguuuacaaggcucuucacagucauguuuguauccauucaacguuuacugagcaccuacugugugucaggacgcuggggauacagaaaugaauaagacaguuccuguggcugaggaguuugaagcaacucuguaucuccuugauaugagaaauguaaccaggcuuuuguaacaugcaagaaaccgguggcccagagaaucugaguaucuugcccagagucacacagccaggaaugaccaaucuaggacuugaucccacgccucccaacucugggcuccaugcucuuucaaaugcuguggagccugggcaacauggugaaaccccaucucuacaaaacauacaaaaauuagccaggcaugguggcauguagcuguaguuguaguuccagcugcucgggaaggcugaggcaggagcauagcuugagcccgggagguguagguaggucgccgugugcugugaucacgucucuguacuccagccugggcagcagagugagacccugucucaaaaaaaaaaaaaaaaagauucuauagcagucaccucccuggcaggagauaggauguggggugagaagcauggggucuuuugccaccuaucugagacagcaauggagggcuucugaaguggaagcuuccagcaccucaauacagaaucugccgugucccagggaauuccuaagaaaugccugccccaguuaaugcaccaguauucacuggaccacaccucugugagaccacccuuuuccucagucuggcucacuggggccuguuggggucggggugcagggaagaggagggaggccuuguggggagguccugcugaggggagccauugugagaaccucaggagagaaaagaugggauucaggcugagggcagccagaugccugagggagcugagcagguuguggccucucccaggaugguggggcuccagggacuuacagucuggauggcaaguucuguccuuggcagggguggggcacaaauuggccucagaccagaggugacagggagagaaacaaugacacgcucgcuucuuccagggaggugccggggauacagccuucugagggucucccaggcgcauaccugcugacucugcaaaggcucagcugcccuccuuaguuggaucggggagcagggagguguugagggauggcggcucaguggauggccagaugggcuagaauugaucugaccuucucagccuaugcagugcugaacagguaaucuuccccugaccagggaugugugccaggagccuggauggggcagagaaaaagcgcccuggccugcugagagcugggcaaaagcuggcuuagcagcggccgccagucaguaccucugaggcaccuucucuuagauguugggguccucagauuagcaaucucugugcugacacugggcucaguugccccuggggaaagagguaucugguguaggccugugcuggagccacagggagccccuccucucuggcuggaucuguggcccugggugaucuggaugauggacacuuuguuuccauucaucagccuuggguagguuuccauuuucacacccaguuuucugagcaccaggccuggcucugacuugccugucaguucugggcaagcccauuucccccgcugggccucguaagcucacaggaauguucuggacccucucugcccuuguuccaaaaugggucaggcagcugagggaagcaaacccucagggguuuaucccugggacgugucucugucucaguccuguucugcuggccugugaguguggacucccggugguagaugggcaguggguggguggagagcacugugggaacagguacuuggaaugcuguguagguguguguggacucuuaaggaggccgaaacugcauguccagaggaacacucucgaggcugaggcagagagacuuucugaaggucaggguagaccccaggcagcuguguguagauguggggucugagacugggguuggucagggcggaguaggguggugcaaauucucgagaaggccaaauguacagaccggcaucacagggaauagacccugguaacgugaggcccugcuagaggagacaccccagcagaagaagccccuuugcagaagaugcugccacugaaaugcuauuggucccacugugauuuaggggccaggacacccaugcaggagaagccuuaucugaaggaaugggagugacagcugacagaguugguuggaaucaaucacugguugacucugaaagcaaagucaauuaugauuuaugucacccggggauuauuuccaugggauuaaguacccuucccuugaguccccaggccaaacacacugucgcugcucacagcccugucuggcuggugaagggcuauuuguccaucugccuauuaaccucauguggccuccauggcuuuuugcuaggaggcacagcaguuucugagagccuugcagauaacagcaggccucaaaacaacaauucaacuuccauuuagccaauaguuacugcucacccauuccgugcuggagcccugaggagcugaauaggacacggagccugguaaggggguacacacggacccugggggucaugaguaauugcacaagagggugcaggauacuguaugauauccugggauaccccggaagugagaccuuccguaagugccuagggaaguaaaggaagcagaggagggcuucccagaggaggugacuuaugagcuggaccuuggagaauaaauggagccaaaaaagcauucuuuuuuuuuuuuuuuuuuugagaugagucucacucugucgcccaggcuggagugcaguggcgggaucucggcucacugcaagcuccgccucccggguucacaccauucuccugccucagccucccgaguggcugggacuacaggcgccugccaccacgccuggcuaauuuuuuguauuuuuaguagagacgggguuucaccguguuagccaggauggucucgaucuccugacuucgugaucugcccaccucagccucccaaagugcugggauuacaggcauaagccaccacgcccggcccaaaaaagcauucuuuagagagggaagcaggaagaaagcauggggaugagggugguguguuuggagaaggaggaaaccagaauuuaggguuugugggaugggcuggugggaagugagucaggaaugggcagggccagauuguagagauccucauguuccaggguuagauguacuuaucuggcaaauauuuauugaguccuuguuauguuccagggacuguuguaggugggccucaucauggaugaaaccaaguccacacccucauggagggucuguuuguugggggaagacagauaauaaacacauacacaaauaaacacagcaggcuguaguaagugcgcuuaauacugcaggaggaauaggaaggggugcccaagggguggauggggguguggucagggaggccuuuaauuaggcagcauuugagcagaagcugaagggagugagggagcagccuuccaggcagagggaacagcaccugcaaaguccccaaggcaggaguaggcgcuauaggccacugugguccaugggaaguggauuucuuuggaguuuguuuucaugacauuuugagucagaggagaggcacagguaagugcauguuuuacagacugucagcccuggcaauugguuugaaagagggaugggagaggcuggagucaagggggccugugaaugggcaaaagccaugcagucguugucuuucuuucaugcauguauuuacuuguuuauucaacaaauaauuauugagcaccugcaaagucacaggugcaugcaagucucugggaaagacacaggagaagagaaagagacacaguuaugucuucccagguguuugccccuagcgggcaaagcaguugugcaggugcaagguggugagguccugggcuggggcugagcugcgggagagaguggagggcaacugugaaugucaguguuguagcagaagccccaggaauuugugacuaaucaaaugucaaggaaagggacagggaggagucacugcugagggcaaacuuaauuccuucugggaggggcacaaagagaaaaaauaugccaggugcuucuggugggaacugcaacuccugcucacccaggaggagcaguugcucaaggcgccucagggacaggcagagacgcguaggccccucucuuccuuauccaguguagccccugcccugagcuuacagcagcucagccuacucaccaggcacaggcuucacagguaaucuggccauucccagccauggccaggggucagugauuucagguagguaaggagcuauuacuggcugggugauuuugagcauggccucucugagccucagcuugaguaucuguaaaauggguugacaacaauuucauugcagggcuguggugaacauaaaauguacuaauggcugugagaggcuuuauaaacagucaggggugggauugagccuaaguuauauauauauccauuaugucuguuugcaugugggucgauauauacauggguauacacagaguuuggguugaggggcuaauguaggaccauuuccugcuugcuauaagcuaaacagugaguaaugcuaucuccuuguucucuuuccagcugguucugaggacauggggaccacagucaauggagauguguuucagguaagcaaggcucugucucagcagugguaaggaccaacagcccuggucucaguaaccuaaagccucauuguuguaggcuuacagcuccagguucuccuguucauuaugucugaugcauugggguggaaacauagagaaagguuuuuggaauuuuuuuugucauguagagggcagggaagaagaauaaggaccacuagagaucgagauugaugggcaguagccucagguugcccauggugaugucugguuuugggagggagaggucaaguggcccacagcagcaugagaugaaggcagcgcaaggccuucccucaccacugacgggaggcagaacccaggccaucuccacacacagggcgggcccuuugauccagagauuccacuuccagaauuuucccaaaggaaauaauuggacaaggccacccagauucuuugcaggguuauuuauaauggcagacaauuuggagacaaccuaaguguccagcaucagggaacugaauagauagauuagaaaaccaggcuguuguuaaaaagggcaaucagggccgggugcaguggcugacgccuguaaucccagcacuuugggaggcugagguggguggaucacgugaggucagaguucaagaccagccuggccaacauagugaaaccccgucuuuacuaaaaauacagaaaauuagccagucauuguggcaggugccuguaauuccagcuacucgggaggcuaaggcaggagaaucacuugaacccagaagguggagguugcagugagcugagauugugccauugcucuccagccugggagaugagagugaaacucugucugaaaaaaaaaaaaaaaaaaaaaaaagggcaaucagaucuuccuguauugacgugaaaagauguccacaauauauuaaguggaaaaagcagcuugcagaauaauauacacaguaugguccuuuuuuuuuuuuuuuuuuucaauuuuaaaaauauguuugggcugggcgugguggcucaugccuguaacccuagcacuuugggaggccaaggcagguggaucaugagguuggaagauugagaccauccuggcuaacacggugaaaccgcaccucuacuaaaaauacaaaauuagcugggugugguggcacaagccuauaauccuaacuacuugggaggcugaggcaggagaauagcuugaauccgggagugggagguugcggugagccgagaucacgccacugcacuccagccugggcaacaagagcaaaacucuaucucaaaaaaauaaaacuaaagguuugcacuacauaucugaaaggauguguaccagcuguuaacaaugguuagccccaaggguggggugggauggggauaagaaaggggcauucacuuucacuggguuguuuacaaauucuuuaaguguuuuuauccugcaaaaaacgaggaaaacccagccgggcacggcggcuuacgccuguaaucccagauuuugggaggccaaagugagaagaucaugugaauccaggaguuugagaccaaacugggcaacauaguaagaccccauuucugcaaaaaaugaaaaauuagcuggggcaauagugugugccuauagucccagcuacucaguagucuuaggugggaggauuacagcuugagcuggggagguccaggcugcagugacuaugauuacacuacuacacuuagccugggugagucuuuuuuuuuuuuuuuuccugagauggaguuuugcucuuauugcccaggcuggagugcaauggcacgaucucggcucccugcagccuccgccuccugaguucaagugauucuccugccucagccuccugaguagcugggauuacaggcacccgccaccacgccuagcuaaucuuuuguauuuuuaguagagaugguguuucaucauguuggccaggcuggucucgaacuccugaccuucaagugauccacccaccucggccucccaaagugcugggauuacaggcacgagccaccgugcccggcaugacagucuuaaaaaaaaaaaaaagaggaaaacccuaguaaguguauuucuaguuaagacugcuucuguccgcacccaccuaacucucuuccccuugcauacacacaaauccauuuuaguacucugagggaacucagaccacagaggcaugcaauaguccucaccucggccccccagccagaugccugguggggcuaaaccuccccucagagccuucauucccacucagacugggccaaagagccuugauccuggggucuuuggcugugggaucuucugagccccgcccuggaggagcuggcuucuugaauccucugggggaguaaacaauacuuauuuucuuauguaagagggaugggcugguaccuuaugcagggagacuggccaaguccuguuucuggaaaauuacucaacuaucagcaagcuggaaaaguccaucucuaggacuucagcagcuucaugucuaguugggcccgagggagucaaagaaugaggauuugcuucugugcagcuugguagaucauuaagacuuaggcugcccaggcucucuggccacauucagaaggacuuugcuugaccccacaguucuguguccuaaagugcaccuggagcuggagauaugcuuggaaccacagaaguauguagaacauggccgggcacaguggcucacgccuguaaucccagcagugggaggcugagguggguagaucauuugaggucaggaguucaagaccagccuggccaacauggagaaacccugucucuacuaaaaauacaaaaauuggcuaggcaggguagugguugccuguaaucccagcuacucaggaggcugaggcaggagaacugcuugaacccagaggcagagguugcagugagcugagaucgcacacugcacuccagccuggacgacagagcgagacuuugucucaaaaaagaaaguaccuagaacacucugagcuggaucauuuaccuuuccuaaagauuagcaucacgaagcucagagaggugaaguggugaaugcaaagucacccaggaaaucagccacuucuggagugcaccccauuugacuuggccccccgccuucucccucccgaccugucagccgugggugagcugugggugaaucugaggagcccggggccuccuuuccaaucugagugagaacucuuauucucacuguuacuaagaaucacagcagguguguuuauuuguaaaucauaucacaucagugccauccgagaauccuuacaggcagggcagggucacagaugagcugaaucacucagaagcuuaguggcaaagccccagcuugccuacaucuccugggcuccgacccggugugcuuugcauuacgacucuguugcuggaacuggcuggccacagcgccugggucacagguggaaagccccagcucuuuaggauugagcauagcaggucuggccugcaccugcagggggaggagaaaccuuggccugugcacacccaacacuuucaaggaucccagacagagcuuuugugcuuccuuucuuccucuuuucugcagcccgugcaccaccagcggguccagcuacaaacccaguugccaauacagccuaaggacgagccugcccacaacuauuccaguuccauuuggcacagccaggggcagggacagaagggcccugcaggacuccgccuccccaccucugcacagauccucucuccuuuccccuaauacucccaucauccuccuuuuagcuucuuagaggaaucagcagcucagcuuagcuuagauuuagcugaucaaucccaaagaaggauguggcucauccucuuggccaucccuggagucgcagcacacgcuuggcugguguggguccacagagguucucaugggugggcccagcagaggggccccucaggagagggauucuagggagcuagacugagacaagccuggcccugacugucgccuccugccuucugguccuggccauuccugccccuuucucucuccagagcuugggaggagucagaacauugcucuagccgcuggugaucucuccugguugccaacccuccuggccaugacugaucuccccacugagaugcucaggugauuaaacgagagcccaguuguggcccgugacacugucacuggcaaggguagggguggggacaggggcaggaaaauaaguucugagcagcccggaaauaaugaguggugacugcuucucggggcuuugccugccagcagcaccacugugcucuccuggucauggugcacggagggccagcagguguggggcccugccacaccggaacagcaggccacagcagccaugcugucccucauacgcacacgcccucuaugggcugcagaguguuaccauagcaucucguaagccucacuucccaccgguaguaggauauugucacucauuuaacagguuugaaagccaagcugcccagggaagggacuucucaaaggucgcgaguccagugaguggcagaagggggauguaaagcccagccccucugauggaguguccagcgcucgucccgugcccuccacgccccuguguacccagcuacuuguuuauucauuugguuuauacguuuggucguucauucauuuggucagugcacauucuuuuauggccacacaccugcuagggcagugaauaaacggauauggaggcaaauccacuggauaguuugucuccaaagagcucucuuuuuuuucuuuuucuuuuucuuuuucuuuuuuuuuuuuuuuuuuugagagacagggucuugcucuguaguugagacuggagugcaguggugugaucauggcucacugcagccuugagucuugggcuuaagugauccuccugccucagccuccugaauagcugggacuacagggagggccaccaugccuggcuaauuuuuuaauuuuuuuauggagauguggucucgcuauauuggccaggcuggucucgagcuccugggcucaagcaguccuccugcucagccucccaaagugcugggauuacaggugugagccgcugcaccuggucccaaacucgcuucuaauagaagacagggaaagaagugaaagaagugaaugggagcccaggaaggugagggcuuggcuuuggggaagcauuaggagcuaacagauugaguucuucucuguguaggcaccagccaagggcuuuacgugcuugaucucccugaguccucccaacucccugugauguugguugucauuauuccuguuuuauacaggagguuuaacagcucgcucgaguuguguagcuaguaagagguaaaacuugaauccaggaucaggcgccagagccugcacuaaaguuagggaaugcaacugugaggggacacuggcaggggguucugaggcugcccagggggauguggguggccuuggccaaggccaagggaagagcaugugcaaagccacagagggucggucacucauuccgggguucaccggagcccgggaccugcugcacaaagggacgugccaggagaggccaaagguuucgggugagcccugcauagcccccacuagagugcaucagugggccuugcagcugguggcagguggcggagaugugggcccaguuuggccaggcuuggcaccuugggacuggggcaggacaccgugggggcugaguuuccuuaaggcuguucccacacccagacugcaggcugcagcggagguuuagauggagucagaagaccuggacuucacuuucugcuuuuucccagcuggcuggcugugggcuagucacuuaacuacucugagccuggcuucucauuuguaaaaugcgaauuagaggcuccgcuccgcugccccaaagggcuguggaaaaaagugcucugcagccccggacgcuucucacaaacuccugacccagccccuaggcgagcugaggguggugugugggggugcgucccagaggaaggcgggccaugagaccugggggcaaccggagcuggggacccagucucuagucuugucuugagaggaagacaagcaggcacacaaacuaugcgucacagaagugacuuugggcccuauuagcuacuauguggcgagucacacccagcaauucaguuugaauccugguucugccacuuccuggcugggugaccuuggcucuuuggagauagaguuuaccuaccugugaaacaaaaagaauaaaacuuggcugggugugguggcucaugccuguaaucccagcacuuugggaggcugaggcaggcagaggaggccaggaguuugagaccagccuggacaacaugaugaaacccugucucuacuaaaaauaaaacauuagucgggugugguggugcccaccuguaaucccagcuaccugugaggcugagacaggagaaucucucaaacccggaaaggcggagguuucagcgagcagagaucacgccacuguacuccagccuggacaacagagcgagacucugucucaaaacaaacacacacacacaaaaacaggccgggcaccguggcucacgccuguaaucccagcacuuugggaggcugagguggguggaucacaaggucaggaguucaagaccagccuggacaagauggugaagcccugucucuacuaaaaauacaaaaauuaaccaggcguggucgugggcgccuguaaucucagcaacuggggaggcugaggaggagaauugcuugaacccgggaggcggagguugcagugggccgagaucacgucacugcacuccagccugggugacagagcgagacuccaucucaaaaaagaaaaaaaacaaaacaaaaaaacaccaaaaaacaaaaaaccaaccauguaggguugcgaagauuaaagaaagcccuuuaaaugcaaguucucuggagucuuaauuuagggcaggcuuggccaggcgcaguagcucacgccuguaaucccagcacuuugggaggccgagguggguggaucaccugagaucaggaguucgacacaagucuggccaacauggcaaaaccccgucucuacuaaaaauaaaaaaaguagccaggugugguggcagaugccuguaaucccaccuacuugggaggcagaggcaggagaaucgcuugaacccaggaggccaagguugcagugagccgagauccugacacugcacuccagccugggcgacagagcgagacuccgccucaaaaaaaaaaaaaaaaaauuagggcaggcuuuauggagauggcgggcccugaaggauacagaugaaaagagacuccuguucagggccccucaccacuccucuccucccacaucuggcagcaucuguguauccauuucccaaaggcuccaggcccacgugauucuuacacgugcuggcucuuggccugaaaugcccuuccccaucucuccuacuguacucuguccccaggcgagaauggugcccucccuuccccacucucuuuaucugaacuguguuccagcaagguucacguuuccccagccaugguucucauuugugagggacucccugucccaacuuccuggaaggugucuugcucgucccuguccccaagccugaacaucuaugaauucauucaguauucuugaaagguuccugcagccaggcccucccggugcugggugcuguauggaaacaggcagccucugcccucauggcagggagggaagggggaggacacagaaaauaaacagguaaacaagccaaggccucaaucaggaggcaggggaagcccuaggaagcuguagacccucgauucuaggggaagaauguuccagacagagucucugaggggauacaagaugagcuugcaugaaggccaguguggcaagagugcacgaauagaggacagaaaucagaggcccagggagagaccagaucacuugaauuuuguucuagccauaauagggagccuucagauguuuuauuuuauuuuuauuuauuuauuuuuugagacagagucucgcucuguuaccuaggcuggaguacaguggcacgaucucggcucacugcaaccuccaucucccggguucaauucuccugccucagccuccugaguagcugggauuacaggcguccgccaccacaccuggcuaauuuuuguauuuuaguagagaugggguuuuaccacguugcccaggguggucucgaacuccugagcucaggcaaucugccugccucagccucccaaagugcuaggauuauaggcgcgagccaccgugcccggcugccuuuggauauuuuaaagugugacaugauaaaucggauuuagacuccgaauaggucauucgggcauuuuguggagauggggcugcaggaagcagagaccagcagugguccaggccaggggcggugagggcaggagggagaguuuuagagauugugaugacaggcccugcugaugacuugcacgggggaugggaaggaaggagaaaucaaggacgaacaggaggcuggggccucagcacccucgggaaauuguucagugucgcuguuuucauuuuaacaucuggaacaaaaauccaagaaagcaaaggagguuuugugaaaaugcugugcaacacaaggcgagcgagugagugacgauugcaggaggcagcccccacugcccuuucugauagaccuaaaggcugaggucucgaugccauguggaugucacccuaaagacagugcucagauaugacccucucuucccuuccuccuccccuacaagggcacuguggugccuuuuucucagacggaggguggggcaaguuuggggaaugaaaagugaagugacguucaggauuccugucaaaacacccacaugggcuggcacagagaaagggcucaguacauguuugcucaaggaguggggauugggugguggucagauggaugccuucauuguauuuuuauuuuuauuuccaacuucucugaccucucaagucauuucagauagagguaagugcugggaagaaaauaaaauagggcaccuggauaaacccauauacacaaaguaacagugcaguugucugcagauggaaggcucgguagguuugggcagcggugcugggaggagucccugguauccuggccucagagaagcauuguucccagaaaggagcagcagugaacuuguguucuccggagaagggccccagaagggcccacugggauguugggagagagucucugaauugcaaugcaguguugugcuggagaggaguaaggguggcgcccagcugccccgaugaucccaggagccaggcugcaccccuguccuggccugcccuggccugcccuucccucacuccccaggcagcuggagacuguagcccugauguuccaucuauguguucccucucccagagcuccuccuugaaccgggugccugcuggcuccaggggucuuugcucauucagccacugcuuacugagcaccugccaggcacuaaggauaggugggcgccguaggacagagagugugccagacacuccuguguggagaagaugucaaacaacgcgggcagucauggaaguuuugauaagugcuugaaggaggagggaggggagacuauugcugggaggggagacagaagcgccaggagacaaaggccggguagcuggagugggaugccugcagacaggaaugcggagggcgugggugccagagcggguguggcuggaccuggauuggaaaggcuuugccagaccagagggugccacacccuugugagcagagcucacggugcucagcgcuuuggguccccagcucuggcaagggguggggagacgugagcagagccccugccugggagucagggaccuggacucuaguccuggcucugccacuacguugugccaugucucugggccucaguuuccucccuuguaaaaugggaaugaauaauaauaguaguaauucuagcuacuauucacugagccaucacuccacaccaagcacucuucuaaauaucucacaaauauuauaguauuaaaucauaacagcucuuagagguguucuuaauauuauuccuuuuuuucuuucuuucuuucuuucuuuuuuuuuuugagauagagucucacuuuuauugcccaggcuggagugcaauggugugaucuuggcucacugcagccuccccugccccgccccggauucaagugauucuugugccucagccucccgaguaggugggauuacaggugcgggccaccacacccagcuaauuuuguguuuuuaguagagaugggguuucaccauguuggucaggcuggucucgaacuccugaccucaugugaugcacccaccuuggccucccaaagugcugggauuacaggugugagucacugugcccggucuauucccauuuuucuuucuuuuuuuuuuuuuugagaccaagucucacucuguggcccaggcuggagugcaguggcacgaucucugcucacugcaaucuucgccucccaggcucaagcgauucucccaagucccagacuccuaagcagccauuacaccuggcuaauuuuuuguauuuuuaguagagacgggguuucgccauguuggccaggcuggucucaaacuccuggccucaagugaucugcccgcuucggccucccaaagugcuggaauuacaggcgugagccaccgugccuggccuuuuuuuccauaauuaaaaaaacuuuuuugaaaauagugacagacucuugcuguguugcccaggcuggucuuaaacuccuggccucaagugauccuccugccuuggccucccgaagugcugggauuauaggcaugagcuaccaugcccagccccauuuuucaaaugagaaaacaaaagucaggcaagguuaagcaauuucucccaggccuuacaaacauuucauaguaucagagguggcaucugaaccgagacagccuggcugcagaguccaaguucuuucccauggugugaucugagcuaugaucaugcugcauaucucagggaugcuucucuacucaacaaacaucuacugagcaucugcugggccaggcacugugcugggcucuggggacauagcagugaaaaggacagagaugacauucugauggcagagacagacaaacacauuauaaaguaagguccuuuugggcuggucacgguggcucaagccuguaaucccagcacuuggggaggccgaggccgguggaucaccugaggucgggaguucgagaucagccugaccaacauggagaaaccccgucucuacuaaaacuacaaaaaauuagccgggugucgugacgugugccuguaaucccagcuacucaggaggcugagguaggaaaaucgcuugaaccugggaggcagagguugcagugaaccaacauugcaccauugcacuccagccugggaaacagagggacacuccaucucaaaaaaaaagugaggucuugaggucuuuuuggacuaaguguuaggaguuaauacaaccacaauagagagugauuuuaaugacgguaacacaagggacucacugugccaagcaguauuuuuauuuuuuauuuuuauuuguuuauuuuuugagacgggguuuugcucuuguugcccaggcuggagugcaauggugugaucucggcucacugcaaccucugccucccggguucaagugauucuccugccucagccuccggaguagcugggauuacaggcaugcaccaccacgccuggcuaauuuuuuguauuuuuaguagagucgggauuucuccauguuggucaggcuggucuugaacucccaaccucaggugauuugccgccucggccucccaaaguguugggauuacaggugugagccacugcgcccgacauucuuuauaauuuuuaacucauuucauccuuauguccucccaucagagugcauacuguuauuuagcccauuuuaugacaaagaaaguggcuggcacacgcuuucuugagucuucugcuuuggggguaucaaaaccuauaacugggccagaggcaaugaucaggcacagagagggugaguaacuugcccgcagucacacagguggcggaguguugcuggcagagggaacagcaagugcaaagauagguguagucaccagagacaguggguaugagguuguuugaggcugaguuauccagacaugaguggguccccagcaggggcagcagagacagcggggcaggugugcuggcuggauagacugcugcguguuuguguucuaggaggccaacgguccugcugauggcuacgcagccauugcccaggcugacaggcugacccaggagccugagagcauccgcaaguggcgagaggagcagaggaaacggcugcaagagcugggugagggcggggcugaggcgggguuggcugggugggcugugugugggguggaguguggggaguccucggagugcaugggaugcugcaugccuuaaugugggacugggccggugcggcccuguggcugccuggcaggggccaggggaggagcgcggccgggccugugcaucccagcuggaaagcagccacucauucucuugugggguccuagaugcugcaucuaaggucacggaacaggaauggcgggagaaggccaagaaggaccuggaggaguggaaccagcgccagagugaacaaguagagaagaacaagaucaacaaccggugagagggcuguagggacaugagggggccauggggacaugaggggggcuguggggacaugagggggccguggggacaugagggggccauggggacaugaagggguggggacaugagggagcuguggggacaugagggggccguggggacaugagacgggcuguggggacaugagggagcuguggggacaugagaggggcuguggggacaugagagggagcuguggggacaugagagggagcuguggggacaugagaggggcuguggggacaugagaggggcuauggggacaugagaggggcuguggggacaugacugaacacugcccagugcucccugccuuugaggcucuguccuucacgguacaaggucuuccaggaagggaaaggccuguucugggaagcuacccuucugucuagggaacugcugcaugccaggcucugggguaggcacggaggagauggagauaaggaggacccagccuuauguccucaaagggcgcagaggagaaaaacacacauguucaacuaagcucaaauacaguagggcccucugcacgaaggccauggaagcaaggaaacaggucagggagagaccucugugucuugggacuugggcuuuggaagaugacuaggaggaaaaaagggaaaaaagggcaggagguaggggggcauucuagaccuggguacgaagaaaaaaaugugauguauuaggcaacagggggccagggagcggugggagagaaggcaggaaccuguggacucacacuguaagggccuuggcugaugaguugggcagugacaugggcaguggggagccacugaagguguuugaacaggaguaacaugaucagggaugaauuuuagagaaggugcuggggccagggugaagguccccauucuccuguuuggggcugugggucguugcugagccuuccagaacuaugcuuccuaacauuucucccacuggagguacuaaugcugucucucucucucucucuaaccuucugccugccugucugucuugccaucugccuucccccaccuaaccccuucccucaaccuuucccucaaggaucgcugacaaagcauucuaccagcagccagaugcugauaucaucggcuacguguacgugucuguuuugcuucucuguugggggagcuagagagggaauggccaccacaguuucuugaguuuccugcuugugggauauaaaugaguguggcugggcucggagcaauggucagaacaggaggcaaaugcccuggugggugcaggcagcaaccaccucccucccuccagugaaguggaggcugcuuggcuaaaucagagccuugcaggauaaaggcagagaaaggaaugugcuugccacuuauucccaugugggaggggcaaauggcagagcaccccaacucccucccucugugaugucucuugguggguguguggggugaaggguuuuuuguuuuuugagauggaguuucgcucuugcugcucaggauggagugcagugcugcgaucucggcucacugcgaccuccaccuccuggguucaagcgauucuccugccucagccucccgaguagcugagauuauaggcacaugcaaccgugcccggcuaacuuuuguauuuuuaguagagacgggguuucaccaugucggccaggcuggucucgaacuccugaccucaggugauccacccaccucggccucccaaagugcugggauuacaggcaugagccaccacacccagcugaaggggucuuuuauucaacaaaacagacacugagcaugggaugcuggaggcauguaaaggacaagagcugcuccuuugugacauccaucucuuccuccugccccagugcacugacuuuggccaucagccccugcccagaccaccacaggcccccucacauguuucagguuuggggucuacuuggugugaugaguaaucaagaccaggguuggcaaacagguuauaucucgugccgacgucaguuaguugguagagacauccuggaggguggugguggggauuguggagcugaagagaagguacuugcuguucuucacucuaggugugcccuggcagcccgucaugugucgaggcuaagccuccucucacagggcacagagcacaccagagccuucgucugcuuccuuccacucucccucauuuaguacucuuuggcacucgccuugugccagauugguaagacacccacaggccgccccccucaccgugcucauggucuggaguguguuaugauaagggccuuguggaaggacacagugagcucuggaagccacucucugccuggggagccugggcaggcuucagagaugcaagaccuucagcugaccuuaaagugugagaaggaguuugcuggauagggagggugggaagagaaggugggaggagcagcuggggccaaggcauccagagagaaaaggcccagcuggcugcaguggcugaagcucuacaggcugggaugguggggaugguggggaugguggggaugggugggagcugaggcugggaggugguuggcuuggggcugguugcaaagcgccuguugugccaaggcugagcucagacuugauccagaaggcaguggggagccacaggaggcuuccagcaagggauggggaugucagaugggcaugggugcuguggaauaccacagggggcucgaugcuucuguugagccugaggaaauggcccagagagcacccaggagagcccugaagagagaguauagaccagggcuucucaaacuuuuuuuuuuuuuuaagacggagucuugcucugucacccaggcuggagugcaguggcaugaucucagcucacugcaaccuccgccuccugggcucaagcaauucuucugccucggccuccugaguagcugggacuacaggugcccgccaccaugcccggcuaauuuuguguauuuuuuaguagagacgggguuucaccguguuagccaggaugcucuccaucugaccucgugauccgcccaccuuggccucccaaagugcugggauuacaggcaugagccaccgcgccuggccacacccagcuaauuuuuuguauuuuuaguagagaugggguuucaccauguuggccaggcaggucucgaacuccugaccucaagugauccacccgccucugccucccaaagugcugggauuacaggagugagccacugcgcccaggcucaaacuuucacaugccuaugaauuaccagggggucucgugaaaacccugauucugauucagcaggacgguggggaggcccaagggucugcauuucugacaggcucugucgucaugcugaugccauuggaccauggacgcuuugagcugcaaggacagaggggagccucuggacccugaagggacagcuccgaggauagcuccccucauccccacuugccacccagcuccacgcagcacuuuccuuuuuuccagaccugcuugcuaccucauugaauucucaguccagugaaauaguugguagggcagagcuaugauccucauuuuacaggcuaggaaaugagcauacagccagcaucccuagagaggggccaggucaccugauccggggucagcucuuccauggagcgcuccugccaucagucaugucuggcaucggcagaacugguccugcuugagauggagagggggcuuccagggacuugugagcgacccucgcuggccaaacaggacauagacccagcucuccucaccuaagaaucccuuauugucuuucuguuagugagucccacguguagauuuuguccacuagacuguauuuacuuguuuccccacugucccuuagucaguggcuucugugacugucaaccagaacuucugaugaaggaccgccaguuuucauccuaacuugauuccaaccaaaagcagacuccaguggagcauucaugccccaggcuguggcuccucagagacaguggugguucugggcuacaaagggcucuguggugaaagacgcuugggaugugguggauuccaucacauacacaccuuggagggucacgacgcacacagcacaugaaaggcuuugaaagucuugcuguaaagauccucuuuagcuggguuuuccauagguauuugaccacagucuuucuggagaauccucacacagaacauucaggcaaugcugaacuaggugcuucuguuagaugguuagucaguguccuacuucugccaaguuuuuggaaauggugaaauagcuaagguccugcauuaggucguccuaggaccuccaagggucuuuaggugucaggaaccucagguugggaacucccgauggggaaguaaugaacagagggugccuaggcugggaagacuuucugaggaggugaggcccgcacugagaccugaaugacaagaagcagcaagccaggaacaggucugggagaagcguguuccaggaagaggugauagcaagugccaagguccugaggcaggaccaagcuaggcuuccuccugcgccaaggcugcccuccucugaagucaggggggcacaaggcuggggaggacacagugccccagaguaggcugggcaaagcagccuugcucaagggcaaggcugggggaaagcagacugcuauaaaagcccguccuaucuccacccgcagggcauccgaggaggcuuucgugaaggaauccaaggaggagaccccaggcacagagugggagaagguggcccagcuaugugacuucaaccccaagagcagcaagcagugcaaagaugugucccgccugcgcucggugcucaugucccugaagcagacgccacugucccgcuaggugccugcuaggugcauggccacagagcaugggcugggccugggcacaggaggagcagcugcuuuggucgggguggagacucgcagcagcugcuacccacagccuauuccacuccuccccaucuccaggcgcugggaggggggcccucaccccaucacgccucgcucccuccuggcccucugguccagccccucacgccuccucucagucuacucaauugugacugucccuccugauguauuuuuuuucuuggcuuaaaggguguguuguugacucuuuuuacacuuauuuauuaucauucucacuucucuggaagccacaacuggugucagggcucgguuugugcuuagaacuuucccagcuucaugaccuugagagaagggagaauguucccccauuucccagccaagugggagccccaagcucuccaugucuguugccuccaccuccaggaggaaagacagccucucgcagaaugcuuuuguaaccucgauccuuuaacaagucugugagguaaauucuguuauucucaccauauaaccaaggacaccaagguucccagaggggaaguggcuuguagugggagggaaaagcgagaccagagguuccuggugguagcuuccuccuaagccuggguaagagcccugaagacccaugagacuccccuccuuaggguuggcugggaccuucuggauguggaggguccacugcccuguguauuucgcuuccuccuucaacugggcucaucuuggauuuuggauaaacaaccagugaucacaccuucuuccccuucagcagaguuugcaaacaggacguucaugaccugcaugauguuuaaaaagauuugaguaauugccaguaaauauuagcuuccuagggcuucuguaagaagguacaugaacuagcuggcuuagaacagaaauuuauugucucauaguucuugaggccagaaaucugaaaucaagcuguggcagagccaugcucccucugaaggagcuggggaagggucuguuccaccugcuucuggcuucugguagccucaggcaucccuuagcuggcagacgcaucaccccaauccugcccccaucagguggcuguuugc

SEQ ID NO: 17301 - RNA, 10148 nt, Homo sapiens
ccagaggcggggacagcagggcuccgggcaaggaggucuggaugcugagggcggucccugaggggcgggcggggcccgaccggcgcucuguguggccgaggccaugaagccgcagccgcccggcuaggccccgggcggcucuagcccagggcggcccgcggggcgcugggccuggcucccggcuccgguuuccgggccggcggguggccgcucaccaugcccggcaagcaccagcauuuccaggaaccugaggucggcugcugcgggaaauacuuccuguuuggcuucaacauugucuucugggugagcgcggggucugcgccuugcccugugcugggggguggugggagagggagauucagucuuuugcugggggagaccacucccugccccaagaguuuggagcucgggaccauccccccacuucugccacacccacgcccacuuccaggaccacccgagguagcuacagaggcccggauugcugggggcggguccuagcgacagcguggggucgggguugggguagggagucucccuaaauaaucccgaggccugguggagaaagggaagguguuuccuugaagaccccaggggcgugcuaggugcagguugcccccucucgcccagcccuccuuccuacccugggaugugggaugcgugccaagccccaccccugguuuagccgguaaggagauucuggcgugaagggagccgccaggccccuuccccggccuccuuucccuuccaguaguaccugggucaggugccucaccuuaggcuccugcagaguggggugggucacaguccucugcccaccccagucccgcacaaggaggcugaccugccaggaggggcagggagggacaauggcgaguccuuggcggcugggagaggaucuccccgguugagagccugggagcuggccuuggggaacagaauucaacauuccacagcugacaagcugaggcuccugggcgggucugccccuaccggggaagggagcuacuagugccccucccaggguggcaucugucccccugggcccugccaggucauuuuucccaucucuccaaagccguggcccucugcagucucugcuccugaggccuugggucaagaugccaggccuuuucccuuguguucagcaagacucaguggcacugccccccacccacgugucaccgagcucacuggugugguggguguccuugcacugcagcgcuaggcucuugagggugugggcagugugugggagcacuggcaaagaagucagaaggccuggcuguagcaggccuggcugggacaccuugggcaagucaucucuccucuccgggccucagcuugccugccugggagacgacgauaaagaaucugccugugagggcuguuaggcagauacaaugaguucaauuuguuguauucucacaacugccuuauuaucugcauuuuacagauggggaaacugaaggaauagacacagagaaauuaagucacuuaccuagggucacacagccagaaaguacagagccaaggugacggcuuagugggcagaggguggaggugaggcagagcugugagcagaaguaaccucaaauaccgagggggagcaggcgugagagacccggguuuguugcuggggcggagcgugggguguuauguuaagguggcauggagaagcgagggcuuccagugaugggucugaucuggcuucuguucuggagaccgcuugccuggcugcuguguggaggguggaugaggggcagggccuggagguuuggaaugggggcagggcuggggcaaagcugggauggugaggugggaaaggugagggagguugcugggaaagucaagaggcugaauugacugggcugggucacuugggggcuggagggaggauuucagauuuggguuaagguggccuaagggaggcugcuuguggaacaggcacagagguuuucauguuuaaugucaggcagacccugguguuguucuguuuggaaacugcuugugguuuccuuuuuucuuuuuucuuuuuuuuuuuugagacagaguuuugcucuuguugcccaggcuggagugcaauggcacgaucucgguucacugcaaccuccgucucccagguucaagcgauucuccugccucagccucccaaguagcugggacuauaggugugugccaccacgccuggcuaauuuuguauuuuuacuagagaugggguuucuucauguuggucaggcuggucucgaacuccugaccucaggugauccaccugccuuggccucccaaagugcugggauuacaggcgugagccaccacgcccggccauccugcucgugguuucuuacugcuccuagaguacugucggccuccagggccccgcggggccgggcuguccgcccuucaguuuguuccuugaacuagacguggucuugugucagggccucugccugugcccuacccuccuccuggaacaggcuuuucccucuugcucuuuucaucauucaaaccucagcugaaaugcccccacccucccuucugcccucucuaaagcuggcguccaaccccagcaucccccaucucgucgccccgcucgauauuuguuaaggggucuguuugcaucugagguuuccuugucugcucacugacuguccaucuccccugcuggaguguaagcuccgugagggucgaguccguccuauucaccagcgaauccccggcauggcggcgaucagugccggugggucguggagguguuugcugcaggcggguggacguaggggugugggaccagcaugaggucuggguggggaucgggagaugccagcgucaugaugggauggaagacgagcgugaggaggaagaacggcagaaggcugaggcuggaggccgugggaccagccacagguggucccuccaggaacacagcccuccaggaacuccugcuggaggcugagagcucacuucccagcuguuuucccaaagugcuuuaauuguauuuccuuggcucugauuggcugccucuggaccaauccccggggcaggugaaggcggagcauccugggaaggagcucggggaggaaugggguugaguuaacugaggugggguucaggaaggagaaaguggcacucaguccccugucugaaggccaagggcaggccaagugggaggaggcaggagaagugauguuugguuucacaucagcagacccagcaggcaggagggaagggaagauguuuccagagaaagaauagagcaguguggggagcccacggucagggaagggaaggugauaaaggccuuggccguggcuaugugcugaggggaaggagccugcagauaaagcagguggguggggaggucgcaggagguggggucauggcccugggcuuggguacgacagccuuucccccucugagacugcacgcccagggaccugcccagggucaggugugagagugaccagccuggacauccagggcucuucccaguagggaauugaggcaggaaggugggaaagcugaggauggaggagaggcacuuggacugccccgguggggagucuagcugguguucugaaggcccaggcagagcuguggccauggggcaaagccacuggcacaggccagauccuagguggauccugcuagggaugauugagauuccugucauucaggggugucuggucgugagccguggaagcugacucuggcaggcggagguuaaagggguaggauggggcugggcuggggaggaguguugagggcggggccgcagucacacggcuuuaggguagcaggagagcuggacuuggcagggugcagaaaggaggcuaggagccuggaaccccagcaccagcuucggucagguguagaggcucaguauacuggcgccgucgcuacccccgcugacacagcugcuauugcuccuuggcaggagugucuuggccaccgucugcuccaauuuggaguuccaggaaggggccccugauguccaucccaaggcuagcagaggguucaguccuccaggcuguguccuguggggaagaagcacugggauguguucuugggaagauggaaaggaccccggaucccguucacagcccuugugccucuuccucucuccgcuggaaaggcccuggcuaccggggaaggaugaggggggaggguccuggggcugcucccagcccugagcucuuuguugcugcccuugcaggugcugggagcccuguuccuggcuaucggccucugggccuggggugagaagguaaggcagcgggcgggcguggagcugguaugggacgagguggugggaaggucagcuccccacaccugccucugcugcccggcacagggcguucucucgaacaucucagcgcugacagaucugggaggccuugaccccguguggcuguuugugguaguuggaggcgucaugucggugcugggcuuugcuggcugcauuggggcccuccgggagaacaccuuccugcucaaguuugugagugcugcccucaagauccccugggaacccccaucuccucccauccaguucuugcaauacaguuggagcuuaaugauggguagcuuuauuauuaugcuauaaucgucaucguuagauucauguugucuauauuuacuaggauccuuuccgugguaugguaagugaccgagaccugguggcccaagcauaaaauauuuauugacucaaauaagaaaaguccaggguugugcuggcugccggugcauuuugauccaggggcugccacaguuucacuuggccugguuucucccuguuucucgggcuccccccguuuggcuccauucccagguggcaggaggcucaggaacagagccggcuuccccaugcccucccaggaacuccugcuggaggcugagagcucucuucccaaccguuuucccaaagugcuuuaauugcguuuccuuggcucugauuggcugccucuggaccaaucccuggaggccgagggaggcagugcucugauuggugggcuuuaggcacuugccaguccuguaucugggacugguggguuuggggaggugucuccauccgaaccuuggaaacuaaagguuugcauggaggaugguuuuucagagacagcagggugugauuaccagacaaagggaauuggauggguagguaacaacagaugccuauuaccaucauauaacaauacuaaaauaauagaaggugggggcucugggcgccucugggucuugguggagguagggauggagcccuucccuguggcacacccaagcccugggaggucaccagagcccugcguuuccaaccccuacugucuguaugcccaaccccaguucuccguguuccucggucucaucuucuuccuggagcuggcaacagggauccuggccuuugucuucaaggacuggauucgagaccagcucaaccucuucaucaacaacaacgucaaggccuaccgggacgacauugaccuccagaaccucauugacuuugcucaggaauacgugaguccaguguccagccugggacaccuguaggaggcgccuuccuggcagacgaaugagggagcaaguucccugugaugggaccaucuccuuacccaccugggcuagcgggccccaggagagagacccaggaguguccucguccgaggagagccagccccugcugauccuuauggguccccauuugccuagugccauagggccacggccuugggaaacagagggcaugggcuccacgcuagcagcucccaggccagggccuacgacacacgggagaauggaggaaaugugacauaaaauauagauuucuacuucugcuaaaccuugggcccacgguauuggcugcagcuauguugcugcugccccuucacugguacagaggcucucuguuugccauuguucccaacacucuguauuuuauuauaucugucagcccuuaucucucauuuauacuauguuuggccucuguguauauuagaguuuagaccccugauggaaggucugcccucaaacuuacaaacuuaaccccagugaagagcagccagagaagaguuccugaaacccuaucugccucccaccugcaccaucucgcccacucaccccuaaccacaaacacacagucacacacugucacccacagucacaaccacaccuagucacacacucgcaggcacacuugaucacaccuacaccuacacauggucccacagucacacaugagucacacccgaucacacccacacacggcgacaggcccuuggcaccauucaccaccaagagucagcucuggauccagaggugaagcagagcuggugccugcuucaagcagcucucaacccagggcagaggcagacauagccaggcaguuaugaugcaguucauucauucauucagcacaggauuguuaagggccuaccauaugccggacccagagccaggcccugaggauucggcggggaagaaagcugggaccuguccucucagggcuggcagucgggaagagacagauggugaacaagcagaacaaacaaaugugugcauguacauacguguguaugcaaaauuguacauugugguaagagucaaaaugaaggguggagaaugggaaggccucugcguggagagcuugaagccucccaaaggaggagaaggaagagaagggagaguguucuguagcaggagcagcuggcgcugagcaggugccaggaggcagguggaggcugagcccugcccugggaccagcacaugcagggcauguggcaggccugacuccuccagcucucuggcucggccacggggccugccugugucugcugccgagcuugagcucccccagcccugugggcugcucuccagccccugcgcugcugcucagugagggcugugugcacccgugugccccacaagaccaugguucauggcagaucccaaacucgccauugcuccugccuaggggacagcuuaggguguucugggugggggugauggggugugggaugaugccagccggcauggaggaaaugggguggcacggcuauggggguggcaggauuccccuccugucccugcacugaagagaggagggcuuuguagaaccucuggggcaagugugggaggccugcugcagacauggggcccagcggucucugcugccacagggcuuggcccagcgccugccucucagguagucuggaggaagccacagucauugaaccaguauccuugucccacucccucccuuuuucuagccucucuugggucggggaagggggagcucaguguccccucccuugcaccccucugccuccaccagccuggagguugggcccaggccuguggggguggggagguggccacccacuuggcugucccagcccugucccagacagcccuguauuccugcagccugggcuuguucccaaacagggugaggcuccugggaugggccuggcucaccuggggcucuccccugcccccacaguggucuugcugcggagcccgaggccccaaugacuggaaccucaauaucuacuucaacugcacugacuugaaccccagccgggagcgcugcggggugcccuucuccugcugcgucagggacccugcggugaguggggcugggggaggagagguaagggacuuuccagugcacagacucuggagaaaccucccacagggccccgcuccgcucugcccugcucugggggcguggaugcugggggacgucauuuuacauggguggcacugaggccuguuggggcgcggcugcuuucccuguucagcaagaccugucuuuuuuaucguagugagauggaaacagcaggacccuggggcacagggauggggacuggccuggaggccucccugcacccuauaccucuacauaaacacagccgcagccauugucugcuccuggccagcuugaagguuggccaggcugucacucucaguuaugguuguaugugacggggguugccugggucauugccagccagcaccccacugggccaccguugcaggguagcagggaguggggaccucugucccuuuacgacuuucuucagggcagaaaccucuccugaugauguuucuucagucauaguccaucugggaugccaaggaccagguuucuccccauucuuauaacacaccagcaggcaggauuccugaacggaggcagguccagguuggcgauugcagccacgcauuccagcgucugggaaagaggcacguggggccaggugugguggcucaugggaggaucauuugaguccaagaguuugagaccagcuggggcggcacagugagaccucgugucuacaaaaaaaaaaaaaaaaauuagacgggcauggugguacacuccugugguccuagcuacuugcgaggcugaggugggaggaucacuugaggccaggaggucgaagcugcagugagcuaugaucgugccacugcacuccagccugggcaauggagugagacccugucucaaaaaaaaaacaaaagcacaugggccucagagaggcucacuuaagacugguggacacggcagaauccacgggcccaucugcguccucugagaaggaaaagccaccgcacugcccagguaccauggaccccaugggaugcguccucaccaagucacuaacuggccugucuccccucaggaggauguccucaacacccaguguggcuacgacguccggcucaaacuggugagagggguaggaaccgggcuggggcaggcaggcagggguacuggguuggguaugagagugucuauaaccuccucuggaaggccucagggauucuuuggggagagggugcugagucccaggaaccagccagacacccaggcagcggagggggaguagaccccugggccugggcagauguggguuugcucaguucugcucuguggagcacccuuggggugcccggcuuugcccuagaggccagagauuuggugcucaugagacagucggcucuggaggaguggagggagaaagacgguaagcccuuagagaaagcaauaugaacagccaugugacagucucagcugagagcuuggaagaaaauaagggaggugauaggagagaagcugggcaggcaggagggggcgugcaucugugcugagaccccaugagaaggagccggcuuuguggagggacuguggggagcagguacugcagguuuagacccuggggugggcgugagcuuggcaggcugggagggugggagccggccugaagggcagguaggcugagccuggugccugcguguccccaggagcuggagcagcagggcuucauccacaccaaaggcugcgugggccaguuugagaaguggcugcaggacaaccugauugugguggcgggagucuucaugggcaucgcccuccuccagguacccuuguggccccacgugccccuccccuugccggggccgcccucacucuccccucaccuguccucugucuuacagaucuuuggcaucugccuggcccagaaccucgugagugacaucaaggcagugaaagccaacuggugaggccgccagaggccauggccacaugccuggccuacgcaggccucuggggggccccccaggacccuccuacuauacuccugacgggcaaggcugcaggagauguuccugcugggacugagccuugagggguucgccugaaccgcugugcuguccacccacggaggaaguugcugugccuccgccugggccucuugucccauaugcguguguacacacacaugcaggcacacgugugcacagggagccaccgucucggcuacauuuggggugguggacucuccaggggacuaggaagggcgcagcucagagggugcaggccaaguggggugggaggugcuguguggagggucccccccguucccugccccccagugcugggacgcaccuuucugugcguagcuguauggggcgcguugccugagccacugccucacacagcuucagagcacucuuuucuaugagcuguaacuuugagccugccaggaacccaccucagccucagugucccagacucugaaauggguccaagaauuuucuuucucuugcuugccucucaggagcaaauggaaugaugacuuugaaaacca

SEQ ID NO: 17302 - RNA, 2761 nt, Homo sapiens
cgccacgugaccuugcggccccgcccccucgcccucuagcccccucccgcgggagucgcggcgcugcggguaggagccggguugcgggagaccccagguucgguugggauucccagccagaacggagcuuaagccgggcaggcgagcgaaugacggaguagcgagcugcacggcggcgugcugcgcuguugaggacgcugucccgcgcgcucccaggccgccccgaggcuuggggucuucgaaggauaaucggcgcccggggccgaacagcgggggcacacggggcgcugccgaagugcaaggccacggccagagcucgagcccgacgcgcugucuggagucguagguuggcgccguuuggggucggggucugaggcuugggcgcugccugggccgagcggagaucgggguuugccucccguccccgcucaggacccugacguggcugaagcggccccgggagcaugagcgggcagcgcguggacgucaagguggugaugcugggcaaggaguacgugggcaagacuagccugguggagcgcuacgugcacgaccgcuuucugguggggccuuaucagaacgugagugcauccggaggggccaggcacggugggcgggggaguggggggccgguaaucugcaccuauggccccgaucucuucccucucguugcagaccaucggggccgccuucguggccaaggugaugucggucggagaccggacugugacauuagguauuuggguaagucccccggccaucuauucuugggagacucauuccugaggagguguagguccugccuauuacugguugauuuguggccucacagacccauuucucauagacccguuuccuuaucuggaaaauagcggggucuggagaacguggccuuaaguuugacucaggccuuacucuuuaggacacagcaggcucugagcgcuaugaggccaugaguagaaucuacuaucggggugccaaggcugccaucgucugcuaugguaagggggggggggguuugggcugucucacaagaaaagaugggugccaggcuagccagagaacagcccuugaccacuugguugucuccugcaugccgcacaccaagaccucacagacagcagcagcuuugagcgagcaaaguucugggugaaggaacugcgcagccuagaggagguaggugaacagaccucacuagaacacuaggggcugggguuuuguuggccuguggaggugacccuugucuucugccucagggcugccaaaucuacuuauguggcaccaagagugaccugcuggaagaagaccggaggcgucgacguguggacuuccacgacguccaggacuaugcagacaguagcugcuccucagcccuuugggggguggggguguguggcugucuggguggaucaaagaaaauagggacugccuuggcugccagggcaaggugcucuaggaggucuuccuggccuccuugaacugugggguccaggagacucccugaacugcuagcccucccuuuugucuguuuaucuaauucucagguaugaggcuuuagucacuucucuuuacagauaucaaagcucagcucuuugaaacauccagcaagacaggccagagugugggugagugcugugcuggagccucacagcaggaacaugcaggggcaccagaggaagcugaauagggcacagagggcugggucacugggagaucccagggcuacuggcauugggcccucgcugaucaucauuuuuccugccagacgagcucuuccagaaaguggcagaggauuacgucaguguggcugccuuccaggugaugacaggugugugcuuccccagccuuuauggagacuuacucuaggcccacagcaucuagccccuuuccugaguuaccugaucccaacagaauggugcugagcugccaccucucuuuuugacagaggacaagggcguggaucugggccagaagccaaaccccuacuucuacagcuguugucaucacugagucagcacucaccuggccugggggaauuaaaggaauuccccguaagggcuggacccagcuccuuucugggcuuggguagucaaaugucugagcuaccccagguccucaugucagcagaguggcgccugccugugcuggcccauggaacggagacagcauugggcugacugugggcaugaggagggauaaggcugauuuggaccccaggcuucugcccuggacagcacuugugucugcagauuauuuaaguggcuuuugaucuguaaauaaaaucagugcacugugcaucacacccagccccuuucccugcuguguggauuaggugucaagacaccuaguucuuccuggggccacccggcuggccucacugcuuauauuaaggcuccucccaacucucauuuuccuuuggaaaacaagacuuuuuuccccaugguuaccgcugagauacuggggcuguaguaguauaaaagcucacaguuccuucugagugcugaaaagagugcaugaguugcuucgaaauaaaagggucaagcauuccuaccugagacagguuggucugacuagcucuacugcaucugucauguuugggccccuaugucagaccugugacucagguccugagcuucccagugacauccuacaaugugguuuaaugguaggaaaguccuaaguucuguaagccagaaaggucuaauggauccagauuugguuccaauucagcugcuaauuuagaaaagggacuuaaauccuc

SEQ ID NO: 17303 - RNA, 2558 nt, Homo sapiens
gacagccucaggccccaucuuggaccuacugaaccugaaucuccagaggugggguccucccacucugcacugaaguuugagaaccacugcucuguacuauagaccagcaucuugugcccucccacggugguaaugggacccugggcccaauaggcaacacgugcgauaguaagaucacuggcugcagagacaccucuccuuccucaaagacagcacauguuuauacagcccauaucacaugcuggcccauguucuagaugcuguggauauauuuuuauuugauuuucuuuuauugagacggagcuuugcucuugucacccgggcuggagggcaaugccacaaucucagcucacugcaaccucugccuccuggguucaagcgauucuccugccucagccucccgaguagcugggauuacaggcauccacaaccacauccagcuaauuuuuuuuuuuuuuuguauuuuuaguagagacuggguuucaccauguuggccaggcuggucucgaacuccugaccucaggugauccacccaucucggccucccaaagugcugggauuacaggcgugagccaccguguccagccaaugcugugaauauauuaaacugacuugaucuuuacaucaagauggaagcaaaugguuugccuccauuuguaaauaggcauuaucuccuauuuacagauuacagauggaggcaaacaaguuaacuaacuugcccaaaguuacacagcuaguaaguggcagagacuaaagucuguuccuacccaccaugcuaugcacaccuggcucacccagcaggggcugggggaggagggaaccaggggcugcuggaagguaccugccauaagucccaguacuuagugguuggcacaggauggaaggggagccaggggcagacugaggaaaacccugaccaaguagaaccuggccggggaugcccagguggaggagaacgcaguuccagcuccugggagucgggcccagaacuguccccugggaauccucacugggcucuucugacuuucucuguugggucucuuauagguucuggcugugucagauggagguaagugacagaauguguggagaacuggcugagugggagggaggagggagguggagauggguggggacaccccugccaccugcuaucuuuccagggaacauggcugcagaguggaugcaugggggaggguggguugugccaggggcuggggaaggcagcaaggcucaccccaacuuguccaucccccugcagagcugagcagcacgacggggccccagggccagggcgagggccgcggcagcucucucagcauccacagccuccccaguggucccagcagccccuucccaaccgaggagcagccuguggccagcugggcccuguccuucgagcggcuguugcaggacccgcugggccuggcuuacuucacuguaagccugggguagggaaagggaaggggggacacgggagagggcagggcguggauggagcuucaggcuggccagagugggguccucugucagcuuccucaucuagccuuccugcagcacccucuuccucuucucccagcugggaacuuuucuuccuucucccuguccuugucucugccucucauuuucucucccugucuucagaucggucuggcuccgucugucugucuggcccugucugucuggcuuggucucuuggcccugucucugucccaaucuuuuugaucacaucccccaguuuggucucugugucucugagucucugccugccucccccuccuuccccucccaggaguuccugaagaaggaguucagcgcggaaaacgugacuuucuggaaggccugcgagcgcuuccagcagaucccggccagcgauacccagcaggugggggaagggggagcuggggccgagggcuggggagaggggaacugggccacgcucccugaccaacuccuccugucccuccuccuucagcuagcucaggaggcccgcaacaucuaccaggaguuccuguccagccaggcgcugagcccagugaacaucgaccgucaggccuggcuuggcgaggaggugcuggccgagccccggccggacauguuucgggcacagcagcuucaggugggcgauccuggggggauuggccuugaaagggagacaaaaggagcaggggcggggucggacccuggcggggagucugaacuacaaagcggagggggcaaauuuggaggcggagacagagccaaaugccggggcaggcagggcggagcucagagggcgguaucagaggcacggggaaggacaguuagaggcggagccuagcugagcucggggcgggcuuggaccccggggguggguauaggaacugaggucggggcggggcuugggaaauccagcccuagguuuggggcggggccagccccaaggacccggccugggugcaggcagcccagcgcccccaccccagccccggcucaccuguuccggggucgccccgcagaucuucaacuugaugaaguucgacagcuaugcgcgcuucgucaaguccccgcuguaccgc

SEQ ID NO: 17304 - RNA, 17133 nt, Homo sapiens
gaagggaucuggauuucuuuauuaacagacaugagcacgacccguuacagaaguuugugcuuuccaaaaaaaaaaaaaaaaaaaaaaaaaaaacaguuacuaaacgugaaaaaggaacccaagcaaagaggaaggaguuggggaggggccaccaaagccccugggccccauccauagcccugaccugaaccgcgccuagggccuccaaccugggaccugcccggcaggagacgggggguagccgaggggccccagcugggccugcuacuuccuuugggccagacaggaaggggucaaaagaagggcggggagggggucccagggagccagagcccacgagccauuuauugccauguuuuaaaauucgugcaaaauaucugaagcccuggacagagaauacaaagugauauuuucccaagaaacauaaaacuaggaaaagaggugggggacauuuucccaccagagcuccccccacgccaggccccaagcagggugaggccuccaacccggccagcugagcagggaggacuaagagcuacaaucuggaccagggaaggagggguggaauuugcaacagcgucucaacuaccaacgagaggaaagccagucaacuguacaagucuccuaucaacuuuuuaaaaaaagagaaaagcuguaaaagucaggcccuguggguagggaagcggccaaguccccagccagggccggaauccggagugggugccaggcggagcugcugcgaaugcaggcacggcgggccgucuggccagaggcugaugcaggugggcggccuuggcaaggguagccuagggcuggcgccaccgcuaaucaccacccucgaagcccuccuccucuucuggaacugggucugcaucccagcaugugaugucgaucucuguggcguuagaaagggagaggaguuagggaccuagcagaccgcuuguguccccagccucugugagcgguggguaguggugggguggcuacccacacucaaauccagcccccgcacccaaauuccuccccaucauccagcccaguacuaccuggaggcuuguuguagaacacaggaggcggagccuuggcacagagcucuuccgauugggcaaacuccuccuccugugauugacugaaguaccccucacuggccugcaggggaaagcaucaggucacuuggccccacccagcaggacuggggcugaccuaucaggccugagcccguuuccccagcaaccaaugauuccaucagugguugccagggaaacaaggaugccugccuugggaacaaaagcagagccggcccagggagggagggugggauggacuuccccucaaauaaugugggucacagagaaggggguacuggugcaagcaugaggaaugcagggccagcacccugcucagcccccacucccucccaucccucccaccaggcagucccugccgcaccuggguccccuccuucuggguggucucgccauugguuagcagguggggcuccggcuccugcucuugcuccagcuccucaagggcugagggcagaguuggggucuggggggcagccagggacuccccuuccacuuccucugggucacagaagguggcuggcggcucaggcagcucaucaaaguugagaaggguggcacagccuucgccugcuggcagcaguggcuccggagccaccucauccagcaggggcaccucugccagggugaccucaguacccgaggguggcgugggggcccugggcucacccuggaguguggaggccccuuccccguugccaggccauaggucaaugaggcugguggcggcgggggguacguuguuggcaacaguggugucagcaguggcagugucaguuucaauggugucagcugcaucguggaucuccguggcgucagcuguggcaggcuccacgggagcagccaggacagccugcucugcagacuccaugaacaucaaguccucugcagggcugccuggcccccggggaggcgccugugccugagggggcuccuccauggggccggcccaggccugaggggcugcugcucuggucuccucacugucuaggauggggcugggcuccugggucucugucacagcacaggcagaggagauauguaaccggcuccccucggggaggauggagacccugcccacccacuaaggagugagggagccagggacuuccaugcaggugucccacugcccccuuacccagugaccccagugacuuuaagccccuuggcagcuccgggaggaaggccaaggcccgauucccacuugagagggcgggugcuaagcuuuagagagggcaggucugacuguacaccagggcuccuccccacacagccgccuccagggcagugcagucuuggugauggguggcccagaucccuggagaacgguuaccauggcaaccuggggcucccagccagggacugaugaugggaggccuggugcagguagcaucccucucucaccuugggcugguggggguggcgguggcagugguggaggcugcgaggaggugaccucauccagggcccgcucuaucugcucagcgacagggguggaggcggugcuggagucagacgggcuccgcguggggaugggagugggcgccauccuccgguggcuguccagguggcugccuguggaacaaaccccaggugggucagugagggcgggggagccgggugagacaggauuguccaccuuggggccuggccagcaccuccucucuggaaucugggugggggcugggagcucuccagccccaccaggggccagacuacagcuccagacccuguaagcuaggccccuggaggccagugccccauaaggccaggggcaagaggcaggcagugccugcccugggggcaaacaccagagaucagcggucagacugggggagugagggcggggggcugcugggaagcggggcccuccuuaccacccccgccgaggccuggggcugcuaccuacaugggagggaggaagagagguuuggggugcgguggcaggugauauagggaaagggaguccguggaggggaggaggaggaagaggaggaggaggaaggcccacuguccgaugccuuuaugaaagggcaguacggacgaccugccgagagagacagacagagaaagagacagaggacaagagagggucagucucccccaccccugcccgaggccucucccgcccccagggccuggcccuggauguccaagcugccuucagccaggggcacaaucagccaagccagccgcagccucacaccagccccagacacacagccagccugggagcaguacagcagggacggccuguggcgggaccccagcauggggcaagcacacucagaccagcagacagggcagggaagagcuucaggagaggcggaagcagcacacugagaagcggaacggggacaccugggugcaagcuccgggaggcucccucaggcccggggcaagagcccagcacgcaugcauuccggccuuccaggccagaccuaauucaccccagccgagcugcuccccguggccagcgcugugccucagcccaugccagagcugccccacaggcccuagcacuccccacuguucagccacaagcgacuucaccaccaucccuggcccuucuugggguccugccaccugggaaguggugggcggaugcacgcuggaugaagggucucgccuucuccaaggguugcuugggcaaggccucccuucugagagagucccagagaggcucagggccgcaaccugaggaguggggccggacgggggguggggccuaggacuaccuggucgaugguugaagggcgaggguacaucacagcugcccgcagaggccgaugcgacucuuuccugcugcuugaagaacucccuuggguugucaggccgcugggcaauaauagcugcugccuccugagggcacgaggaaaagguuggggcugggccaggcaagcugagauagcccugucugccucaccuggcuggugcccccagcucucaccuccaccuccgacucugacuucuucaugugggucucuuccuccucaucccgauggucacccuagaaaccaaagggacagugucuggugcaccuaccccccacaggggcuuuuggccuucuuuuuuacuguauuuuauuuauugauuuuguuuuuaagacagguucucgcccuaccacccaggcuggggagcagugguacaaucacggcucacugcagccucugccuccugggcucaagcaauccucccaccucagccucccgaguagcugggacuacaggugugcaccaccaugcccggcuaauuuuaauuuuuugguagagauggggucucccuauguugcccaggcuggucucaaacuucugggcugaagggauccuccugccuuggccucccaaaguguugggauggauuacagucaugagccaccagugcccggccuucuggccuucuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacaggguuucaccguuuuagccgggauggucucgaucuccugaccucgugauccgcccgccucggccucccaaagugcugggauuacaggcgugagccaccgcgcccggccccuucuggccuucuuacagcccccaugcuucuuucgcaaucuggcaggaaggguuucagaggugguaccucugccccgucaaacccugucacacagccccucucuucccucagggcccucagccaccucaucucugaccugccaggccucugggcaccaggcucacucacucacuugcucauccccauaucuaagcaggugccuagggcccuccagaagugcuccuuguuuugcagauaacuucuuggaccuccuacccuagugccggggccaccaugcucccaauguugcugccuggaccguggcaucaugguccagccuuccucacugcuaccugccuuauuugcucuccauaggcccugaaaggaccuuuccaaaaugcggaucagaccaugauuuuccugagcuuaaaaucccucagggguucccaugagccacagcaagcacuggcuaaauaugacccacagauggcuuuuguuuugcugguaugauauuuuuaaaccauguucauuaguuaccaccacuuaaaaaccaggaacuuucauacugagaugagggucccaguuucucuugaggugacagagcccuggcgacaucaccugcaagcccggagcagccaucaccggggccucgccgcagcccccuuaagacaggcgugugccacccgcucacccccggccccaccaucgccuacuggcuucaccugcccacugcacacguuguuuugggugggcagcgcccgcacuuggccuacgucccccaccccugccugaccuagccgucaccucuccaacaccacccccugccggcccccaccccaaggcucccacauacugugagauguagacaucaaguccucagcacgacgcagucaguucccagaacaggcacacccguucccaccuccaagccucagcaugggagacuggccucccucccaaaugccugcuccccacccgggggccaggcccucugguuuccagcugcagcguggccacugcuuccuggggaaggaccucugaacaagaggcuuguucaggucauuuccuccucuggguccccacagggugcuccuggcuuccaccacgaugacaccacauccuaaguuccuguuuccggaggcaccuccccccuccgcugugagcaacgcaggaugaggaccggggucuccggguggguggccagcacaaggcgggcgcauguuugcucaacugcacucacacaccaaaggcuucuuagucgguguccccugcugcucagguggcagcuugggcaggaggggcugcuaagguggugaagucccagggcugcucuguuuuugagccuauaaucuaaaauuuuagcuuaugucaggagcacugggagaagggcccuucguaguaucccaccucaggagggcuaucaccucagugauaacuuugugacccccagaaugaagucuaaacuccuccucugcccuugcucuccuuucccaaucaaaucucccccacuccucagcccacgggguuccagucagccuaggcucuucaccuucccaugagccugugucccaccagccuuugcugcucugcccacugccugcuguaaucucaguugguuccucugccuuguucaaagaaaggaccagaggcaacuaccacaaaggcuuuuuuuuuuuuaaucugagacagagucuuucacucaggcuggagugcaguggcgagaucucggcucacugcaagcuccgccucccggguucacgccauucuccugccucagccucccgaguagcugggacuacaggcgcccgccaccacgcucggcuaauuucuuguauuuuuuaguagagacgggguuucaccauguuagccaggauggucucgaucuccugaccucaugauccgccugccuuggccucccaaagugcugggauuacaggcaugagccacugagcccagcccuccacaaaggcuuuaauaaacuaccaaccaugugaacacugaaacaaguaaggcccagagggaggagagagaucaacgcacuaaccacaugggucaaagccacugcugugccuaaagcauuuucagauacacgggagcuccccugcaggccaggcaaaaagggaacucagauauggaacacaauucguaacaggggagagaaagcaacagcuccuuaagccaagagaaagcauuucacagugcuaaaucccaaagucucucgcauauucccuuccuuagaggaccugaaauugaaaggguaccacacugaccugcuagaauguccacugucacucucacgugaacuauacuugaagggccagaugggacuauaaaauaaugguaagcuccuucagacuuuaccugaaauguugauaacuggugaaaauaaaucagcucaggggguucacaacacuauucugucuaccugcauguguguauguuugaaauguuagcaaaaaaauaaacuuuaucagggcugggugcagugcacuuugggaggccgaggugggaggaucaccugaggucaggaguuugagaccagccuggccaacauggugaaacccugucucuacuaaaaauacaaacauuagccgggcauggagccgugcaccuguaaucccagcuacuugggaggcugaggcaggagaaucgcuugaacccaggaggcagagguugcagugagcugagauggcgccauugcacucuagccugggggacaagagugagacuucaucuuaaaaaagauaaauaaauaaaaauaaauaaauaaauaaauaaacuuuaucaggcagggugcgguggcucacgccuguaauuccaggacuuugggaggccgagacagguggaucacgaggucaggaguucgagaccagccugaccaacacggugaaacccugucucuacuaaaaauacaaaaauuagcugggcaugguggugcacgccuguaaucccagcuacucaggaggcugaggcaagagaaucgcuugaacccaggaggcagagguugcagugagcugagauugugccauugcacuccagccugggcgacagagcaagacucugucucaaaaaaauaaaaauaaauaaauaaauaaacuuggcugggugagguggcucacaccuguaauuccagcacuuugggaggccgaggagggcagaucaugagguuaagagaucgagaccauccuggccaacauggugaaaccccaucucuacuaaaaagacaauaaauaaauaaauaaauaaauaaauaaauaaauaaauaaauaauaaacuuuaucugcugggugcgguggcucaugccuguaaucccggcacuuugugaggccggcggguggaucaccugaggucaggaguucaagaucagcuuggccaacauggugaaaccccaucucuacuaaaaauacaaaaauuagccaggcgugguggugggcgccuguaaucccagcuacuugggaggcugaggcaggaaaaucacuuaaaccugggaggcaggccgggugcaguggcucacgccuguaaucccagcacuuuggguggcugaggugggcagaucaugaggucaggagaucgagaccacccuggcuaacauggugaaaccccgucucuacuaaaaauacaaaaaauuagccggacgugguggcgggcaccuguagucccagcuacuuggaggcugaggcaggagaauggugugaaccugggaggcggagcuggcagugagcugagauggcgccacugcacuccggccugggcgacagagcgagauuccgucucaaaaaaauuuaaaaaauaaaaaaauuuuaaaaaaccucacucugaaaggauaaauaaaaugugguauauccauacaauggaauaugauucagccuucaaaaagaaggaaauucugaugcaugcuacaacauggaugaaucuuaaggacaucaugcuaagugaaauaagccacacgcaaaaggacaaacaccgugcgauuccacugauaggcagucuccagaguagucaacuucauagagacagaaaguggaauggucguugccaggagcuggcgaguggggaagggcagaauuuguguuuaauggauggugguggugguuauccuacaaugugaaugaauuuaaugccgcuuaaugaaaugcagauuuuaaaaugacugaaaugguacauuuuauguauuuugccacaguuacauacauguggccaggcgcgguggcucacgucuauaaucccagcacuuugggaggccgaggcgggcagaucaaccgaggucaggaguucaagaccauccuggccaacauggugaaacccagucucuacaaaaacacaaaaauuagcuaggcaugauggugugcgccuguaaucccagcuacucaggaggcugaggcgggagaaucgcuugaaccugggagauggagguugcagugagccaagaucacgccauugcauucuacccugggcgacagagugagacuccaucucaaaaaaaaaaaaaaaaaauacaugaaucaacuuaugaaaaaaagaucuuacccagcucguucuccaccauguucuuuauguggcagguggcagguguguguugaaugaaugacugaggauggagcuuaccagccacacaucauccccaccccauccaagggcagaugugacuggagugacuuaaugcugcugccugcaggacugucuugccuccucucucucagccuccugugggugacuccggagcccguuugaguccccacagccaugcaucugcccauuacagucccaauccagaugaguaucaacccaccucccuuccugaacugagccaugcucaguccugaaugacauuagcuauuuccaaaauacuaaauucaaagcauggagaugugacucugcugugauucucagggaccaauccacaggaccuacgggccauucccaauguguggagauucagacaguaccccuggaacaaaggggcugcucccagggagaugcugcucccaaggagaugguacacacugccugcagaugcucagcacuggcccaggcucacccaugccgccugccucacuccuguggccccucagagugcagaacagugucuaaucgccgagaaaccccagggcaggggagggggagccuggucagugagggucugggucuagauggaguuucucuuccaaucuagagcacaagcuucuccaaaguagucuuuuuccacggccagaggccagagccccacgugaugaggugccaggccucaugcuccauggcacccugugcccaugcagcuccccagaacagccaccacugucccugagccacugaucuccccacaaggcccaggaacacagggaccauucucacuucccugacccagagaccgggagccuuggcaaagaacuuacaaagauagacugcuccuucaaccgccucuuggccucuuccgcuucuaaagucugcuguuuccuccuggaacgauaagcagccagcacccgucagggugcgcccgggggccccuggagcgcuccgggcgggcaggcucaccugugcuccucgaucugcugcucccgcucccgguagcgccgcucgcgcuccucuugcuccugccgcuccugcuccauccgcuccugcucgaaccugagccucucauccagggccuucuuccgcuccuccuccuuccgcagcucuucuuccuucugcaagccccggugcgaacaaggguaggccccgagccuaggcgccuggacccugccccuccagccccucccuaacccagcgcugggggcggggcacguggcaugggccaugccacugcagugagggacucagaccugccccaugggguccaugagggguggcucagccaggccgggcucaggguuccauaccuuggccugcucccagaacugcucucgguuaauccgcuucauuuccacagcugcauccgucuucugguagguggugcccugcagugucgaaggacccagcauaagcaggcugaaugccccaggaacccccgacaccuaaagggugagagcuaagagggaccgggcaggccagacucgggcaccaggccacgcaggcagagcccacgggugccaaacacacacuaaccacgggcucugcguucucauccucucgcagccgcagucggugcagcacagggcuggagagucgcgccagcccguuagagagccgcugcccgauggcacccgcgucuaugucuuccacgcugcuggcguucacgaucacgucgacacccuuccgcaagaagacggcagugcucaggcggcaccauccucccgccauccccaccccagcacgcagacccugguggcuguccccacccccaagagcgcuggccccugacacgcaccuggaagaacuccgccaccuuagccacguggcuggcacaagcgcacuugcgggcaucaggcacaucuucgcccaccugcaaaguacccagcaaagagggggucaggaaaggacaaggggggcccuacacgauagggugcaucuuccccggggugggaagagggugggcuucccucuccacgggugucagagggccgacggggagggcgacugcucugggccuucaguucccuuccccagccccggccgcauacccaguugaugagcagcucugggcccucagcccccuuccccagccccggccgcauacccaguugaugagcagcucugggcccucagcccccuuccccagccccggccgcauacccaguugaugagcacguauuuuggcagagcagcuugggaguccuugacacugcagaagccguacaucaccuucugguucucaaagugucccgaaagcuccugcaagcccccuucuaggguaaucaggagagugucaggucucucugccuccuaaacccuucccaaaaagagccuggaacucaaagcaaagacuccuccaggccuccacaggcacccccaggggucuucuggccucuggggucugugggucccaguuuuguguugguaugugugggggugguggcgcacagggauguagcuuugccugugacuccugcagggccugauuuggggguaggacugaggaaguguuuguucuucacacucaggucucauucuucacacaucaucaugucucaccaggugccagugcccagaggcacaaucaagccuucuggcucuggggaaggcggugaauagggcccuucccccaaagugucccagcuguguggcuucagauaagucacuuucccuguuggaggcucagccucagaaguccaacauucaacaaggcucugagauuccuccccacccuggggacacagggaugacuggaggaaggacacccgccagauccagacaaguguggggcugcagggugcaggcagggagguggccuacagccagguggguggggaagaaaacaaccaggaggaggggguggagaaggcggcgagggaauggcuggaauuccuaccuccugaugcugcaagcuugaggucaucggagccaucuucauauguguacagagcccuggggagagggagggguggcugucaaacugucagggcccaggccgccaauucuggguggggacggcucuggggagggagagggacauggaguggguaggacaggaacggggagggcuccugcuguagccaugacaacagggccaggcaucgguucaggcgggagcccagcaggguacugcuggaggccugggucaggggggcgcaggcagugaggggagaaauugcuggcuggucgagcucagugcgcagcaucccggcccuggcccuggcagccuacaacccaguggagcgggugugugauggagauuccaaggcgacgguuccuugguuaccguucccuggcuaccaggauccucaucccccauuggcuagugccaggaacuuaccuggcacgugccuugguccccgcugccccucccccggggagggaggaggagaagagagaaccuggugcucccaacagcucugggcaucccccaguaaccauggcaacccugcaauuggcacacgacuggcccaccccaacugcauucuccuugaacacaaaggacccuggggacccgcccucagccucaaucuccgccucucugaaauggggaugaggucacugcagucacucucgcccagacucuggccccgggguggccaagccugagcuccaggccuuccagccccuaggcugccucaguccuggcugaggcuuccugagacugcuggccuuuccuucugucugagcucuaacagaaagcugaccugguggccuuccuccuuccuccuccucccuagcuuugugugcccuggcuccuuuugauaggcugcggugacagagcaaccauugcacagaagggaaggcagagaugccuccuccaucaccccaugcaggcccaggcugaggacccucugggagggaggagagccggggccuaggaggaagggccuugucccugaaguuugaaagggcucucaaccccuucuccaaacuccuauuccccaggugccaaggcaggaggcuggggcugugaggaggggaggcagaaagggagggcaagggagaagagaaagaggaggggagaagcagagggagaaaccaggagaggaggaagaagagaaaggacagaagugaagggacaaaggaaaugaaggcgggagggauggaggggacgucucaggagguuguggccagggccaaauggccucagccccuccccuuccuggauucccggcuuccuaccuccaggaaggaacacaggugggcuguggggcugggagcuccugguccaacuguuacccccagccccagccuggcccugacagaugcuuccagcacagcuggcccaccaccuguccugcugcccuaacccaccacgggaacaaagggcccugggagaagcaggcucugucucucuccaugcacugaugagaaacuaaugcagagcccagggacccuaguuccuagagacugcuguagacaucaagccucccucugagaggaccugucuuggccugccuaggcuccccggggugccuuccauccucagccccuggcuccccaccuccggccaccucuuccugcuccagccgcagcucucccccagcagaaaccauaccccaguucaaacccuccagccugccuuuccauuggaccacccuguccacaccacacacuugggacacacuggacggcucccugacccaagcaggguucuggacagggcucacccugaagccucugccuauguaguucucuucacguggaaggcaagaccugcuccucuaccccacgccuauucccaguggaaugcuuccguucuucagagcccagugcuggcccccagcagccucuccugagcugccccucccagagcacccaccauaucccagcaggaauacaaagaccagugcuucucaaccacaucagaggcaccccgagccugguggugcaccagguggaagcuggcgaaaccacagggaaucaggaugggguaggcgaccaggcaucuacacaucucaccagcuccaacuccuggagacagacacugcccccagcuguaagccuggugaaggcaggaacgcugacucagucaaucagcacauccugcucucuggguccugggguccagcacaccgcauaccagaaguaugugugauauugacaccaacucaaaagccaucuagccagauaaacugaacuagcgugaggugggagcuggaauguggcaguuccagagacccuggggugagcugggauggggggugagcugggguggagggugagcuggagucgggggcugagggcagguggaccccgcaggaccaucacucucaggaugguggugcuagaaaggccuucaguauccgagguagugcugggcccaaucccuuuucuuuccaagaggaccaggaacuuguguaugaucacagugagucauaucacaaccaggacaacaguggcccuucccaccacacaaccucauuuccuggguccccugcucccugugccagaguaguggugcacuucagaggcccugccaccuaggagugaacucccccaaccaccccuccccauuggaggcaagguaagggucggggggcagacagcaauuuacccaagacaccccucccucuggaccuaugugcagggucugccucugagucuucagaccucacugcaccccugguuccaugcugggcccugggguauucauauucucuuguguagaaagugauccucacaccccuuuuucaaaauguuaucugggcccuuagugaacgaaugugugcaugugcgaggguacaugugugcaucugugugugucccacacacaacccagaugggggcugacgcacaccagugaugaauaacucgcuuuggccacacggaugcugcuggggugggugggggcaggccuguguugagcaggauguggggcaacagggguuguguggccuuggcaauaggccaccagagcucugcuuuuaggagaaaaugggguguugguagacaacaccccuccaggcuggagggcaaaggagguguucuggggugagcugugcuucuccccaggcggggccuuaucccaaagccagcuccuucaccaggccaagccggccacuugcccagagcuccucccaugaucucagccccccuggggcagggcugggacaaugggugggccgccugccugcugagccugugccggccucuccugugacugaccugcaggacacgagagcuugucucucgcguccaucccuccaggccuggcugcuggccagugcugcaguaccaugccauggaugcccagccaucucauccucuccuccagaagcccccaggucagaguccccaccuggcugcccucccagugugcgggugaggccagcccaagcggggucccucagaccugcccuccucuuugccucaguuuccucaagaagaaccuguucccaucugccagcagggagaggaggccuaggaaccagaugggcaccuucccuagaagaagaguauuacggggggguuaaaggauuccaggauggggcugugaggaaccccucgguuuccuuuuuccaccacccugggccgccagccccagagcaggugguccauccccucccccagcucagcgggagacaacagcuggggggcggggugaggggcggcccagcuccucccccaucagggaccgagugccccuugcugggggccgguggaucuguucaccccuucagccgucuuugggggcucccuccacacuuguucuccagagggcuuccucccagggaucucagcuggccccuuaggcagcucggugccccccagcccagcugccuaguccccgcaguccccuucagguaggggaggagagcucaccccugccuccuccgcgacccgcggcgguaagggagucacuucgcggucgccauguggcagcaaacauccuuccaccucacuccagcccagguuucggggggagggcggcccacuccgagaggccccccggugggcggggcgcccggcccccagcccgcuccgcuccucccccgcccucgcuuuccuuugugcuguggccgggccgggcugagccgggcaggcugcgcuggcuccgcuagcucgguccccgccccguccccgcccggaccucgcccgcucgaagguggcgaaggugcccuuggccgccccgugcacaccugucccccgggcccgggggguagggugggggaugggcucccgcagggccacgcggccccgggccccacaucgggaccccgcgccuccgggccgcguccggccgccgcucccaccgcgcgccuugggccgccuccgggcgcucggggcccggcagugccccgccuggcccgccggccccucccccggcgcgcacaaaggcagccccucccggcccucccggcccgcugcaccauuucggggucccccucccuucccggcggcggggcggcggggcgggagagaaacaaaggcgcggcggcggcgcggggacaaaggggccgggggcgggggcggggggcucaccagucggccgcgcucuccucucggaucaccuccucguaagccgccagcagcuccaggcgguggccgcugaagcugacgccggccaugcuucgggccggaccgggccgaacggacagacgcgcggacggacgggcggacggaggaggagggagggaaagagggagucgccgccgccgccucggagccucugcagcgucgcgagccgagcgagccagcggccgggggaggggagccggccggcggggggcggggggcgcuggcuccgcccggcucgcucccuccgcucgcucgguccuagcgccgccc

SEQ ID NO: 17305 - RNA, 5575 nt, Homo sapiens
gggccagggcugggcuagagguuugggcuuuaauggcagcugggguaaaaggaaacaaaaacaguaauucugaagagcacagggaacaggcagccaggaccagccuggcccaucccaggccagcugagcugaaaugcugauucuguccagggggcugcuguauguguagacugguggcagucuuggggacugaggccucuuggagagaagggaagacugucggcucagaaguccauggagcugugggccagguaguccuugcgaccgauguugcugaccugcuuggucugcauagccucgaguuuggggcagucagugauccgaugacccaggcccccgcagaaggcacagccgcgcucuccugggggaauggggacaggggucagccaagucaaggaccaggauccaugcccuggacuucgggccccccguuaggcacccucgguccaccgguuucacguuucugacuuccagcaccccuccuugccaccugccggcuggggacucggggaucccgcucugcagucaccuccaauguccagcauggacucauccccgcaaugcagcaccugcagcacgggcggcaccuucugcuuggcuucuagcagcagcgcuuugagguccaucagcacugacucaucugggggaggaguggggaagcaucagggcccauccugggcucuguggccagaaccuggguggccacaggcaggggacccagggaacagcuaagguggcgcugguaacagacucaccacacgcuuuguugaugaagguaguggcgaugccuguguuucccgagcgcccggugcggccaauccgguguacugcagagagaaggacagagucucuggcccaucgcuggacacuaggggccuggcuuggcccuuuuccggccuaacccaugcccuugggccccaggcucuuaccauaguucucaaucuccucuggcaugucauaauugaugacgugcuggauggcagggaaguccaggcccuuggaggcaacgucuguggcuacuaggacauccuucuugcccucccggaaugccucgauggccuuaguccguuccuccuggucuggggagggucaggcagacacugucagagccaccaugggacaggggaguggcaggccaaccaggcaggggaaggcauuagguaaagcacugcuacugcagcaggguccaagccagugcuugcaccacccugaccuuugcccccauggauggcuacggccucaacccccuugagcagcagguacucguggauggcguccacgucugccuucuucucugcaaagaugaguaccuguccggaaagaccaacuccagucaggggcuaacugccugggcacccaccgcaccuccccuggcacucuguccccuccaaagcccucccugguccuggggacucuggccccggccuggccuggcugcacucacaggcgggggugucuucugcaggcacucgagcagguacaccaucuuggccuccuccuucacauauucuaccuccugccaccacaaagaucaggucaggugaucuugagauuaggcuuacccgccacagcccugccauggcccgucaucuggaccaggaggugaccagaagccucuggccgccaagggcuggugcccuaaaaauggcccugguuaagcgucaggggcuuugaaugaaacccccgguucccacaagguggacccccggcuccaaucagcuucagggagacuugucagauccagcccccacaggugagagaccgcccaucaggagcaccugcccaccuggaugacauccaggcuggcagccccagcgcgccccacauugauggucacaggcuuuacaagggcacucuuagcaaaguucugaaucuucuucggcaugguggcacugaagagcagggucugucgcuggcccugaggaagaggggggcugcgaccaagggcacacagggcugggcugaggggcauggggucuggggaagcugagcaacugagacacagcccacaaaguaugagcaguggguugggguggccaggggcauggggucccugcagucugauguggcgugcaguggggggcggugcagggugcccuggccgggcgggggcggcaccuugaaguaggagaagaugguacggaugucacccucgaagcccaugucgaucaugcggucagccucguccagggccagguagcgacagaugucuaggcugaccaucuucuucugcagcaaauccaugaggcgccccgggguggccaccaucauguguacaccgcuggggaccaaggagagacccugagguuggggccacuggccuaucaccuaucuagaggcaagcaggcacccugcaucugcucugcucucuguccuccuuccuauuucuuugucuguccccuucucaucauucccaccaccugcccuauguauagcacacagcucuuucccaaggcacugcagccaucuucaccaccgcucggccuggcgcgccuucccccuucuccugggucagccucucacccagaagcgcugucaucaagcuccagaggcuuuacucugggcucgcuuuccuggcccacuggcuucaccuuuucugugcucaccaucucccuaauacucagaaguccguggaggaaggccuccgggauggggucuggcccaucugugaacagagggccugguccagggccucugguggucugcagaggacugcacagcacugaaaggacacaggugccgcugggauccagcccuaccccagugccucaaccuccuugacugaccacugaaugacccugaccuuccugggccguccgccucugugcuuucagccuggacugccccucuucccaauucaaaugucaccuucccggaaaagccuucucugagcucccaccucccagauguccccagcaaggugggccauuccaucugccgugcucccacaguaccuggccacaucccucuguccucccccaacuaaccuccccauuagacugggagcuccuugagggucgcacucacagcagcccucugugaagaucuguggaguggcuaagguaaaggguccuuuagcuuuuccacagacucgcagguggcagagguggggggcagggagcgccagcacucacugucggauggucuccaucugcucuuucacggacaugcccccaaugcagagggcgcagcgcaggaguggugagcuguccuccugcagcaggcggcaguaguacuccaggaugccaugggucugccgggccagcucccgcugcaggcagagggacaaaggcuggcaccagauggcagccccaaucucuggccugcccuccaggccagccuaucuuaccgaggggcagaugaugaguccauagggccccucgcgcuuugagaaggguaaccucuucucuuguuccaggcagaacaugaugacgggcaacgugaacaccagugucuugccugaacccgugaaagcgaugccuaucaugucacggccagauagacuguugggagaggaugacccgagggccaauuucaacagaagaugaaggacaccuagccauugcuccucccuguuccagcccuccucaaggaccccagguccacaguccacacucacaugguggggaugcccuggaucugaauggguguuggguggugaaugccuuucuucuucaggccucucaggauggcuaugaaaaccaaccgacaucgucuucaugacucacagguacuuucucagagccccaaagccuguaaaacuggcacuaccccuacaaguugcagaugaugaaacugaggcucagagagagagagagagaguggaaaaaaaaaaagaaaaaaagagacuuguccaaggcccacaggcuaggugcagccaggauuuguacccagugucuaugcccaauggcacuuuccuccugaagcuuuguaacagcagagaacaaugaacacguacagcugaggcaacaaggaaccuaaagaaacuccuccucaaaucccuccagccccagugacuggauccaaugcagauguggcugagcucagugggagccaggacauaaccucacaggcauuugauuauaaaagugugguaucucucuccagccccugacuaccugcaggaaacuucauuuccuugaagcucuugauggguggugggauaccgucucccuccaccaggaugugguauuucuuccgcacgcgcucaugucgcucuucagacaugcucagaacauaacgggguggaguccagcuguggauggguaacagggaucaagagagcccugggaauagcuggccugggagcaucccugcauguaccauccuaagcaagggcaacugcagacuguacagacauaccugguuuugauggggucaucauacguaaugcccuuagccaucuccuucacugacaucaaugcugaagagagagacauggcucagggcuggcuccugcuucugagaagccagaucccuugagauauaacaugccuggggcugggaggagaagacucaguccaccuucucacuauccuggcuacaaccauaccucggcccucggcaacacucuccaggaucuucucuucuuccuucagcugcuucuccuuggcagacucuuugcgcgcugagaaaagaaguggaagaugucagacagauaccaaaacgguguaccaggcucagcuucuucuuucucgcccaggcagugcugcccagcccaccuucagccuucucuuuaaggugcuggugcugauccaggaggcugacguuggacugagggccuagcgggaugucguccucaucuccccgggguucacuaccgcuguccugcugcucuuccuccgcagcucccuugcgucuucgcugcagcagcuucuggagcugagguuccacccgggauccacagauaggaugggcauggaguccacaaggucagcgucaggauccuggcuuuggggcgaggauccugugcccgaggcgcaaagcugcccuaccccucagaucaagccgucggucccucguuugucugggggccgcgcccugguguacugaagcucacuccucagacugcccuccuccccacggaggccgaggccacgcccgcccccugcgaccccgcggucacggccccaucccuccccggacgcgugccccucaccaguagcugccggcgcugccguaacggcacauagggcacguaguccucgucguccucaucuuccgccucggagcggcuuccuccggcaggcaccucgucggugcgagcccgcugcaagcacacgccagucaggcacggccugcuccccucuucacgcccgcucccacacgcgcggggucucgccucucuccuaccuuccguucggguuccgacuccuccauucuuugcugcacgcaugcgcgccacggcgaaaccccgccucauccuugcgugagacccaauccgaugugaagaggcgaacgacggcgcguaggaacgaccucggaguuccggaucgcgcagagggacaaauuuguuccggagauacuaucgcacggcgaggcauggacgcuuucaugggugguuacgcgacaguug

SEQ ID NO: 17306 - RNA, 2815 nt, Homo sapiens
cauuccacauacggcagccacagugagcuuuucaaaauggaaauuagaucagggcccucuccaaagguuccugucacacccagugagaggggucugccaccucccgcccuccugccccugccccagguggccucucacagggccugagaagccugagcccgggcaggggugccgaggggagagggugggggcgggcgcuaccugaagugguccaccugguugagcacguagauguggugccggaucuucuuccugcucaggaagcggcgcauguggggcacgaagaccaggagcuccucgaagcguucgcggaagggcaccagcacugccaggcggugggggccccaggaugcgucuucuucccagugcucagggggcggcucuggggggcaggcacggggagggcccgaggucuccugcccuuguccccugacugcccgggccacguccccagagcagcugagcugcagccagaguagggagaagaagcccagcgagaggcaggccacgaacagguggaagacggaacacuuccgagggaggccgccggagagcaacccggaccuggagcaagcgcgggacagggucaggagggcggggcagggcuggcccugugacagacccguucucuggccuccccacgaggaggcugcacauaacucgucuaccccaagcaccugggaauuaguacagaagcaacuuuaauguuucugcucaugccacuaccaugcauccgaauccugcuugccucucuagacccaacccaugccacccgcucucgggaagcccucugaaccacucccaguucacagagcugccccggcuccucaaugcucucuuacuuucugugacugaguccuggucagagcugcucagggcaaggaugaggaggcuccugucacuugcaggugcuccuccccacgauaguggcucaauguccugagccaaugacaggaguccccaccuuagagaugcaacccacugcuuuccaaacccgcuccccuacagauccaccccagcagaaaccguggcuccauccugcuuccaagaaugaccagaaaggccacccagacacgggugugugcuggcauuaguccagguaaaaugaccaauguuuacucugggaagaucagacgugccccccgaagcaaugcaaggcccaaacugucaguggcgguucacugaacgagccucaaaccuuuaguccaagaggcagcucaugauaaaagaugggagauggagagggaaagaaagaugagggcuggguacagcacaggcacugauuucagaaacuggaaaaacagcugaacaucacagacacuggggugaugccaggagacagccuuuugguuagcaaauacaaagaaacagaauucaccagauuccuuugccgcuccucuggaaguuccugaguaugcugagacaggagcugaggaauccaugaagggagaagcuuccucuguacucccccuaccuucuccccaaaguaaucugcaaaggaauccacuucacaaucuuaagagucagcgauuagcuaucaggucuuauaaauucuaucuccuggccaggcgugguggcucacgccuguaaucccagcacuuugggaggccgaggcaggugcaucacgaggucaggagcucaagaccagccuggcaaauaugguaacaccccaucucuacuaaaaauacaaaaauuagcuggguguggugguacgcgccuauagucccagcuacuugggaggcugaggcagaagcauagcuugaaucugggaggcggagguugcagugagcugagaucacgccacugcacuccagccugggcaacagagcgagacuccaucucauaaauaaauaaauaaauaaauaaauucuaucuccuaagucccccucugauccuuccucacucaucuguuccuugcccugcucagaccccuucagucuucugaaugacccuccucuguuugccagacaaaggccaagcccuuuggccugacagucaaagcccuccaugaccuggccccaacuccaggugcucccaagccuucgccccauguucucauguugggcaccucggagcuucuccacuugcuauauuccuuccugcuccagcccucacacagccugcuccuucugccugaaauguccuucuuuaucugccugaggaccccuguugauccuucagagccgaacuccaaugucauggccagcacugcccccugcccccauaaugcucccacuuuuguauucccacggcaucuucccacuuuuuuguaaugccuuguguccuugcuucucaggccgugucagauucuuaucuguggccccagcacagcaagcacaggccagacagcagagagcuugccaagugaguuacagaaagggguaaggcagucagggcaugccuuaagucacaugcuaaagccagaccaacuccucccuuuuucuagagagaccgccaaccuggaagccaguagccuugcagccaggcccagguuccacacgcagcugagagguggccugguaggaaaccccccagggcuucugacuuaccccccauuauccuguggugguggauucagcuggggaggagcacagcccaguccugagaguggucugggaaggcuggaaccucuacagauucucccuugcccucugggcuuuuucuggggacaggguagagacuggagagauggauauggggugauaucccaccuucaugaaaagaagcagugacuauuauccaggggaacggcguggacuggguacuccgagcacguccacacgcuaauucccucggcccugcuccccucuccuau

SEQ ID NO: 17307 - RNA, 25924 nt, Homo sapiens
uaagauggcggcgcggggccgcgcccgcgcucccaggcucuccucccccagccuuccuccggcuggcagcacgacucgcguagccgugcgccgauugccucucggccugggcaauggucccggcugccggucgacgaccgccccgcgucaugcggcuccucggcugguggcaaguauugcugugggugcugggacuucccguccgcggcguggagggugagugugggccgggggcggugcaugagaugauggggcgagcugagguccacccgggcgacgcucuggaccugcgcgaaggccggcggugcgcgacucgccccuucuuggcgucuccccgggcgcgucuccccgacuucucuccccgcgcaccgcccgcugguggcccgcgaaagggggccggugggcugagggccgguggacgggagcccgggggugguugggccgcguucaggccgcccucagcccguggcugguagccaggagggacagugcgguaagcgcugcugaggcauacccucuggugauaagcaauuuauuauuaauaacauuauaucaaauaccgacauuguuguggccguauuaggagccaggaacugugcaucgugcuuuauuuacaucauuaucccauuuaaugcucccacaaacccugucagaucgguuccguuuagugucuccauuucacagaugaagaugcucaggccccgccuaaguuugcgcuucugauacguggcagaagccugucucucugacgccaaagcccagucuggaguccacgcugcuggaccacugucuuaaggaggccagucuugcucagcucccugcaugaaaaacagacgagaaacacgggagacucccgguaacccccaacuugccgguagggaaggcagccacucuagaggcauggcgaggguggagaguggaggccuuacuuucaugcuccuucaccccacuccucauaguccuguuaaaguccagacccucggucucgcuugucauuuagaccuuaacaggaauaggcaggucuuucuuuucccugggguguccuggauggaggcaggacagcagagaguuguggagaagggugagucauaguaacacaauuaccaugaaugaaagcgcucacuguguaccagaugcugugcucagugcuuuacgagcaucaucuuuuggaaucuuuacuguuuuguuuuuguuuuuuuaagggaugagggcuugcucuguugcccaggcgggagugcaguggcccaucauggcucccugcagccuugaacuccugggcuuaagugauccucccaccuguuucccaaagugcugggauuacagaugugagccacugcucccgguuuauguaauuuuuauuuuuauuuuuuuuugagauggagucucgcucuguugcccaggcuggagugcaguggcgcgaucuuggcucacugcaaccucugacucccggguucaagcgauucucgugccucagccuccugaguagcugggauuacaggugccugccaccacacugggcuaauuuuuguauuuuuaguagagaugaugguccaccauguuggccacgcuggucuggaacuccugaccucaggugauccacccaccucggccucccagagugcugggauuacaggcuugagccaccgugccuggccuuaguaauuuuuaaaugcauaugcaguagauguuaucaugcucauuuuauagaaguaacuuaagacucagagccaauaaguccuuugacaaggucauacagccagaaguugaggagccuugauucaagcccaugucugccugacuucagagcccaaccucugcauuuucacuauacuuaacugcuagccucacagaggggauggcauggguuggauaucuucuguuucagccccuccaccgugcucugugcccuguguggcuguccuguguggaauaaauaccagcuguccuaccgucuugcuuccauuguguuggaaugaggggagagugaggucaggguauugauucucuccgcucccucccugagaaguuauugaaggcuggcuuugcccccgguggaaagcauugaauucuagaaagcugcccucuguguuacccuugauguuucaagguucugugacuacuucucucuccagacucuuaaggucuaugagugguaacuggcuccuccucuacuguuacuggccuuggaauuccuuaccauugcuuuucauuucucugcacccagccuacacauuaguggucccuucauuaaacucuccucaacuugcccaaguuaaaugugcuguuuccuggcagaacccuggcugauucaggguucagcuugggucuuuggucaucauggccaggccaugaauggggugaagacagaagaaacuucaccagcugauuucuucucagaguagcugaaaaucugagguguuuuuuuuuuuuuuuuuucugcagaggaugccacuggcagauuaugcuggccucaggugcugaggcccugagagacuaagcaaccuggagguagcaaugcuauccaggugucuaggaauggaagcaaacuccuggcuucaauaccccuaugccacucuucccuaggcagucagcuagcaaauucuuacugagcacucaucauaugcuaaacacugugcugagcacuggggauccaguggugaguuagagcagcaggccuuuggggaaggcagccacuaaauaacuacaaauuacuaagaaaauugcaagacugagaaaugcaucaaggagagucccagggcguuuuugggaacuguaaugggagaccucccacccuggucugagggucagggaauguguccuuacagaggugacauuuagggugagaucugaaugaggaggaugaaggauuuggcaggaggaagcuucccagcagagaaacagcccucaggaaggcucuaaggcagguggggauaggaggaguguaaaugaucagggacuagagggaucugauggccacaggugagagugcagacagaggccacauuggggccugguagcucugcuacagaaugcagaugcauucacaggguaggggaagccacugaaagaguuuuagcaggggagugacaugaucagauaugccuuuuaucuuucaguuucacuuguauugcugugaaggucagggucuggaggggggauagcaggcugaccagggagaccaguuuagguggcuacaguaguugcccagacaagaauuggcuguggccuuugcugagaaguguuaguugggauggggaaaguagauggauugugaauguguuuagcaggugaaauuuuuuuuuuucuuuuugagaaggagucuugcucuugucacccaggcuggagugcaguggcaccaucuuggcucacugcaaccuccaccuccuggguucaaaugauucuccugccucagccucccgaguagcugggauuacaggcaugcgccaccaugccuggcuaauuuuuuuuuuuuuuuuugagauggaguuuugcucuuguugcucaggcuggagcaauggugcgaucuuggcucauugcaaccucugccucccggguucaagcgauucucuugucucagcuuccugaguagcugggauuacaggcacccgucacuacaccccggcuaauuuuugguauuuuuaguagagaugggguuucgccauguuggccaggcuggucucgaacuccugaccucaggugaucugcccgccuugaccucccaaagugcugggauuacaggcgugagccacugcgccuggccuaauuuuuguauuuuuuaguagagaugggguuucaccauguuggccaggcuggucuugaauuccugaccucaaguaaucugccugccuuggccucccaaaguguuaggauuacagguaugaaccagcaagcccagugugcagguuaauuaauagaacuuaguuauugugccuuuccaucucuuugaauuguaaacaccacucaucauaaucaucaucaucaccacagccauuuauggaguguuuaaccuguggcagggaccauacacaucuuuucucauuuaaucuucacaguagccucauaauuuucuacauuuuggugguauugucuccauuugcuaaaugagcacacaguauugccuauggaaaguauggauugcugucccuccaacccuugacuguuuuuggucccuccucauuugccuuuccugccagaagccauugugaaaacaccugcagcugguaaagagccuucugagaaaagcuggaagggugugaaggugcugaccuaggcuagggcucccuggcagaauuggcauggugcccucacacuuguccuucagacaacuucuuugcugccagugaugcaauaauuaucacuuuauguauagcucaaacugcagucucuuaaaaggcacauuaccagucgggugcaguggcucacgccuguaaucccagcacacugggaggccgagguggcuggaucauuugaggccagaaguuugagaccagccuggccaacauggugaaaccccaucucuacuaaaaauaaaaaaaguagccaggugugguggugcgcaucuguaaucccagcuauuugggaggcuaaggcaggagaauugcuugaacccaggagauggaggcugcagugagcugagaucgugccacugcacuccagcccggacaacagagcaagacucugucucaaagaaaauaaaaaauaaaagcacauuaccaagggaggguucaaugacugucacauaguaugacauuuuuauuuucguguggaauaauucaguguuucuuuucuuccuaauuccuaaaugaaaacguugguaccugaaggcauaagauuuuuuuguuccuaaucuguacuguguacuuaaauauuuuuacaaugugcagggggauggaggggacaacacucuugaacuuaaaauaccagcuccaugcaccacuuacauucccuuuugauuuugugcaggggcuaucugagggucaucagagagaaccagauuaaaauuugugcccugauuuuuuuauccugagguucuucguuuuggcauucuucauuuacuuguggaaucuagaauguugauuagguagcaagagcaaaucucugaagaacugugguguuugggaguuggguuggaccccaaaccuggcauccuuucuuuuccagacucuuagccucucuggcuucauuuccugcuuugucuuguggcugacacagaaaacauguguguuuguuuuuucuucugaucauacaggcaauacacacucauuaaccaaaggcuauagaaauaaaaggcuauagaaauaccgccaaugugaucccgccccuccaccaauuuggcaaagcucccuucccaggcacccagccgcuucucuggauuguagucacagaagugcuugaccuucugcuaaagacucacuuugcugcccaagccuuaaacucuguccuauguaaccuccauugccaccucucccuucuuaccugccuuuuuuuuuuuuuuuuuggauacagagccuugcucugucacccaggcuggagugcaguggcgugauucucggcucacugcagccucugccucccagguucaagugauucuccugccucagccucccaaguagcugggauuaccggugcaugccgccacaucuggcuaauuuuuguauuuuuaguacagacgggauuucaacauguuggccaagcuggucucgaacuccugaccucaagggauccgcccuccuuggccucccaaaguacugggauuacaggugugagccacgcgcccagccccuucuuaccugcuuucucaucagcuuuguguauccucagauugcuccuauguuccaaauagcaaaauagaaaccucccuuagucuuccuugccuguagcgaaucuacccuaccuuccucgcccccuuuauagcuagauuuuuggaaagaauuguguauauuuauccauguaguuaccauuuugguuucucuauuucuuuauguggauccauauuuccaucuguuaacauuuuucuucugccugaaggaguuccuugaagauuuuugucauguggguucgcugguaaugaauucuuuuaucuuuuguaugucugaagaagugaagaaguauuuauuucacuuauuauuuuuuuuuuuuuugagauggagucucgcucuguagcccaggcuggagugcaguggcacuaucucaggucacugcaaccuccaccuccuggguucaagcgauucucuugccucggccucccgagcagcugggauuacgggcgcccgcuaccaugccaggcuaauuuuuuuuuuuguauuuuuaguagauacaggguuucaccauguuggcuaggcuguucuggaacuccugaccucaagucauccaccugccucggucucccuaagugcugggaguacaggcgugagccaccaugcccagccaaaaucauuuuuuucuuuuuuuuugagauggagucgcacucuugcuugcuuuguuuccagugagaaaccuguuguuauccuuuguuccucucuacaugauguuuuguuuuuuuuccucuggcugcuuuaaagauuuuuuucuuugucacugguuuugagcaauuugauugugaugugcuuuguuguaguucauugaguuuggguuuuguugagcuucuuagaucuauggauuuauaguuuucaccaaguuuggaaaguuuuuggcuauaauuucuucaaauauuuuucuguuccuccacucucuucucuugccaguacuccaguuacuguacauuagaccacuugaaauuguccuacggcccacugaugcucuuaauuucuuuccauucuuuuuuuuuuuccuguguguuucauuuuggauagguucuuuuuauuuauuuauuuauuuauuuauuuauuuuuuuauugaucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcgucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuaccucuuucuacacagacacggcaaccauccgauuucucaaucuuuuccccaccuuuccccccuuucuauuccacaaaacugccauugucaucauggcccguucucaaugagcuguuggguacaccucccagacggggugguggccgggcagaggggcuccucacuucccaguaggggcggccgggcagaggcgccccucaccucccggacggggcggcuggccgggcggggggcugacgcucccaucucccucccggacggggcggcuggccaggcagaggggcuccucacuucccaguaggggcggccgggcagaggcgccccugaccucccggacggggcggcuggccagguggggggcugacccccccaccucccucccggacgggguggcugccggguggagacgcuccucacuucccagacgggguggcugccgggcggaggggcuccucacuucucagacgggguggcugcugggcggaggggcuccucacuucucagacagggcgguugccaggcagagggucuccucacuucucagacgggguggccgggcagagacgcuccucacuucucagacgggguggccgggcagagacgcuccucacaucccggacggggcgacagggcagaggcgcuccccacaucucagacgauggguggccgggcagagacgcuccucacuuccuagaugggauggcggccgggaagaggcgcuccucauuuccuagaugggauggcggccgggcagagaugcuccucacuuuccagacugggcagccaggcagaggggcuccucacaucccagacaaugggcggccaggcagagacgcuccucacuucccagacaggguggcggccgggcagaggcugcaaucucggcacuuugggaggccaaggcaggcugcugggagguggauguuguagcgagccgagaucacgccacugcacuccagccugggcaccauugagcacugagugaaggagacuccugcaaucccggcaccucgggaggccgaggcuggcggaucacucgcgguuaggagcuggagaccagcccggccaacacagcgaaaccccgucuccacccaaaaaauacgaaaaccagucaggcguggcggcgcgcgccugcaaucgcaggcacucggcaggcugaggcaggagaaucaggcagggagguugcagugagccgagauggcagcaguacaguccagcuucggcucggcaucagagggagaccguggaaagaggagggagagggggagggggagagggagagggagagcuggacagguucuauugcuaucuucaaguugacuauuuucuuccguauugucuacuuuaccauuauucuuauagagugcaauuuucaucucagacauuguaguuauuauaauuuacgucuuuaaaaguacgauuugggcugggcacgguggcucaugccuguaaucccagaauuugggaggcugaggcgggcagauuacuugaggccaggaguuugagaccagccuggccaacauggcaaaaccccaucucuagcaaaaauacaaaauaauuaggcugggcaugguggcucacgccuguaaucccagcacuuugggaggccaagguggguggaucacgaggucaggaguuccagaccagccuggccaacaugaugaaaccccgucucuacuaaaaauacaaaaauuagcugggcaugguggcacaugccuguaaucccagcuauucaggaggcugaggcaggagaauuccuugaaccggaacccaggaggagguagcagugagugagaucgugccacugcacuccagccugugcuacagagcaagacucugucucaaaaaaaaccaaaaaaacaaagacaaaauaauuagcugggugcaguggcucaugccuguaauccuagcugcuugggaggcugaggugguagaaucgcuugaacccgggaggugguugugccacuguacuccagccugggugacagagcgagacccugucucaaaaaaaaaaaaaaaaaaaaaaaagaaaagaaaaaggcuaggccugguggcucgcuggcucacaccuguaaucccagcacuuugggaggcugaggcaggcagaucacuuggggccaggaguuugagaccagccugaccaauauggcgaaaccccaucucuacuaaaaaaauacaaaaauuagcugggugugguggugggugccuguaaucccagcuacucaggaagcugaggcaggagaauugcuugaaccugggagguggagguugcagugagccgagauggugccacugcacucagccugggcaauaaagggagacuccaucucaaaaaaaaaaaaaaaggaaagaaagccaggcgcgguggcucaugccugcaaucccagcauuuugggaugccgaggcgggaggaucacccgaggucaggaguucgagaccagccuggccaacauggcgaaaccucaucucuacuaaaaaauacaaaaauuagucaggugugguggcaggcaccuauaaucccagcuacuugggaggcugaggcaggagaauugcuugaacccgggagguggaggcugcagugagcugagauugugccacugcacuccaaccuggacgauagagcaagacucaguuucaaaaaaaaaaaaaaaaaggguacaauuugaucuuuuuuuuuuucccgagacagaguuuugcucuuguugcccaggcuggagugcaauggcacuaucucggcucaccacaaccucugccuccuaaguucaagcgauucuccugccucagccucccaaaaagcugggauuacaagcaugcgccaccacgccaggcuaauuuuguauuuuuaguagagaugggguuucuccauguuggucaggcuggucucgaacucccgaccucaggugaucuacccgccucagccucccaaagugcugagauuacaggugugagccaccgagcccggccaauuugauuguuuuuauuuuuauuuaguuauuuuuuugagacagggucucacucuuucgcccaggcuggagugcaauggcuugaucuuggcucacugcaaccucugccucccaggucgauuugauauuuuuaauaucuuauaucuugauaucuacuuuacuuuuugaaugcaauacaguuacaauuauuguuuuaauauccuugucugcuaauugugacaugggugcaaguucugggucaguguggcuugauugauuauucucauuauguguccuauuuuccugcuuccuuauaugucugauaauuuuuuacuggaugccagacaugaauuuuacuuuguugaaugcuggauauuuuagauucccuauacauauucuuuuuuuuuuuuuuucugagacggauuucucucuuguugcccaggcuggagugcaguggcaugaucucggcucauugcaaccuccaccuccuggguucaagugauucuccugccucagccuaccgaguagcuaaaauuacaggugcccgccaccaugcauggcuaauuuuuauauuuuaauagagacaggguuucaccauguuggucaggcuggucucaaacuucugaccucaggugauccacccaccucggccuuccaaauugcugggauuacaggcgugagccacugcaccuggccccguauauauauucuugagcuuuguucugggguacagugaaguuacuugagaacagcuugauucuuucagguuuugcuuuuaagcaagcaagcuguuauuuucuuuaggguuaauagugucccacuacugacgcagguccuuuuguauacucuacucaauacccugugaauuaugaaguuuuucagucuagcugguaagaagagguaccauucccugcucugugugaauguuggguacuguuccuucccauccuuucugguaguucuuucucuggcacuggguaguuuacucacaugcaugugaugacccguacccugcuguauacuugggggggccucugcagaucucuggaguccccucucuagauagcuccucucaucugcaguauucugucuugcaaacuauggcuucuuggucuccuuggacucuuagcuccaucuccucaacugggagagucugcugggcucugccuggauuuccccucccugagccacagugggaacgccaucaaggcaguaaguuggagcaguuguaggguucucuucauuugucgccuguuucucggaugucacuauccucuguugccucauaacugauuuccugaaacuguuguuuuauauauauuaucuauuugguuguuucaguagguaagguaaaucugguucuuguuacuccaucuuggccagaagcagaauucccagauaauguuuuugaaucucugaaugaauccacagagcucuaugcccuagugugagguagaucaguaggguaacuguaguucauaauagccuauuguauauuuuaaaauagcuagaagagaagaauuugaaugauucuagcaugaagaaaagacaaauauuuaaggugauggauaucccaaauacauugaucugaucuuuacaaauugcaugaauauauugauuaucacaugugcuuugugauuaucacauguacaucuguuaugcaucagcaacaacaaaaagcucuacagggauauucuuugaaaucuuauacaaaugugcauaccugaggaagcccccagaccuucccaacuuugaagucaguuggucacugacacuccagugacaugcuguuggcacgcagaacucaucacccagcgggugguuucuuaaccacauggugagcuuucgugagggcugcuggccucacugguuucugcugguuggugccuggcacaaagucuggcagcugguguugaguugaugaguuggagggcaggaggcauugcuauggaggugaguggaguuggguaaauagauguacgagacuaccugggacucuucccuuaucugagcauuaugcucaagacccaccuucuagcuccaaagugggggaaaguucucuucuuccuccugcugcugccucugcacugccgagcccaucucccagcacucccaagggcagcagcccaaggguggcaggcaggagagcagaguccagcugucagaggccaccucaggaaggagcugcuguguggcuugaacaguguucuucaggcaguguggcucagcauccccgagguaucauggcagggagccuacggcucguucuggaguagcagccagaaaacuuugcucgcagacuuggcuuugcugcuuacuaucuguguaccaucggacacugugcugagccucucugugccuugccucguuaccuguucaguggucuugguaacccuugucuugcccaucucacaggacuguuauaaugugugcaaagaugcuuuguucuaguagaaucuugcauaaaaccaugauccuuuucuuggauauuaucaaacaaaugaaacucuuaucaaaaaaugaaaguguuuauauucuauuuuccuaaugagauaucugaacuggaauguuuuugguuauaauccacauggcaagcagcaaguuuagggcagagcuguguguuugucuauuauuugacauucauuauuuuguuugcuuguuuguuuguuuguuuuuugagacggagucuugcucugucgcccagacuggagugcaguggcgcagucuuggcucacugcaaccuccgccuccuagguuccagcaauccucuugccucagccucccuaguagcugggauuacaggugccugccaccaugcccggcuaauuuuuauauuuuuaauagagacaggguuucaccauguuggccaggcuagucuugaacuccugaccucaagugauccaccugacuuggggccucccaaggugcuagaauuacaggugugaaccaccaugcccggccuucuuugacauucauuaauuuauuaauaguaccugcuugugaccuucuuccuaaccugggaaauggugaguagcucucugauaguuuaaugaaaggagaccuuuuugucuccagaggggaaaauuucguguuagaggggaacuguaauucuuugggguucauuuguuuugaagucaaauaugacucugaaugugcuggcauguuuuaguugcagaggaaaguggucgcuuauggucagaggagcagccugcucacccucuccaggugggggcuguguaccugggugaggaggagcuccugcaugacccgaugggccaggacagggcagcagaagaggccaaugcggugcuggggcuggacacccaaggcgaucacauggugaugcugucugugauuccuggggaagcugaggacaaagugaguucagagccuagcggcgucaccuguggugcuggaggagcggaggacucaaggugcaacguccgagagagccuuuucucucuggauggcgcuggagcacacuucccugacagagaagaggaguauuacacagagccagaaguggcggaaucugacgcagccccgacagaggacuccaauaacacugaaagucugaaauccccaaaggugaacugugaggagagaaacauuacaggauuagaaaauuucacucugaaaauuuuaaauaugucacagguaaggaaaaauuauuuagugcuuuucuccuuuucaguacauuuauuuuaugauuaauacccuaucaacuuugaaauggaaaaucaugaucuugaucauauuguaagcgagauagcauuuaauggcugcuucagugaaaaucaacuuugcccucugugauguuuauagggagacgaggaaauauaacuaguguugauuaugcuuuucagauggccuaaaccuaguuauccuugggccagucucaccaccaaaccucacgauagaaaucccaguggacagauaguugcuuggcaccaaaaucauagcauuuuuccuuuugagacagaguuuugcucuugucaccuaggcuggagugcaauggcaugauaucggcucacugcaaccuccgccuccugaguucaaaugauuuuccugccucagucucccauguagcugggauuacaggcaugcacuaccaugccuggcuaauuuuguauuuuuaguagaaauggguuucaccauguuggccaggcuggucucaaacuccugacuucagguaauccacccgucucggccucccaaagugcugggauuacaggugugagccaccgugcccggccauuuuucuucuuccaaaugaaguauuuauuuauuacagaggcaauuuaaacauaucuggauuacuaaaauuauaauuuaccauuauuuagacuaguaaugccccuggaaaauauguuauauugaugaaauuuucucuuucaucaaugacugacaauuucuguggggugguucagaaaacagaaggguaggaugcauucacacugcuuauguaagagagguaaauccugacucuaagagcugugacuguugucagugagggcacagcaccuguagugcacauagcuccuccaagggcagugcucggcgcuggcuuugcauccacuccugagugccuguagaugcuguggucugugggacucccacaggugucacucacaugacugggagagagcaguuuaaacagucugaguuauggauuaaacaggugguggcagggacgguguacccuuuuucuuuuuuugacacagagucucacucugucacccaggcuggagugcaaugggaugaucuggguucacugcaaccucugccucccggguucaagugguucuccugccucagccucccgaguagcugggauuacggcacaugccaccacgccuggcuaauuuuuguauuuuuaguggaaacgagguuuuaccacguuggccaggcuggucucaaauucccgaccucaacugauuugcccucuuuggccucccagaguguugggauuacagauguaagauacuguggcuggcuaggacaguguacucuugaauugaucuaaccuuuggccaaacauaucgauaugacugcuuaguucagacuuagcucugcugagaugauaguuuggauuugagaucguaguccucuaauaauuccauuuuagaugguuugagaugcacaauucaaaggugggggcaauugccuggacccugugaguacuuaguacaggcauaccucaaagauacuacagguuugguuccagaccacugugauaaagcaaauaucgcaguguagcaaaucacgugaauauuuugguuucccagugcauacagaaguuauacuauauuguaguuuauuaaguaugcaguagcauuauguuuaaaaaauguauauaccuuaauuuaaaaauacuuuauugcuaaaaaaugcuaacgaucaucugagccuucagugaguuguaaucuuuuugcugguagagggucuugccuugauguugauggcugcugacugaucaggaugguaguuacugaggguugggguggcucuggcaauuucuuugagacagaguauugcucugucacccaggcuggagugugguggugagaccauggcucacugcagccuugaccucccaggcucaagugauccucccagcucagccucccaaguagcugggaauacaggcaugugccaccauaccuggcuaauuuuuuucuuuuuuuuuuguagagaugaggucucacuauguugcauaggcuggucucaaacuccugggcucaagugauccuccugucuuggccccucaaaguguugugagucgugaaccaccaugccuggcccacaguuucguuucguuuuuuucuuuucuuuucuuuucuuuucucuuuucucuucucuucuuuucucuucucuuuucuuuucuuucuuuuuuuuuugagauggagucucacucugucacccaggcgggagugcaguggcgugaucucagcucacugcaaccuccaucuaccagguucaagcuauucucccacugcagccucucgccgaauaacugggauuacaggcgugcuucacaugcccagcuaauuuuuguauuuuuaguagagacaggguuucaccauguuggucaggcuggucuugaacuccugaccucaagugaucugcccaccuuggccuuccaaagugcugggauuacaggcaugagccaccacaccuggccuguggcccacaguuucuuaauuccuuucacgaaagaauucucuguagcaugcaaugcuguuugauagcauuuuacccacaguagaacuucuuucaaaguuggagucaauccucucaaacccugcugcugcauuaucaacuaaguuuauggaauauucuaaauccuuugucgucauuucaacaguguucacagcaucuucaccaggcguagaugccaucucaaaaaccuacuuucuuugcuuauccauaaaaaucaacuccucaucucuucaaguuuuaucaugagauuguagcaauucaguccuaucuucagacuccacuucuaauccuaguuuucuugcuauuucuaccacauccgcaguuccauucuccauugaggucuugaauuccucaaagucauccacgaggguuggagucagcuuauucuaaacgccuauuaauguugauauuuugaccaccugccaugaaucacagauauuuuuaaagucaucuagaaugguaaauccuuuccagaagguuuuaaauuuauuuugcccaaauccaucagaggaauugcuaucuauggcaacuauagccuuaugaaauguauuucuuaaauaauaagaguuaaaaguugaaaucccuccuugauucaugggcugcagaauggaugcuguguuagcaggccugaaaacaacauucaucuccuugugcaucuccaccagaacucuugguugaccaggugcauugucaacgaguauaauauuuugaaaggaaucuuuuuuucugagcaguaggucucaacagugggccuaaaauacucaggaaaccaugcuguaaacagauguacugucauccaggcuuuguuguuccuuuucuagagcacaggcaaaauaaauuuagcauaauuuuuaaaggccccaggaucuucagaaugggcaaugagcaaugagcauuggcccugugguugcucauaccuguaaucccaguacuuucagaggccaagguggguggauugcuuaaaccuaggaguuccagaccagccuggggaacauggugaaaccuuaucucuacaaaaaauacaaaaacuugccaggcaugguggugggcaccagcuacuugggaggcugaggcaggaggauugcuugagcccagaggcugaggcugccaugagccaugauugcgccacuguacuccagccugggugacagagcaagaccuugucaaauaaauaaauaaauaaauaauaagauuuauuguuaaauaaauaaauaagaccgcagcuacacuggccucuaaaaagaguccgccuguccuuugaagccaggcauugacaucucuugucuagcuaugaaaguccuagaagccaccuuauuccaauagaaggcugucuuaucuacaugaaaauugauuuuugaguauagccaccuucaucaauucucuuagcuagauguucuggguaaguuguugcagcuucuuuuuuuuuuuccccauugaucuuugauguuacuauguuguagcuucucuaucagcacuugcugccucaccuugcacuuuuauguucuggagacagcuucuuucuuaaaccucaugagccaaccccagcuaauuucagacuuuuccucugcaguuuccucaccucucucagccuucguagaauugaagagaguuagggccuugcucuggauuuaggcuuuggcuuaaauguugugacugguuugaucgucuaucuauagcauuaagauuuucuccauaugagcaauaaugcuguuuugcuuucuuaucauuugcauauucauugaguagcacuuauuuuuauuuuuaagcaucagaggucaccacacuggauggaguagcacauuaacuuccuuuaaaaacuuuuccuuugcauuuauaauguggcuguuugguguaagaggccuagcuuucagccugucuccuauguuggcauucggcauggcuuccucacuaaguuuaaucaaucauuuuuggcuuugauuuaaaaugagagauguacaacucuuccuuucacgagagauguacaacucuuccuuucacuuaaacagaggccacuguaggguuauuaauucaccuaauuucaauauuguugugucucagggagaggccugaggagagggagagagauggggaauagcuggucgguggaacagucagaacauagacauuuacugauaaaguucacugucuucuauggguacaguugguggcgccccaaaacaauuacaauaguaacaucaaagauacuuaucauagaucaccauaacagauauaauaauaauggaagaguuugaaauauugcaagaauuaccaaaaugugacacagacacaaauugagcacaugcuguuggaaaaauggugcugaaaaacuugcuggaugccgaguugccacaaacuuucaaucugcaaaaaaugcaaugucagcaaagugcaauggagugaaaugcaguaaaaugagguaugccuguauuugaaaugaugaauuaugaaaaauauuaaaauaacuuguaauauuaggaaagcgcagaggaaaguuuaaaacuuucugcuuaauucagcaagacuuaaaaaaagugaaaguuuauaacuugucauuugaucauacuuuuuugcugguuccuggauucauaugguucaaaauccaaaagguuccgaggguuccuucucucgcugcuccuacccacccguuccucucccuggagcagcaguguguccuguuucuuggguauccuuucagaaaaauguacuuuuacugcuaacuuuaaugcuuguuucuuuuaccacaggaccuuauggauuuucugaacccaaacgguagugacuguacucuaguccuguuuuacaccccguggugccgcuuuucugccaguuuggccccucacuuuaacucucugccccgggcauuuccagcucuucacuuuuuggcacuggaugcaucucagcacagcagguaucuuccauuggugggguuuacguccauccuccuggcugaugguugcaguuauuuggagguccuaauuaguuaaguuagaagcagaagagggggggcaugaacuguguccugggauggaaggcaaggcaagagugaauagugaggauuaucauacuccugagggagcugguggugucacuuuauggaggccccuuaaagaaagugggcuguucucugugugguggauuuaaagguggcaggugguagcaccugauggcaggggaggggccagaagacuuuugagggccauagccagacugaaucagcacaauugguaucacaguaggauauuccuuugugacuuuaaggcgcagguuaaauccccaucccaggcagcccaauucccagcaccccuguuuugugucuacucaggauuucuucccuuccuuuucuuuuucuuuccuucuuuucccuuucccucuuuccuucuuucuuuccugcguacuuauucuugcagucauguucuguaguaggcacucgaucaagucaugaauuaauuuagcucuuuaacaugacauuuaucuuuguuuuauauuucucguguaucauucacuggguuuuuguccaggcuggccuugaacuccugggcucaagcgaucguccugacuuaaccuccugaguagcaggacuacaggcaugcgccaccaugccaggcuggucauuuuuuuuuucuuuuuuuuuuuuuuuugagguggaaucuugcucugucacccaggcuggagugcaauggugugaucuaggcucacugcaaccucugccucccagguucaagugauucuccugccucagccuccugaguagcugggauuacaagcaccugccaccaugccggcuaauuuuguauuuuuaaacgggguuucaccguuuguuggccaggcuggucucgaacuccugaccuugugaucuaccagccucggccucccaaagugcugggauuacaggugugagccacuuuuugucuuuuuuaaauguuuaguaaaguaaguuacagagaacuuuguugagaugguauauguuucuccuaagugcugcgauugugccugaguuauaaacuguucuucucuuccaaaucagaugcuccuuaguaggucagccucaacaaggagguuguguguaaauaaaucuagaacaucugaaaaauggucaauuggugguaaaaugaaguugaguaaacuuccauuacucuguacuugaggccaggugcaguggcucacaccuguaaucccaucacuuugagaggccaagguagaaggauugcuugagcccaagaguuugagaccagccuggacaacauggcagaacuccaucucuauaaaaaaaaauacaaaaaauugacugaggaugguggcacauaccugugguaccccagcuacuugggaggcugaggugggaagauugccugaaccaggggaggucaaggucacagugagccgugauccugucacugcacuccagccugggcuacagagugagacccugucucaaaaaaaaaaaaauuguauuccacugauuuucauugugggaauauaacugccaauguuuaccugaaacuuuuaugaagaaagaaauggcucaacaaauuaguaauuuucauauaggcuucuggguuauaucuaagugacugggcccaagggagcagacugauuggaaggacagaucacgucaguguccagcuuugguggggccuccacugcccccaggcauacucagugcucuuugguucugggucucacacugucccuccugccucucccgcaacucccucccuaaccugcuuucuucuuuccuuccuucagcuccauguuguaucuuaauuauggagacuaaggcucuugcuguuauuauaugggcugggacauguuugcuucuuauguuaauauuuaaguuacagcauguguacaaaagaaaaaaauccugguuauacacuauuacuauuuuacuaaugcggaaaauugaggcuuagcaagguuaaauaaucugcccagaguucacauugguucaguggcagaacugaggcuucaacccagaguguuuugacuugggagcuuaucaccacuagucuguauuauguaaaggugaaauaagcccgcacaguuauauuccuucuaaacaagucauccugcccuaauugugaacauccugguguguuuguuagaucauauacucccuugugccagcuuaccaaaccaauugccuacuguaaguugaucuuuuuugagggacagggaugggcauucugaagaguuggaaauuuuuucugucaaauaaguugacacagugugcuuuguccaugaauuagaguuuucuggucugguuuguuuagacaggaacuuaacuaguggaauaauugugccauugguagauccauauuauaauugaaagcaacucagauugcagaaaaggagugccccccagccaugacccauaagcaaagaggucagaaacaaaugaaaaagccaaaaguuucaaguaucagaaaucuccguaggucacacgcaacuuccucauuuauuucugucuauucugagaugguaauuguaugagaaagcccucuauuaauaauaaauucagguuuuuugacuucuuucucuuguagccuuucuaccagguuuggcaccguagcuguuccuaauauuuuauuauuucaaggagcuaaaccaauggccagauuuaaucauacagaucgaacacuggaaacacugaaaaucuucauuuuuaaucagacagguauguggaaguaaugugcugaggaagaagauauucuauugcugggggucugugccuucuguggguucugaucugcuauaauccuuaagugaaggauucaagacugacuuugaguuguaaaacuucucuucuaaugaacuguuaugauccuguuaaauacuucccaaucaguaugaaguuuaacaugaauagguaauuuuaauuauuauagauacuuuuuuuuucccuuuuuuuuuuuuuuuugagucuugcucugucgcccaggcuggggugcaguggugcgaucuuggcucacugcaaccuccaccucccggguucacgccauucuccugccucagccucccgaguagcugggacuacaggcgcccgccaccauacccggcuaauuuuuuguauuuuuaauagagacgggguuucaccguguuagccaggauggucucgaucuccugaccucgugauccacccaccucggccucccaaagugcugggauuacaggcgugagccaccgcacccagccuuuuuuuccuuuuuuuugaggcagagucucacucuguugcccaggcuggagugcaguggcaugaucucaguucacuucagccuccgccuccuagguucaagugauuugcgugccucagccuccagaguaguugggauuacaggcgugugcccagcuaauuuuuguauuuuuaguagagacaggguuucgccuuauuggccaggcuggucucgaucuccuggccucaagugauccacccgccucggccucccaaagugcugggauuuuacaggugugagccacugugcccggucuauuauagauacuuuauuguuugauugacugagacggagucucgcucugucacccagacuggagugcaauggcauaaucucaguucacugcaaccucugccuccuggguuaaaacgauucuccugccucagccuuucuaguagcugggauuauaggugcgcaccaccacaccuggcuaauuuuuguauuuuuuaguagagacaggguuucgcccuguuggccaggcuggucuugcacuccuaaccucaagugaucugccugccuuggccucccagagugcucagauuacaggugugagccaccgugccuggccuauuauagauacuuuaaaacaaguguuacugaaauauaauucacauaccauacacuuuacuuauaacuuuuaacgcacauuuuucacuuaauauuuacacaaagauaugcauaagucaugaguguacagggugaugaauuuucacaaagugaacacccuggguaaccacucugaucaagaaacagagcacuggcuuaugccuguaaacccaggaguuugggaagccugugcggguggaucucuugaggccaggaguucgagaccagccuggccaacauggcgaaacccugucucuacuaaaaauacaaaaacuagcuggggaugguggugggugcuuguagucgcagcuacucgggaggcugaggcaugaaaauugcuugagcccaggaggcagaggcugcagugagcugagaucacaguacugcauuccagccugguugacagagugagacuccgucucaaaaaaaaaagaaaaaaaaaaagagaaacagaacauuaccagccucccuucagcaccacugcuccugccuuccccaaagauaaagauaaccacagucuugacuccuaauaucauagacuguguuacuuguuuuggacuucauauuaauggagacaugcaggauguuuuauuuugugucuguuuuuuucauccaacaguaugcuugugagaugcaccugcauugucauguaugguuauguuuuguucuuuuucuuugcugcuacuguuccauuuauuaauccauuuguagaugcuaucuuaguuccuuaauauuugccaaaacauauggccuuauuuuuuauuguuuguaaaacauuguaaagcauuguaaauugaaaaaauuaccuccauuggaaaaguucauuccucuaaagccucacugucucaauugugagcaucccacucuucccaaaguaugcucacuggaaauaaauaaaaauuauaacacacauugcauauauauuaaauugcauauaaucauuuuagcuaacacuaaagaaaaaagagcugaguuggcugauaggaguaaaaguaggauauuacaaggugguuagcuaguccaagucuugucauggaucccugauugucauuucgauugauguguggagagggagccauuuuauucagugcucuaagaaaaccuagaacacaaaucugggagucagagcaucuuugguaaucccuguuuccguugguggcuuguuguuauaacaguucuuucaguaaauuauuaaaagcauuuuggggcugggugcgguggcucacaccugugaucccaacacuuugggaggcugaggugggcagaucaacugaggucuggaguucgagaccagccuggccaacauggugaaaccucgucucuacuaaaaauacaaaaaaauuagccaggcauggcggugugugucuguaaucccagcuacuugggagggugaggcaagagaaucgcucgaacccaggaggcggagguugcagugagcugagaucgcaccacugcacuccagccugggagacagagcaggacuucaucacagaaaaaaaaaaaagcauuucgaauuuagcauuacuuaaccugugaaaacauucuguagacaccugagaggaguuuuacuaguuacuuacugaacuuuggucucaaaagacaccaaaauacaacucuuauaaacacauugacuaagaaacuucugaugaguucacagaaauucuaguguuuuaguugugaacagcugaauggguuccugauccuuugaugcaguggggagaaaggcaacuuacaaauuacacugauaggcaagugaaauccaucccauauauuuauauauauacuaguggcaaugcuuauuuuaggacugcaugucauuuugcauaccauacauaauacuugagaaaaaucuguggugggugcuuuuucugccugauuugaaaccagugauuuuucuuucagguauagaagccaagaagaauguggugguaacucaagccgaccaaauaggcccucuucccagcacuuugauaaaaaguguggacugguugcuuguauuuuccuuauucuuuuuaauuaguuuuauuauguaugcuaccauucgaacugagaguauucgguggcuaauuccaggacaagagcaggaacauguggaguagugauggucugaaagaaguuggaaagaggaacuucaauccuucguuucagaaauuagugcuacaguuucauacauuuucuccagugacguguugacuugaaacuucaggcagauuaaaagaaucauuuguugaacaacugaauguauaaaaaaauuauaaacugguguuuuaacuaguauugcaauaagcaaaugcaaaaauauucaauagaugcacuauucuuguuuuuacugcaugaacguaauccaguauuuggaaaguaauccaguuugaaaugugaagauguauuccggcagaauagugaguagaaugacaugcuuacuauacagaaggcaaaaauaggacucucagguaauaguuuaaggaaacccuugauuccuuauauauguuuaagaagguuaguuuucuguuucuuugcaguuuuucuucuagaguccauagcaggaaaguauguaaccagaauugguuagugugacccccucaaguagcaagugauggaaaauaagagucaaauaccuugauguuugugaucucuaacucaaaaaauuugaag

SEQ ID NO: 17308 - RNA, 12093 nt, Homo sapiens
cuuccccgcgggcgacgggcggcggcggcgggaggagcgggccgagccgaggaagccccggccucgcgcgcugggauguagcgaaccagcaggggccgaagaaccgugcagugccagagccagagcuggauccggggccccagccggagccgaaaccugagccagaguccgcggcgggcgagcccggagcccacgagccgcagacgcagcgcugcccaggugggguaagagacgcugggcuaggggcgcagggucuccgcgguggaggggcgcagggagguggcggccgaguccugcgcaguuugcuccuggcguguguggguccacccggcggcgcgggacagcgcaaggcgcggaaggucaggagccuucgaggcagcgcgaggagcucguuccugcgcccagggcacagucauagccgccgucaccgggugcuaccucacccaaccggcgggaucaacccucugcuuuggcuccgggcaccucaagaggguagcagccucgggggcacgggccacggccccgcgaagggcacaaccugagaagcccguggcagccccucgcagcgucgggugacacagggcucccccacccccaggagaagugggcaggagagagggccgcccgcugcuccccgcugcguccagggauggagggccccaccacccauggaauugcuggccccucugcguggcccgggacuucagccguggcuucgcgucaagaggguauuuuuccuaaacgaaaccgcuucguucguucguucguucguucguucgggcagcaaugccgcagaaaagcagcagacgucgguccgcgcccuggcucucuucgccccggaccccgacgucccgccgcagcgcucggaggugcccccagcccaaggcagccugcucucgccggcacaggucgggcuuuuucuucccaggagagaaaccccaauucccuucguaacguccaauaaagacauucccgcggcuucucccagguuugguuguugacgcagggucccggagcacgcagucgcuucucaagaaccgggucucggauuucugaaauugaccagcuucguaaauuggagccuauucucccgcggcaaaggcagggccccaaagccgggaucgcaguaaugggaaccccaggcuggaauccgggucccaagcuuuuccgauuuaggaauuccccgaaucuacaaauauuuaguccacuuuucugaaaaacuaaauucugaaaaacacaaauucucuugacaucccugugaccucugaaagccaccagggccagagggaggaaaucccagguugcuguccacugggggaggauucaggucuaggguucaggucuacgguagucagggcaaaagcuacaggcagcaggggcagcacaggagacuugcuguccccgugcccuuucccggggcugcuuucggccucccgcaucucuuccagggaaaggaaaagaggugggcuggggcuuggagaccaggcugucuggacucuaggaugcagaggccuccagacaggcucagggugcucuucucccaugaaagcagccgcugggaggaggaggcuauggugcauccauaaguugccccucugcuccccaguugugcgaccagcugcuaccuccuuccuagucuucuuccccacagcucagccauucucaggaaccagacagcguccauggacuuaggugagagaugggccggguagagccauggguccuaccagccgcugacugagcggcccacggcacagaguccugaguuccauacucccaucugugccucacuggcggcaguccugcucaaauacauccuggcucuccccgggacaggcuggggauccccauuuggcaggaagccucagacuggggucccaggaagccuaaaggagccagugaggucuuuccagccccuaccugagcacccuccuccccacuuacccaguaauugcuguauucaaagaaacgggagcuuuuauuggggaggggguguuagaucaggcagaaagagguaggugguccaaaccugcacucccaaaacaggguuuucaaguuugaacuucuccacggacuaagaggcuuagggcuggaaugucccagagagucauggauagcccugguggcaggccauggcacauuccuuccuuuuuccuaaaauaccuugauucugggagcaaggauuagggcacggugcccccguggguggguagaaggaugcccccccacugagagccuuccaaccacccuucccaaauuacauuacuaaaccauucuugggcacaggguguuuuuagugagccaggcuucaggaaggguccucauggugacuacuucaaccccacaacagcccaagcucuucugcucagcccagccaagacccuaaacuccaaaauucuugaaaaucagagaaucauugcuggcuuuguguggucacggagggguggggaacagggcacaugguuccagcuccacuaagcccccuucccuccucucuucgugucccaucagcaagugagcuggaugcugaagcagcaggcagaguccgguguuggacaugggaacugaggcacagugcagaucaagccuuaaccuugagggaaacacaggucacauagcacagcugggggaacacaaagccucugcuuacuccugaaagagugcuguuuucuguccuguaugugugacgugucugugagcgugcaagaagccccuaucuugacugggacaauggccagugaguguagcuggggaagaauugagagcauguccaggucccuuccccagccaacgcccaagaucaggccacagccuccucacaaucaauugccuccucacuccuugaucacucagugcugcccaggcccagcagaacagacucugccagcaggccccacuagccccagcuccucuuugggucucagguccccugaggauauggggcuucaccugaaauggucugagggcuuuuccuucuacacagcaggcaucaagaucaccaaauaaagggacuauugugccugccuggagcccugccagagguuugggcccagaggggcacacagcaggugcucaauaacugcauuaaaugcacuaacagugaggaaacacgccccucagacuaagcagugagugcugcucacagaauaguccccauugggggauggcccaaagagucacuuuggucccucugggaagugagaaggcaagugagaaggcugugagucuuaaccuccucuagaggcccacagacagaccauucauuucuaagucucuacccagagacgcacugugcuucccaccuuggccugacauguggcaggguuagaacacaccuccuauccccugccagcccgcguucaugccaaguagcacauauaugccuaaacucagcacuuccauagugcagugaauacauguguguguacagcaucuccgcauggauguacaggaugugugugugugugcgugcccccaugcugucugcauucaggcuguucuuuuugguaagacagcuaaaaaaagaauggucugugaagggacacucccuagcacgcugcaacaccugaauaucuccuugaaaggagggaucuucuacugcaggagacucgugguaaagguggccaagaaacauggcaacgguggggcugagggcaaaugcugggcaacugugcuuccccauguuccccuccccguagccaagacucauuucauggagggagaucucagcuuggaagaaggcaggagucacugagccuccccaauccaaaccccugagaaguguccucccucuggccucagacccugcauccuguggucacagacccacagugagaaaggaccaggcccuaaggagcugugcugucucuccacggcccagagcgggggauggggauggggauggggauggggauggggauggggauggggguaggggugggggugcuuuggacuaacguggagggaauggaaggcaggccugguuccacccugcaugcccgacccuggccccagcagcccccacaaggagcucagcugacccugggugucucccugugaugggaagggguaagacgaggacucaaaggcagaaccugcagagugccccagacgcugauaccugcacagucagugccacccacccaggaguugaggaggcacuggguuuuggggugaggacacuggacaccucccugcuucuuucccaggcagacaauccuggcgcagcucccuuggguugcugugucugguggagcugaucacaggugaggggcagagggcagucugggguccgccuauggccagaggagcaggucagggcggcgccuugccgccccagcuguggccuguuugcucaagacgcugaggucucggggccagcuaacaauuguugagcaaaauccuucgacaaacuucaccuacgugcaaggacucgaggagggaaucacucuuaggagugggagaguaaugucuuugccugugcccagugaaggcccauuggagcugcagcucagcuaccacugugugggagagaagcuggaagacugagggcuuccugggcugcuggcccaggguugggagacagcagucaccuggcuuaccaggccuaugccugaagcccugggaagccaggacgcaggccccaggcugggacaaagcuacccugaaggagggcaaaggcugccaaggccaaccccaugccugccaaggccaggccuggcccauuuggccaaggccuaagguguaaaacaaggggagagguacaagaggcuguggggucuggcugggauccuuggggucuuccuucugcauucuccaaacgccuagagccagcagaaacguuucgucugauuagaagccaucauuucuaucccaaucccggaaaauugacugcggugcagagagggaggccugagaagcagccguaggggagaagguccaagcuaauuaggaggcagcauccgggggcccauuagagcgcaggcugcugucacucagccgggcugaguucccgggagaagaggcuggagaaggaggggcaggcggccccucgacgaggacaccgcugggagcugccggaacgggccccgggcucugcccccgccccggcgcuggcucgaaggcgcccgcucggugcgauccuguucggcaaacauucacucauccugggcuguucucgccagggcuggggacuucgaggcggccgagacgggaguugauucuaggcgaaacaagucauuugaggccugaggugugcacgagccgcccgggacucgcaggccagaugcguuucuuuugugaggccgagggagaacucggugugucaccggggaaggagggagaggcgcggcgaggccgcggggggcggggaggcggcgggaagguggcugcggagggggagggcgcgggcgaggcagggagggagggagggcggcagugagggcgcggcggcgcgggcggcuuggggcuggauuccgcccgcgcucccucgcucgcucgcucccuccccagcccccucccacccaggcccaccccacccagcaccccuggcgcagggacugcuggaaccuggcugugcgcgcugucgcuuuaagacagacucugccggcgccguccggagccuuagaaaccggccccggaucgcgagccggagccggagccggagccggggccggccgggcugcugaggcccgagcggcaggagcgcagcgcggagcgcugagccaggcgcccagucgcgagaagcugccgccgccucugcccgcccggcgccgcagccccgggcgguccauggggcgggcacggcgucgcugcaggcgccggcagcccuggagggcagccgcuuaggcgcugcgcucuuguccccgcaggucgcagccagggcggcggggcgcgcccagccccggccccuggagcgcccgccgcgguccccaccuccauggacgccuucaaggggggcaugagccuggagcggcugccggaggggcuccggccgccgccgccgccaccccaugacauggggcccgccuuccaccuggcccggcccgccgacccccgcgagccgcucgagaacuccgccagcgagucgucugacacggagcugccagguaagcgccguuccccgcgcggcgcgcacagagccuacccgggcgcggagcacggggagcugggagcagggccugacgcccgcgccgcgcaaccaagcucccucuccgccccagaagcgucaggagcuuucuuuuucccguucucgaccugacggugaacgcggaaacuuacgcacacgcgaaggcacuuccacgcgguccccacgcgccaagagacuggcagaugcacgagccuacagcuggaggguuggacugacagccccucuugaucaggaguaaauagaacgggaaagaauuugauuugcgcaacugggcgcuaaggagcggcucggacgaagggagaggaggagaccgagaaaggaagaggggugacgggcgagagaacgcacucagagagacagagagggagguuaacaccgugacaguaggcgacagaaugaaagagaccaaagagaaggggcgggcgggaaggguaaacggggggagaggggucaucaaguagaagggagacacagaggacggugagggcgagcgggccaacaggcgcggccggacucccagcaaggccagccggaacgccgaucaagggauccggcccacgugcgcggccgaagcccggagcagcccggcucuggcccccgccccggcuccugcgcgucucccuccgcgcugccuuuuuuuguccgagcuggagcuuuuuuccagcagcgaacugggcccgcggguggccggcgcgggcaguggggcagcgaauccgcugcccagcgcagccggccggguuccggaggggcuccgagcuccccggugugggcgccucuucugcguucauuucuuaauacacagcugaauguuucucuccacuuucuuaguaucuguuucucuuuugcaucccuaagugauuuuucugagagguuguuugcuugguuaaaacauaaucaacgcugaacucuacuuuuguuuucaaaaguuuuaagcgcggucuuugguugguuuuauuuuuaaaaccuagagagauauauaaucguauauugauuuuuuugaaccaaaucuaugaggaugaauuaauuuuaacuguaucuuucgauucugaaagaauuaacguacgaaguguaggucuggaauuuaaaauaucuacaugcaacauuauucuuccggagauuuuaaaaagucaauccaaaauggcgcguuucuccggaauuuucucaaaauccauuuacagugguguuauuuggggaauuuaaauuaucuaacuauaauguguuucucugggauuuaaaaauuaucucuacaagggccuuauugggaaggaguuaaaaaucuaucuacaacgguacauuauuuuuuuaaaucccagagaaauaaaugcuucugucaaccuggaguuuauacacuuacagcucuguauuuaguuagggguguguuuguacggagcuuucuggcuucuuaauuuacauuugcucuguguuucuuccugucugauuuugagaauuuguggcccuuucagugucuuuaggcauagagcugugagcuuuucugggcuucuguguuuuguuuuuaaacucuuuuucuuuauguauuaauguuucuaugacugcguguguuuuguguagcuucaaagagagacagacuaaagcccgaggucaccuagacagagucugucugucugggcugcaguuggugggguuuucuaggcuuugggacuggaggccuggaagcaaggccgagaacccggcuguguugugccugcccaguggggcucccauacaccccugaggagaagaaaguggagggacuuuaggcuggagagaucugauccuaguucagaaaagcagagacccccucagauuuagacccccuaagaguucgcaaaacaaacaaacaaaaagcauacauuugcugggaacaucagcagcagggucagaaucugagccgagcuaagggugcaggcccugcccagccaggaacgcaggcccgcggcuccagcuccgauucuugggcucuucuccgcggcacaccagacuagaggugccuacugacgaccagcacccggcgggcgcuuuccaguggggacaguucccaggaacccuagagggagggagggagggaagaccgccagcgcugguggcgagcgguucgguggagccgggacggggugcaacggggcguaagcccaggugacccgcuccccguccugccuacugcagagaaggagcgcggcggggaacccaaggggcccgaggacaguggugcgggaggcacgggcugcggcggcgcagacgacccagccaagaagaagaagcagcggcggcaacguacgcacuucacaagccagcaguugcaagagcuagaggccacguuccagaggaaccgcuaccccgacaugagcaugagggaggagaucgccguguggaccaaccucaccgagccgcgcgugcgggugagcaaggggugcgcgccuaagggcacccgcgcagagggcucccgggccgccucugcugcagcccuccaaagcuuagacccacaagcagaacuucacucucccaccauucagaccugcucccucccuccaccggagauccccaccuuaggcccuggcccacuagcgucugccaggccuccaggcgccucggaccuucaaccccuuugacccucauccuaccugauccucggacuaaggcaaccccagcccaaagaccugugcccccaggggacucccccaugcccuauggggcccaggacccacucagauguuagcaggauacccugggccagagacugggcaguggauucccugccgcuggggaccucgggagcuguuggccuuaucccgaaaacgaaagggaaaggcagguccugucuggcugccucggagaagccugaaaggugccuggguuuggggcucucaaaacuuccuggagcaguggucccaucucauaagcagauucucuaaaagcucaagauauucuccacccuccccagccaucaguaggacccuuugccuucugcccuuuccggaaggucucccgucaggugaggugggggguggcuccgggagccaaauguccuucccagucccuuuuaggauaugccaucucagacccaagaccagccugcauucucccucuucucacccguuugguuuccaguaaaagcaaggcuuuccugccaggguagcaagagaaucauuucuucccugggggcguaaauauuuaaucagauauugggagcaccucccaagucgaccaaaaucccagcuggcccacagacuccuuaccauaaccccagcccucaccccucccuaggcaggcuggccagcccagugggacuuggaaugaagacacagcacucaguaauccugaacucacuaauccugcccagguuuauggugguagggguggguggggguggaaucagguagugucagugcuggggacuagggaaagcugagaagcagggaucuggcaaacuagcucaggaaacuccacucagaacuggaggaaaauccgagugggcagagggcaugcgguaggcagauagguaaggaugggggaggacuaggagguucuuaccaaauuuggggggagaaaaggaagggcaggaagauuagaagaaucuaguaagaauagaaaaaauuuaaauauuuguggagaaacauauuuggcauauauuuaggcggcaggaaagaaauuaaauaggaagcaaaaagaucagguauuugagaaaaagaaucaacuguuuaaggggaacagugcaggucagauauuuggaaaggauucaaaagccuaauauuugaggacgauucaaaaggaucaaaaaugggggauaaacaagaaaacagacugagggagaagaaagagguucagacagugggguggacugaacgaaaauaaacauuuggagccaaaaagaaaacaucaaauauugccgauaaagaugauaacaaacuauuugagcgaugaaauagaucgaagaauugggggagucggaaaguccuaugucucagggaggaaaaauaccuuuuguauuugagggagaauaaaaagacugaaauauuuaguagauagagcgaaccuguuugggggagaaggcagaggugaacugguugagagaggaagaaagaaaacgaauaucuguuaaacgagaauccguauucggagaagaaaacggauauaauuucgggagaggauaaagaucggaaaaagaaauuaguauuuucuggggacaggaaaggaaccauuguggagggaaugcaggagcggaaauaucggucgaaggagagaaacgacguucggagggcagcgggccgacggaaggcuccaggcgguggggaaggggguggggucccucccggcccgcagcggcccugacccuucucccguccccucccccaggucugguucaagaaccggcgagccaaguggcguaagcgcgagcguaaccagcagcuggaccugugcaaggguggcuacgugccgcaguucagcggccuagugcagcccuacgaggacguguacgccgccggcuacuccuacaacaacugggccgccaagagccuggcgccagcgccgcucuccaccaagagcuucaccuucuucaacuccaugagcccgcugucgucgcaguccauguucucagcacccagcuccaucuccuccaugaccaugccguccagcaugggcccaggcgccgugccuggcaugcccaacucgggccucaacaacaucaacaaccucaccggcuccucgcucaacucggccaugucgccgggcgcuugcccguacggcacucccgccucgcccuacagcgucuaccgggacacgugcaacucgagccuagccagccugcggcucaaguccaaacagcacucgucguuuggcuacggcggccugcagggcccggccucgggccucaacgcgugccaguacaacagcugaccgccccgccgcaccacgcgggccggcggccggagcggggaagggcgcgggcgcgggcgcggaggacgcacgcggggccccggcucgcaagccccagcucaccgcgccgcggaccucacaccugcgcagcccccuccucccacuucccacuccggguugguuuuguguuugcuuuuccggaccccacucugcccuccaaaaagacaaaaaaaaaaaaaaaaaaaaaaaagcaaaaagacgucggagaaaagugccgcgaaaaaauggaugaguugcaauuucucucgggauggcgcgggugguguguguguucccacgggccccggaggcccacuccgcggagggcacgcggcgcgguaggcgagcgccgaggcccagcggccgggggaggacgaccucguaucccgcguccccgccgcgcuggauccggacugaguggccgggccugcggacuggaugugcggggccuggacuugccuaggauuucccgaccccguacaaaccaaguugcccucuccgagcuaggcccggccgagagcgccuuagcucgagucggauccguguuggggcgggcguuggguuuggggggacggugcccccagcccaggaucgggcacucaguggagccgcacacggccccggcgcgccugguagagccucgcuggccccgcgccccggagcccuauauuaaggccacggagcgacagcgggcagugcgggccuggcgggaggugggggagguccaucucagaacaccccagccuugagcuuagcugcaggcccaggcccucugcucugcucccgggcuaggagguggcccucugucugggcgaacagcccccuccucaccgcccgccgugcaagagucgagccggcagagcaaggggcgcggccccagggcccugcgcccacuuugcacacccgcucuccggcccgcgccccuguuuacagcgucccuguguauguuggacugacuguaauaaaucugucuauaucgacuuguccauguacgucuauuaaaaccauaguccgagcgugcuaagcacugcuga

SEQ ID NO: 17309 - RNA, 1772 nt, Homo sapiens
uuuaguuuuuauuuacaugaagcgucugcaguacaaaaauguaaacuuugauagcucauaauagaauaaacucuuuauguacaaaaauacauuuucauaugaaugaagcaucuugaauaaauuaaaguacucuccagcccugugccugaauagcuaagcaagagucuccaguucuuccuagagcgagucugcaguggugggggucgggauccauaaugcaugaagcccacuccuugucucugcuuuuuaagccuuuucauuguauugucagccggcucaaaccgaauuuucaugcucguuuuucuucauuagaguucuacaaauuguaaaauugacuuuucaccucgucuucaggggcugaucugucccuuuucuaaaucacacugaagugguggcuggggucaguucugagccagucacaaaggagguuuuguggaguucagaaagugcaaaaggaaaggccgucuaggggcgggcaggaggggcgcugggcugagggccggagaaacagaccaagagacauccgccgcgagggugcggcgaccuaacaagcggcucagguauccccgacugcuuuaaagcucccgcuuccucccuccgccuggagagggggucccgaggcggcagcuggggccccaucuauugccugcugacuaggggagggggaaaguaacagugucuacaaagggccuagugguaaggaaugaaacagggcguuguguggagcaagucuuugggcaggcuugggaaggagaaaacagggucgccggggcgguaggugaagucuucggaggcggcugggcuacuggggucagagagcggggaggcggcggcggcaccugagccccaggacuccgcgucgcuggcggggcuugggggaccgggcaggcaggggacgcacugcggcggcaggaggcgcucccgggcaccgccuccgggcagcccuugauccgccaggcgcagugucucggccagagcccagauguaguuguaggcgaagcgcagcgucucgauuuuggugagcuuggugucgucggggaacgagggcagcacgcugcgcagugcguccagggccgcguucaaguugugcaugcgguugcgcucgcgaucguuggccuugacgcgccggcuccugcgcagcgagugcagcagcgccucggagcggacccgcguccggccgcggcgccgccgccucuccugcucgucguccugugccccuggaaccucagacgcccgggagauauugggcgcgccccugcgggccggcgcgggcggccccgaagcggaggcugccuguuggagucuggcacagucuuccucgucggugaggaagccggauaggucacugccgcugcugcuggcgcagucgaggucggagaugcaggucucaaggcgggcuggcaucguugcgcugugcaggaccgacggacagauagaaaggcgcucagagcgcugcagcccggacugagggcagagccgccagggcgcacuuacguucccaacagccugggguuguuacucugugccaguugcgggugcgagagccuggaagggugcaggggcgcacggagaacuuggccuggccuccucgccucgccugcaggggccacgcgcccggccggucuccugagugaugucgccggcgaucagaucagcucgugugagcaccgaguguggcacacgacuggccucaggaccccuuaaguacccggcgcaacaaugggcgccccccucccuugccaccuccgcccccgcggcagcccgggugaaug

SEQ ID NO: 17310 - RNA, 9458 nt, Homo sapiens
gaaaagucugaagguccugcugguggcuggcagacaaggagggugucuggauacaagacagagcugaagagguggucacaucauucccaggugugaggacucccccuggccuuuccuggagcaucacagaagcccggcuucuuucaggcccucaaagguaccagccacauuucccccacagagcuuuugcacugaucacucccuccaccugcagcucccucucccugcccuccucauagccgacuccuaccuccuucagaucuauaccaaagcaucuucugcaugaggaggccuccccaggccccucacaggaggucacgaccugguugcccucucucaaggcaccccugcuucuuuuuccaacucucaccaugccgcucaguccuugugcaaugcuugguugcuccaggaagauagauaggacccgucugaccuaucugccaccgugacauuuucgggcucugccacagagcaggcagacagcaauuacucaggaccgaguucaaaggauuaaugaaaccggaccacgggcuugugcugucuuucuucuuugaguguuugccccagcugcaucauuccugcacuggccucagacaacgggagcucugagcucccuccuugacucugaugggaaggaaaaggagcacacgauuuucgagcuucucauugggagcaggauuucuuccuuuguugauggcacuuugggaaaguaugugcagagcaugugcagacugaaucuggcccaucaccuguucagcuugaggcuggcagucaagaagcagagguaaguggcugugaagugagggggugaagcagcuggcgggaaagcugggcugccugggcucugguccuagugcugcugcugccucucugggcaucuugggaaaguccaggccuuaauucuuccucuauuuuuuggaagguaaggacgaucuccucuuagguggugucugcagaagucugaaauucuuggccacggggauaucagcugcggaggucucaucaagaugcgccaggagagggcgcugcugcgcagcgcuugaggcucucgggcggaaaagacaagcguggcugcucauucuggauaguuuccuggcccgguuugccuggcacuggcuggcagacagccacacucaguauaugugugggccguggaggagaugcuggcccaggaggcucagaggggagucugaggugccagagcaaaccucggagaagcuugaugagaacccaucuaagguguuugaguacugugugcuuggaugggaggcgacaccccaaucucuguaccuguguagaucuaucgaagccuugaaugucccaggcuuucuuccaccucagggcuccgagcuggcccagugcugcaugcuccguuuacaccaucuuguugaauucucugacgcaaguucuccuuggguaggugagaagaaugagguccagagaggucaagcaguuucucuaaagccacacagcagucaguggaggaugaugaagucacaccugcuguuugacuccaggguccaugcuauuaaaaaaagugcugccuccuagccaagacucgggaaguagaagugacuuucccaaagacccuugcccccacccccaccccucugcauaaaugcccuaacuuuucugccucaguuucuccacuaucagugugaugguacuaacacuguccaacugugccauauucauaggacuccugcaacaguuuaaucagggggaaaacaucccuuccccaauaccaucccagugcccugggcugcccucuauccuuucuuuccugacaagguccuguggguccacagaagucugaaauucugggccgcggcgauaucagcuugaaaaucauaugugcuucuuuccaucagagucaaccugcggguugaggcuggcucugcggacaucugagaauaggaaaugcugcuguccgccugacugaaggccaggcaggucaguggaccaggcagcccagguuggagagguuuggaaucaagggguuucuguaggaguguaggaggagacccugcugcgugcugcugucaaggucccaucugaaagccuggcugagcaccugcuauaugcuaaacucccugggacucagaggaguuugagugcugacagugacagaagagccaguguuuggggacagccuacuccaucuucugccauguggcauucuccucuaucaugcagucaucaaacaucagcugcugggcugggggagacccauaaaucucacaucaggccugaccucaaauagaggccaggaccauaggaaauuuggagggcagaacccagaagucucgggaaggagcagcauuugagcuggaacuaaaaagacaagcuaaguugugagcaguggagaagugugcagaggcagagggaacugccugaguagugccaggugggagaaugcaaggggagucgggaagaguuuugcucacccaaagcccccauggcuguaggaggggcagcuggaaggcuuggaguuuggcuccugaggacccugaaugccaaggaaaggggcuaggccaugauucugugggcaguggcgucuacaggcuagaggcaguccucaguccugcugcugcucugcgaguggaugaaaggcccaucucuggggcuagcuguaucucaccuggaugaaccuccauagcccaugcugaggcuggcucaggcuccuugcaaccagcauuuuucucugcagggaacuggugggcuugcccuugggaaguugaggccugugccuguccagcuccucagaagggcuaugauccuccucagcaccugagagcaggcaguucagccucccccagcaggagcucacugggucauuuaauccacugcaccuggacauccuccucuguaagaugggggugauaacuguaccucacucaagcugcacuuaacacacucagugagucaaugcaugucaaguacucugcaccaugacuggcacgcaguaacacacccagcaagucaaaucucuccaucguuaugaccuguguguccugaguguucacgucuguguuagcacauggacagcucccagccaaggccggcaggugggccagaagcaaacugcccuuccagcugagccagccccuuaucugggaucucuuuugcaccaaaucuuuccugcaaacuacucccuuagagagcucugcagcaugggaaaccucuggcgggucucuucauccccaugagcaggggagguaccuccagcucgccaagggguugcugacaggcuacugcagggcucucggcccuccuuggguucuggauggcacacacaugggaagagaggaggggacauggcucggacccugcuugggcugcacaaggagagaguggccccaguuuguaccauagacauagauaccucccaaccugucuguuccuuugggggcagugagggcccacagaugccagcuccucgaugaggccccaaacuaaaaugacaagcuaaguugugagcaguggagaagggcacagaggcagaggguuggauaccucccaaccugucuguuccuuugggggcagugagggcccacagaugccagcuccucgaugaggccccaaacuaaaaugacaagcuaaguugugagcaguggagaagggcacagaggcagagggaaccuccugagcagcaccaguugggagaaugcaaggggagucgggaagaguuuuccagccuuauggaaaauaaagggaacaguccuauugccucaccccaagaacaaagacgaguuuuccuggcaaggguaccuuuauuucuucauacucccaucauacuccaaaucccaaauccccaaacccaaugggaagucauaggagugccuuggaaauaguaaaaaauagauuuucuaaaaagaauuucuuugauguaacucuagugugaccgauugauuucucucucuuucuuaaaguccucauccucaggaagcaugugagcaggugagggcauuccagacaagcagccaucggguggaggagcagggauccaguggucagaggugugugagugucaaagcaaacaaagaaccuacacccggggaggagacacaaaaccagcgccacgggacagagaggcugugaacuugggacaugccaguguggcuggcacuaaaggauuuucaaacaggaaucagcaucuaagugucuggucccgggguaggugggaugagcauauacucucaaaaucccagugugauucagccacucaccaggugagccugggguuggaaguugggcuggagcaccagaaaacagguccacaagguccaaggagguagggccuagcagacacaugcagagucaccauccuuaccugcucuacccaagggcaggggcaggggaaggaaaggugcagaggcaaugaggaaaaagagagagcaagaugggucuaggggagcacguggcucauuucuugcuaugcauagacccacugaggaagaauguagugaggaggugcuuaaguacuuggcccgaggucagacagagcuggugugaaucccagcuccacaguucccggcugucugcuagcugugugagcucgggcacccuauguaacaucucuuagccuguuuacucagcuguagaauggagaugacaccagugucuacaacccaugauuauggagaugaucucuguaaagugccuaguacaaaguaaaugcuuaauaaauggaagcugcaaguauuacuccaaagcauccaauuagugcaccagcgccaaggugcacgauuuauuuacaaaaccagcuucugggugucugcacccuucaguuguucagguggcuccugcuuccucugucugagcuugggucaggcuacaaaaggaauggucugaggucagagugcuggacaagauggacacuucucuccaaagccacuuuugguguggcuguucaauucucauguggcaguuuuuccagcuaggagaacaggaagguggcagcguggggcgggaugggucucuuccuggggguggaguggcugaacauggggcacaggcugaguuucuccccucugcugcuugaggagaaaggcaaacccuaggccugcggagugggacaccucaugcuggcagggagcagccuggugggcugagaggggcugggagaaucugccaaggguuggguucuuccugcuggcucugcuggguaagggggguaggaugccccucauccauggucaugggcacugagacagagagaauacaggccugagugccagggucccaggccagcucuggucccagggcaaacugacugaccucugggagccuccccgcaaucaccuucaucccucgacagucagugggugcugggggccugcucuccagugguuucuguugcagucagcuccggcuuccccguggugugacugcaccagcccugggcagccccugagggccccuggcucccagauggaaaggcaggaggcccagggcuaguguguaaccccuccucagggguucuguaguaaugcacaaauccugaggcauaaagaccauggucccuggagagaggggcaucccggucacugucacgggggaacucugccgagaccugcaggacggggcagcaggccagugaguguggggacccagagaugagguccuagugugccgaggcagccuggguaugaaggaacaggaaggucagcccgaugcaagccccccucccagguucaggcccagauacccgggaccagccugugccugcaacaccacaguggcagucccagaaaaggacaggcccaugucugcucuacagcccaggaagcacucagcaaugucacucacccauccaagggcacccugcugggaggggugugucugggauuaaaacccaccggccuugccuccucugucucugcagucaugggccacagugcccagcugcaugguggugauuaggaauguuauagaccacaagcuucgggucaaaucccagguuugcuacuugcuagcuaugugcccuuggccaagucacuuaacuucucugagacucguuuucucauucauaaaaugggaauaauaguacggcuuguuuuauaggauuacuauuaggauuaaaugagaugaugcuaaugaaacauuugucugagagccuagcaagucauaaggaccaaauaaauguuucugugagcucaccauccugcugagcacuuuagguacgugguuguauguaauucucacaauggcuuuauuguugcugcugcuguucucucuuuuauaaggaaaccacguuccccaggccgcucuccuagcagguggucaagcugggcuugaacaggacagucuuccugcagugucugugcucccaaccagugacaccuugcuccaagggccgcagcagcccugagaggggccuguccaggggccuguuagagucugggccccaggacagagagguuugaaggaugcgggggccuagugcugcuccccccacccucuauggccuccucaacucacagagcauucgucccugacuguuguccugcagaagcagccagcccgugccuccuucucagugggcagaucuugggagccccugugugaccagccaggaagggccaggcugggcaaacucuccuccucagagcgguaguaagggaagaacccacugagcaguucugaguccuccuggagcggugucuugggcugcaggaccaaccccuccucuuccaggaggcacccauaggugcagaagaaaggcagguacuccaaggccaccugggcccuaugugaaagguggagggagcuuaggggcuucuugucccuugaacugguggccugcuguugggaggacaaggguccugggucauccuccucuaggaggcuaggagagguuggggcuccggauucagcgucacaguucugacacaucugagaaaagaaggacguuccaucuguuacugcauccugaauuccuaaccacaccagcucuguccccagucccugccuacauuggaguccagaggggucuuacaaagcccaaaccugacugugguucuccucugugaaaagccagcaaugggccucaaccauggcuagauugcucaagcacucagggcuucuugccauuccuaagucacaccaaacuuguccuucccuuagagccugugccaagaucugcuccuggacucucagcucagaagagccuucccagccccagccucccugcagggugacuccagaucauuucaucacuggcaugcucuuccugggcuguguggucugccugcuucaugugugggguggucuuaucugucuuaucugucuggugccucucguucacaauaggaacucaacugacacuuuuucaacuagucugcuggcucucaguccaacucauauucccuucacucuguccaguccagccacacaggccuucucuugauccaucucacuugccaagcauccuccugccacaggggcucugcaugggcuaaugcuucugcccagagucucuuccuucuccuuucuccuagguggugacuuccucagcgcuugguuaaggucacuucccuaaugucccuggcuuaguggcaucaccuucuucaugacugccaccacccucauaccccucauucagagcacccguuccucugcugugaaauauuugacugugugguuucuugauuaauaucucucauccuguuaguuacaaauuccaccaaggcaaggcccaucugucuagaucacuucugugucccgaaggccuagaaaaacccuggcauaugguagacaccaaguauuggaagaaaggaaagaagggugggagggaaggaaagaggcagacaaaaagagaacaccuuggccaggaacgaagucuuuaucagacuccauggugauaggagggagaagucacgucuuggggagaggguggagaagcggaaugaggaauuacuucccaggcccagaggggacacguggcccagagugccagguagugaaaagccagcucauucccacauugacuaugccagacccagagcccaucaggaacauggcagggggccccuuugauccugagcaagcccccaggcuguuccacuuguggacuccugacccauggaagaacuuaugguggcuuagcccccagccuucgugaaucccacccuggccuucccgacucccacccuagccccugggccuugaguccccgccccugacacaugcuccugugguccaugcucucccccaacucccugcaggcagccugaccacugaggucccuguccuaagccagacuccuugguaagugccuacuggcccauagacugccagcuucuggugagcaggaaccaggcccccuccuccaagucccagagacccagcucagggccaucuuugcugaguuucuaccacucccagacacucugcagagcucugugguccucucucucagguaauccuuaggaagcccaccaggauagacuugccuuuccaaccucacugugccaagcagaagggacaggcuaaauggcagcacccaggucugacccacucugaagccugugcucuguucgcugugaauuauauguuguugugugucccccauaggacauguucaagucuuaagcccuggcacuuguggauaugaccuuauuuggaaaugggaucuuugcagaugcaaucaaguuaagaugaggucacaccgggucagggugggcccuaaauccaauggcuugucccuauaagaugagggaaauuuggacacagacacacagguagaaugucaugugaugauggaggaagcuauuggaaugaugcugccacaaaccaaggcacaucaagaauugcaucaucacaggaagcuaggagggaggcaugaaggaacagauucccugcugagaccccaagaagaaaacaacucugccgacaccuugaguuugaaauuuuggccuucagaacugugaaagaauaaauguguguuguuuuaagcuacuaaguuuguguuaauuuguucuggcagcccuaggacacuaacucauguggguuugcuggauggcucauuuguggggauaaagggauuuggcacaggcuugagggcucucccagcaccacccugugagcagcuuggggagagaggcccauugccauggccaagguucacucuguugggggggcuuaccuaaggcccuacccuuccugccauccagugggcacuggacagcacagacucccugugguggaccaguggcccucccacagcucauucuuuccugcgagggccccggcuccacuucaacagugaguccuggauugaaggaggccagguguccucugagcuccccugggaggccucagcaagauggcaggugcacaaugccacucacagucucuagugagcaccacuuccggcguuguguuuuggggucagcaguagcaccgcaucgugacaugaugaagccuaauugucaaacucuggcugaaaagacaaa

SEQ ID NO: 17311 - RNA, 965 nt, Homo sapiens
ugaauauggcacaguuggacaguguuaguaccaucacacugauaguggagaaacugaggcagaaaaguuagggcauuuaugcagaggggugggggugggggcaagggucuuugggaaagucacuucuacuucccgagucuuggcuaggaggcagcacuuuuuuuaauagcauggacccuggagucaaacagcaggugugacuucaucauccuccacugacugcuguguggcuuuagagaaacugcuugaccucucuggaccucauucuucucaccuacccaaggagaacuugcgucagagaauucaacaagaugguguaaacggagcaugcagcacugggccagcucggagcccugagguggaagaaagccugggacauucaaggcuucgauagaucuacacagguacagagauuggggugucgccucccauccaagcacacaguacucaaacaccuuagauggguucucaucaagcuucuccgagguuugcucuggcaccucagacuccccucugagccuccugggccagcaucuccuccacggcccacacauauacugaguguggcugucugccagccagugccaggcaaaccgggccaggaaacuauccagaaugagcagccacgcuugucuuuuccgcccgagagccucaagcgcugcgcagcagcgcccucuccuggcgcaucuugaugagaccuccgcagcugauauccccguggccaagaauuucagacuucugcagacaccaccuaagaggagaucguccuuaccuuccaaaaaauagaggaagaauuaaggccuggacuuucccaagaugcccagagaggcagcagcagcacuaggaccagagcccaggcagcccagcuuucccgccagcugcuucacccccucacuucacagccacuuaccucugcuucuugacugccagccucaagcugaacaggugaugggccagauucaguc

SEQ ID NO: 17312 - RNA, 2629 nt, Homo sapiens
uagcauucugccucugcaugccuuuccguauuacccaagucgaacccuguagucaggaaauugcaucagucuuguggguuccugauggcuaugauuuuaaugagagaggaacggugccaagucugaucaaguuguucuuuccuccuacuggaccacuguuauugggaaaggugggcaguggugcugggagaugcucaaugauuucccugcugugagcacccagucccuccucuggacucucuucuuucauaacagcuaauuacaaguguaagugcugaugacaauauuaauuagccuucagcugggcugcuuugcgccaggcccugugccaagcauuucacaugcauugucucagggaaucucuguuacagccuugugaguuuauuaugcuucuuugugagacagggaaacagaagcccagaaaguguaacuaacaugcucaggccacccagcuaguaagcaggagccaggacuugaacucagaguuugacuccagagucacuuuguuucagucgccuauccccaccagauccugaauuccauaaggacagggauggcggcaugcuguuuuguucgcccugugccuucgcuccuaauauaagccaaauacaaagggugggggugcucacaaggcacuugcuaaguaaauaaaugaacuuaacacccaaaccuuguaugagugugagagcaggagaagcagucuggaaucagguucacacucuuucacccgcuuuuguguguuuuacagauagggucuggagggauggcgugagggcccaggcauagugcuggugagugguuugcuguucuuaaagaauccagugggcugggaguggugguucacgccuguaaucccagcacuuugggaggccaaggcgggcggaucaugaggucagggauuugagaccagccuggccaacauggugaaacccugucucuauuaaaaauacauaaauuagccgggugugguggcacgcaccuguagucccagcuacuugggaggcugacacaggagaaucgcuugaacccaggaggcagagguugcagugagucuagacugugccauugcaugcuagccugggccauagaacaagacuccaucucaaaaaaaaaaaaagaaaaaaaagaaaaauccagugaaagcugcugugguugucaagguaaacucacuucugagaaauaaagacauuguugccauugaagguaauugugggccauuugguaucauuuuuuauuuucccaaaucuuuagcauugaaaacucuaauccguaauagucagcuaacugaaaauagaagaaaacucuagacaucuucauuuaccuuucaguccuuuagagacuuagagaauuuuguucuccaagugagugcugggauggggugggggcagggugcaccugcaagugucugcauuacugaacuuggcacauugauuuucugcagugaacgucucuuauuuuuaucauagaaagcuauuucauuuagaaaaauuuaaauuauauaaacaaaacagaaagacaagaagaguauaguaaauuaaagucccucaaaaacccacaacccagagcuaaccaguagauaauuuggugaacaucuuuccagcauucauguguauauaaaauacaauuuuaaagagaguaaaauacuguaaauacuguuuugcaaucugcuccccucuuuccucauuuaauauacuguggagaucuuuccauaucaauggaaaugugauaugaauaugacacuauauuauucuuuuuaauggcuguauaggacacuauuguguggcuguuucaugauuaauccaucccuuauaauguacauuuauccacauucauguggcacuauaauuauccauuuaaucauuugucucucccucuaugcugugagcucauugaaaacagggacacagcuaaacccaugggcauacaauagguguccuauaaauguuugcauguauagauggauggaugagugagugagaaggagaggaagaggcuuuguuuugucauugcuguggaugguuucugacucaaccugucugagugacagccuauuaacccagggcugcaggaggcauuuuggugauuauauagcuggagggcccuuguucuuuuggugccaugaguuuaaauccuagugccaugaggaaguauuucugacaccaaucagauuaauuccugaucuuccugaagggaaguccuugguuucuugacccuguggguuacuuuccaugcagcuguagccucucuucugcucaucucuuucaaaggcacauuggcugugcaggggaaaaugccucuuacacauuucaggaaacuggaauuggcuuuuuguggggaguugagggacagugucagggauaauggcuauuccucucucucucucucucucucucucucucauguuuuagaauucugagcuggaugcuugaccccauuccaggggugcagaaugugcugaaaaguaaaaagaaaagaaaaccuccaagcucacuaagugaaaauaaaauuaacauccuagaggccugcuucuggggacagugaaagguagagucaagcugggauucuuaaccugggacacaguagugggaggcacacagauggccuucacaggguccauagcuauugcuag

SEQ ID NO: 17313 - RNA, 608 nt, Homo sapiens
aagcagccugagguaaucugugaaaaugguucgcuacucacuugacccggagaaccccacgaaaucaugcaaaucaagagguuccaaucuucguguucacuuuaagaacacucgugaaacugcucaggccaucaaggguaugcauauacaaaaagccacgaaguaucugaaagaugucacuuuacagaaacaguguguaccauuccgacguuacaaugguggaguuggcaggugugcgcaggccaagcaguggggcuggacacaaggucgguggcccaaaaagagugcugaauuuuugcugcacaugcuuaaaaacacagagaguaaugcugaacuuaaggguuuagauguagauucucuggucauugagcauauccaagugaacaaagcaccuaagaugcgccgccggaccuacagagcucauggucggauuaacccauacaugagcucucccugccacauugagaugauccuuacggaaaaggaacagauuguuccuaaaccagaagaggagguugcccagaagaaaaagauaucccagaagaaacugaagaaacaaaaacuuauggcacgggaguaaauucagcauuaaaauaaauguaauuaaa

SEQ ID NO: 17314 - RNA, 12900 nt, Homo sapiens
acauaagauuacuauauuuccuuuuaagaggaacguuucaacaaauuuuacaggugucaaucaacccuuguucaaaucgggcacacaucaaaucuagcaucauggguguuuuauuuauuuggaagugaauuuuaacuaucaauacaaaugccaagauacuacacaaaacauccacaggaacuuuuuucaucuuuuuuuuuuuugaauuguacacaaacauuuccuacauaauccaacauacaacagagaaaugguacaucuuuuucuuucaauuugcauacaauggaaaaacaaguauauauauauuuuacaaaguuuaacuaauaagacacuagagcaaauugacaguuuaagucuauaggugagaaauuaucuaauaaaaauaaucaauuuuuucagcauuagucacuuccauaaccaaguguuauucugauuaauaaaacuugcugccaaucagaauucugguauauacucauaccauuacucaacuuguaguacugcuccccaccuuaguucuucacaacuaacauagaaaauuguugaaaaguaggggcaagcauuugcaaaaacaaacaaaaaauccccagcuuauuauaagcaugaauauguaugauggaauuucuucccagcaauagacuuccaaaccaucaagaaaucaccagaacuaaguuugccaaguuauuuugccuauguccaacaagagaugcacuuauauguccaacagaggagcugaaaauuaaacuuaguguuuaguuuggggguggguugggaaauucagccaccauuuuaaaaugacugucuuaaaaaaaaaaugaccaccaaaaauagguucacuaaauuuauuuuaaaaaucauaaaacguuucuuacaaaagagcauuacauucugcacacugcucugaacagaugccagggacauguggacuauuguuacuuuuccucccugucccaccccccaaauguuacagugaccacaaagcaagguguucacaauaauuacauggggggaauuuuuuaaaccaccaacaauaacgaaaaauaaaauccacucacucugcugcuguuucaaaauuucaauguuaguuuuugcacgcccuucccccccccaacccuguuuguaaggaacuaaaacauuacaucuggugaacagcaaagauuucacuacaccucaaaugcagaacaccuaugaagcagaggaauguuggcuuuuuaaacagaagcagauaaaaaaaaaaagaugcaggacuccuucaguucuucacuagucuuagaaaaacuuuccagaauacugcuucacacuauaaaaaagaaaaaauaucuugcauuagaauccuucaacaucugcauacugcuucacacuauaaaagaaaagaaaaaaaagugcgaauuagaauuuuugcucguaacaucuuaaucaacaucaagacaauuucaaugcuaaauuaaaaugauaaacacguccauuacaauuagaagaguucaaaaaccauuagcaauuacaaauuaaagcaauguuaagugucaagaaaaaugaugaguaguaaaucggacauuaguagaacagaauuaagaaaacggaauugaaaguuguuaauauuugguagaaaagacaaagaaugcuaguaaggugugaaaugcugcauuuuacagcaccaaucauuuguccuguagaggcauggccugugccauauggcagacugugauuuguugucgauuuaguuaucuaaaaacaacaaaaucacuagucuuccacacagaacuaggccaacauccaaugaaucuucuauauuuucuacaggcucuguacaauuuuuaacaagugguuuuggcagcaguuuucaccagagaaaugagaaguuugcuugguuaaggcuucuuccagcaagauuaguauugaaugucuucauuuuuaguaagaaagcagaagaaaaauuaaggcaaacuauuagaauguuuagaaguuagguccccaaaagguugagacaccauggcuucuaaaagaaaaaaaucaauugagaagaaaagcuuuuuaaagguuuuaguauguauaagcuaacacaaagcuaaacuuaaacugaccuguucugcagcaaauacugugcauucuguaucugguccuguguuccuguaaugguaaugauccgaucuucggauccuucuaaaggcucaucaauuuugaucgaagcucccgacucaugacggauuuguuuaauccgcugaccaccuuugccaauaauagauccagccaacugaaaagauuuuuuaaaaguauguguuuacgauauacuuuuaacauuuacuaccuguauuuucaaggagcaugaaguuauuaauuuuauucauucagaaucuuaacugaugaucuaacgcucccuaaaccugucaagguuugaguuauaauguauuuaugucacacuuacuaauguuucccuuaguuaguuaagggcucaaaaccuacuuaacuacuuuuauuaauagcacugaucacuugacaagacucaaacagcugaaaacccagcucacuaaagcccauuaacauaaccucaauccuaaauguguauuuuuguuaaaaccuucugaauuaaaaaauauacagaaaggaggaauaaucauaaaagugauaaaauguuccugguaguauuaaagauacuuacaucuuugggaauaguuacuuguguaguaauaauagguccaccaagaucaccauaugagccacgacccccugcauaggaauaaucugauuuaaauaaugagcaguaaguucauuuaaaaaguaugaaauuaauguuugacuucacaaaggagagaacuuaccauauccggagccacccuaaaaacagaaagaaaaaaauagaaaauuacuuugccguuguaauuacuaccgguacuuuaaaaaaauucauuuaauaaaauggagucuugcuauguugcccaggcuggucucaaacucucgggcucaagugauccuccugccucagacucuuuuguaguugggauuaugagugagcaccacugcacccagcuucacuauucaaguauuuuaaucucauaaaaucccucuucaggaaaccaaaguccuccuguauccuauuuucaguaaguauccucaggggaauaaaaaacuuacuggagagcagguaagcaucuuaaauuaucacugauauacacacgaacaacuaugauacucaaccugugguucauaagccaucugccauucugaugggcuccauguaucuauugcagagucccaaguuucaucagcacugaaaccaaccuguuagagauaaaaacauuaacaugaacccgcauuguauuuuguuauagagcuguuuuuaauaugccuaauuugcauguuacauuaaaacaaaagaggguacauauauaggcagcaauuuuguaaucgaggggaacaaagcucaauaaagucguaauccuccagcagcaaauaacagaauuauuuaacuaguaauccaaacaaaauuuacuuguaagaaaaacuuuuuaaucacuauaaccuucaacaaaacgugaacuacauugugacaacccucacauacccaacacacugguaauaaaccaaaguucuuaccaugccgucguaacggucuccaggucucccucuucugucauaggccaugaggucucugcaagcauaguacuuguuguaaucuaaacgugcuuacaugccacacauaucaaaucaaagucuaccuugucuaccacuaagugcagccucuugcagguuaauaauucauagaugggggaagaaaaaacaacaacaacaaaaaaaacaacuuaccccccucuaggugguggugguggaggaagaggaagauuccgagcucugcuaccaccccggccgccucguccgggaggagggggaggugguccucgacgagggcucauaucaucauaaucucuucuagauggaggcaugggacgcccaccccgaccaggaggcauucugucaaaaccaccucuuccccgcaugggaaaucccacugggcguccgcgacggucaucaaacaucauuguaaaaccaccauaaucauagguuucaucguaaaaauugggaucauaaggcugugcacguccuuugaugggagacuaaaaacagagauggaacaaacuuacagacugaagaaaaagaguccugcuucauaccaauccuucuaacaucaucaucaaacaaaauguaagucauucccccaucaggagguacuagagacagaaacaggaauuaugucaacgcuaaaaguagcaaaguaaagauuccaaagaaauccaauacuuuuggcaaaugcuaaacaaaagugaguucuauugccuauacagggagaaguaauagcuugcucuuacacuuagaucguaagaaaccacaaagcccucccauuuuacacaugacaaacuacaaugcacauuucacaacaagggcugaagagaucagucuuggcaagccuguaauccauacugaggcaccugagauaggaagcccugcagcauaguuacaaagacacaagcaacacuauaggaaauucauucaaaggcucaaaggcuauagaaauaccaccaacaaauuaccacucuccacuuuuucaaaaccauuuuuaaauuaaagugauggcugaagccaggugauagaaaauugcuagggaaagggcaaauaaagacuauuagacuaaaugcucugaagcuacuuuugcagaagguuaucacuuuguuucauaaaaucaaauguaaacaaaaaguguucugaaguaccucagauauaagaucaaggaugaucuuuaugcacucuacaacccuaucggguuuuccuccaauaagaacaacucugucaguggaaugaggacagcauuccuggaaaagcuugauggugguuugaguguucuguaguaagaucauaaaaaaaaauaauaauaauuagaagaaaauuagcuuuccuagguucagugaaaauugcauuugaauucaacaauuaaccccccacaauauaaaaacuucauuaauuaucacagggcuuugcaaugguauaaaaauuuugacaaaauaacaugucuagcagugccagacauuuuuugucauuugcgauaagcaaucuuuggagggaacugagaggggaagcgagagaagcucacagaaacaagucuauaugaaaauuuacuuuccagcaaagaauacggcagaauuuuuuuuuuuuuaccucucgaaguucuuugauuuuagcaccuuugaccccaauaauuccuccugcuagacucugaugaaucaacagccucaacucgcagucaaagucacuuccuuuauaguguugguacuguggagggagaauuauaaaauuuuagucucaaaucaacaauuccccaauacacacuuaucugcuauaagcauaacaauaauauacuguugcagugagcaaccugaauuuauauuucaauaacuuuaccaguuaugugcuuauuauccucaauagccaggcccaaaaaggacauucugcaccaccuuaaaaaacuauuuuauuuucagguccugcaacaccauacccacacugcagccauuuagcaugucgcuguuaccacaaaauuauuauuaacauucaaauaacaccauaauaaaaaugacugcaaagcacuuugcaaauguaguuaauucccacugcagcauggagcagggucaacagugaguuguaagaccauucauguaucauguuuuuaagccuuuuucuauagagaugggaaaagcacacuauguuaaaaauauaaucgauccuaugggccaggcuccauacuucagugggguucaauggcacuaugacauacauuuaagcauuccacagcaucagauucgagcgggagcuggcugguugcagugggugauggcaacugcaggcccugaaaguagaaaaauaagaguaauagguuaagugucuagcgugaucaggcuauugucgcauauauugguaaagcuacuacaacauauuuuaaaucuauauuauuaaauaaugagaaacugcuuuauucaacauuaagacgauucaaaacauaaaauauuuuucucuauauacaccuagugaauuauguagagucuuaaaauccuaacuaaaucuaacuaauucuccuuuucaacauguucccacaaauauucuaauuuuaaaaaucuuucugauaacuaaagcccauaaaauacauacuaaacccaugaaagcacaugaccacagguuaaguucacauuuacuccaggaguggccagccuguuuuuuuuuuuaaaaaaaaaaaaacaaauuacgcauguacaaaauuauguagcagguuaagauacugcuacaaacugucauauccauugucucuccaccucccccaucauaccccaauacaacauacuuuaaacauuccccccucauauugucaaauacauuuaaaaaaaaaugagccuaccucuuccaagguagggaugauuuucuucagaauuucuccaauuguuucaauaucagcacugauacucaauaugcugucaaacaccacaaauaccagauaguacaaaaaagguggaaaagaaaaaugaguuuuguguuugucaccaaaucauacaaacuuucacagagauguaacacaugauuauuuaauauuccccauuuaaaguagccuauuuauagauuucucacaugcauuuuguuuuauacccaauacagacaugauaacaauauuaggagacuugcagagagacagagagaaugggcuuuuggaagggcucagauuaagugggcaauaaacugaccagaacugaagcagaguugaauauuuauguuccccgccaccacugaguuaaggauacccuugcuguuacauugguaaaacuggcacaccuucucuuaggcaaagugggggaauaugcaaguggugaacauuguaucuggaguaagguuaugaauaccaguuagaaauuagaucacuaaugggcucugcaagaaaacaaauacaaaugcaagacaaaacaaagacaacacaaaugagaagugaaggaaagugaaccagaguuagcauuucaucagaaaaaauuaugaacaggcaauguugggaagcaaggugggccacaaagacagagcgagagacuauuuugguaacaauuugauuuacaaugcggcaaauaugcaacacuugaagcugugcuccuuccaucgaaauaaaauuaguggaucguuugggugggcaacucacgguaaaaguucagugacaaaaagacuuaauggggaaaauaagacagaaacuugaaaaacaauacaccgucuaaaggggauacuauuuaauuauauaaaaggcagguaauaaaauacauuucucucuuucuaaucaggcagugaggcauaaacuguugggacauaccgcucggggccacugcugucugggacugaaacacuggcauuguacugcauuggucauuggcguucguggauguuggcauugggcaugggcauucaaucagaaguugucaaguaugguacccguuuggcaacgagcacauuuuugggcauagccaaccaggguuuucacaugggcguucaggggcggaugggccaacgucauggugggcaacgcagggguaagucgauccaguacaugggcaacggagauauauggccaaaaaaacaaggagagggaaaagggggaaaagcaauaaauuuuaauuuaauacaaacuauacucauacucucaaugaaacaagcuuaaguuguucugaagacuaacacaauaauggacuucucuaaaucugacuguggcuuaacauuaaggaccucaaaugaugguucuagccuuuuuuauuuuuuaagaaaaacaaacgauguuucaguagcaggcuggcucaugaggguagacacaaaaccugacucaaaguuuacugaaauucuugaggaaauggggaaauuaauaacccagauaauuauacagaacaucuggauuaagaggagagagguuuauaaaagacaaaacaaaaauucccacaccaccaaaaacccuaacuaauaagacugguuugguuuucuggagguuuugaaaugcauuccuagauccuaacaggcaaguuuguaaaauuuuaaacaaauuuucaaguucaguuuacaguaaucaagaggaacauacaaagaucugcgaccaagagagaaaugaaauacugucaaauaaguacucgacacaaaguuauuugccucauuuuuagcaagaaaaacauuaagaaauguguacacuaugagaaaaaaaauuuagaaauuuugguguagccaaguccuauaaaugugcucacuucuggcacugccaacauuuaaugugucuaaucacaagagucaacccacuguaaaaugaagacucaaacaaaucauaggcauugacgaacaguuucccaauuauaagauuaagugccuacucuauucuuuacccauauuuaaaucaugcaaccucaacauuaaauucuuugugcuccaugugcaagcuguuaaagaacagauggacauuuuucuucccaaagaaaacaaaaaaauuuuucuggauuuaaccagccaccugcaaugguuuucaguaauacuguaauugauucacacacaggaaauggugcaaucaaggauuuuuacacuuugucgcuauuucuaauuaagauguuaucuugcuugaugaagugaauaauuugguggacucuuauuaaaaugugaagagguuugaaagaaaccacccccccacccugcucaaucugggcuuuuguuaaaacaggaauggauaacuucgaaaucaauucuguaauaauaaauuauuacaaaugucuuuguagcuaaacuaugaaaugauuucuaggauguaaaucuuuaaauuucuauagacauauaaacugaagcugcucguguaguaguuuaaacucuuaauacuuacgucuguacggagagccuuaauauucuugccuccuuuuccaaucacugccccagcauucuggagaagauacaaagacaaaaaauuauuuugccuuucccuaaaauuaauagcuaccuacgcucuuagauuuugcuaaaaaauccucuaaccuguuuguuauaagaauaaaaaucuauuugggguuguaaaaacgaccaggccaaaaccaaaccaaaaaucaaaauauaauucuaagugcugugaggacuagauaguuuggaguacucaaugucagaaauaacaccaaguauaaaauaaaacuaagcacagauuuuauagcacccuuugguaaaauaagucaauuaauuuaguauuaguagguaccuucauauugugaccugugaucaaacaauaaacugccaaccaagcaguuuccuaaggaguccacacauaauuaagauuuaaucuauuaacacuuuaagaaucacacucuccuccuaguuugaccuguaguggcgguucacuacagcaagggcuuuaaucuuaacuguuaguggaauaagaaaaccaccagagccuucaagucuguuuagaaagaaccaaauguuuuauauucuucaaucuguaaaacuuugacuuucuagaaagccaaaccagaccuuaauuucuaccugaguaugaaccaccuucaaauuuucaagaauaaaauuuauaccuugcucugaagcagaaugcguaauucaaccaucucaucaguguuucuagaucuuuuaaaugcuuguuccucuuccauaucuucugcagggcguuuaccuaaaaauuaacaguucacauuucaaagaaagcagcgaagucuccaaaguaacuccauucuguuucaagagacuuguugcuaaucuuaggcauguuuugaaaagaccaaaggcauugcuacagacuugaacguuaugcuuccaucuaguaaaaugcaccaaacacaaaauacugccacaaaauacuucaaaggauuugaaaucccaaaaugcaagaaaaauucuuuauaugcaaaucaguuacuucuacuucauaaauaaaagcuaagauguaacuacugauaaucgcagaauuacauaaacaguaauaccaaaaauucaccacacacuccuaaggcaauaauuaacagaaaaaggcaauuuauuaacaggauaaaaaaauacuguuaaaacuaaaauuucuucucaccaaauucaccauugguuucaguguuagggaagguuucuucuggcuguucaguuuccauauucuuuuauuaaacgggcacaccaaucuguggaaaaauaaagcagcuaguacauuuggcuuauuggaaagcaagcuguaaaaaaaaaaaaaaaaaaaagacauugcuucuagaacguaccaguuauuauauauccuugcagagcagaacugaagcguucugggucggaccaacaacugacaccccagugcugcaguagccuauaagaaccaacacaaaucaguuuugcuuuuguuuauucuuauuacugaauauuuguuuccgaucacagugaauacugauuugaacccaaaaaaccagcuguuucuaaaacuugauucuucauuuuaggguuucacaauucaaaugacugccuaaaaaauacaaaauucaagggagccugguuucauuuuuugcuaaguuagaacaauaacuuuuagccacuggauuaagucccaccacagcaaugaauuguuuuauacggcacauucccaaaacccugaaaagauaaaugucauccacaaagcauacauuuaugaaaaguuacaaugcaucuuauucacugggaaaacuaauuuuauauuaaaacuuccaauugcuuuccuauuucuuucgacucaugcuugaagcgaucuuaugugacaucucuaaaguuuacaaauacaacggcaauugcgaacacauccaacaaccagaacaaucuaccggagggauaaauccaaaaaucuaauauaggaccagacccaaacuaccacaauaccagucuauuauuaaucagcgaaacaaauggagcccuugaaaacuaacagucacuagcggauuauuuuaaauuaggcuuaagggaguacaacacaacaaucaugccuguaacacgaaaacuaaagugucuacgugccaaaacggucgauaggacuacaaacagccuuuuuaagcuucccucuugucgggacuaggaguugacaagcggccucuacuagaagguuggcuagacagcaaagagccaacaagcgaggcacauuuaugccucccauucucccauaccguuggucgacuuauugcucuccuaacgacaacugaaacgacauccuuccggcccagcacgcaauuucugagguguggugggagaagaguuggauaagaaaguuuaagcaaaaacagcagggcuuaucuguaagaauaacguugccgcuugccguucacccuucggguccugcagucacuaguccccaggccucaaaaauccgcuaaguaugugcuccacuggccgagcgccaacgcgcccuccccuccccgccucccggcaccgagaucaaaaacagccggguaacaggacgggaaaaagcgaaagucgacagcagaagcaccgcaccucuccucacccggauccgacaggaaauggcggcccgcguaauggcgacuacgugcuacuaggcggagccgagcgccgacccccucccccacccaccacgcggucccgaggucucaucccccgcauccuccccccacugcccgagacaaagccaucgaggcagcccugaccguuccauccccgccgcuccagcuccgaccccgggccgggagacccaaggugaggcggggcucacacaaagagagcggcggcgcgaccuucuccccgcaccggccuccuuuccuccacgaggucccuaguucccagugccacauagcuccagcucauccuagaggcacaugccucacgaauccccaagucucuaggaccacaacgcggacugcggauacacgcucagggaaauggcggaggugggggaggggacaccgggcaacguucccacucggagaagcggccaaacaccaaagcggcucccaggacgccucccucaagcggaaaaacugggcuccgacccucaccuccacgagccgcucccccaacccggcuccucaccgcgcgagacugccgucccuccgcugccgcgccgccucagccggucggagcuagacagaaaacgagcgcaggcuccccucccccgccuucucgcguccuccccgccgucgcgcccuauuggcugccagggcuucagcgauggugcgagggcgaagcgauuggcccgaggccacgucaaucaaggcgacggaggaggcgacaaccccgccucccgccagcgccucccuucgggcugggaggccacuaagggcucgagaaaacccgggcuugggaaaaguaaacgcagccuuucagggagccccaacccuuacccgaaucagcaauacccaagcuccaauaacuccaauuaccuauaggccgcgaacaagugggacacaggcaagacgucgaggucggugcagcagagaaacagaggauaauggcgucugcagugcugucgccuggagcgcccuccuccuuucucguucgcgcacucacuagcuggggggaggggcggcuagggggcgaaccucucgcgagaucuaacaacugccuaguucacgcgcacagggagggggcggggaaggggcguuuuccagccccgaaggaguccuuugggguuggaggaggggcgcgagcgcgcggcaaaucgggcgggaagagguaaaaaaggaacugggagcgcgccgcggcgguuccuguccuuacaguugcgcugcccagggaccgauguugcgcgaggaaaaugcgggacgcccaggucggugcucggcccagacuuaugcccguguuuucacagcccacacucgugcccgaagccccuuaccccgccccgggcuguggucugugggc

SEQ ID NO: 17315 - RNA, 23139 nt, Homo sapiens
cgccucccgccagcgccucccuucgggcugggaggccacuaagggcucgagaaaacccgggcuugggaaaaguaaacgcagccuuucagggagccccaacccuuacccgaaucagcaauacccaagcuccaauaacuccaauuaccuauaggccgcgaacaagugggacacaggcaagacgucgaggucggugcagcagagaaacagaggauaauggcgucugcagugcugucgccuggagcgcccuccuccuuucucguucgcgcacucacuagcuggggggaggggcggcuagggggcgaaccucucgcgagaucuaacaacugccuaguucacgcgcacagggagggggcggggaaggggcguuuuccagccccgaaggaguccuuugggguuggaggaggggcgcgagcgcgcggcaaaucgggcgggaagagguaaaaaaggaacugggagcgcgccgcggcgguuccuguccuuacaguugcgcugcccagggaccgauguugcgcgaggaaaaugcgggacgcccaggucggugcucggcccagacuuaugcccguguuuucacagcccacacucgugcccgaagccccuuaccccgccccgggcuguggucugugggcugugggacgagcugcggcgcgguaagugcgggccgucugcguccgcugggccgggcccacgcuucggaaacccguuguuuguaaugguccggggcgcccgucagucaaggccgggcccgggggcgcagcuggcgguucucggccugccuugcgccggggcgggagccggggaaacgcggggcgagccugggaguacuggagaacuucucgccgagagggcacaggcgguuucacagggcucucgguucugagacuuuccucuuggguaaugggaccugagauggaaguauuuuguagugucgucgcuguaguuuauuccgauaaaauuuuuaggcaauauguauugcccuugucuccuaaaaugaaugcguaucgcugaauacguugcagaccuccacguuccauucaaagcgccugccuuguggcagugaugaaaacagacaaaaacccuugcccucaaacgugcuccuguucuagcggguucagcgcacacuugcauuguauucgguuccuuacuuuuaaggcuccugugccaagcuuucaugacuuccuuuguuaaggcacauaaggucacuuucaaucggugacagcccugggaaaucuccagcccugguaguacccgcuuuccacauccuuacucgucaaccuuccagccuccgcccacaaucccaaacucauuuugaagcauaaaggugucauaaucugcacauaaagcgaaauccaccauuggccgaauacaugcauauauuuuaguguugaugaauuugugcugauucauuccuguuauaauguuuccuucuuggguaauuugcaaaacauauauaccagcauucuuuuaaauggccaugauugcauccacccagcaucuuuuacuugacugauuagaggaaaacucuuguuagggcgcacugaggauuucaugacaaacaccaguauuuacauucugggaggauacguuaacacaugcuguuagaacauaauguccgggauuguggaauuuauaaaaguucucuuuaagugauaauauaauuuuuuaaaugguccccaccaugaagaguguauagucuuguuggguagguaaaacuuaacucgcauuucaguucuaaaacacaaaguucagaauuuuauuaaauauucaaaacugaugaguuuauguaggggcuuaggauacuuggauuauagagauuuaauccgccaguuaguauuugcaacauuuaauugaguuugucauuuaaaaccugagacaugucacugacacuaauaugcacaaauagcgguacgguaaugaugaugcugugcuuucuuucaaauuaggauuuauguugcagucaucauuuucuugauaaggaaugaugagugggaaucacaaguaagcagcccuauauaagaaccucuuccggccgggcacgguggcucacgccuguaaucccagcacuuugggaggccgaggcgggcggaccacaaggucaggagaucgagaccauccuggcuaacauugugaaaccccgucucuacuaaaaagacaaaaaaaaaaauuagccgggugugguugcaggagccuguagucccagcuacucaggaggccgaggcaggagaauggcgugaacccggaaggcugaucuugcagugagccgagaucgcgccacugcacuccagccugggcgacagagcgagacccugucucaaaaacaaaaacaaaaacaaaaaaaaaaaccucuuccucccaguuucauuguccagacuggaccccgacugguguaaauuauucauccccucuagaugccauugugggaugguugcuauuuuuccccccauuugauuucuucuuuacgucuuuuuaauuuuuagguuugcucuuuaaauaacaggaaagucuuuuuucuccauccuuuuauucucuguuugaaauuaagacuuuucaacccaauaauuuuauaccuguguucauucaagaacuuaacaauacauucauugacuccagucuuguguaauugguacaaugguguaaugguguagugaucacuuuggacucagugaauuuagacccaauauuacuuagaugggggauuuacuuuagaugggcuaauauaauugagaauguacacuauccagcugcauuauuguuuaaaauaguauuuauaacuacuauuuccugaguuccccacugugugcuaaacguugugcuggcaguuuaauacuuuuuagaguucuuugagcaaguuguuaguuaucuuuguuuugugaacgaaugaacuagcacuaagagaagcuaaggaacauauccaaggucacauagcaaaaugggguuccagauucucuuucugucuuuuccuuacuuuagguuauggaggauccauaaaaaucuccucugauuacuucuucuaauuucagucauauacgguauaaauuuuuccucccuaauuuucggaguaucuucucaaaaauuccaggauuaccuugaacucauccucaaugaauuaaaauguagacuuaccuuuauuguuuagaugaagauaauggaacuguggaguagauuuaaauauucguuagugcuuuuaagucucagcuauugucagaaugacacacguaagguccaaaaggaugacacuccugccucgcuuuuuauuaaaaaaaaauuggaauauaugaggcugacugaaaauuaaucuguaaaucaaauaugccuagaccuucgugguaggugauaaaauuuucccacuuuauuuucuuuuguucaguuccuggcaguacagaucuagaaugcagauuaguguggucagccaaguuuaucauucauacaaugcuaaucagcuuucuuaaaaauguuuuuuccugauuauaaaauuaauggggauuaagcuguauguaauuuuauauguguucuuuuucccaacaaaaugugaauguauuucuuugucauuaaauaauucuuaaaaaugguuucuuuaaagauuucauagcuuuucauuucauggugguagugcuauguauuuaacuuuuuuucccauuuugaacauuuuguuuuuuucaaaauauaaaaacucagugguaaacucucugccacauaaaucuuugucuuuauuuauuuuguuacuuauugaugcauaaaagauguacauaguuuugggguauaugugauaauuuaauauauucacuuaauuuguaaagaucaaaucacaguaccggggauauuaucuccuuaaauauauggcuuuucuuuguccuuauuuaugauuauguccuuaauucuggaaaguaaaagaaguggauaauaugguaugaacauaccuuuuuuuuuuuuuugagacugaguuucguucuuguugccuaugcuggagugcaguggcgcaaucucggcucacugcaaccucugcuuccuggguucaaacgauucuccugccucagccucccgaguagcugggauuacaggcaugugcuaccaagcucggcuaauuuuuuuguauuuuuaguagagaugggguuucuccauguuggucaggcuggucuggaucuccugaccucaggugauccacccgccuuggccuaccaaagugcugggauuaccaguuuugaacaucuuuuuuucuuuucuuuugagacaaaguuucguucuuguugcccaggcuguagugcaauggcacaaucucggcucacugcaaccucugccuccuugguucaaacgauucuucugucucagccucccuaguagcugggauuacaggcaugcgccaccaggcucagcuaauuuuuuuguauuuuuaguagagacgggcuucuccauguuggucaggcuggucuugaacuccugaccucaggugauccaccugccucagccucccaaagugcuggaauuacagcugugagccaccgcacccagcccgaacauaucuuacuguauaauuuaaaagacaguuuuccaaauuuauuauuauuuucuuggacaguggaguucuuuaggaucaggagcuguucuuugcacaugggaauuugugcugcccuugcuaaccucugccucugagcugcuucuaccugcuugugacuaugguuacccaauuuccuaagcaaagaagggaugaaaaccuuaggaauuaucugaaggacuagaugccauuaauauaauuuaccaaauuauuaaaggucucaauuauuaauauccagucuaaacuuuauaauauagaucuuacauaauauuuuuccauuugauuaaacauuuuaauaagcuucucuuucuaaucuguaggaaaaauaaccuauuacacaucaucuuuuuauuauaauuaagacaugcaguuguaggaauuauaucuguauccuagaucaauccuacuuucuacuuuguuguuaagugaugaaaucuguguaacagauguauguuagcaguuauuuuauuuccccuaaaguucuugacuuuuugguaaaauauuugagaauaguuguauuggaaugcuuguacaguguuaaguaucucuuaucacauuugcuuguguuuuacaggugucuugguuaucuuuuggguguuuagucaauggaauuuuuuucuuugcccaguuaugauaacauuacuguaaauucauaguaugucagcuucagaaguugagagugguucuuagaguuauuaauuaggacugacacauuuaauggaacaguuuaguuguugggguucacugagcaguguuuuucagaauucaucccaacucuuggcugaaaggaguuuugccacuugcgguguucaguagcacauacggccgggcgcgguggcucacgccuguaaucccagcacuuugggaggccgaggcggguggaucacgaggucaggagaucaagaccauccuggcuaacacggggaaaccccgucucuacuaaaaauacaaaaaaauuagccgggcaugguggcaggagccuguagucccagcuacuugggaggcugaggcaggagaauggcaggaacccggcaggcugaguuugcagugaggcgagauugcaccaccgcacuccagccugggcgacagagcaagacuccaaaaaaaacccaccaaaacaauagcauauaccaggaagagcaaguuuggaauuaaaaaaaaauuaaaaaauaaacugauacauaagccuuagaauaucaguuuguaauauucaaaaaauguaaaaauuauuuuaugugcuauguuaguaggguuauagcaaaaggaaaaguaguacuuaaccgcagcacuaugucgaagcuaucacaaagauaaauauaguagguguaggugauauuuuuaaguuuuucuuucauuugauuuuguaaaugaaacaauuuagaaugcauuagaugggcuuguuauuuacgugagaucugagaauucuguucauuauaguagcagcaaaccacucuuauagaauggccguuuauauguggauuuuauacauaaguggguuuuauagaugaauugagggacugguuuuacuuccucuuuccacuuaaguugacagaaaaagguaaaagaauggagauuagcagaauuuauguucuaguucugggucugcuguuggguaugauauguaugccuuaaucuucaugccucaguuucaucauugucaaaaauagaugagaauacucuuucuaucaaaaaauuacuguuuugagguuuagauaacauuguagauguagaaguacauuuuuuauugauaucuuuaaaaaaauuuuaagucuuacaaaauagguuuuaauuuauuuucagcaaagucuucacuucucuguuuauacaucuguaccugcugggaaauauaggauuaauaucucugaaauucauucuuguuuauuuucuguccagccuugaccuuuucaguucauaaccaaucagucuucuuuucuuacugauucauuucuuuugaaguuucaaagucaacugaaaguacacuuuguccucauuucaguuuacuuaaucuaaugucugucaucacauuuuuacaacaccuuugaaaauuauacuagguccauuugccagcacuguguuauuuaaauuuuacuggaggaaauaggaaccuuauugaauuggugcaacuaagagccauggcuggguuccuucccuccccuccccuccccuucccuucgcuuuccgauggagucucacucugucacccaugcuggagugcagugggaaacccuuggcucacugcaaccucugccuccuggauucaagcgauuuucugccucagccuccugaguagcuggaauuacaagcacgugccaccacgcccagcuaauuuuuguauguuuaguagagaugggguuucaccauguugacucacacuccugaccucagaugauccacccgccucggccucccaaagugcuaggguuacaggcgugagccaccgcguccggccugccuucuuauuguuucuauuuuuaucacuuuucugcuccuuuugugccuucuuuuagauuguuuucuuuauauuuuccucagcuaguuugaaaguuaguuguuacauuucuauucuuuugguguuuaccuucaguuuuuuaauuggaguauaauuuaccuucaguaaaauucauauuuuuuggaguauaguucugaguuuugauaaacagauaacagucauguaaccaccaaccaccaccaucgucauguuauagaacaauuccaucaccccaaaaauuuucuuuugccccuuguagucaaccucuuuccacauuucuggccuuuggcaaccacugaacuguuuucuguuuguauaguguugcauuuuuccagaaugucauauaaauggaauuauuccuuuacuuaccauacugaauuugacauucaugcauauuauuccuuguguccauaauuuauuuuuauuauuaaauaguauuccauuguauggauauuaucacaguuuguuuauccguucaccaaaugaaggacauguggguggguuuuuuuuuugagacagagucucagucugucacucaggcuggagugcaguagugcaaacacggcucacugcagccucaaccuccugggcucaagugauccuccuaccucugccuccuggguagcuaggacuacaggcaugugccaccacacucaguuuuuuaauuuuuuguaacagauagagagauagagauauugcccaggcugguuuugaacuccuggccucaagugacccucccaccucaguuuccccaagugcugggauuacaggugugugccaccacaccuggccacauacaggauuuuaauggaugucaaaauuauuuacucucuugaguaaauaccuugcaguugcauugcuggguuguaugguaaguauauguuuugauuucuaagaaaaugcuaaacuguuuuccuuuuguuuuguuuugaaacagggucuugcucuaucgcccaagcuggagagcagaggcaugaucacaucucacugcagccuuguccuccuaggcucaggugauccuccucccucaggcuucugaguagcugggacuacaggcaugcaccacaaugucuggcuaauuuuugcauuuuugguagagacagaguuuugcuguguugcucaggcagguauugaacucucaggcucgagcaaucugcccuccucagccucucaaagugcugggauuacaggcaugagccacugcaccuugcccaacuguuuuccuuuguagaaaccugccaaauucuuuuccacgguggcugugccauuuugcauucucacuagcaaugagaauucuaguacuugguauugucaguuauuuuuuauuuuacauguguagugauaucaccuuugauuuuaauuuugcauuucccugaugucuaauaauauugaacuguuuuccuguguuuauuugccaucugcauauuuucuuuggugaaguuuccauaucguuuuucuuuuagccuucuguuuguuuuuuuguugagacagggucuugcucuguuacccaggcugaaugcaguggugugaccuuggcucacugcugccuugaccucccaggcucaagugauccucccaucucaaccuccugaguaguugagaccacaggcacaugccaccaugcccaccuaauuuuguuuauauuuuuguagagacaagaucucaguauguuguccaggcuggucuuuauuuccugggcucaagugauccuccugccuuggucucccaaagugccaggcuuauaggugugagccacuaugccuggacugaaguauccuuucaaaucucuuucuuauuuuguggauuaaauacuuaaauguaagaccugaaacugugaaacuacuaggcaaaaacauuguggaaaugcuucaggacauuguucugggcaaagauuuuuuugagguaaaaacuuaaaagcacaggcaauaaaagcaaaaauagaugguauuauauuaagcuaaaaagcuucuguacagcaaaggaaauaaccaacagaguaaagagacaacuuauugaaucagagaaaacauuugcaaaauauccaucugacgagggauuaauaacaagaauauauaaggagcugaaacaauggcaaaaagccaaauaaucugauuuuuaaaaugggcaaaugaucugaauagacauuucacaaaagaagauguacagguggccaacagguacaugaaaaaauauucgacaucgugaaucagggaaaugcaaaucaaaaccacaaugagauaucgucucaccccaguuaaaauggcuaucaaaaagacaaaaaaaaaaauaaaauaaaauaaaaaagauucuugugaggauaaagagaaaggggaaugguaggacaguuuuauugggaauauaaauuaguguagccucuguaaaaaacaguauggagguuccucaaaaaaaucaaaauagaucugccauaugauccagcaauuucaccacaaaguauaaacuaaaagaaaggaaaucaauguauugaagagagaucugcauuccagcguuuauuacaguacuauuuacaguuuccaagauacggaaaaaccugaauccaucagcagacgaauggauaaagaaaauguauauauacacggaauauuauucagccauaaaaaagaaugauauccugucauuuccagcaacauggauguaacuggagaacauuauguucagugaaauaagccaagcacggacauguugcauguucucacucuugggauuuaaaaaaaguugaucucgggaagguagagaguagaacaaugguuaccagaggcugggaaggguaggggggcaaaggguaggaagacagauuggucaauggguguaaaaauacaguuagaggccgggcgcaguggcucaugccuguaaucccagcaugggaggcugaggugggcggaucacgaggucaggaguucgagaccagccuggccaacauagugaaacccugucucuacuaaaaauacaaaaauuagccaugcguggugguacgugacuagucccagcuacuugggaggcugaggcaggagaaucgcuugaagucaggaggcggagguugccgugagucgagauagcgccgcugcacuccagccugggcgacagagcuagaaugcugucuuaaaaaaaaaaaaaaacaauuggaauaaguucuaguguuugauagcacugcauuguggcuauaguuaacaauaauuuauuauuucaaaauagaagagaagguuuggaauguucucuacagaaagaaaugauaaaugugugaagugauagauauccuaauuacccugauuugaucauuacacacuguauguauguaucggaauaucauguguacuccauauauauguagguuauuauguaucaauaaaaaguauuuugcucauuuuaauauuuguuuucuuucuuucuuucuuuuuauuuauuuauuuauuuuuuugagacggaguuuugcucuuguugcccaggcuggagugcaaugguacgaucuuggcucaccacaacccccgccuccuggguucaagaaauuaucuugccucagccuccagaguagcugggauuacaggcgugucccaccaugcccaacugauuuuguauuuuuaguagagacgggguuucuccacguuggucaggcuggucucgaacucccgaccucaggugauccacccgccucagccucccaaaguguugggaauauaggccugagcuacugcgccuggacgauauuuguuuucuuacugaauuuuaaaaauucuuuggauauucaggauauuucucuugucaauuagauguuucuuuuagacuaauaugcaugugugugugucuugucuuuuuauauuccuaacagugucuuucauagaacagacguuuuaaauuucuuucuuuuaugcaucauggaucaugcuuuugaugucauuuuucuuuuuuuuuuuuuaacuaauauuuuuuagagacagguucucacuuuguguccaggguagggugcaguggcacaaacauggcugacuacagccucaaccuccugggcucaaggaauccuuccauuuuagccucccaaguugcugggacuacaaauguaugccaccauaccccaguuuguuuuaaaaauuuuuuguagaaauggggucuugcuauguugcccagguugcuccugaacuuuuguccucaggugaugcucccaccuuggccucccaaagugcuaggauuauaggcaugagccaccacguccagccuggugucauuuuucuaggaaaacuuuuaggaaaccaaggucacaaagauuuuuucugcaaacuuuucuuauacauauuuuguaguuuuaguuuuuacacuuggcucugugauccauuuugagguaauuuuuauuuguugaauuacuucuacaacuuuguggaaaaucaauugaucauauauaugugugucuauuuguagacuguccuuucuuccuauuuuccaguauguuaauccuuuugucagcaucucacuguugauuauuguaguuuuauaugaagugucgauguuauauagugugaauccuccaacuuuguuuuucuuuuucaaaauugucuuggcaauucuaguuccuuugccguuccauauaaauuuuagaaucaguuuguuauuuuuuauaaaaagauugcuggggauuugaauggaauugcauugaaucuauagaugaauuuggggagaacuaaaaccuuaaccagguaaacucuucuaauccaugaacacauccauaucucuccauuugcuuagguuguuuuuaauuucuuuaaucuguaauuuauaguuuucagcauaguguuugccuuuuaggugcuauuauaaaauacacuguuuuguccguugcuugugcaguuggcaaccuuauuugaagguuuaaagacaccucauuuaauauauaucauugaaucauuaacauugaacuuacacagccaacagugcuguaacucaugccugaauaagcuuaucuaaaauacauauuuucuccacaagacagaucacagcuuucuugugcuuagguacacuagguagcacuugagcacugugccagggauccauuuuaaacaucaaaacuacuggaaaaaaaaaaaagcauaaaaacauggcacuaaguagagcacuaaaaggagacuuguuuauuguaugagaccugaaccaaaaaggcacaauaucacuuugaccucagcugggaaugugcauguugggugacucagguuuuucacugcucugcacauguucaugaaugaccacgagagugcaguaaauauugauuuugggauuacaaauaaauuuuagugaguaggcaaauaaggaaucugugaaugaagaucaauuauauaaaaguaaaauugacuuuugugcuauauauuggccuuauaucuugcuaacucaggugauagagcuuuuuuguagauucuuuagcauuuucuucaucaauauucaugucauuggcaaauagggguacuuuuauuauuccuuuuuucucucuuccaucuuuuucucuuuuuaaaauuguagugaaaagcacaucaaauaaauuuaccuacuggucugauugcagugauguuuacaacuaauugaucacaaccaauuauagauuucuuuauuccuucuccauuuccagugcuuuacuugaguagccuaaaaaaaaaaaauuacacucuuaacaaauuuugaauacaauuuauggcauuguuacuuaugugcauauuguugugcaacaguuaucuauaacuuuuucaucuugcauuacugaaacuacccauuucucccuccccacaacacuugacaaacaccauucuacuuuccauuucugugugcuugauuauauuagguaccucauguaaguggaaucaugcaguauuuguccuuuugugauuggcuuauuuuacuuagcauaauguccucaagguuaauuuauguuguggcauaugauaggauuuacuucuuuuauaauacugaacauuccaugguauguauauguuauguuuuguguauccuucuaucaguggacauuucgauuguuucuguaucguuaaugugagcaaugcugcaacaaacguggauugugagauaucucuucaagauccuguuuucaguucauuuggauauacaccuagaagugggauaaugugguaguucuaguuuuaauuuuuugaggacgcucuauacuguuuuccauaguagcuucaccauuuuauaauaauauuaacagugcacagggguuucaauuuucccacauccucuccaauacuuguuauuuucugguuuuuugauauuggcacuucuaacagguaugaggaugagaucucauugugguuuugauuuguauuucuuuuaugauuagugauguugagcaucuuuucauaugcuuauugaccauuguauaucuuuuuauuauuauuauuauuauuuuuuaagauagggucuugcuuugucgcccagacuggagugcagucgcacacuuacggcuugcugcagccuugacuucaagcaguccucucaccucagccucaugaguagcugggacuacaggcgugcgccaccaugcccggcuaauuuuuuuuuuuuuuuuuuguagagaugggguuucgccauguuguucaggcuggucuugaacucuugggcucaagugauccaccugccuccgccucccaaagugcugggauuacaagugugagccacuguuaucagcucauuguauaucuuuggagaaaugucuauucaagcucuuugcccauuuucaaauuggauuauuuuuuguuguuaauuaucaaguugagaaguucuuuacauauucuggguaauaacaccuuaucugauaugugguuugcaaauauuuucucccauuccauaaauugucuuuuuacucuguugauuguguccuuuggugcacagaaguuuuucaguuugauguagucccauuugucuauuuuugcuuuuguuaccuguacuuuuggugucauauccaagaaaucauagcccauuucaaugucaugaagcuuuuucccuauguuuacuucuaggaauuuuauaguuucaggugcuaccuuuagaccuguaauccauuuugaguuaauuuuuguauauggugugagauaacguccaucuuuaaucuuuuacaugggcauguccaguuuucucaacaccauuugcugaagagaguaucguuuuuccauuguggagucuuggcaccauugucaaagauugaccagauacuuccugggaucaagugauccucccaccucagccucccaaguagcugggaccaccagaaggugacaucacaccuggcugauuuuuguauguuuuguagagaugggguuuugucauguugcccaagcuggucuugaacuccugagcucaagcguucugcccaucucggccucccaaguguugugauuacagacaugaaccaccacgucuagcucccacauuuuuguuaucuuauauuuuacauccagcuuguuaggucuucugauacuuuucuuuauccuuaauguuuuguauuuugccauguuacuguguauaaguguagauuaaaaaaauacugauuagcaguagagaguuuuuucaaccuagaaaauaauaucuuggaaaaauuucaaccauuauuuauuuauuuauuuugagaugaagucucacuguaucacccaggcuggagugcaguggcgagaucucggcucaccacaaccuccgccucccagauucaagccauucuccugccuaagccucccgaguagcugggauuacaggugcgugcaaccaugcccagcugauuuuuguauuucgaguagagaugggguuucaccauuguuggccaggguggucuugaacuccugaccucaugauccaccugccuuggccucccaaaaugcuggcauuacaggcaugagccacugccccggccucaaccauuacuuuuuaaaaaacauuuccuucaccucuucuauuuuuucuuucugaaauugcaauuauuucacuguuggaacuauguucccuacuucuuaguucuuuuuuccucauuguguaauaucuuuuuuuuuuuuuuuuaauugagacaagagucucacucuguugcgcaggcuagagugcaauagcacgaucucagaucacugcaaccuccgccucccggguucaagcaauucuucugucucagccucccaaguagcugggacuacaggcacaugccaccacgcccggcuaauuuuuguauuuuugguagagacgggguuucaccauauuggucaggcuguucuugaacuccugaccucaggugauccacccaccucggccucccagagugcugggauuacaggcgugagccacugcgcccagcagguaauaucuuaaucuuucuuuauaccguguucuagguaauuucuaaugcauaaguuaucuccucauuuguuguuagcuggauguuuaucccaucuauugauuuuaauuuuagagaccauuuucuguuuccaagauuugcaguagauucuuuuuauaaaugcccgugaucauuuaauuaucuucuauucuucuuuuaggauguuagucccacuuaaguauauuuaguaugcucaaagagauaaaaaaaaaauuaagauguuucauuuaaaaaacugucuucagguguaaauucuauuugcucugucugcugauugguaguaauuuuccuaaaguguauuauaauuuuggcuugcaggcucacguuggauuguuuuuuccuguguguguuuuacccuuuuuguguggcuuuagaguuuacuccaccugucccucuggcugacauagcucuaggucagcuguuucauuaggaauuuggguuuuuacuuagugaauagcccaguucuggaccacacuacguguguuauauguguuaugcaggcccagugucuauucucaggguaacucuguucccgccacauguagguguuggguggaacuuuuuuuggcccaguuccagcaaggagucuguuucuggucuucugucccauccauggcaugcuggauuucuggagcuuuguaucuuuagcuacacuguuuuuagcuaagugcccuuuuccugggggcugcacggcuuuagugcccacuuaaccacucuuaaguuugccaucuguuccugacccacgaagaucuuacucuuguuauugaguguagcuaaauauuuaaauuuuugucuaguuucuuguauauccaucuagagguacuuuauguuuauuaaguaauaaugugcuuauuuuccuuuguuuuguauacaaaaguuagcauacuauauauccuauuagauuaguucguucuuguucugcuguaaagaaauaccugagacuggguaauuuauaaagaaaagagguuuaaauuggcuuaugguucugcaggcuguacaggagcaggcuggggaggccucaggaaacuuaaaaucauggugaaagugaaggcaaagcaggugcaucuuauguggccagagcagggggagggcagagagggagaaggugccacacacuuuuuuuuuuuaaucaggcauuuauaaacaaagcauacauuaauuacauaaaaauaguuuuugaauaacagaguaaacaucauauugucauuagcaacaacauaggacauggggcgggaugcagggcucugggugguuuuaaagauagagguggauucccccccccuuuuuuuuuuggcagggcucugggugguuuuaaagguagagguaaguccaacaccccccccuuuuuuuuuuuuuuuuuuuugagauaggguuucgcucuuguugcccaggcuggagugcaauggcgcaaccucagcucaccacaaccucugccucccaaguucaggcaauucuccugccucagccuccugaguagcugggauuacaggcaugcgccaccacacccagcuaauuuuguauuuuuaguagagaugggguuucuccauguuggucaggcuggucucgaacucucgaccucaggugauccuuccaccuuggccucccaaagugcugggauuacagguacgagcuacugugccuggcccuuuuuuucccuuaauugaaaaaaaaaaagaaagaaauuauuuguuacuccugacuuaaagcaagaacaaaugccucccuggacccuggugggcuguguaacagggcgggucagagaggagugaggagggcuccgcacccacugggaggagggugucacauggaaaacuggcauaggggcuucuucuccucgucugugccacacacauuuuuaaacaaccagaucucaggagcacuuacuaucaugagagcagcacugagggggaaauccaucaccaugauucagucaccuccuaccaggucuuaccuccaacacuggggauuuggguggggccacagacccaaaccauaucaccuauacuuugcuuuucuuaauaagauagggaguauuuuuuuuuuuuucugagagacagggucuugcucugucgcccagguggaguacaguggugcagucauagcucaugguagcuucgaccucugggcucaagcaguccucccaccucagucucccuaguagcugggacuacgggcaugcaccaccaugcucaggcuaauuaaaaaaaaaaauuuaaagaugggaucuugcuuuguugcccaggcuggucuugaacuccugggcucaagugauccucccaccuuggccucccagaaugcuggguuuacaggcgugagcuaccaugcccagccaagauaggaaguauuuccauuugguaaaucagagagcuggcguggagauuugguuucuuuguuaaagagaccugcucauuugaccugcauaguuuaucuucaucacaacaaguaaagacuuuuuguacuuuugaauuuuuacauuguuuuuuacauauaguuuaaaaaauguuuauacucucauuuucuuuaauauaaagauuaaucaguucuauaauuaugaccuuaacuuccccauguccuuuaaauucuaaucauccauuaaauuaaauuaauaauguacccacuguuuauagguuccugagaacuauaugcuucuaugucuucuuuuaugggacauuuaaaaauuuuuaaugguagcaagcacuuacauacauuuacuaugugcuaggacagaaguacagaacaaaagaggagaaauuguuuagaggcagugauaaggaauccaugucacugagaaauaugaaaagauguucaacugcuagcauuagaaucaauaauaaacugaaguuuuaguuccuuccauuucucagacaugugcugcauuucuuucagcuguuuuuggggaugcaauguaaaauaguuuuguuauagcaguagcuuaaggugagcuguauuagcauuuucaggguuuaaaccccuaaaaucucagguagguauauauuauuuucuugagaaccuacaaaaaagucucauuucaguaauuucagagcaguguagaacuuauccaauguaggaauuggucauucagucuaaaauaauggcugggcgcgauugcucacaccuguaaucccaggacuuugggaggcugaggugggcagaucacuugaggucaggaauuugagaccagccuggccaacauggcgaaacccugucucuacuaaaaauacaaaaaguagccaggugugguggcacacaccuguagucccagcuacuggggaugcugaggcaggagaaucgauugaaccugggaggcagagguugcagugagccgagauugcgccacugcaguccacccugggcgacagagcaagacucugucucaaaaaaguaaaauaaaauagaauaaaauagaauagaauaaaauaaaauaaaaaaaaauaaaauaacaauaaguauaguuuuugaguggcugcuuuuugccaguugcuguaguaggcacuguaagucuaauaauaguauacauuuacugaguucucgcugugugccaggugcugcuuuuuucauauuaaucuaaucuucauaacaagccugaggaaaauccuguuauucuuguuuuacaaaucagauaaggauaaguaggauaucaugaaguugaguaacuuguuuagagucagagguuauaaguaagaguuuaugauauagucuagcaccagagauguacucuuaacaucaaauacuauaccuccuaucuucuuuaauuuucacaguaagccuaugagguaaguauauagaaaaggaaacaggcuuagagagaauguguaacuuucucauggucucuuguuucugauccccaugaaccauaccaucaaacucuugcacuuaagaaaauaguccugucuuucuacaacuucaucuuauaacucuuacugcuuuuugucuuaucucccagggccauuucugagcaguggagguuucaaguaauccacuaacaaccaguuccaaauucugucaucaaauccugugcugcuguuccucgugguaaguuuucuuauggacauaguaaaacuuuaauauauucuacuucauaaauaucuucaucuguagaaggaacaaaguauacuuuugugaacacaugauugauugggcuuuacuguuuugcuacugcuuuaucauacugagaaaaucagaaguuaaauauuuauauauuugccuggccagacuuuugaaaauauuuagcccaacaaauaagaugcuuuacaucuaucagcucagagucugcuguuauuuguuauaauuuuaucuuuagaccacauauucaaguacuaaauggacagacacagugguauguuuuaauagaguuaaauuagaacuauugcacauacauaaagaacauuagugaacauuguuucuuaacuaaauuuuaaaugauuagaaugugauuauuagaucaauuauaauauauuauacaguagucucccuuucuccgugguuuugcuuucugugguuucaguuaucugcagucaaccaaggucugaaaauauuuagcagaaaauuccagaaauaauucauaaguuuuaaauuuagugcuguuccgaauagugugaugaaaucauacccuggacuuggaucaucccuuuguccagcauaucuaugcuguuuaugcuacccacccuuuagucacuuaguagcugguuggucaucggauuuaaaaaaauaauauauauuaaguuugauaauauuuagaguuucagacauccacuggggguauuggagcauauuccccauagauaagggaggcuaauguaacuacuguuuacugaauauccuuuauaggucugacauuaugcuuuacaaauauaauucaugugauccuguuaacaauccuauaagauagaugguaguguugacauuuuauagaugaaaaaacugguuacagaaguugagaauuuuauauuaggucacauaucuuguaacuugacagagccagcuuucaaaccuagguauagcugucucaaaccuuuugauuuucucauuuuaccaucugauuauguguaguguuucaauuucgaccauguaagaugcugaagagugaaaaaucuaaagggugugccugucugugcauuguagagaauuacagaagcuguauucaaauauacugaauuaucuaaauuuuuuuguuuuuuguuuucagguaauagaugcauauuauuucuuuuauuuaaaagaaaugaaugugacuaguauugcauuaagagcugaaacuuggcuuuuagcugcauggcauguuaaaguaccuccgauguggcuggaagcuuguauuaacuggauucaagaagaaaauaauaauguuaacuugagucaggcccaaaugaauaaacaaguguuugagcaguggcuccuuacugaucugagggauuuggagcauccucuuuuacccgauggcauuuuagaaauuccaaaaggagaauuaaauggauuuuaugcucugcagauuaauuccuugguugauguaagucagccugcauacucccagauacagaaguugagaggaaagaauacaacaaaugaucuaguuacagcugaagcacaaguaaccccaaaaccuugggaagcaaagccuucacgaauguugaugcugcagcuaacugauggaaucguacaaauacagggaauggaauaucagccuauuccaauucuucauagugaucuuccuccagguacaaaaauuuugauuuauggaaauauaucuuuccgucuugguguucucuuauugaaaccagaaaacgugaaaguguuaggaggugaaguagaugcucuuuuagaagaauaugcccaagaaaaaguacuugcaagauuaauaggggaaccugaucuuguaguuucagucauaccaaacaauucuaacgaaaacauucccagaguuacagauguucuagauccugcauuagguccuucugaugaagaacucuuggcaagucuugaugaaaaugaugagcuuacagcaaauaaugacacuuccucagaacgauguuucaccacagguaguuccucaaauaccauucccacaagacagucaaguuuugagccagaauuuguuauuucuccaagaccaaaagaggaaccaucaaaccuaucuauacauguaauggauggagaauuagaugacuuuucacuggaggaggccuugcuuuuagaagaaacuguccagaaagaacagauggaaacuaaggaauugcaaccauugacuuuuaacagaaaugccgaucgaaguauagagagauuuucacauaauccuaauacuacgaauaacuuuucuuugacuugcaaaaauggaaacaauaauuggagugaaaaaaauguaucugaacaaaugacuaaugaagacaaaucauuugguuguccaucuguuagagaccaaaacaggaguauuuuuucaguucauuguaauguacccuuagcccaugauuuuacaaauaaagaaaagaacuuagagacagauaauaaaauaaaacaaaccagcaguucagauagccauuccuuaaauaauaaaauauuaaauagagagguggucaacuauguacagaaaaggaauucacaaauuucuaaugaaaaugauuguaauuuacagaguuguucuuuaagaucaucagagaauagcauuaaucuuucuauugccauggauuuguauucuccacccuuugucuauuugucuguucuaauggccagcaaaccaaaggaaguuacaacagugaaagugaaagcauuuauuguaaccuuaacuggaaaucucucaaguucuggugguauuuggaguauaacugcaaaggugucugaugguacugcauaucuagauguagacuuuguggaugaaauacuuacuagcuugauaggguucucaguaccagaaaugaaacagucaaaaaaggauccucuucaauaccaaaaguuccuggaaggguugcagaaaugucaaagagaucuaauagauuugugcugucuaaugacuauuucauuuaauccuuccuugucuaaagcaaugguacuggcauuacaagauguuaauauggaacaccuugagaaucuaaagaagcgguuaaauaaauaauuaaacuaaaauaguauuaggaacaauuaaaaacaacaaggaaauauuuagaauuuguucacaauuuuacuuaugauacuuuguguaaaaaggaaaaaugaaauuucauagcuuauuucaguuuaauuuuaaaguguuuaaucauguuuguuauauguggagcuuuugaaaauaaguuaaucuuuuuuuuuuuuuuuuuaaugucaggguauugcucuguugcccaggcuagagugcaguggcaugaucauagguuauugcaucaaccucuugagcucaagcgauccuccugccuuagccucuugaguugcugggacuauaggcauguaccaccaugcccagcuaauuuauaauuacuauuauuguuuuguagggacagaguuuugcuauguugcccagauuggucucaaacuccuggccucucacuccugccgucauggccuccaaaguuuacuuuuuuuaaaaguaacuguuagauggaggaauauggugacccacuauuguugagaaauuuguuuuccacuugucacgucacauaagaugauugcuaaaauauuguacugguguucgguggugagucauauuuuugaaaguuaauaauuauaaauagguaauuuccuucuaauauguug

SEQ ID NO: 17316 - RNA, 6455 nt, Homo sapiens
uuuucuguccaguuaguaaaggcacaucacugaacacaguguuuuuagcacuggucaggaugaccggaggcaccagguugacuucacacugcaagugggguuuggcuguggcacaggcuuccuguggggcauggauuggggaugccuuugacacaauaucuuccccuuaaauguccaacuuccuggggcuaucuguccuugucuaugaucugucuaaucauugcaggauaauucuggccgacaaagauagcuuguuggcugcaagauuugguacaugucacuuugcaggagggagccauguaguugcagggauagcccuggacaggcucugcucugaccugcaguucuggcacauucugagauuucccaagcugcacuggggaggaaaggggcuccuggggacaggugauaucuauucaaugucuaugccccagcuucucuucuaugaacuccccagugucuuuccuaauuuucugagcuucaauagucccaguaaagacagcucuacuuuuaacucgaccucuauucugcacagaugaugacaaggagcuacccuuuuccuaggaacuuucuuguuuuccauauguuaugauggguuuauuagacugcugcaaaaaggucuucaucaauguuccgaaaagguuuucaggaggaggcuguguuuucaagguuggggaagauuugcucccaagcgacucccuugaugucuuguuaugaauagcauggcucuuucuucugaguugggauguccccagcccugcauccccuccaccaagcucuccuccauuaggucuuagagggcucacucucuuuguagcuggugaaaaauucuuaacuuggcauuucuguaagacaugcguagggacccugggcuccugcugcugugccacacggauuccucugaccuccaaguggacaugcagcaccugggaaguucccaaguccugauucgagaugcccugggcaugagucaguaaguccuuggaacucaaguuaucuaaggcaagagacaugccagugaaauggcucugagguuggcuaugcuuccucuggaccaacuuuaacuggcucaacaucugauuuuuaagauaugaugauuuaggaguuugaggaacugauauucuuggugggaaaauuucaguuucaugagaagugcuucuuuucacguuugucacuaagcagcuuccugacuugcugguugucaaguuguuccuaguuugugauugaagaguacagaucuccucuuccuugaacaucuccuucgacccauuggugacaggaaaggucuuucuacugcccugaagccuguuaacauuauuacuggcacucucucucuuaucccuugaaucacggccaacuccagcuugcaguaugggcagcucugcacugcaucuacuggcaaguacagucuguuucugacugacuucgucuaugaugcuguguguggggggcagaaaagucugucugccauccucaguuguccagacacuuucuguaagauccucgucaguaucagcgaauucucuucugaggguccccugcuuuucuugaucaacaggugaggugacgaggugaggaugacccaagauggagaaugagcuuguuguuucuaauuuuucuccuugaaaauauguagugccucuucuaaggggcguggaggcaccaucuuuggcaucugucucuauaaggucauggucaguaucagaaaauugucuucucaggguccccugcccuucuuugccaauaggugaggagacaggcugaggaugauuaaggacagggacugagcuuguuguucccaacuuuucuccuugaaaagugcuucgucuacaagacuuagagaccccaucuuuggaaucucccugagaaauaaagcuggcugaggagggaagguagaaaugggaaaaggaauuggaaauauccucuucugauuugaagauuucuguggguucacggaucuugcggggaaggccccacagcauccucauauggaaagauuuaauaugggcuucauauggaaagauuuaauaugggcuuccaacaucuuuuguuuguuggaacuaaggaaggacaucuccugggagguaucaacgcggugguccucacucaccaaugcugccaaauuucgauguuuaauuuggcugugggauuucucaggaagacauauugucugcuugacugagugccaugaacuaugcacagucccaggcauucgacccucauugauuuccucaaauuucuugcucaaauguacugucagggcauuuucaaguuguuucugaccuagucucaccccugaaucauucccugacagaugcaucauaugaguuccuaggucucucucagaguuagaccucagauccuccucugaagaugucuccggaucaugcaagagaugguuuuuuggggcagucuccuggcugcaucccugauaauuccccacauucuccauggaaagcauauuugagcuccucucguggaagcuucuagggaagcuugaugcggacuucuuuagaacauugcaccucugacccucaaccaaagagauauuuaauggaccaugaaugcucucugacacagauagcucugaaauuuuguucugaggacguagcaaugacagagacucauggauucugcggggcaggccccaucugcgcuggaugagccucuuucgaauguguugcucuaguuucuuccuuaccucagagcugaguggaaaaucuccaggaaugauggagaugggaacauggaccuugaaggacuuucugaccaauacaggauugggagcuggaggacaaaagucuuccugggauuuuugaaccacagaggguaaaccccacacacuuuccugcacuuucugcaacacguuccacuccagaugauuaauuucagauggcauaagagaccgugccucauucuggggucuaugaaaacacacgccacacacccuaaucaggaauagaggacuaggugguagggcugggaauggagauugagguugagccagggacuucaccugagugagauguagggacugaccucggggcaggguuugaggcaaggguagagguuggguacuaggcaagaacagagguuggggagggggaaguacuggggauucaugggacauagauguauuuguaaugccauugaagaauacaaacauggaggaacggccauguuggacaaaaacaguaggaugcagagacucgcugugcaaagaugggagaccccagaagagcuggacauauuuuugcucuaaaugguccucaaaacacuuagaauaugggggcugcugauggaugugcugccacucuaguuugccuuuacuggcccaaaaaggaaaggauucugcuaagucaugcuuaacagcaguugagguuaacauauuccgugaggaauuuaguugguaguuuggccuaaguuguguugggaaugauccugguuucuuuccauuuucuuuccacaucaggaaaucaccccuucuuuugacuugucucuccaggagugccggaaugucauggcugagaaaagagauguuaacaggcuguaugauguuggccacagagugccccccuaaagaggccucagaagaaugaaggguaagaagcuccuccaugaaaucagauggcacaaaauuagaggaaaaagaguccuuggcaugaggcugccaccaggagaauucugaagaugcagggcaugaauggucaaugccuuucguuguuggggcagagguggaugacccaccagagccaccuagagauaacauuuccggaaaagucuucaagacggugagauuugauuuagacugagucacagugcaaucuuccggugguaaagcagaugggguuggugguccaugaugacgagcacaugaaucagugcgauucacggccugggaaauaucuuggcauaggguggagccaaaugaaaagaugguguucagagacaaacuggccucagguuggaggcugggcuccacucucucaaugugauguggugggagaaggggaaagggaagcuguugggguggggaauggucuauggggaacuuggaauccaagggagaaacaggcugugguggcagagggucccucaguggugagggugaaaauaagucagcuaagguggugaucaggucaggugagagaauuaaggggggugguggagagggcuuaggccgagaggacaauauuaggucuucuggagugguugcugaggggguggaagccagagugaacgaugacucagccccagaagcugaagaagccaaaggggacacagagggagcagcaucuuucagggacucccaagacagcagucgcuggauaucagcaguugcucuguuacacacccgacagacagggucugggcauaacagucgacgaaagagggugguaucaugaugcuggcccaggggacugcaggaaacaggagguccaaagcugcagccaggaucagaacaaggaaaugaggaucuguuagccuggcagggguggggcccccugaauccugcuucacauuaccccccauccaugagcucaccguaugugaggucauaugaccucacuauagccucuccucaaagcauucauucacauauccguuccuauggcuacccacucccaaaacuacagcaggcuacaaggaaucccugaaaugaauagaacaugcaaaaaaaaaaaaaaaaaaaaaaaaaaaaaaaaaaaaaaaaaaaagaaggcggugggaacaggauagaaggggaaugauuaaucaccuuuucagaaaagaauguagcuuucuuuccucuucugcuuccuucugcaaacuuuuccggucuggaaaccagaacagcauguuacaugcaaugaagguagaggcacagggaucauacagaaguaacucuguggaagacccuugggauauuaaacucugauagccccaagaaucaguagaaaagggcaaauauucauugauaauguucacaaguucacauguguauguggaaucauuaguagaauucuuucauauacauuaucccaugugaugcucaaaaccaccacgugaaacauagacaucagugguuaccuccaggaggaauccgagcaucaaggaagucaaaguacuuaugcaaaguuguaagacagaaacucugacuccaagccaaccaguaguccuuccucgauaucucagguggccaccaauugggcaacacccauuacucagguccaucacuuugucaugcccaugaaugggcagagcagggccuaugagcagugucucaggucugauugauuucccacgagccugucuucugagggcucuguuuucugagacuaucuaguaacugacauucuaagaaaucaugggacugaguccucaugaaagagacagaaagggucacccugaagcucagauagaauaggcugacauuaccuuuaaaugucacgcuuuuucuuuuccuccuggcucugcccugaugcugagaaugaaacaaagauaaugacaggcugguacucacuucucucacacucuuugaagcucauucauucauucauucauucauucauuauacaagaaugauaugacucucuaauuaauagaaauauauucuuguuaucaauuuuuaaaggucauaaaauauuucuuguuuucccuucucugaaaagcugaaagaggauuucuucugugagagccacacuugaugugcucaguuagaaguccucauccagggcacagacucagaggucgacagucacaucugugcucccucacagggcaagcaucccagagacagagcucuggcuccagccucugcucagagacucucagcguuacuccccuggucagcccaacaagaaggaaggcuuuguugaaugacgggugacaugggaaucugacucaugaucaaauuucagcagagacuauucuccuucagagagcccagacucucuaaauaaucccaccugggaccacagaauuacuguuugggauuuuauccuggaacucuccaccacagccggauagguagucuaugagcuacagauggaaaccuuuguccuccugaaccccuacaucugcccaaccuguuccacagaagagugaaguucuauccucucuucagacuucccaucuaagacaugucucuguacuaaccaaacuuauuuagaaaugugggaauaggauucggaaacaaaaacagggcaucucucuuggguguucacccacaguuccuuaccuuuugggugucauuauuuuuuucggugggugaugaauacagggucaauaccauguagaacaaguacaguauaaacaaccccaacccacucaagcagaugaaguugaggucaauauccaaacaaugugagucagggcucagcccugucucaguauagcuguucagaaaacagaggauauucuccauggucugaauagcucagcugccugaagcaacugagcacugagggugccca

SEQ ID NO: 17317 - RNA, 7261 nt, Homo sapiens
aguuacauuuaauucuguauucacuuggaaauggguagagaagaaggauauggugugaggagggaaacuaccuccuuucuuccccuccaaaauuacuuauuugacauaauacaguuauugaauaauucauacuuucccccauugguuugaaaugcaaacuucauuauguauuacuuuguuacauauaaucacuuaagaauuucucaggucucuucaguuuuuucguugaucuauuuguucagacuccagaacaaaauuuaguaacuauucugugguauugguuuuaaucaguaauccucauuuguguccuccaccuguaaauauaauaaauuucccuuuuuccuuuuauaucaauaaguuauugcuacaaugauuaccauccacagcuucguaucugcagaguaaugaucuaagauauuuauuucuggccagauaauucuuugcaaucuauuauguuuggcugcaaaugaagauacugaauuauacaaggcagaaccuuaaguucgucuggugcucuguaccaacauggaaauagugaauauguaaauguauuaaaaugagaucacucuaggaaccugucugcauucagaaagaauuuugacuaagcuuauauuuaauuaaucaugugcauauauacuuuucaauaucaagucuuauuacuugauucaaaacaagugaccaauucuaguaugaaguuuuugugacuacuuaauaagaaguaauuuuauggcuuuugucauaaagcgaggcuuguuucauuuauauuggguuuuguuucuuccccuccucuagguagccuuuccaguaaauauaugacucagggaaaagccucagcgaagaggacccagcaggaaucaugagggaaggaaaaugcagcacucuaaauggccacucaggcguuccuauucacucggaaaauuagguucauuucacaggacacagcaguguagaucaggcuucaacuuaacauuuaagggaaaugucagauuuuuuuuuaauuuaaugaaauuguuaaugaggaaaaauuuuuaauauagucuuaucuaccacacauccccauagauuuaaggauuuuaauagaaagacaugauguauguauuuaagccacguuaaaagaaaaaauauaacuauggaccgguauucagugaauacaguuucaugguuuuuaauucuuucaaagcacauuaaaaauggugugcugauaaaccccaaguaaauuaacccuuuuuccguauaaauccauuuuuuguuuugaagaggggaaauuauauuuauuguuguuuacugaauccuggugugaaagcauaucagauauguaugaacugcuacugcuguacuuccgauuuacggacaucauuuuauugcuauuuguagacgugauaacaugaacaugaguaccuauuuaugugggccuucaguggaugggcagugccacucaggucucugggguuucccucucuaauuuuaaguaaauugacauauaacuacuaugcuuauaaaaaugaaguaaggaaaacaaguaguccuguuugccacuaaaaacauuuucaaaggaaaaauaaaaugaaaguacuuuuuacuuuuuaugauacucagaaauuaggaugaagaacuuuuaaaauugcugaagaucaaagagguuaucucugccagucacaaguguggcuggugucauucugggucugacuggagcccuccuggacuguuucuuuaauuucaaaagcccugcagacauaguaccuggucagaacuaugccucgguuuauuuaucauuuugaaauaaaaucagaauuucaaccuguaauuuuaucuacauuauuuucuagugaaagauuccuaaauuuccuggggaaaaaaaaaaaagaucaaggagugagaacauugggaaugauaguaagaggcguuuaacaaaaaagaagaaaggacaaauauacuccccuaaaauaguguacacagacuucccuuugacuugugcccuugcaaucauugguguguguuaacauccaguguguuccaggcucugggaacguauaaauuuguuauuauaaaaggcacagaugggggugggggggcggggaauuuguaggcagggaggcucagggggugcuugcuggacgaacauucuggauguuugaggacucagaagacgcacaucccugugcccuucuuuuuuaaacaauuauuugaagacagucuagcuaaagacgaaucauaucaaaauuaaagacuucagaauuuggaggccaugguagaaagaauuagugaucauucccuacucauuuugaacgcaaacuaaugaaugacgcaaccugggcugaugcugcucuacgugaccguccucagcugcccccuucugguuucuucucucuaacucaugcaugaaagucgacuaggcuuacaaugcuugucacacuuuucuuugaaaagcccauugaugcuguucuguuguuuucuagcauuauagcagaagacaagucuaagaccaggcugauuuuuguucucuuguagguuuuguuuuucugccugggugcuucuguuuuuuaauuuuaucccuguaauucagaaagaaaauuaccucaauauagaaauacaucuauccagugacuuuucaugcuaggaaaacuucaaguuuaaucucuacaugacuggcuuaauuuuuacugucauucuggugcuuccuguuucuaauauggauuuucucauugcacuucuaauuuucuggaauuugccucacugaccuuccuuuaccucucauuucuuuaguuuacuuauauucucuuccuuuucauaggagccauauuuucuuguaucccuuuaaggauguuaaaaguuuccuacauuuuaaucugauccuuaagguagcuucugcccaaaguacugggucuuuuguuugauuuucaauaccucacacuggauccaugggacaaugagcaguauuugccagcaggccuggauaauggauugcccuugauucuuuaccuggauguggucgcagccccaucuugcugccccagcugggaugccaaaacgucugcucuuugcuaaguccauuggccuagcuaucuuucaagugcagccggcuuaucuaucuuaagcuguacaaaugccccauuaccaagguucuccuugccaccuucucucaggaacaaaaauaugaaaucucuuuuguauagcagugguccaguggccccaaucuaugauguuuaaaacucuugcuuggcugggugcaguggcucaccccuguaaucccagcacuuugggaggccgaggcgggcagaucgcuugaggucaggaguucgagaccagccuggccaacauggcaaaaccccgucucuacuaaaaauacaaaaauuagcugggcuugguaaugggcaucuguaaucccagcuacucagaaggcugaggcaggagaaucacuugaacccaggagacggagguugcaaugagccaagauugcaccacugcacuccagccucggcgacagagcaagacuccaucucaaacaacaacaacaacaacaaaacucuugcucaaugugugcaggaucagcagugugcaaaaauguuuuuaaauguucuuagauaacuucaguguauuuuucuucuugaaauauguuugacaaauggcuucuacuuuuaaaucuuuccugaguggaaaagauccuggauaaauacaucaauagaguucaguguuacaagcaaaaauauacacacacacguugaaaacagaauuuaucaaaccccuguaaaacuguaaagcccucaguaguuuuuucuuuggaagcaggcauauuuggacagcagcagucaagaacuacauagacuuuccacugaauggaacucuagacuuagacaaggucuggcccaccucguuuuccagcuguguggcaguccccuaaucucaggcaguucaguuuccauuccuauaaaauggaaaccauucuuggcuuuccacacaguugugauaaucaagugaggucuuaccaggaaaacacuucuuuaaaugucuagaacuaugaaacuaaugccugaagugcggggugaaacaguucccuauugcaaguucugucacauauuaguggaaaucuaaaagugguuacagcuuguaacucuuuugacacuucccauacccaccucauuuugacaccacuggacagcugcugcucugagauaagcucacauacugcuuaaauaaucgugaaaauuauuuauucuaacauaacauuauuucagggacuugugccaguuucaagugauauuagaaacuaacaaguagauuaugugacuuaaugcuuaugugcaaaacaacuaaccaaguuaaaaacugaauagugggguuuucuuuuuuguuuguuuuuguuaaauaguggguauuaaauagaggaaagaagucuguuaaacauacacaggauccugaaucagaaaauugaggacuagauguuuucaauagugucuaaugcucucuacuaaaauccuugaguuucagcaucuguaaaacugccaugccagugcuucugcccuacucaguucaaaguugugaggcuaguaugagauaauauaauaugcucauggaguuuucugaaucuuguaaagugcugcacaacuguguaaugugucaauaacugaaaaaaaaaugacagcaucuuuuauuuuuauuaaauuuuaauuuuagggcuguuuuagguucacagcaaaguuaagcagaaaaacagaacugcauauaucccuuguuuccacaugugccucacugucacucugcaccacagugguacacuuguuacaaucuuaaaccuacauggacacaucauuagcucucagugcccauaguuuaccuuaggguucacucuuggugguguacauuguguggguuuugacaaacgcauaaugauaucuauccaccauuauaguaguuucacaauacauggcaucuuuaaauacucauuaacaauuaccauuugagugaggcugugugccuugcaccccucuaagggcuucuccuguauuaacucauuuaaucuucacaauaucuguaggagggaggauaugagaucccaaacccccagguagucaaagaugaaggccaagaaacaaacccaccacaccaccaccucucuaugucccucccucccucccuuccucccucccaucacuuuuucaguuucuuucuuucgagaugcagucucgcucugucacccaggcuggggugcaguggcgcaaucuuggcucacugcaaccuccgccuccuggguagcugggauuacaggugcccgcaaacacgcccggcuaauuuuuguauuuuuaguagagacgggguuucaccauguuggccaggcuggucuagaacuccuuaucucaaguaaucugccggccuccggccucccaaagugcugggauuacacgugugagccacugcgcccggcccccaguuucuuuuauuuucuuucuuucucucucuuucuuucuucuuucuaucugucugucugucucucucuuccuaucuuccguucuuucuuuuuuuuuuugagacagagucucacuccguugcccaggcugggagugcaguggcacgaucucagcucacugcaaccuccgccucccagguucaagcgauucuccugccucagccuccugaguagcuaggauaacaggugugcaccaccacacccggcuaauuuuuguauuuuuagcagagauggggucucaccauguuggccaaccuggucucgaacuccugaccucaggugaucuccccgccucggccucccaaagugcugggauuacaggcgugagccacgcgcccggcccccaguuuaugugcagauaaggcuuaggggaaaaaaaaaagcguccucuuauugucaaugcgauugcauuucuguagcaggaagucagaacuacuugauggaauuuugaacuauccuuucagaaacugcaggagaucgaagauaaacuuggcuuuaaaaaauguuucacugauuaguucuucccacauucaaacacugcgaaucuguccuccccaggacugcuucauagaccccuccugcccuuuuuccuucacuucuagcacuucaaugacaaaugccaccugucuugauguccuccucucuucaucugcuagcccuguccugccaguaucucauucuucccuggccccucuuuaccuggcuuccuguguaugccuggguaccgcgccugugcagugucuggugcucaggaauacugcaucaaaaggcagaauuaagccccugagcagccaggacaaggucugacaacacguuuuaaaucgaguaauuguugcucgcuauaaaugugacuauucacacugcugcccagucacauuuucaaguaggguugguucccaguucagcaccagaaugaaaacugcauuagucaccacccuucagcauccccagcaguacagcacgcuggggagaaggguggaggguggcgauuauacaacucugcgguaacgccaugcucuuaagaacagccuaauuggaccacaaaagaagaaugaaaauggauguagaugucugggcaucggaacgaucacucugcauuugagagcauaagcucccagugcaggguugacuuaugcguccuuaagugucaccgccuaugaugguguuugucacggugaguauuaaagcagggggugacgcugcaccuugccccgggggcagguggugaagcuacgugcauccggagucagcaggucugaggucauuccucgcccccucccgcccgcuccccgacgucacgccgacuccguccucggcggugaagacauuccucccgggcccugcgcccugcagcgugguaaccccacugccggagaccgugcgcaacccagcugcuagacccccggcguugagcggcaaaaccccgccccgagcggcuugccccgcccccggcucgucacucaugcaacucacccaaugguggcggcggggggcggggcuaggacugagggcgccgugcgccgaagcuuguggcgucaaugcgcccgccguguccauggagagaagcugaggcggccgaccuucggcccgaggcaccggggcgccgggacggcgaagaugucggcuuccuuaguccgggcaacuguccgggcugugagcaagaggaagcugcagcccacccgggcagcccucacccuggugagugcucgcggcgcgcggcggggcccgugacauugcucguguccgccccgugcaaggggaggucacggcggccgggaguggggccgcagggacgcggac

SEQ ID NO: 17318 - RNA, 3316 nt, Homo sapiens
aagcgggcaggcucggagcgcgcggggccggggcucggcgagccggaggagcguugcuaauguuuuuguuuguuugcuuuuccaugcaugcauaaugagggggcaccgcggcaccacgcgggggcucccggcccacuuuuguauuuaaagccucgcugcuaacgagucugcagccgggcucagcggauccgcuccccgggcucuuggucacccgagaagcugccgccgagugaagccagggagccgcucuccggcagcgccgacuuucuuguucuccccgcgcuucccggaaagagcuccccggagcucugcggaggccgggguugccgcgggcggagggggaggggacgcggggcggccgggccgcgggaaggcgggcagcgcgcggacgccgggccaggaagcggcgcgaugcgagagaccgcggcggcgguggcggcggcgaggcacugagcccaggaggaaggagccgccgcggccgcagcgcgagcagccggcacggggacagccggccgcacaacggaucugcaggcgcggagcaaaaugcacccgccgcgccgcgcgguccugcagccccgccacggccccgcggcccgcacccccccggggcgacagugagccucucccgccaccaccgggggccgagcggagggcucucgggugggagagcgggaccagaucucgacagcuguucauuuccaggaagccaccgcagccagagcgaaaggggaccuucugccaccagcggggcaucagccagcggcgcgcauggauuuaugaagacacucaugcaagaagugggcaggacuuggacaaacuuuuccaccggcuccgcguccgccgcuccccgcgccucgucuccuuuccccuccucucccggcggccgccgcugcccgcgaugguggccgcgcugcugggcggcggcggcgaggcccgcggggggacagugccgggcgccuggcugugccugauggcgcugcugcagcugcugggcucggcgccgcggggaucggggcuggcgcacggccgccgccucaucugcuggcaggcgcugcugcagugccagggggagccggagugcagcuacgccuacaaccaguacgccgaggcgugcgcgccggugcuggcgcagcacggcgggggcgacgcgcccggggccgccgccgccgcuuucccggccucggccgccucuuucucgucgcgcuggcgcugcccgagucacugcaucucggcccucauucagcucaaccacacgcgccgcgggcccgcccuggaggacugugacugcgcgcaggacgagaacugcaaguccaccaagcgcgccauugagccgugccugccccggacgagcggcggcggcgcgggcggccccggcgcgggcggggucaugggcugcaccgaggcccggcggcgcugcgaccgcgacagccgcugcaaccuggcgcugagccgcuaccugaccuacugcggcaaagucuucaacgggcugcgcugcacggacgaaugccgcaccgucauugaggacaugcuggcuaugcccaaggcggcgcugcucaacgacugcgugugcgacggccucgagcggcccaucugcgagucggucaaggagaacauggcccgccugugcuucggcgccgagcugggcaacggccccggcagcagcggcucggacgggggccuggacgacuacuacgaugaggacuacgaugacgagcagcgcaccgggggcgcggguggugagcagccgcuggacgacgacgacggcgucccgcacccaccgcgcccgggcagcggcgcugcugcaucgggcggccgcggggaccugcccuaugggccugggcgcaggagcagcggcggcggcggccgcuuggcgccccggggcgccuggaccccacucgccuccaucuugcugcugcugcuugggccgcucuuuuagcccucgcgccccccgccguuggcugcgggagagcccgcgucccacucccgugcucgccucgaccccgcgccgggcaccuguggcuugggacagauagaagggaugguuggggauacuucccaaaacuuuuuccaagucaacuugguguagccgguuccccggccacgacucugggcacuuccccugaagcuccucuccggagcuugacuucuuggaccuccucccccgccccaauuccaagcuccagaaacucccaacucgucugccguccagaaagcuagcugcaguguucaggacguccgggaggaagcaagcaugugggggacagaacaguaguccuggacucgaaagggaaggugcugaccaguggggccuuagcaauuugaaggguugggaaggaggaauuauauuugcaaaggggcugucuauuagcauauuuccuuugagggggcaaaaaaaagugccaguaucgacuuuuacagauuguggccagugaggauauuauaauccuauguaaacagaaaagucccacuuaccgauucauucuuucacuguuuguaucugcgcccagaauucucagugacgugggggugaggguggguggcgauugccuuagagggaaccccuaaauugguuuuggauaaguuugagcccuugaccuuaauuucauugcuaccacucugaucucuuagcacauuucuuaggauuaaggguccaaaaaugcugaucuaagggguugccaugguguugaacaaugcaacuuuuuauuuaaaaaagcucugcacugccauguaugaaagucucuuuaugauguuuguuuuuuugucauuuuuguucuuuacaucaagaaauuuuauguuuaaauaugcggagaauguauauugccucugcuccuaucaggguugcuaaacccugguacaucguauauaaaauguauuaaaacugggguuuguuaccaguugcuguacuuuguauauagaauuuuuauaaauuguaugcuucagaaauaauuuauuuuuaaaaagaaauuaaaaguuuuaaacucacauccauauuacaccuuuccccccugaaauguauagaauccauuugucaucaggaaucaaaacccacaguccauugugaagugugcuauauuuagaacagucuuaaaauguacaguguauuuuauagaauugaaguuaacauucuuauuuucaagagaauuuauggacguuguagaaauguacaaaugcauuuccaaacugccuuaaacguuguauuuuuauagacauguuuuuuaaaaauccuaaguuuuuaaauaacuauggauuuguguauuuuuuuugguuauuuguuuuauuaaaacauguacaucaguaaagaguuuuaaacaaugaa

SEQ ID NO: 17319 - RNA, 17092 nt, Homo sapiens
gggauccuucuaaaguaaauauucugguaccuggugcuggacuaggaagacuggccugggaaauagcuaugcuagguuaugcuugucaaggaaaugaauggaguuuuuuuaugcucuuuucuuccaacuuuguacucaacagguauuuaauuuauuuuuugcuggaaauaguaauuucucagaaucagauugacuuaccuauuuucuugaacaauuuugaauuugaagauaaguacauagcauuugauuauuauauauaucacaaaugugucuuauguuaaaaucaaaguacuuacacaaauuaucacuugaaccaauugccuaguuauuagaguguugaaacaagauggguaagugacuuuauagaaagugacugggcauuccaugaaaugauuucuguacaaaaucuucaggacuaaguaugaaccaggaaggaguauuucuaaauuuauuccuuaagcuucuuuacuuccuuguuucuuuaguuaaauaagaguuuaguuuagcaauuauaacuuuuucuccuuaaucaaguucuuauaaaauggccaaguaugcucucaugacugaguuggaaagaucucucagaacuucuguggccucuuuuggaaggcaguggaaaacaauuguuauuuuuaaagccagaagauguacauugaguagcugccuuguuuaaauaauauguugucucggauggcaguaugaguuuuaggggauuggugaaaaagggaaaaaagaagaggguuauacaaaaaauagcaaacuguuuuaguugaaaccaguaccauuuuaaaaaaccucguuggacuguuauuacuugguuuugaaguuuagaaauacauuuuuaaaaaucugaaugaacagcacauuuauaucucugaauuuacuuuuuuuuucugucuuuaauccauugauugguugcucaucuacauguauauguacauuuucagauaauuagggaagcuguaauagugacucuuuaaauauuaauuauauaugcaaaucuucaauuaaacaguauauuuuuaguauuuaaaguggauuuucuugguaaaauauuuaguuaacaccugauuuuauacucauauuuugcagauguucugaaauuaauaaauauaaacuuuauccuuggauccaucaguuuagcaauaaccggagaucagcugaucagauucgacccaucuuuuucccugauguugacccccacagucuuccuccugguucuaacuuuucuaugacagcaggagauuuucaagagauuuauucagaaugcaguaaguccaaaucaagcguuuaaaaagucuuguccuuuauucuaaauuuaaugagcuaguuuuauccuaagccaagguuuagaucauucauuuugaugguagaacauaaggcauaugucagugucaauuuagaauguuuucaaggucguguacaaggcagugauaggaaauaagaaguguaagauaucuacagucaagaaauuuagaaucuguugggcccauuaauacuaagagauaccauguaaacaaagguuaaaugaguaaugaauaccaaaaaaaugaaagguuauuaguguaagaaggaagcuguucauagugaggcuaugacuugaagguugagagaauagcauuugaggcagacagaaguacaaagauaugaacaaggugauuggggauggcagcacagcuguacuggcagggaaagaaaagauuuaaugggagauuuaaugagauuuaauaggagcuauugcuagaaaagugaauuuguuccagaucauggaggacuuguauagucaggcugcacaguugacuucagccuggcaaacuguugaagaaaucugagcuaggcaggagagaaagggagaugguaauagggaaaguggagagggagauuggcacuaaaaggaaagcaaaauagaauaccgaggguucagcaagaucauugagucaauagguauuuguugagcaccuacuaaguacuagguauuuuucuaggugucaaaagagaacagugaacaaaacaaaaucccuguccacagagaacuuccaauagagaaagugaggcaauaacaaauacaauauuguaaggaagaaaaaauaaggcagggaagacggguuacagagugacuggggagaggcugcugcuuuauauagaguugucagggaaagccuuucuaagaguagaaacuaaaaaaaaaaaaugucuaguagagaaccuugaaagaguacacagacaaaccacugagauauuugaaggcaaaauuuugcagauggggaauggcaagggaagaggaucagggaguagagugagugcuugcucugcucaaggaggagcuaggcuguaguaagcaauggguacaguggugagaggucagccucgagaggguuugaugaggcaaacuuguuggcaggccauagcaaggacuuggaauuguacucagagaaacaggaagccauuggagggcuuaaagcagggauagcaacaacauagauuguuuuuauuuauuuauuuauuuuacaacauagaaaguuuuuguuuauuuuucucugaacucugagacugggacaaccuguacucugaaggaagaaagggagagauggaagauguuagguguuguggauaaggaaugaaauaauggaaaacaucacuuaggcaaguaaaaguccccuuuuucuggagcaagguuugagagaacagaugaugaagguaguccuccaugggaucaagugccuuuauugcaccagcauuuguauagacaccauaccuccuagaggcaaacgguguucucuacuggguucccacccacugcuucugccugccccuggcuccccuuuuucccugguaauuauucgaaguugugguagauguugaaguauuuggaugucauucauuucucaguuggcaacuggugccugcagucuuucugaaaccugccagaauuggugguuaacacuaguuuaaauuugaaugacuauuauuuuguuuuaagugauuuuaaaugaaggcuagaaguugaauagaggauaaacaaaacucuaacaaauaccauuugguaauaauauguagagauuagauuauaauauuaguguuauuggggaugauuuccaaauugauuacuuaaucagauuauugauaucaguauuucccauaaaugacuguuugguuacuguaauuauaauguugaucagaaguuuagcuucuguaucucugucaaauauuaauacucuguaaaagguaacuggcagauuuaaauaauuaauuaaaagaaaaaagcaaaauaacauaacagaugcaguaauuugauuuuucuucauuagauaccugggacuguauugcuaccuguuucuucauagacacagcucacaauguaauugauuauauugauacaauauggaaaauacucaagccagguggaauuuggauaaaucuagguaaguuuuuuaguauuuacuaaaauuuuguauauuaaucugaguacuuacagcuguauuacauuuaacuucacagucucaaaugugcaugaacauuagaauuauguuguaaauguuuuaaaaccacuacaguuuccuuuagacugcauccugguggugaucccuccaaaggcaguggaagcucagaaguuguauauucacacuuaggucagucucacagucauuguaauuucaguguauacuaauuguugaucugaugguagguaaucauucccucauuaucaccaucccacaugcugagacagugguccguucuguuaggaagagaguguucucuuuuucuuucuauaaugaagcaugcggggagauuuuaccucuuccauggaaucuuccucccuaguacauccauauacugggaaggguguaggugugauaacuucugugauuaccuugaguuuaagaaagaauagaaacacaauuuuuuuuaugcaaaauuuuuuuuuacugcauucuacuuacuacucgauguuagaaauuaaauguugacuauaacauggucccuccaguccagaaucuaaaggaaauugccauuuuacuccuuuuuaaaauaaaggggguauaaugauaauauucagguagauauacauguauucuuucgugagauauauaaucuguguucagaaagacaucaugacuagaacauaaagguuuucaagauaaggauuauuauacuacauaaaaggacauaacguacauggucuugagcccuuggccuuccgggugggucuaguuuugugacugauuucugacaccuacucucuuuuuaauuuuaauuuaccagaaauuuugccauuugggacuaagcccuggagguaguaguaagucuuuugcaaacuucucuuaagaauuccuuaggaccagaugaaagcagcuguacaaugcaaucauaauaaaauaaauaucccaaacuguaagucuucuuuaaaaguaguuaccuugggaaauuuuucccaaggaaaaauggaaagauauuaccuacuggguauuugcuuacuguggguuagguacuguguuggucccuuauaaauaccuuguggaaucucaaagcagcccuauauugaaauggcacuauguuauaguugaagagacuuagagucuuggguuaaauaacuagcagaacaguccuguagcuuacauguggcaaagacaggcuugaagcccagagccaauuucuugauuacccucaguuaauuuguaaguuagcauuaacaugacccuguguuuauauaauuaaauuuuuugacccccauuacugaguuaugguaagguuuuauguauuuccagagcaugugacuuucauagaaacagcuuuuuuuuuaacauuuguuuuauugguuuaugaauauuuuauuaaguuauauaauacaauaauuguaacuaccugaagcacauaaaguuggcuccugauaaguauacuguuugauaagaguagauguacuauagugugacuuaugaucugucaugggcaucagaaguaauggagcauguugguuaacaggaagucaauuaggagagcuaauuccauuauggagucucaaaacaauuuugaaaauuguaauaauggagaaacacaguccuuaaaaauaguuauuuggaagguuaguacuuuauaaaguauuaacuuacacaucuuuugcauguauaaguuaaagaauguaaaaaaaaaagucucagaaucagcuuucuuuuaaauguuacuguguucugggcaucuaaucuguguuuuucauuuuuuaugccauguacucauuuuugacuccauauuccuccuaccuaaucucauggcuuuuccuacucuuuggauucccaaucuguaucucugguccaaacaucucucuugugcuccaagccaguauguccaacuuggguguaccacagauacuucaaaauccuugugucucaagaccagccugggcaacaugcccugagaccccaucucaaaaaaaagccaaaacaaaacagaaaaugauuccaugccucccaauaucuuuucuauuaaucaucuacucagguuacccugaagaaaaauacugggagccuuucguuaccccuuuuauuaggucacucaggcuaccauaacaauaccacagauuggguggcuuaaauaacaaguuuauuuucucacaguucugaugacuggaauuccaggugcucaccagguuggugucuagugagggcucuuccuuugauuugcagggguuacccucuugcuguguauucacauagccuuucuuugguugugcauagagggagaaggagugaaugagagcaugagugagcucuuuggugugucucuucuuauaaggacacuaauccuauuggaugaggaccccacccuuacgaccucauuuaccuuaauuacuuccuuagaaguccuacuuucaaauacagccacacuggggauuagggcuucaacaugugaauuuggaggcagggggacacaaacagucaauaggaccucucuuuuuccucgcuguuugucucuagucagucuaaaaguuguaucuccuaaagcuacuuaaucgcucuugaauauccuucuauuccaggguuucucgauugugguuuugacauuugggcuggaucauucuucagugggaguggugagggaagugggggucugaccuguauaguguaggaugguuaacagccuuccuggccucuaagacuccaguaguaccucccaguuuugacaaccaaaaugucuuuagauauugaaaaauguugcccuccggggguggaggguguuggcagagucauccccaguugagaaccauugcuccaauuucaugguuucuugccuggauuagcauuaggauuacuguaguaauuuccuuaaggacgccccugccuucaaguugucuucggcccuuuucauuucuccacauaaucaucagugaccuuccuaacaugcaaaucuguuccuguaagacucccugcaugaaauucuagcuuucuggaaaaccuaaacucuucaggauuauguuuuuuaccuucaggauuauuuuuuaccaccccuucucugaccucaagugccaguccuuugacuuagcccuuucuuucucuucuguuuucccuugguuaguccuuauguguucuuaaacacuuagcucaggugauccuuucggguuggguuaaguauucuguauuucuuauguucuaagagacucugcuguaacauauacuucaguuugguauuagcacccauaugcuuuuguuuccacugcuagucucuaagcuccauaagggcaaagaucuaaugcuuccuagucaccugguacaaagccuggcaaacaauggguauuaaugacuguuacauguauguaugaauguauuguuucaaaauuugaaaaagggaacauacuaagaugucucgaagagaugaugaagugccaucuauauugguaaauucauaacauucuuaugguuuuggcuuuaauuauauagaccuggaggcuuaauuuacccuguaaacugagagaucaaccucuuggggaugauuuuacccuaacccugcuuagguagacuagaacaucaauauauucauauauaaugggaaauguaauggccagccauucuggaacaaaugacauuggagguaaaauuauauaugaaaauguugcccaaacugcaugaaaucagauuugguggggaucauuaauuuacaaaugcuuuaauuaaggaggauuugauggacucuuuaacacuacccaguuuaaggaaagcuaguaagccuuuuaagggaacuauuaugcauauguccuuuggguaaggcuaugauuuuggcaaagaacaaaagaaugccugugaauucccuuuuucaguuuuucauccugaccagcacuccuuaaacacauuuauuuauaauuucuucuaaaaagaaaguguguguguauguauccacugauaaauuugggagucagguaguggagggcaggcauuuagcuacaucuggaagaauuaauaaaaugaaucuaacuacaucugaagaauuaaaauguaacuacaucugguaaaaguaccaaaggagaucuuuguaaaguguacugaaagauaggucuuaucagauuuuagagcauuaugaagcuacagaauuuuuuuuucuuuuuuuuuuuuagauggagucucacucugucacccaggcuggagugcagugguaccaucucggcucacugcaaccucugucuccuggguucaagcgauucuuaugccucagccucucaaguagcugggguuacaggcgugcgccaccacaccuggcuguuuuuuguauuuuaaguggagaugggguuucaccauguuggccaggcuggucuugaacugccgaccucaggugauccaccugccucagccucccaaagugcugggauuacaagcgugagccacugugccuggccuagaauuuuuuaaaacgagauucccuuuaaaagauagaugacugaacacauacagcccuuuccucauuauaguaguaguaaaaauauaaaaagauauaaaacacauggacaaagaauggcaggcauguuacugggggacaaaauaaugugccaguuuuuagaaguugggguagauagguaaguuuugcgaagaaaaacacaugugagagccaccuuacccgaauaacucuggaaaacgaggugcuguauggaaaaaccuaacuugaaaaucuguauauauugaacaguugacuccucuauaaucaagaugccuaccuuauaugcccauuuccacuccaugcucaggugagagaccauaaguuuaauucucuagaaaaaguaaauaggaaaggagcaggauuuaggaaagcguguccucauauagaaugggggcgaaauguagggcagaaaagaaggggauuaauuaaaaacuuuggaaaaugcucaagcagugaacgucagcccaagccaucuccaaccccuacccugccuauaaaacguaccaagguuuggccgggcaugguggcucacaccuguaaucccagcacuuugggaggugaggcaggcggaucacgaggucaagaaauugagaccauccuggccaacauggugaaaccccgucucuacuaaaaauacaaaaauuagcugagugugguggcgcacaccuguagucacagcuacucgggaggcugaggcaggagaauugcuugaacuugggaggcagagguugcagugaucugagauugugccacuucacuccagccuggcgacagagcgagacucccucuggaaaaaaaaaaagaaaaaaaaacuuaccaagguuugaauuccagauguuuugcacagaugcaagucacauuucuuggagugggcaugucaauaucacuauaugagcuuauuuuaaaauuaauaacuguuucuuguaucuuuuucugucucuuaaaucuuuaugccuaacuuuuuagauuuuucagccuuuuuguggcaaucuuuauguuuuaggugugucucuuacaaacagccuacaguacauuuuuacuauccagucaaacaaucuuucucucuuaaccagaacuuuuagagccuuacagguguaaaugguuuaaauccgccugucacagauuuggcaagugguuuggcaacccccuuuaagcuaguuccuguucuuucgacauaucccugucacuguuugguaccuccuuugugaaacaaccagauauuccaagcccaucuuguacuuugucugaccagccauuauuuccaaggauuccuaguuccuuuuaauggggaaugguuuguagaaauggaaaaucuaguuccuaccaccgaagugguauuuugucuaggccuuuuuggcaaacaggguaggaaauauauguauauguccgucuguaaaaaucauguauaugcguguauguaaaaaucaucaaaggagggccuuaagaaaaacuaaacacacacacauacauacacacaaacauacagacaaaaucguaaguucauacugauaacuuuaguuccaaugcaacacucaguauaaaauacuaagguggcagguagcuuucaacacuuagaauauaucacacccaguggccucuaguuuccgucuuugcuguugagaauucagcuuuuuaaaauguugcuccucugaagguauucuguuuuuuuaagauuuuuaccuuguaguuuuaucaggucuaauauuacaucuagguguggaguucucuuuuuaauacugugcacaguuuguuaggcuucuuaagucuaugaauugaccuuaucaguugugaaaaauucucagcuuugcggggggauccccucucaccaaucauagguuuagcauuaaaauauguaacaauagccauuauuucuucacauacuuccucugccucauucuuuuucucuguuucuucuggaaaugcaaucaaauauauuuuagaacuucucaugguagcuuucauauaucucaaccacuucucuugcuaucuuucucgccaugcugcacucuggauaguuucuucugaccgauagucuuuuauuugaaaauacugagcauauuauuucugauaauucugacaucucaagucuuugcaggucauuuucugcuuucucuugcuuuucuugguucuuguucaugauuccuuguuucucugugcuguugacuuugaguguuuauuggggauuguucaugagaaaucgcacuuuggauuucuuaaggccuggguugaaguguuuuuccccaaaggaauuugcauuugccacuuuuaaagcaucagaucuugcaagaacucaguauccugagaacagcauggggggagccaccccuaugauccagucaccucccaccaggucccucccuccaugugggauuauaauuugagaugagauuuggguggaggcacaaaggcaaaccauaucagcaguaaacuauauuuuuagauuaaaaaaauucuuuaaagggggaacaaagagaaaacuacccagcaaugaaauaggcuguacaacauaaauaugcaaguuauuuuaauaauaaaaaaacuggaugacguagcucaugccuguaauccugacaacuccugaggucaagccaggcagaucacuugaggccaggauuucuagaccagccugggcaacacagcaagacccuucaucucuaaaaaaaaaguuuaaaaauuagccagguguaguggccugugccuguagucccagcuacuugggaccugaggugggaggaucacuggagcccagaaauucaaggcugcagugaacuaugccuaugccauuguacuucaaccugggugacagagcaaaacuccaacacucaguaaaaaaaugaaaaaaagaauaaauguaaacaaccuauauacagaaaaaaauguucauucucacuguuaaguaaauaaacauaaaugugcuaccauuuuucaccuaucauauucacuaaguuuuuaaauuugcuuacuuaaagcuuagguaaguacagugagaugggauaugcucuuguucuguuaguggggauguaaaaugauaugacuuucuucuagaaaaacaguaacauguuauaaaauagugugugggaaaaccuuaaauauucauacauuuagucagggguuggcaaacuacagcccaauuuggccuguagccuauuuuuguauggcccuaccacuacaaguauuucuuacauucuuaaaggguaauggggaaaaacacaaauaagaauauaugcuagacacuguaagugggacacaaagccucaacuauuugccaucuguccuguuacauaauuaauccacuauuaccuauguuuauuagauuaauuauacuucuagaagucugucagaggcaaauaaucagauaugggcggacuaaagacugaugaaauggacagacauacucagcaagaacuuagagugaacuuauauuucuaacaguaauggaguggacagucauaagacauucauacaguaaaacuauuuucuagaaauaaugaaauagagaaauguuccuaaugaaguauaagauguaaaacuguauauggaauauacuguacaucaaggaaagacugcaaggagauaaauauucaagugcuuacucugaauguuagacuuauaggugauuuuuuaauuuuuuaaugcuuuuucauguuaucucagcuuccuaguuuugaucuuauaaucaaagaaaaaaacauaucuuugcuccuucuguuauggccacuaaaagaauaugaagaaagcugcgugugguguugcaugccuguagucccagcuauuugggagacugaggcaagaggauugcuugagcccaggaauucuaauccagcuuggguaauauaacaagacacugucucuaaaaaaaaaguuaaauaauuaaaaauuaaaaaagaaaaaaagaacgaagagacaugagaguugagaaaauaaagaacccuuugaggaaugugucucuguuauucaucuucauauauauccagugccagacauuagcuaggugcuugguaaacauuuguuuaaagaaugggcaacuaggucgugaauaugaaaaacugcucagccucaaagagaugcaaauucaaauuauauauaauuuuccccauaucaaauuagcaaauauuuuguuuaauaaaaauucuuguuguguuuuuuuuuuaaguuggauuuuuuuggagauauaauugacauauaauaaaauucacccuuuuuacaaauguacaguuugaugcauuuugaaaacuggauaauuguguaaccauggccacuaucaagacagggaaucuucccauuuccaucaccccaaaauguccccuuguacuccauucucuccucuuacuccuaauaccaugcugucacuacuuuggauucuguuacuauaguuuucccuuuucuagaaugucauauaaauagaaucauacaguaugcugcuuuuugucucuggcuuucuuagcauaacacuuuugagauucaucauuuuguugcauguacuguugugguggucuuuuuuuauuguugacuaguuuuccauuugauauauuacauuuuguuuauccauucacugguugguggacguuuggguuauucccaaauuauuaugauuaagaauaaaguugcauuaaauaugaguauaaaucuuuguguggcugcaaauuuccauuuauccugcguaaauacguaccuaacagaauugcugggucacauauggugaguguaucuauaacuuagaaacuggcaagguguuuuccaaagugacuguacuauugcauucccacaauuuaauauaagaugcugaaauaaguacuuauugcaauugugagugaaaacuuauaacucuuugggaaagcauuuuuggcauucugaaucaggucaguaaaaauguuuauucucuggccuucaagaaacaucuuuguaagggauaaucuaaaauaugcacaaggauauuugucaaaguaccauuguauuagaagacuaaaaauauacacuccagcuguugucuuugguaaaauuuauaaauucagcacuaaguuaggcauugugguggguucaaaagcaacuuaagauguguuccuugacuuacauaacuuguaaucuagugagaaaacugugcuaauugccugaaaaauuuucacugagcaaugcaacacagcauuaaaugaguguuaaaauaugccacauuaagaagaaugagcaguagggaugaagacuuggauggauuucagcaagguuuugaagcacggcuaaagcuugaguuggaggguuggagcuuucuagguggaacacaccaugacuagagguaaaaauggucuaaguauguaaaaaucauuggaauauauguauguauguagagauaauaaaacuauguuauuggaggcucuuaauggaacaggaacagcauaaucuuuaaaagcuggaaagacucugcugugaggcucugcauucuuauaaaagcuuuggguagucuaggaaacagcagugcucaggaaaugguagaaaacaaucauuuuuacugguacuaauauaacaaauuucagcuugauagaguaguuugauaaggaaccauuguuaucuuuuguaaguagcacuaacauauacauuauauucauggucauuuuuucuagucguuuauguaggauacagaaaggagagagaaagaaaaacuuuuuuacccugugauccacagaauguuaagccucuugguagcagaaccuuugucuuguuauuaaauacuucugucuuccaugauuagcacauuguauggggaguaggaguagagagcugguugcaggauuuauaauuaacccaaugaaagguaaagagaagauugucuagauuagccugagguauauauaacuguguuaagugauaaugguuccuggaugagguugauggauugggcaaaaugauagauugaaagauuugaaaaucaugcuuuaaaucauaugugcauuucuugaauguauagaaugagcaaauaguaaagggaggaugucauauaaacaguguaauaccugccauuuacuuagugccuuguuuaugacagguguaauacauauuaucucacauuaaagucauacuacagggcacacacgguggcucacgccuguaaucgcaacacuuugggaggccaaggcugguggaucacuugaggucaggaguucaagaccagccuggccaacauggugaaacgcugucucuacuaaaaauauaaaaauuagccuggcguggcgacagguuccuguaaucucagcuauucaggaggcugaggcaggaaaaucacuugaaccugggagguggagguugcaguaagcccagaucaugccacugcaccccacccuuccugggcaacagagugagauugucucaaaaaaaaaaaaagucauauuguagaugaaguggaguuauugaauugcccacagacacacaauuauuagauguuagagcugggauaugaacagugcacuuaaaaaaauaaaagccagcucuaauguuacuucuuccuuucaggaaaccuuccauauaacuccuguccaccuuuuacuaccuagguuaacuugaggcuccuccuuuguuuucauaugauauacaguugguaacugcaguuuugcauuugcuuauggaauuauaauugcagaauacauuuggaauuugaggacuuagcauucucugauucaucuacuccuucaguaacuugcaaguuaaaggugaaggcccauggugugaaucacagugcaaggcagguaugccagagggacucacuccucaugaguguaggcccaacucuugagauacuaggccaaauuuucagaggucugggcauuuucagcaaaugcccagacuuuuuauguuugucucauccaguaccuaacuuacucaacuuggaauucaguguaacacagcuaugaguguauguuuauauucaaguaauucauaguaucuuuaaaccauagguccucugcuguaccacuuugaaaaucuggcaaaugaacuuuccauagaauugagcuaugaggauauaaaaaacguuguucugcaguauggauucaagguagagguaagaauggaauaaaauauugccaaaguuuaacucccaaagcaccucaacagaaguguugauaucauggcuguuagugacuauuugaauucucuguuuucuuaucuauaaagggaagauaauacagguugaguauccccuauucaaaaugcuugggaccagaaauguuugggauuuuggauuuuuuuccaauuuugcaauauaugcauauacgugacauaucuugggaggggacugaagucuaaaugugaaauucauuuauguuuuauauaugccuuauaagcauagcccgaagguaauuugauacaauauuuuaaaauuuugaccaccugccacaugaagucagauguggaauuugucacuuguggcauuauguaggcgcucaaaacauuuuggauuuugaagcguuucagauuuucagauuagggaugcuugaccuguguuccuuaguuuucagaauuauaaggauuugggauaauguguacauaaagggaaaacuacuuucuggugaaauagccuuucaauaaaugguagccgaucauuauaauacugaucuuacagacucucacugauagaaaguagaguaggcucuggggaaaacaaaagggggucggagggcagguguaagagggauauucacaauauguccuuguguacugcuucaucuuuuuuuaaucaugugcauuacuauaaaguuuugugauauuuuggcuauuguguuucaguucauuuauuuagaagcauuccauuuuagaaacaauagguuuguuuuuaagaaugacgagaagcaacauauuauaguaguucagagcucaagacugccugaguuugaaucucaguuccaccacuuacuagugugacuguucuuuguaaagugagacuacuaauauuaauaguaccucucuuauggggguaguuguauguaauaaaugaauaugcuuaaaauagugccugccacugauacauaugugcucagaauuuguuagugguguggucaugaugacugucauaguauuaugauuauuguuugcauugcagguggaaaaagaaucuguauugucaacauauacugugaaugaucucucuaugaugaaauacuacuaugaaugugucuuguuugugguccguaagccacaauaauggucucaagugauaccaccuggaaaaaaguuuaguaagaacaaaugcugaaaucaacgacucaaaaucaacuaucagugaugacaggacacaaccucaaaucaguggugccuucuuauuccuaacgaaauuuagaaauagugucuauuuucuuaauaugucuauugcuuuuucagaaauauacuaugccaugcagauuuguacuacacaaguaaaaauggaggaaaugucuugaaguauacuuuuuccuugaagcccagaauuguguuucaguaggaaaaaaaccuaaucuccagugucuucaugaugcuguccauugcaagucugccgaauuaaugacuaauaguauugaaguacauaauaaucuuccuuuuuuuguuguuuuguaugcauugcacauguaacuuuuagaagagucuaaggauccucagucauauucaacaucuggaguugggacuuuguucacuuucaaucuaagaaaacuaugcguaaaauaugucuuuuuuuuuuuuuuucuucagagacaggaucccgcucugucucccaggccggagugcaguggcacgaucauagcucacuguaaccucaaacuccuggacucaagcgaucuuccugccuuagccuuagccuccugaguagcuaggacuguaggcauguaccaccgcgccuggccugugucuauuuuaucauucagauuaauuuaauuuuguauuuucuggcucagaugaacuuaaagaagcaucaaacauuucuuuuuuaugaaauguuaaauuuaauagcaucacaggccgguaaaauauauucaaguaacagaaauaucaaagucuuuuggccacaauaaacugaacacuuuaugaaagcauacucaucauggaucacuuugaaauauacgagaucucaacauucaaagugagaaauaaaaagccuuuauuaaaaguagugcuaggaaacagagaaaauaagaauaaaauuuacccauuugaaaua

SEQ ID NO: 17320 - RNA, 1037 nt, Homo sapiens
gugcuuuggcucuucggguaaagauggcggagcgcgguacggcuuuucgcugacuacauucagcccgucugauaaacuuguccggauugaauaugcuuuggcugcuguagcuggaggagcccugucagugggaauuaaagcggcaaauggugugguauuagcaaccgagaaaaaacagaaauucauucuguaugaugagcgaaguguagacaaaguggaaccaauuaccaagcacauagguuugguguacaguggcgugggcccagauaacaaagugcuugugcacacagcucgaaacuagcucaacaauacuaucuuguguaccaagugcccauucccacagcucagcuagugcggagaguagcuucuguaaugcaagaauauacucagucaggugguguuuguccauuuggaguuucuuuacuuguuugugguuggaaugagggacaaccauauuuauuucagucagauccaucuggagcuuacuuggccuggaaagccacagcagugggaaagaacuaugugaauggggaaacuucccuugagaaaagauaaaaugaagaucuggaacuugaagaugccauucauacagccauguuaacccuaaaggaaagcuuugaaggccaaaugagaggauaacauagaaguuggaaucuucaacgaagcuggauuuagggggcuuacuccaacugaaguuaagauuacuuggcugccagccgggugggcgcgguggcucaugccuguaaucucagcacuuugggaggcuaaggugggaagaucaccugaggucgggaguucaagaccagccugaccaacauggagaaaccccaucucuauuaaaaauacaaaauuagccgggcaugguggugcaugccuauaaucccagcuauucgggaggcugaggcaggagaaucacuugaacccgggaggcggagguugcggagagccgagaucgcgacauugcaguccagccuaggccaaaagagugaaacuccuccaaaaaaaaaaaaaaaaaaagaauugcuuggcugcauaac

SEQ ID NO: 17321 - RNA, 13808 nt, Homo sapiens
uuuuauuugauaauaguucauuuuauuaaauaauuuauaaagucagaccagugcauugggcuuguuaggggaaaccauuccuuccuacugucacauagccuggcagauuauaucaggugccaaaacauucccuuuuauucaauuuauuaaugagaguguggaauuaaaguagauccuugcaugucaggaaagcugcaacacaucugguuuaaguggagcacaaagguaaguuauuccacauucaccaacuuccccacuugaccucccaccaguuccugucugcuuuuuccaucaaucaacucuaagaugcccuaaacccaaacaguucccauucaacugugcacaaagguauagauauggaagacaucucacuccaacucucaccuuuggaauuaaauaaaccuggaacagggaaggugaacuauggcugaaaccaagugaagauuuuuaagaagcuuugacagaaacauuaagaauaacaccugaaugcaaauccagaaaaaagcgcuacugggggaaaauagucuuagccaauguucuaaaaaugcucauaaggaaggguuggggaauuacccuuuagacacaagcucuaagaacucuggauacaacgggaacuuggauggauacagucugggccugcugggccagauguuccgagggcggcccggcaagcagccugucuugcacauugcaacugacuggcuuaaucuacggcaagaguccuucagcuccgucacagaguacucuccaauguguuauaguuauccuuaaagcucuucaauucaaggaagugcuuggcacguuuacucuucugacuggaggggagguaugucaccuggaugguuguuggggagaccucaggggacugaguuaggucuuuggcugcugacuggugaugucgcugagagcucccaauucgugcuuuaacccugaagaacagagaggggaggucauugacagaaugaggacuaaucaaagaaaucagggcuuaucccaggccauaaaugcagcaauagucacaaauaguuauuuguguccuaucuguccuauuuuguaaacuaguuacuaaaaccccaucuaguagcuuagaaauacaagaggcugagcgcgguggcucacgccuguaaucccagcacuuugggaggcccaggcagguggauuguuugaggucaggaguucgagaccagccuggccaacauggugaaacccugucucuacuaaaaauacaaaaauuagcugggagugguggcgggugccuguaaucccagcuacucgggaggcugaggcaagagaaucacuugaacccaggaggcagagguugcaagccaagauugcgccacugcacuucagccugggugacagagcaagacuccaucucaaaaaaaaaaaaaguagcagagaggcugggcauggucacuuauaccuguaaucccagcacuucaggaggcagaggccagagaucgcuugagcccaggggaguuugagaccagucugggaaacaaagugagacccuaucucugcaaaaaauuagccagguaugguggcaagcaccuguaguccugguuccucaggaggcugaggcaggaggaucgcuugaacccagaauucgaggcugcagugagccaugaaugugccacugcacuccagucugggcgacagacugagacccugucucucucucucacacacacccuaaaaaaguagcagcacuccagccugggugacagaauaaaggcccuguuuggguacccugacacacaccuacucauaccaaaaacaacuagcagcagagaaaccaauuucccagaguucuugccucuggcucaagcuuuuuuuucagagacagguauccccaauauagguaucaccuuguuuugcagauuaggaaacuaaggguccaauaauuagcuuguaugaggucacaaaacuaguuaagugacagaccugggauucaaaccuaaguuugucagauuucaaagccuauacucuucacuaaacccaaugaacauuccuagaaacuacaaaucaaacauaauuuuuuguuuuugagauggagucuuuuucucuguugcucaggcuggagugcaguggcacaaucuuggcucacugcaaccucugccuccuagguugaagcgaccugucucggccucccgaguagcuggggauugcaggugcauaccacaaugcccagccaauuuuucuauuuuuaguagagacaggguuucaccauguuggccaggcuggucuugaacuccugaccucaggugauccacccgccucagccucccaaagugcugggauuacagccgugagccaccaugccuggccuucagaaauaauuuuuaaaaagauugugguaaaauacauguaacauaaaauuuaccaucuuaagaauuuuuaaauguaugguucaguaguguuaaguauauucacaguguugugcaaccaaccuccacauuuucaucuugcaaaacugaaacuauacccagugaacaacucccuauuucccccacucuccagccccugcaaccaucauucuacuuucugucucugaguuugacuaccuagguaucucauauaacuggaaucaucuaguauuuaucuuucaaagaaagugaauuuugaacaggcuucugcugacuucuagaccaaaugcccuuuuccagccuuucuacauguucauuuucaucagugcucuaagcaguuuuuuuuuuuuuuuuuuuugagacagugucucacucuguugcccagguuagagggcaguggcaugaucuuggcucacugcaaccucugccucccaggcacaagugguacacgcaccucagcuccugaguagcugggacuacagguagguggucgccaccacucccagcuaauuuuuuuucgagauggagucuugcucuguugcccaggcuggagugcaguggcgcgaucuuggcucacugcaagcuccgccuccuggguucaugccauucuccugccccagccucccacguagcugggacuacaggcacccgccaccacgcccggcuaauuuuuuuuuuuuuguauuuuuaguagagacugguuuucacguuagccaggauguucccgcucuccugauuucaugaaccgcccgccucggccucuccaaguguugggauuacaggcgugagccaccacaccuggccuaauuuuuuuauuuuuaguagagacaggguuacacuaugaugcccagguuggucucaaucuccugggcucaaguaauccacccaucucagccucccaaaguguugggauuacaaguacgaaccacugcagcuggccuucuaagcaguuuuuacuaggaccuuucaucuuuucgagacagacucuugcucugucacccacgcuggaguggcacaaucucggcucacugcaaccucugcuuccuggguucaagcaauucuccugccucagccucuggaauagcugggauuacaggcaugugccaccacaccaggcuaauuuuuauauuuuuaguagagaugagguuuugucauguuggccaggcuggucuccaacuccuggccucaagugauccgcccaccuuggccucccaaagugcugggauuauagacgugagccacugcuccaggccuuggcccuuucaucuuuuaagacaacguagcucauuuuuagggacagagagaagacaggagagacauaccccuuaagcucuugaaaaagagcaauauucaacauagcagaaaacagauuauuuuuauggcugguaacuaacuguuuauuauuauuuugagauggagucucgcucugucgccuaggcuggaguggaauggcacgaucuuggcucacugcaaccuccaccucccagguucaagcgauucuccugccucaccuuccugaguggcuggcauuacaggugcgcacaucaucaugcccggcuaauuuuuguauuuuuguagagaugggguuucaccauguugguuaagcuggucuugaacuccugaccuuagaugauccaccugccucggccucccaguguugggauuacaggugugagccacugcgcccggccuaaguuuuuacucuagauuggcuuuccuuucucgccaagaacuuugauuuuaacauuugcaugaaaauacgagacuauguuuaguguguauuaaaaacauucccaaacaaaagccaugaauccucuccugugacacaaaugcucaacagcugacucuauagcgauggccuuuguuucagacaugguuacuaauacuuuaagugguaguaaaaauagauuuuuuuaauuuuuaauuuuuauuuuuuuuuugagacagucaugcucuugucaccccagcugaagugcaauggcaugauaucggcucauugcaaccuccaccucccggguucaagugauuucugccucagccucccgaguagcugguauuacaggagcccgccagcaugcccagcuaauuuuuguauuuucaguaaagacgagguuucaccauguuggccaggcuggucuugaacuccugaccuugugauccacccuccucggccucccaaagugcugggauuauaggcgugagccaccgcgcccggccaaaaauagauguuauuuaauucuuuuuuuuuuuuuuuuuuuuuuuuuuuuuuugagauggagucuugcucugucaccaggcuggagugcaguggcgugaucucagcucacugcaaccucugccuccuggggucaagcgauucuccugccucagccacccgaguagcugagauuacaggcacgcaccaccaugcccagcuaauuuuuguauuuuuaguagagacaggguuucaccuuguuggcuaggauggucuugaucucuugaccucaugauucgccugccucggccucccaaagugcugggauuacaggcgugagccaccgcgcccggcccaauguuauuuaauucuuacuuuuauugggccaagacacaaaagggacgcugagacucugaagagaaggaaucccugugugugcugaaaaacuauucccuuugcuaggcuacaccaauuuugacauuuuauugggcuaaacaaaagacaagaaaaaugcacacaagaaaaaugcuaguaaaaacuucuuuuacuagcuuguauaguugcaucugcuuucuuuucuucuuuuuuuuuuuugagacagaguuucacuuuuguugcccaggcuggaguauaauggcacgaucuuggcucaccgcaaccuccgccucccggguucaagagauucuccugccucagccuccccagaagcuaggauuacaggcaugcgccaccacgcccggcuaauuuuguauuuuuaguagagaacgggguuucuccauguuggucaggcuggucucggauucccaaccucagaugauccucccgccucggccucccaaagugcugggauuauaggcgugaaccacugugcccggccgcaucugcuuucuaauguaagagacugaucuaauagucuagaaccugacaacucuuaugguaucauggauuuuguuuauaugcuuuaugaaggucacugcacuguggcaacaguccaacacuacuguaccagcucccucugacacguuccccuccaaacucacgcaguggccagcucacucagggccuccugauagcguagguacucauucuggccaaagaccuuaggaaagagaaaggaagagugaggaucucucagucugagggaucucuuuagugccccgaagaaaaaacuggcuuaccccugucccauagcgggcuguuucauagccauccaaaaggguaucaaugagugcuuugcguacacccuugaaaggcguacuaguguuucgcagauccagcagguaggagcggaaauucuugcccauuaaggaacggggaugccggccuucagaaugaaaugggaucucuguggagaaaacagcacaaugauaucucuucucauucuuuagucuuuuuuuuugagauggagucucgcucugucacccgggcuggagugcaguggcagugaucuuggcucacugcaaccuccaccuccuagguuugagcaauucucuagucucagccuccugauuagcugggauuacagaugugcaccaccaugccaggcuuauuuuuguauuuuuaguagagacaaaaauacaaaaggguuucaccuuguuggcuagguuggucuugaacuccuggccuccugugaucugucugccucgcccucccaaagcguugggauuacaggcaugagccacugcgccugccccauucuuuagucuuucuaguuaauuccccaaacuuagaaguaggucuaaugaagcugggcgcaguggcucacgccuguaauuacagcaauuugggaggccggggcaggcagaucaccugaggucaggaguuugagaccagccuggccaacauggugaaaaccugucccuacuaaaaauacaaaaauuaaccaggcauggugguagguaccuguaaucccagcuacucgggaggcugaggcaggagaaccgcuugaacccaggagguggagguuguggugagccaagaucgugcuacugcacuccagccugggcaacagagcaagacuccgucucaaaaauaaaaagaaauaggucuaaugaaaugagcaaguugaguuagagggagauucugauugagaccaaagguauaaagcugugccugaguggucauuuggugguaacaccacaguuguaagcuacaucuaugacacaugauagugucaucacacauuuuaccauccugcuuacucauccauccuagguuuaagauauaaacuguuuucauagagauaaagcauauaugacaaguguugacagaauggaaaaaauucaagaacaaucuaucuugggcuuagugaaaaagcaggugccaccuguccuuuguggaaaaacaagcaaauuacuaucaucuacuucaugaaacuaaaggucucaagagaagaacuuuaaaaaacaaaacacccagacucuuuggagaauaaccugcuuauaucauuuccuucagcaaaaucucuaaucuaguacuuucaaaacucuagaauuuccuacuagccagggaugugcagaaaggacaaauccuaacauacaaaguggguucauuacucuguucccuaggugggcuuucaggauccuagaauggacccugucagguagcccuuaccagagguacgaauggcauccagagcuuucauccuauacagauaguuguagcaaccuguugaggaaaagacugguguuaggcauaacccuaaaaauauuccccaggcugggcgugguggcucaugccuguaaucccaacacuuugggaggcugagguggguggaucaccugaggucaggaguuugagaccagccugaccaacauggagaaaccccgucucuaguaaaaacacaaaauuagccaggcgugguggcgcaugccuguaaucccagcuacucaggaggcugagguagaagaauugcuugaacaaggggguggagguugcagugagcugagacugcaccauugcacuccagccugggcaacaagagugaaacuccaucucaaaaaagaaaaaaaaaauuccccaaacuccagcaagcuaauaaaugggcucugcaucuaacauauauccaauaacaggaauaacuaaggcuuugccagcagcuuuugacaacucugagagaaaaggaauucuggacuugugggacuccucacugaagcauuccaagagcuugccacauacuuugauuucccuggguuuccaguuguaguagucuagcaucaucaucugcaaggagcuggggcucauacuugauauccugaacccuggagagucgaauaucaaucuccucuuucaaguccuguucacauaaaaaaagaauacacaaucauuuacccugcacucugcuuuccaccaaugugaaaauggggcagaguuaaugaauaacuaagacaacagaaauagagaccaugcucauguaguuaauaaaauuaccagauaagagguaagaauuuaggaaagaacgggauuggguuuuccaauaaccucuccaagcugcacaucucuaagcuagaacauuuaacuugugccagaaauccuucaagcuauacagcaccaacauuauuuccaauuuuuuuuuuuuuuuuuugagacagagucuugcucuaucacccaggcuggagugcaguggcgcaaucucaguucacugcaaccuccgccucccagguucaagcaauucuccugccucagccuccagaguagcugggauuauaggcgcguacgaccaugucuggcuaauuuuucuauucuuaguagagaugggguuucaccauguuggccaggcuggucucaaacuccugaccucaagugauccgccugccuuggccucccaaagugcugggauuacaggugugagcuacugcgcccagccucucuugccucagccuucugagcagcuaggauuacagguaugcaccuagcuagaggcuacuuuaaaaaaaaauuaacacauauuucuuuuaaaauagccaagucaaauucaugguauacaaauuuuaaagauaguaaaggggccgggugcuguggcucacgccuguaaucccaacacuuugggaggccgagguggguggaucacaaggucaggagaucgagaccauccuggcuaacacggugaaacccugucucuacuaaaaauacaaaaaauuagccgggcguuguggcgggguccuguagucccagcuacucgggaggccgaggcaggagaauggcgugaacccgggaggcagagcuugcagugagccgagauugcgccacugcacuccagccugcgugacagagugagacgucuccaaaaaaaaaaaaaaagauacuaaagguagcaccucucaguuacccagcagcaacuacuauuuucaguuucauauuaaucucucuuaccuaagaggguuaccagagccccaggaaauaaauuuuuuguuguaacuuuuuacaaacucccauugugaaacauaagauacacaaaauacagguaacauagauguacauuuuaaauaauuauaaaaagcauaauaaugaacaccuauaaccaauauccaguuuaugcaauggaacauuaccacuaacuuucuuuuuuuuuuuuuuugagacggagucucgcucugucgcccaggcuggagugcaguggcgcaaucucagcucacugcaagcuccgccucccggguucacgccauucuccugccucagccucccgaguagcugggacuacaggcgcccgccaccacgccuggcuaauuuuuuguauuuuuaguagagacgggguuucaccuuguuagccagguuggucucgaucugcugaccucaugauccacccgccucggccucccaaagugcugggauuacaggcgugagccaccgcgcccggcccuaccacuaacuuucaagucuugugugcccaucccucauugaaugcuccgcaccccaaaccuuaacuugucaauaguccucauacacuucuucacuguuuuaucgugucacccuaaaaaagaugcuuagcuuugccugguuuucaacuugauacaaauggaaaaauacuuuaagaaucccucugcaacuuguuuaaaaaaaaaauuuuuuuuuuuugagacagggucacacucugucacccaggcuggagugcaauggcacaaucucagcucacuauaaccuccaccuccugagcucagaugauccuccugccuuagccuccugaguagcugggguuacaggcacacaccaccaugcauggcuaauuauuaaacauuuuuuuuuuuugagauggagucuugcucugucacccagacuggaguacaguggcaugaucuuggcucauugcaaccucugccugcuggguucaagcaauucuccuugcccuccugccucagccucccaaguagcugggacuacaggcgcaugccaccaugcccagcuaauuuuuuguauuuuucguagagauggggucucaccaugcucgccaggcuggucucaaacuccugaccuugugaucuucucaugugggccucccaaagugcugggauuacaggcgugaaccaccgcgccuggcccauuuuuaaacuuuuuauagagacaggguuuccccauauugccuacgcuggucucgaacuccugagcugacgugaucagccugccucggccucccaaagugcuaggauuacagguguaaaccaccucgccuggccuuaaauuuuuuuuuuuuuugauacagagacucacucugucacccaggcuggagugcaauggugugaucucugcucacugcaaccuccgccggggcucaagugauucuccugccucagccuccugaguagcugggauuacaggcacacaccgccacgcccagcuaauuuuuuugcauuuuuaguacagucgggguuucaccguguuggccaggcuggucuugaacuccugaccucaggugauccaccugccucagccucccaaagugcugggauuacaggcguuagccaccgcacccagcaaaauuuuucaaauauacuuuauugagguugaauuuacauacaauaaaugcauucauuuuauguauauaaauugaugaguuugacaaaugaacauacccccuucaccaccacgucaaucaaaguaaagaauauuuucaucaccuggaaaucuccccucucccagcccaggcaacaugauguacucuuuuacaguucugccuguucuagaauuucauauaaaugggguggaagcacaugguacauauucucuugugaacggcauuuuggcuuucuucacucagcaugguuuuuuuguuuuuggugagacagagucucgcucugucacccaggcuggagugcagugguuugaucucagcuuacuacaaccucugccaccuggguucaagggauucuccuaccucagcgucccgaguaguuaggauuuuuuucuuguauuuuuaguagagauuggguuucaccauguuggcuggucuggucucgaacuccugaccucaaguguuaucugcccaacucggccucccuaagugcugggauuaccggcaugagcuaccaugcccggcccacucagcauguuuuugagauucauguuugcaauuuuuuucauucagaaguauuuugaggacuugucuucauauauuuaucuucaguuuuucauuuuuuacacuauuccagaauaugaauauaccacuaccuauuuuuuagaaacaaggucuugcucuugcccaugcuggagugcaucagugcaaucauagcucacugcagucuguaacuccugggcucacaugaucuucuggccucagccucccaaagugcuaggacuacagguaugagccacugcacucagccuauauaauaauugaaaaguggacauuugaauuaaguuucuucuucaaauauuaugaacaaugccccuauaaauaaucuugcacauguuucuugguacacaugagcaaaacuuaauuucucuaugguaggagagaaacuguuggaccauggauuagguacaugugcaaucuuaccagacaaugaccaguuauuuuccaaagugguuuuacuaauuuauacuuucacuagcaaugguugagaauuuagaaaaaauuuuuaagcaaaaggaauauugcucugaacuagaccaagggaccccugaauagccaaaguauugauugguucaugaugugcuagaaacuaacccuaugucuuucucaugaggcaggcaggacuguuaagguuucaagccaggacauccuccuagagccuuuucauguacuaugucagcaaagaacaaagaggggaagguuaauagcacuuguuaaugaaaguacagugcucuaggaguugagggagucaugagcucuagcucuacaacuaaccuguuuuucauucagcaacaaauuacagaguaccugcuauguguaggcccuggcacuaaccuguuuuucauucaacaagaaauuacugaguaccuacuauguguagguccuggcuuuauagucgugaacaaaacuggcauggugccugcauucuugaagcuuacggucuagcggaagagagaggcauguuuuaaacaaauggacaaacauaaaaauuaugguaaaugcuaugaaggaaaaaucaggguaccaugugaaaauaaagagagggggaaccuacuuuaaaauagguaauaagcauuccuuuuuuggaaguaacauuuaagcuaagaucaaaagaaugaaugagcuagccaauugaagaccauuccagaucacaggagcaaaaaggguggaaaauucagccaguggagcugggucccagugaucuggggagagccacacaaaaggggguugguaagggaagcaggugucuuuuacuuagaagcgaaagacuaaagaagcagaaugagaguggcagugggauagcaauaauucugauucacaaauguuggguuugagaugucuacuacaaaucuaaguggaaaugucagguaaucaguuggcaauauauguaaggaacucaggaaagaguucuaggauagagauaaaauuucaucuguagcuaaagccaaggaaaggaagacagucaccuaaggagaaaguacagacaaagauaaaagaccacuggguuauucacuuccuauacgucuucugguaaacugccuccuuuucuugggcuucuugguaacaugaaugguggaauuagaugauuuauggagcuccucuuaagucuaaaauuauguaaagguaacccuucucauugcucuuggguuaaccuuaaugaucucaaccccauccuaaucaaacaaaaaacacuggguaguuuaagaugagcugggaaauauuuuacuacaaacaguugggaacuucgacccaagcccuucauucugcagauacaaaaacagaaguuccaggaugagccacaugcuugccacagcacugagcagguaagccaaguuccaaagcgcacagugccugcucaacuuaguaaguacaaggacaagugcacgcaaagaaacaugagaauuaaagucaucacuaaaggcagaggaaaucucauucuugacccuaaaagaucuggagaaguauguuuaacuugugcccuaaggaccuaccuugggggcauugugucccacagggacaugagguccccuucgagauuucauugcaaagcgcaugauuugccucuucacaaaaauaaauagcaguacaaacaccuguccaaaaagauguaaaaauccuuuaauaaaaagucaguuuuguuuuguuuuuuuuuuaaaaaagcaugccuucauuccaaauccccagauuccggcucucaggaauguuucaggguaaaacuuggggcaaagcaaggccguuaugauggggguggaucuaagaagccagcagcagggaggcguggggucugugcucuagcguuaaagggaggguucuagacuaacgagggcgggucggcccgacuaagugacuuaaacucccaccuacuccuggaauaaggagucaaagcccggauaggcgcaggugaguggguggagaaugcagacgggguacagcucaaaaggagggucucuacuggguaagaugcgacagcaggaauggggugggguaaucuccucaccaggcucccguaggccaucaccagcacgacauucaccccggagagccaguuacugccggacgccauggccucccuaccucgcgcagaauuguucggguuuaccccgcuguccuggcuggucagcccaggcuccgccgaagcgacggcgccuggguccccuggagcuccccggccauuuccuuacgg

SEQ ID NO: 17322 - RNA, 1046 nt, Homo sapiens
cagucacuucauuguuaugcagccaagcaauucuuuuuuuuuuuuuuuuuuuggaggaguuucacucuuuuggccuaggcuggacugcaaugucgcgaucucggcucuccgcaaccuccgccucccggguucaagugauucuccugccucagccucccgaauagcugggauuauaggcaugcaccaccaugcccggcuaauuuuguauuuuuaauagagaugggguuucuccauguuggucaggcuggucuugaacucccgaccucaggugaucuucccaccuuagccucccaaagugcugagauuacaggcaugagccaccgcgcccacccggcuggcagccaaguaaucuuaacuucaguuggaguaagcccccuaaauccagcuucguugaagauuccaacuucuauguuauccucucauuuggccuucaaagcuuuccuuuaggguuaacauggcuguaugaauggcaucuucaaguuccagaucuucauuuuaucuuuucucaagggaaguuuccccauucacauaguucuuucccacugcuguggcuuuccaggccaaguaagcuccagauggaucugacugaaauaaauaugguugucccucauuccaaccacaaacaaguaaagaaacuccaaauggacaaacaccaccugacugaguauauucuugcauuacagaagcuacucuccgcacuagcugagcugugggaaugggcacuugguacacaagauaguauuguugagcuaguuucgagcugugugcacaagcacuuuguuaucugggcccacgccacuguacaccaaaccuaugugcuugguaauugguuccacuuugucuacacuucgcucaucauacagaaugaauuucuguuuuuucucgguugcuaauaccacaccauuugccgcuuuaauucccacugacagggcuccuccagcuacagcagccaaagcauauucaauccggacaaguuuaucagacgggcugaauguagucagcgaaaagccguaccgcgcuccgccaucuuuacccgaagagccaaa

SEQ ID NO: 17323 - RNA, 1046 nt, Homo sapiens
uuuggcucuucggguaaagauggcggagcgcgguacggcuuuucgcugacuacauucagcccgucugauaaacuuguccggauugaauaugcuuuggcugcuguagcuggaggagcccugucagugggaauuaaagcggcaaauggugugguauuagcaaccgagaaaaaacagaaauucauucuguaugaugagcgaaguguagacaaaguggaaccaauuaccaagcacauagguuugguguacaguggcgugggcccagauaacaaagugcuugugcacacagcucgaaacuagcucaacaauacuaucuuguguaccaagugcccauucccacagcucagcuagugcggagaguagcuucuguaaugcaagaauauacucagucaggugguguuuguccauuuggaguuucuuuacuuguuugugguuggaaugagggacaaccauauuuauuucagucagauccaucuggagcuuacuuggccuggaaagccacagcagugggaaagaacuaugugaauggggaaacuucccuugagaaaagauaaaaugaagaucuggaacuugaagaugccauucauacagccauguuaacccuaaaggaaagcuuugaaggccaaaugagaggauaacauagaaguuggaaucuucaacgaagcuggauuuagggggcuuacuccaacugaaguuaagauuacuuggcugccagccgggugggcgcgguggcucaugccuguaaucucagcacuuugggaggcuaaggugggaagaucaccugaggucgggaguucaagaccagccugaccaacauggagaaaccccaucucuauuaaaaauacaaaauuagccgggcaugguggugcaugccuauaaucccagcuauucgggaggcugaggcaggagaaucacuugaacccgggaggcggagguugcggagagccgagaucgcgacauugcaguccagccuaggccaaaagagugaaacuccuccaaaaaaaaaaaaaaaaaaagaauugcuuggcugcauaacaaugaagugacug

SEQ ID NO: 17324 - RNA, 1242 nt, Homo sapiens
acuacccaccuuagauaccuuuacuuagauuuuucaagauguuccaacuggcccugaacuugauugcaucaaacuguuaggucuggcugcugacugcuccuacgagauacaucacaggagcagacuuccccaacaugccaacaauuaauguccagguucaggagaaaacugguaugucaucaauguagggaugguuuucuuucaaccaaacaccgcauguucucacucacaggugggaauugaacaaugagaacacacggaaacaggguggggaacaucacacacgggggccugucauggggugggggacagggggagggauagcauuaggagaaauaccuaacguaaaugauggguugaugggugcagcaaaccaacauggcacauguauaccuauguaacaaggcugcacauguauccuagaacuuaaaaguauaaaaaaaaaaaaaagaaaaaagaaaaagaaaugguuuucuuucaaauauuaaaugaaauguuggguguuauuggaugucuucccacuucucucccaaguucauaacaaaaccugaauccuaucaaucaauccaaugcagcgauuagaggaaaucccagcaaggcccgcuucucaagcuccucuucugagagaucuguaucagcaaaccaggauccgcuuuaucucagugugcuucauguugagucaaagacugucaguugaucagaauuaagagcaaacuugauccaaccuuucccuauuaaaaacacaaggguauuuacaucuuccaaacaaaugccuucagcccauauaaaaacugaugagccaaaaugaggccucgcaggccacugugugugauucaagggaaaaauuauuaauauccaaguagaguuucaugauuaucucuccuuuucaaauugcuucaaccucagcccucaugucauuccugacccauguauaauucucaaauuauaacaagcauagucucaaauccucucaucuaaaugaccuguacagacacuuaaguagcauuuacccauuugguagauucuuugguauuuccuaauacuauucuaucaaacccaccuauauugcaaggaaggagaaaaugggagaaaacacgucuuaaugggugucugggucuauuuucccuugucaaagaucuccuuuaugaagacaccuguccaaauuacuauauaaaaguacaguaaaaauaaaguggaagcaaucgcuaccuacaucuuggcuucaagcaaaaaacaauaaua

SEQ ID NO: 17325 - RNA, 3659 nt, Homo sapiens
cggcaagaacugguccaacgcgacgcaguacacaggccucugcguaaggggcgagcgcggagcugguaccuuugccugagguuuccgcgcggggcuguggcgccgacggauccauccggccagggggaggggccgagcccggcugcauguaacacccggaaggcggcggaggacagcaagguggcuggccggcaggccaauggcggccaacgccacuuccggccgcccuccgagcaucgcucuucggcaacccgaagccacaggauggaggagggggaucccagcaaagguagcgacuaaggggacccaagcagaacgggagggcgacguccggagcggcggcagagccaggggacgcugugugaggcuggcaaagcgguguucaccuaguucucucgggcuccgccgccgccggaggaggacaggaggccggcaaggcgacccccaaaucuuccuaggcucugacuuccgucuccuaacccccgcaaauuccaacccggucuuggaaaaucccgcgagaacgggcucccgaauugucauugggaucucgcgagaacgaaaucuuccuuucugugggcggagcaaucuucccgaugucucuucccucugaggccaguagcaggaagggccucgggaguugcgagugucgcgagguuugaggucgcucggugggccgggcgcugugcgaagcuagaaauaacugggggcauggagaaugcgguggcuguaaagggccgcugaggcgguggaggccuggcagagagcguccccgcggucgcggcuucuggcuucucuguggagcuugguucuuccgugguggugcagcaccccaggaacuucaggaaccaguccuuccuuggagagcuccccgggacagccacgggggccaagugaaacuagcgcguuuucuuggauccuacacuuuauagugagucauaaauacuuuaaauacaaagccaacaacauuugcugcaaauaaacguaaaaauacuguuaaaguguaaaguguuuuccuccguaccaucugacguuucuggcgguucguugaacgcgagagaacgcugagccgucugcacugagcccgggagcaucuucagggcagcgccgcccacgcgcgaggugaaugaaggacacggccucuugacacucccaggcagcacagauagacggauccguaaguggcucccgcgcauguuaaaauuuguauacuguaagguauuucauggauugagugaaauaccugacagggccuguauccguucccuauugccacaauaaccaaaaaccacaaacuuuguagcuugaaacagcacaaauuuaucaucugacagacaaugcauuuauuaucucacgguucuguagaucagaagugcuaccugggugucacccgggcugcacuccuuucuggugacuccacaggacaauccuuagcuugccuuugccagcuucuguccacauuccuuggcuuuggucccuuccuccaucuucaaagccagugauaugccaucucucugaaccuuccauccucaagucuaccgcugauugcagcuggaaaagauucugagggcucaccugaguaauccaggaucaucuucccauuuccaggucucugcccuugaucacaucagcagaauccuuuugccauguaagcuaauauauucacgaauuccggaaauuaggagauaaacaucuuugggggaucauuauucugccuacaguagugucuuaagaaaacaauauggcuguuugcaaauagaucucaauucuauggcagauacuaaaaacuaguaguauguguucauaaaaugcuucauuuaaaauaugacuuguuugcuuaccagcaggcaauaacuuuaagccuaagugaaacaucuaacucagccaucuaugugugaguuguuggccagaucacuucuccguguuuuauuguacucaccuaucaccauuacagugaagcuaauaauaguaaacuaccuaaaaaugguaauuguaaaaaauuagauaauuaaguaaaacuccuaaaacaguagcuggucauaguaaggaauauauguguuguuauuacuauuauuaucaauggaaugcauccacuugaaaguugcauucuacauagccauuaugucaguuuaauauuuuggcuaauaggccgggcgcgguuggcucaugccuguaaucccagcacucugggaggccaaggugagcggaucaugaggucaagagaucaagaccauccuggccaauauggugaaaccccgucucuaauaaaaauacaaaaauuagcugggcguaguggcacaugccuguagucccagcuacucaggaggcugaggcaggagaaucgcuugaacccgggaggucuauagagguugcagugagccgaguuugcgccaccgcacucuaaucuggcgacacagcgaaaaacacuacuaauuauaauuguaauucuugauucugacaugcacccugauauuggaaaucuuaaaaucuagaaaaaucugcugcuuguuauugauggauuauaucucuuuucacauugucucuaaaaucaaaauggcaaauugaaauuuuaaucaagcuucuuuuuuuccccuacaacuaccagggaagaaguuugauuuuuuuccccucucugaaaugacuaguuguguaauuuugucuuauuuuuccagagguccauugaguuaagauguagcucuugacagagcagaccucuuaauagaagugauaagcaaauucagaaauaaauuuugauuuaaaugggagguaucaucugguugaaggaauacccuugugacuaacaaaagaggaggauaccucauuuucuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggcccucauuuucugaguguuuauuauuuaaccucacugcuguacuuacaguguauacugaagcagaaauaaucaugacaugaaaauauguccuagugaacuaguugccucauaaaguuagacauucucaaauauuccuucccccaguagcuuuugucuuugcauugacauccuugucuaggugcugauauugugaacaucuaacgcugucagaccagucacuucaaaguuaaacugaauaucuuguaaaauauuaaggaauuccuguaguuaauaugugugauguuggauaaaucacaugaaugaacugaaucacauacaaaacuuuuggcaaaggaggaucuagcaaaaauuaagccaauuaaaacuacaaaagagaaaaaaauaacacagauggugauaacacaggcauuucaaaacaggcucauggaaggaugauuaaacccaccaauaauuugccaaaaaauagucucucuuuaucuucacacugcaaaagucaaauauauaucuguaugugguugacagaucuccagaauugu

SEQ ID NO: 17326 - RNA, 733 nt, Homo sapiens
uuuuuuuuuuuuuuuuuuuugaacugguaauagaauuuauucaaaugugccuuaauauaggcgcuggggcuugcccauggugcucucgauauauaaggcccggacauucugccaguuuuucuugagcaaugacaccaagaaguugacagccaggugaauguuauacacaagcucaucggcugucaucuucacgugaccaacagcuacagccagacauaacaccuucuucauuuggaacuugauuguggacuucaccucacccacuuuggccaccauguuuucguugugugugagcagggaagggaacuuuccugccuuauuuagaccugggccgaggauucguggaaucugcuugaucagagacucugaggccaaaaacgcaucauacuucuuggccagcuucuugaccaguuuuuuauucuuuuugaguuuuuucagcgccucgauguccaugugggggauauccacggccuuagccucgucacagugcugcuggucccccaggacacacacacacaacuuagggcggggaguggacuuaagucugacggugcccgagaagcacuuguccuucugggggucauaguucuucaagcugaucugcaacuccaccgucuccaggaacuugcggcgcuugcgcugguuccggugcaggacuucccgcaccgccucguacaggguguugcgagagacugcugcucauggcuucucacgccgcgcuaaccggaaaaga

SEQ ID NO: 17327 - RNA, 1366 nt, Homo sapiens
gcccgcccgcccgcccgcgccgcucaccuugagguggccgcugucugggcugcucgcuuccuccucguccucaccucccgaggcggcggcggaggccgaggcggcgggcgggggcgcgccccggccacgaagccccgagugcucggcggcugcggcugcaggcagggcggccgaggcggcggcccccgcggccccagggcugagcgucacguugugugcguucucgccccagcgccacggguacaccaugaagucgcugaagccggggcugguggggaugagcggcggcggcggcuccggcuccccuccaccgccgcacguuggcuugaucggggucguccugaugaccgacaccagcacccgcuucggggagucguggcagaagaugacgggcggcggcggcggcggcggguucuccgccaugggcgccucgaagccccggaucaucgcccggcccgacccccagcuccggcggccccgggccgcacuccugagcaccgcucugccccucacucgcucugcuccgagucgcaggcucaguccugccggcucauggcagacugacguuucccggaauccugcgcagcagccaccuaacuaguugagcagacggcaccggcgggcagggcuggaccccagccccaggucaagcgcgcccuccgcucuuuguacuccgcagcgcaggcugcaggggugggaagcagcgggcggcccggcccuugcggugacaggaaagcaggacgcgcggcgcugagcccccaaaaauaacaaccugccgccgcggugccugccccggcuuuucccgcguuacauuucgcgccugggcggaaccagucaccgcgaggccgcugcccgcuggccgcaccggcgagugacaggcggcgcgagccaauggccaggccuggccuucuuuccagccggccggggcggggccgggucugcgcgcggguccuucccaccucgccauuggccgccgcucuuauauuuuuuucugucuggagggccaacagcguucgaaacuccaguggagcgcgcggcgucuccacucgcccggacacacccgccugccgccccgccccgccgucccuccgcgugguuaguccgggccagggagacaagggcggcggggagggcggcaagagggcggcugauuggacagcggcggggcggggucgggggggguggugaucguugggcgguggaggcgcgcgccccgcucggccccgcccgccguugguuguugggccgcgguucccgcgcgcagggaguuuaaagggcuggggccccgccgcccgccccgcccucggucccaccacccgcccggcggcuggagucucugcugcccgagguccugaugggcacccgg

SEQ ID NO: 17328 - RNA, 784 nt, Homo sapiens
uuuuuuuuguuuguuauuuaguuuuuauuucauaaucauaaacuuaacucugcaauccagcuaggcaugggagggaacaaggaaaacauggaacccaaagggaacugcagcgagagcacaaagauucuaggauacugcgagcaaaugggguggaggggugcucuccugagcuacagaaggaaugaccuggugguuaagauaaaacacaagucaaacuuauucgaguuguccacagucagcaauggugaucuucuugcuggucuugccauuccuggacccaaagcgcuccauggccuccacaauauucaugccuucuuucacuuugccaaacaccacaugcuugccauccaaccacucagucuuggcagugcagaugaaaaacugggauccauuuguguuggguccagcauuugccauggacaagaugccaggaccuguaugcuuuaggaugaaguucucaucuucaaauuucuccccauagauggacuugccaccagugccauuauggcgugugaagucaccacccugacacauaaacccuggaauaauucugugaaagcaggaacccuuauaaccaaauccuuucucuccagugcucagagcacgaaaauuuucugcugucuuugggaccuugucugcaaacagcucaaaggagacgcggcccaagggcucgccgucgacggcaaugucgaagaacacggugggguugaccauggcuaauaguacacgguuuuccucggcggcggcgucugcaaagccaaguaauugcuucuuaagacgccau

SEQ ID NO: 17329 - RNA, 16356 nt, Homo sapiens
auuagucucugcuuuuaaaagcuuuuaacaagaagucugcugcuaguccuggggacagggccccaaugagaaccuuuuguuccagaaguggaaucuguucccggacugugggguggguccugaaaugcucuaacacacuuuccugaaugagauuccacauccaaacuuucuguugcuuccgucguuuggcagucagcuccccacuggcaagcauuagguccuggaaaucuuucauuuuaucccacauuucagagauccccucuccacuucgggcagaaauacgaauuaccuaucgaaaagggaagaaccagaccauuuuacuuaaaaugauagaaaaaauuuuuacagggacgcugauaccugccaguuaauucuuacggucuacaaaaauaggcaauugacaagagugagauuuuauugcugugucaaaguaaauauaccaauauauauucugagguaauauaccuaggauuacuaagugcauagcagaaauaaaacacugauucaaggucaaauuuuaagcccagagauuuauuuuaauuuaauuuauuuuauuuuaauugcucagauggucaggggcaucauagaggacuugugacaagggcaaugccagguagguuccccugaggacugagugccagaaaaugaagcuagguugagaaauagccuaauucucucugccaaauuugccugauuuagcaaguggaagagcuggguaucugacaucugcauguauauaugaggugaauccagacucaaugcagacaacaugauugggaaaaacugggauaugacaguaagauaagucaucauuguccucauuauaaugauuacagcuuauucuuuaauaacauagugucugucuacagauaaagaugaccacaucaauauuacugcaucacuuauuacaggauuaaaauuuuuuccuuacugaaaauggcacccaacaaacauaaugggaaucaaauuccaauauagauaaucaaaucauuaacugcuccauaaucuuaauaaggaugguuccuuucagaauggauuugcuaucacuuccaaauggcucaaaucaaguauuacaaucacaucuaucaucucugaucuaguuuuugacaucuagugguuaaaggauuauauuuaaaaucaugacuacacacuccgucuuugucaugauuuuuaaaacuaucaucuucacauagaagcaagauugauuauaugucuaguuugggacuuauauccugucuucuaauguacacaauccauucagagugaaagauacagaaugcaagcaagcuuaccuuugguuuccagacuugugaacguuugcggaguaauuucagugcacucacauauuccgcuuguauccuucgagcuggcacaaucaagucuccaucagauuuaguuacagcuaccagaucugccaucucgauuauaccccuuuugauacccuaaagagaucagaaacauuuaaugacaaccaacauaaaaaugggaaaacuagucaaugcucagauuuugaaagucauacauuucauuaacuuuucauccauauccuccuaagcccuggaugccaagaaucaccauuacuugacagaaauuacucaaaagcauuggcuauuggaauuauagaagucaucuguaauaucucuuccaaauuuagagacuaacauguugaaauacauucagaauuaggguaaauacaucaagucacaacaugauugaguggcaggacaguucacauuaucucgugauggaaugugcuucuccugagcuaacacugcaggaugcaaaaccauucaucauuaaggugcuuaaaaagaaaacaccuauccuuaacaucugcauuuccagaaaaaagucuuugaaauuuuccuuaaauguauauagcauuuuauuuucaauuugcauuugaggaaaaagaaccugaugccuaaaaauaugucaaucucuuuuuuuauuauuauuuauuuuuauacuuuguauuuuucuuauuucagcuuugcguggacaaaccucaaucucuuaauucaaauuaugucacauaaaaauauuagaaauaaaggaugaaauccaaaagccaaaccuuauuuaguaaauacagauuuuucuacauaagauuaaaauuucuuuucaaauauuuuuaaacaaaacauucaauuaugaaauacuaauaguuaauguuucuaaauaagcagcgauagucugcaaucacuauguuuuagaauuauaaaauugaaacagaagcauuguauaacaaauaauuugucugggcuaggugugguggcucacaccaguaaucccagcacuuaaggaggcuaaggcagaaggauugccugaggucaagaguucaagaccaacucgggcaacaaagcaagacuucaucuguagaaaaaaaaauuaaaaaauuagccgagagugguugcacauggcuguagucccagcuaccugggaggcugaggcaggaggguagcuugagcccaggaguucaagguuacagugagcuaugaucaugccacugcacuccagccugggaaacagagugagacccugucucugaaaaaaaaaaggaaaaaauuugucugguuuuuggguuucugggagguaaucuuuuaaguucuaaauucccagaauuuccugaguaacaggagugucuguuauucaugggaggugccuggggcuauaccuggguuuuuuuguuguuguuguuguuuugagacagagucucacucugucaccuaggcuggagugcaguggugcgaucuuggcucacugcaaacucugccucccggguucaagccauucuccugccucagccucccaaguagcugggacuacaggcgccugccaccaugcccggcuaauuuuuuuuguauuuuuaguagagacgggguuucaccauguuagccaggauggucucaaucuccugaccucgugauccgcccaccucggccucccaaagugcugggauuacaugcgugagccacugcgcccggccuauaccugaguuuaugcaaugagaucacucaggaugggagacugaccauggcagaaagacuuaucaugugauuagaggguugggguuuuaugccaugugauaucaacccaacuuccagggaggggacaggggcuagagaucaacuucaauuauucagucaaucaugccuacauaaugaaaccccaagaaaaacuugggacacuaaagcucaggggagccuucugguuggugauacacaucaauaugccaggagagaaaugugucuugaggacacagaagcuuugcauuucggcccucccaggcuucuuaugugugucuucauuuggaugguccugauuugucuccuuuauaagcacgcugcaauuguaauauagugcuuuccugaguucucugagucacucuagugcaaggguccccaacccccaggccacggaggaacugggccucacagcaggggggcagcaggggggcgagcauuacugccuaagcucugucccguuagaucagcaacaacauuugauucucauaggagcacaaacucuauugucaacuaugcaugcuaggcaucuagguugugcacuccuuaugauaaucuaauugaugccugaugaucugagguggaacaguuucauccugaaaccauccccccuuacccccagucuguggaaaacugucuuccaugaaaccaguuccugaugccaaaaagguuggggaccacuguucuagugaauuacuaaaccuaagggauaaugggaacccucaaauuuauagcccguuggucagagguauggguggccugggaacccuggagcuugcagcuaguagugucugcagugagaggaggcuuguggaggacucugcccucacccuauaaagucugcacuaacuuuagguaguugugccagaacugcggugcagaggagaguaagaaucucauuguacaacauauaaacuaugauagugggaucccacucuccccagaacuuuugaaucaacguacuaacaacaucuaugcaacaauggucucuacuggcuggagcgauccauguauuucagucauguuacagauggaaaaauuaauguugcauaauuuuacauucucaaggacacauauucuauuccuguaaguuaggaaaaaauauagagaaucugccuuugauucagguauuuuagccaacaugaaugauauuucauuuucuaaaccauuaucaacuuaguuuacaaaaacacaacauuggaaauuuuuauuuucagagauauacauuuuauauuuuugggggaaaaaauaaaaauaauuaccugcagcucaucuccuccugcugguggcaguaguaaaacaaacaugucaaccaugucagcaacagcaaacuccgacugacccacaccugaaauuguaaaucacaacuauauccuaaaauacucaccauuauuugacuuucucaacuacauugaccauuuccauucuacuucauuuacucauacucauggucacacagucaaccuggucacuccuuuaaacaucucacuucugaagaauguauuaaaugucauaucuuacccucuaagcaaacccguuauccuucccagcucucccgcuccguucuuggauugaauggagaaccuaaaggcuuccauccucuccucacucucacagcucuuucuuggcuuccuuuucaucagcgagcagcuugaacacugugacucuaaucuugaaucaugccuacaaauacuuucaucuuuuuugucuucuuguccucauacuugccugcaaacgcccaauuauguauggaucaauccaacuauguguguucucuccuccauaggcacgugagagaaaucacucaacucuguggacaagagccacgacaggcagccucugcuacaucuuccuuacggccuggcaaaagcaaucucccuaaaugcccucgguuggcuuccguuccauuucccacagcagcuauuaugaacauucacugucccauaaucuccccgcuugaugaggacuacagcaccuacuucacagaggaaauaaaggcaagaacuuccuaggcuucucccucucccguacuccacagguaacaagacacaaauacaaacucagccuuacugccuccucugcagucucaguguaauaagaacuauuugacugaaaaggaaucucucauuccuuuccacuuccucuggguccuugcugauuauuaucuuuaaccucucauuuaucuacaggcucuugccccccggcacaauacauaaauugugcucaaaucuuucucaucuuaaagccacauaaaacaaaaacaacaacaacaaaauaacaagacaaaaacucacaaacuccuccaacuaucaccacguuucucacuuuuauuaaaauacucguuucuggaaaaagguaauuuaugcugacuccuuccacuucacuucauguucaucucaccccacuuaaaacugucuuccagcccgggugauguagugagacccugucucuacaaaaaauacaaaaauuagcugggcauggugguauaccuguagucccagcuacuugggaagcugagguggaaggacagcuugaaccugagccugggagguugaggcugcagugagcugugauuguacugcugugcucccaccugggcaacauggugauaccccaccucaaaaaaaaaucuacuuccaccaaaacucuggaaacucucucccuuucucggugugauggacuucuaguugccuauuuaauauuuauucuucccuauuuucuuauuccaauguuauuaggaguaucaguguaucagaugaaagaccacauucacaagaucuccuuucagcgagauaugaugaaugagucaaagcaacagucauuagaugggguucccagaaaaguuuuuuaaagauggcuaauucagcuauaccucuuaugccaccccucucugcuuccuuauuucccuuuccuucuuccaucuauguggaacauggaagugucagucagagcuucaucagccaucuuuuaaccaugagcaaacuggaggauggaaacugagugcuaagaaugguaagcaggcagacaaaagaaaccugugacaccgagggcacugucaaagcaccauaccugcuguggacugccugccucaggcuccuuuguauuuuaaagagagauugggucuugcucuguugcccaggcuagagugcaauggcacgaucguggcucacugcagccuugaacuccugggcucaagccauucuuucaccucagccuccugaauagauggaacuacagguguguaacacaaugccuggcuaauuuuuuuuuuuuuuuuuuuuuuugauagaaccaaggcuugcuauguugcccaggcuggucucaaacuccugggcucaagcaauccuuccaccuuggccuccugaacugcugggacuacagguguaagccaccaugccugaccucaggguucuuuuauuuuuugagacagagucucacucugucaccccagcuggagugcaguggugccaucacagcucacugcagccucagacuccccaggcucaggugauccucccaccucagccuaccaaguagcuaggacuacaggugcaugccaccaugcccagcuaauuuuuuuauuuuucuguagagacgggguuuuaccaucuugcccagggagguuuggaacuccuggguucaagcagccugccugccuuggccucccaaagugcugggauuacaggcuggggccacaaugcccgcucuaggucucuuuuauauagaaaauaaccucuuucuuguuugagucacuguuauuuugaguuucugggaaagguagcuaaauauaaccagguaauauauuugguuuuuaaggugcucuucuccuuugauucuccuacuacuacucaggcaacuaacucuucauucaucuacuuuuuaaugguggaguuucuaaagcccugucauggcuauuguuauaaacugagcuguguuccccucaucuagaaacauuccuaaguuaggccgggugcgguagcucacaccuguaaucccaauacuuuggcaggccgaggcgggcggaucacaaggucaggcacuggagaccagccuggccaauauggugaaaccccgucucuacuaaaaauacaaaaauuagccgggugugguggcgugcaucuguauucccagcuacucggggggcugaggcaggagaaucauuugaacccaggaggcggagguugcagugagccaagauugcaccacuacacuccagccuggacaacagagcgagacucugucuuuaaaaaaaaaaaaaaaaaggccaggcacgguggaucacaccuguaaugggaggcugaggcaggcggaucacaaggucaggaguucgagaccauccuggcuaacacggugaaacccugucucuacuaaaaaaaaaaaaaaaaauuagcugggcaugguggcaggcgccuguagucccagcuacuggggaggcugagguaggagaauggcgugaacccgggaggcggagguugcagugagccgagaccccgcaacugcacuccagccugggagacacagcaagacucugucucaaaaaacaaacaaacaaacaaacaaacaaaccacauuccuauguuaaaguucuaaaccucaaggugacuuuaucuggagauagcgccuugaaagaagcaauuaaaugaggucauaaggguagggccuuaauccaauaggacuagugcccucaaaaggacaggaagagacacuaggagagugaagugaacaggaagagacaagggagagugaagaugcagcaagaaggcagccaucuaucuacaagacaaagguccggggucuuaggaaaaaccaacccuaugggcaccuugauguugaacuuccagucaccagaacugugagaaaauacauuucuguuguuuaagccacccagucugugguauuuugcuauggcagcccuagcagauuaauauaaauaucuuccauuuuugucccauauuuuccccaguugaucugaaccaaauuuuuaacuuaaacuaugaaacuaugaaccaugcugguaacuguuaaaucuguauuucucauucaguccuuuucucuugagacacacagucacucggauaccuaauaagcauuuaacacuuaauauauucacaacugaacucauuguuuuccucucugcaaaucuacuuuuucuacaguauucucuauuaucugcaauuccccuuccuuccuuaucucacaucuuaucauggauaaaauccugcccauuuaucuucaguguuuuguugaucuaucucaucgccauuccuacuuccuuugcuugguucagaccuccaccaucuccuucugggauuaguacaguggucuccugauucuauucuagcccuccuucuaaucauucuauacucugcugccagggaucucuccaaaauaccuaucugguuuucucacucuccugcuuauccagcaggaucuuccugcuccuuucaggguaaacuccagaagacuccuuggcauggcauguaaggucccugacaaucuggcccuggccuacugcuccaacugaccucccuucauucccugccuucacacucuuugcucuaaguauccugagcaaacuguacuucucuggaugggccauguuuucucacucccguguaucuuugcaaaugcccuuuaucgcauacuuuguuuaucuccaauucuuccuucgaaacugaguucagcugugaccuccucuaggaagucuucacuggacccccacaucugaguuaggcuguaucacaaacauuuaucccacaguaauauaauagacugucucuccacaagaaagaauuuauuaggguuuucauuucagugucuucaucacauguaacuauaugcuaaggauauaaaacaaugaaauaaaacauauuugcauuuucaaaaggcacccaacuacauuaauuuucuugaugaacacaguagacauaugaaauguacuuaaaauagguguugugccaaagcaucauuuacacagaucauccuaauguuuacaguucuccucuggcauguauaauauaccaccuguauaacaguuauccagauagauggcuuauuuuuacuuuuuaaaauaagaucuuggaggguaaagauuauaaccuauacauucauaucuucuagggaguaugggauaucuuguauuuaauuauacauuuagcaaauaucugcugaaugaacaaaaauaaguugucacucaucuuuauauagcauucauaaaauaguacauuguuaugaaauagaauaucacacucaccaacgguuucaauaagaauuaugucauaucccgcuccuucacacaacagaauagcuucauuugugguccuugucacgccuccuaaaguuccucuaguaggagauggccugauguaugcauucauaucucuugauaacucagucauucggguuuuaucaccuaagagugauccuaaaacauacaguuacauuuuauaaucauggaacaguuuuacgggucaauuaucagccaguuccuagagggaagugcuuuaugccauuucucccuaaaucucaaacugcauuucauauuacugagcuucucuccaacucauuguauacaaugaugucagauuaaucuuaacauuucaagccccucaaaaucuauaauuuauagcuucccccugaccaaagguuccaaucuagauucuucagccgcaccuuaccuguccaacucuggcuucuacuaguccccacaccaauccucuguuccaaccagggugguuacuuuacugucaucuuaacaucacuguguuugcuucgucccaucuuuuuuguuugugcucucaugccagaaguaucucuccugcuuccucacugcuaaguuacaaugugucaagcccagggucuguauucuggcuccaccauuucacacuauucaauuuugagaggucacuuuaccuuccugaauccucuuuccucagcuacaucacaaggguaauaugcuacugggagaagcaaauguaauuauauacaggaaugugcuucaaaaaccguuaauaacaaaaacacagaacuuauccaccuuauaaagaucaguaaaaguccuugcuccuucauauagucugccuggaaccuuuucagcccaugcccaucucugugauuuucuaagguacaacagcucugcaauguaugccagcauccuggagggcauaagagaacuuuagugucccuccccuuucuauuaucuccaugagcacccuccacuccucauucuuuuauuuuugcaaaugacauuuucucaaccuuacguaaaugcuacacaaauauaucuucaagcugccccuucugcccagucuguugcuucuaaucgccuacuacuuagaaaauuuggagcucucacugaaugcaauguaagcugaguuaauggauggaaaacuauucauacaacacauuuuuugguuucauauuuuuaauucuuaucucuuucacacagugguucucaacugggggcaaucuggcaaugucuagagacauauuuacuugucacaagugagggguagggugcuacuggcaucuacuggguagaggccagauaugcugcuaaauaagcauccuucaaugcacaggacagccacccacaacaaagaaugauuugacauaaaaugucacuaccgccaaacuugagaaaccaugcuuuaaauaagucuuugccuacaggaccacgucuuacauagguuguacacuaaaugcuuaacaaaguguuaagaguaggcacucaauaacuguggaauaaaacugguuauguuuuuguuuucauuguaguauaauauuuugacaaacaucaauacuuacaaauucuagaagacugaaaguccugggacuauuauguuuuacuacuuugcuuuagucauauaccaacauuuguagguguacugcuguucuaaucugaauauucauuuucccucuuuccacauaauguuuccacauaucuuuccacauaauguuaaagauugaaaaguuucuuaaagauaugcucuuuuaccacuaaaugccaguucagagucuucucauagguucuaauucuagaccacacauguaccccauacaucaacuuccuuauuuacuucacauacaaccuuuuucuaagguaauuuucugcaugaaauaaucucuguguaaguaaacaaucugccaaagcuauacuuuaaauuacuauccuauagaucccaucacacugaaguaaacauuaggaaauuacuuuccuaugucuuagccagaaauuccaaaacuguuaauuguagacucucacgaaggucucaaagcuaucacagggggucugugaauuuaaagcacaaaaaagauugacuauagaccaaaaaacuaaugcuucucaaacuuuaauguaaugcuguuuuucaaguguaugcacugauacaauaagguagaaauuuauauucauaguguuuugucuauccuuguauuuuuuucuuucaaagucuauauaauuuuuugccugagaaagggaccacuauuuuuugagaaagguuaggaaacacauagcuauguaacuuuaaucacaggcuauuuuaugacauuauuuuugucuauuauuaucucaagcuauuauuuuuuucuauuguuaaguauucuagaauauugugaaaaugggggaauggccuucucaccuauauauaaaugagggccacuuacuaaaaaauccuucauuaaguacuuacuuuuaacaaaguucuaaagcuguaaaugagacaacauauugacauggauuuaauuuugaaccuugugagcaaaaauuuuauuuuacaguuaacuuuuuuuauuauagugacucaaaaauuuugaauguucugagcuagauuucucaaugggaugauaauaggaauggggugauaauaggaauuguccacgucuauauuaaccuaagucccuaaaauaugauuacaucaucauucugaauacuuaguauuaaacccacauuauaacacaguaugcaaaaaccaaauacuuccauaaagcaucuuguauuuaccccuucacaacacacauuguauuguaauggccuguguuuguguuuccugcauaagauguaaaccucacuaaagccaggacuguaucuuguucaccauuauauaacacaguuuaagaaccuuccauguacaaugccucaccuauaguaggcacucaaauacuugcuaagugaguaacuguaauaugaaaagcuuaaaucauaaagagggguaagggaagaaaaaaccuuuccuguuuauaugguaugcuuucuguuuucuuuaaaugauccuuuggggaacuaaguuuauauucauuuuaucgcugaugagcugcaaauuaaacuuugagugacuucaugacaucaaaucagaaaguaacugcuuaacauucugugcaacguacaauguacuaugcuaaauacuguaaggggaauggcaguauauuacagugccccucuaagagcuuucuguuuaacugaacauauuauauaaacaguugacaauuauaaacagcaguaagguuuuucuaaagcuuaagagauguuaaaacauuaugaggaaaaugacacaugaguaaggaccuauuuucugaauugcacaggugcuaaugcagccaggaaacacaacaggagcaaagaggggccuggccuuaugcauggaagcugaaggacugaaauuugcauuugaucaucuucaacuucuggcaccuguugucgcaguuuucugagugcccacugagcuauccacaagcuggccuccucugaggaguacaacacucccaaacuacuucucucagcuuccaccuaacucugcagaacucccuuccuuuagcgagaccaaacuuagcuagcaguuagaggucacccaacugugccaauuccuacuaaauuguaacagaaagcccccagaccucugcaauugaaaaagaaucagccauacuuaccaccacuaguacaagaagaaggguccacagcuagcacagauaauuugugcccucucucaguaagcauuuuuccaaaauauucuauaaauguugauuuuccagcaccagggggcccagacaauccuacgguggaaagagaucuucuaauucaaugaaacaaaugaaaucagaacuacgaucaguuuuacugaguaaaauauuagacuaccuucuauuuccccuaauguauuaaaaccacaauuaauauauuucaacauguccuaaaauggcaaauaaaaaucuguuucuuuaauuccugaguaauggggcuauaggaaggaaacacccuggguuccaaauguucacaaaauucacuuuuaaaaacuacaaaacaugcuuugccuuuguacuauaaaguagaucuuucuggacagacuucauugucuccauuguuaaugugcucaguuucuacaucugcccaccucucaucaugaucaguaauuauucuaccuaccucaguucuguauacuucuucccacuggaaaaacaacucauuauucuagaaauucccagugauugagaaagcaauuuucuauuuauaagggaucaucuuuuuucuucaucucacucauaacucaaagaauauaaacugaauucugaaaaaaauaauuuauguuaagaaaagcagaaaacucccccacuuggagaguuggcagugcacggccgguaagagcacaaacccugaagccacgcagccaguucucauucuagcucugccucccacgagcuaugugaucuuggguaaauuacuuaaccucuuucuaugccucaguguccacugcaauaaaauagauauaguaauaguaccucucucuucagguuguuuuaagaauuagaugaguuaaugucugcaauauguuuagaacagugcauggcauaagagacauauaaguguauguuaaaugaaauauauaaaacauagacauuuaacuaacuacacucaaaauauguauaguguaugggaugccugacucuuuaccacaauucuuggggcagauccaauacuaucuuaaacaccuuuuuaggugcugaauaaacauuuguugcuuuuacuuaugguggugaaaaaaauaacugcaauaaagacagguuuaucuggccucauaagaucaagauggaagaacuggaauagcacuacaaaguuaucugugaacugcuaguuaauuccacacauuucugagacauuuuuucacagauucucuaaaaucuuaguaaguaggcacuuugucauaccuagaauuucucugcgggaguuugcuauuaucuuuguuuaccauacauaaagauuauuaacauccaagguaguacucucaaaaugagaaucccucaguaagggcagaagauuaagaagucugaaaaauggggacugguauaaauauugguuggugagcuauuuugaaauuaucuuaaagcaucuaugcccauuaaccuaaaaacuaggaggcuuuugugucugcauugccaauaaacugugagacaaagguguaauguaacaugaaauuuuaaaaguauuuacucauucuccacaaaauuuuugcacuuuaaccaccaagacaaguuguuuuuagcacgaggguugguucaaaucaccuaguucaccaccgugggacauucucauuccaccuaaacuggcuuguuuaauuccugcuggucaaacauaucuaaauuguuuuacaaugcacaauuucaaaaacaauuucagaaccaagucaaauuguucaagaaaucaaaugaacaucuaauauacagacaauaaauaaauaugaucucuuucuuaaaguacauuuugauaggcugggcaugguagcccaugccuguagucccagcacuuugguaggccaaggugggaggacugcuugagcccaggaguuugauaccagccugggcaacauaaugagaccccaucucuacaaaaaacuucuaaaaaaaauuagccaaggaugauguuggaggcaugauauuggagccaagcaugaugucagagcuaugaucaccacugcauuccagccugggugauagagugagacuaaaaauagcugagcacaguaguucaugccuguaaucccagcacuuugggaggccaagacggguggaucacuugaggucaggaguucaagaccagccuggccaacauggugaaacccugucucuauuaaaaauacaaaaauuagcugggcaugguagugcaugccuguaauccuagcuacucgggaggcugaggcaggagaacugcaugaaccugaacccaggaggcagagguugcagugagccgagaucgcgccacugcacuccagccugggcgacagagcaagacugucucaaaaaauaaaguacaaaaauaaaaaauaaaaauaaauaaaauacauuuugguauugagaaggcuggguuuacagucacuccgagaaacucaauaaaaaguaccugaaggaagugagacuugccuauagaaagacuaaugaaauaccuaagaggcagaauuuucaaacgugauaauuauaguugauacgacaacaaaacagggaauucacuuuaaacuauuuaagcagaaggacuacuaaaagaaaaaggaguaaacucacuaguaguucuuccuaugaauauuucuguccugggauccagagcaagauucuugccaaaguaaaaaucuuauauuauuuucuuaaaauacauagccuugguucaaaugucauggcaauuuuuucaacuuaacaaaacuaauauuugccaggaaaacucauuuaaaauucauccaaauauugugaaaaaagucgccauucgauugcaaacuauuuagacuuuuuuuuaaaaaacagaauacagagaauuuguaaaaauauuuacugagaaaacacacaaaaaagacugaccuacucgaaaugcuagugguuuuccuuuauuugauuguucuuguucucugugguaaaguaauacuuucugaagaagcaccugggcuaacuccuuuuuccugcugugaguugauucuacaagaguuauggccucugcuaaacaggcccuuugcccuuggauuaaaccaguauaaaguuuauccacaaaucuuugcucuuuaucagaaaguccuucugugugguccuuuaagguuguuuguacacauaauuuucucuuuaagccaucugacagcagcauccacuuuguacaauggaguccaagagaauuaaacggcugagcacaugggauuccugauccgagaugaguacuugagugaaagaugaagugguaacaucggaaaggugcucuuaaaaggccuuuuaggaaaugcuggugaggaugugguagcagcaugggcauauucguuuuauuuguaacuggagaaaacacuggaugcguuuuggcucaaugugauuguga

SEQ ID NO: 17330 - RNA, 544 nt, Homo sapiens
cuuuucacaacauggcgccgaaagcgaagaaggaagcuccugccccuccuaaagcugaagccaaagcgaaggcuuuaaaggccaagaaggcaguguugaaagguguccacagccacaaaaagaagaagauccgcacgucacccaccuuccggcggccgaagacacugcgacuccggagacagcccaaauauccucggaagagcgcucccaggagaaacaagcuugaccacuaugcuaucaucaaguuuccgcugaccacugagucugccaugaagaagauagaagacaacaacacacuuguguucauuguggauguuaaagccaacaagcaccagauuaaacaggcugugaagaagcucuaugacauugauguggccaaggucaacauccugauucggccugauggagagaagaaggcauauguucgacuggcuccugauuacgaugcuuuggauguugccaacaaaauugggaucaucuaaacugaguccagcugccuaauucugaauauauauauauauauaucuuuucaccauaaaaaaaa

SEQ ID NO: 17331 - RNA, 1379 nt, Homo sapiens
ccaaaaaacauuuuuucauuuaaaaaaguauuuagaacacauaaaacaaggcaacauuuauucuuuuuucccaucuucugguaugggaucuguugguggcuccuccacuguugggcuguugcucucugagccaguguuacuaucccugguuccuuccucugccauacuguccacccccuccugccacucuccuuguccucaggaguagacgugccuucuucaccauucuguuggcucucugucauuucuucaaggugugucuccucugucuccauuggaauguugucgucuucuuucuucuccucgccuuuguuggcugcuuguucuuccucaggaaggaugcugcucugacugcgcucagcuugcucugcugccuccuucucccuuuccuccugcccuuugcgggccuguuccucugccugugcaaucucagcugccauuuucuccauauccacuucuacuuucagagggcacaaccuuuuaaguucauuguuaagugaaucugugcuuuccaggaauuuccucuucuucuccuggugucguuccucuauuugaaguucagcuucuaguuuucgcugaugaaccauuaaggacuggaccuguccuucgaggaccugcauucuagcuguugugacaacugaccgaacgucugccaccacacucccacuaaggauuucacugaugaggagguaguuucucuggaaauggguagugacuguaugcuucauugaaaagccaucaucauaaucaucuggaucuucagcaggcugaaugcucauguacgguucuccuuucuccaagcgagacugucucuguccacuuucucccucuaaaacagcuucugcacgacuuuuugcauuuauguaagcaaaguacacgggggaauuaugauaggccuucauagauucauuguacucuaucuuuucugcuuuguauucguuuaaauauucuuguuuuucaucagugagaucuugccacaugccaccaauaaucuagccaaucucccacaacuuuaggucaggguuggaagccuuuauuuggucucagaccuuucugcuguaccucauguagggcaucagcagcuuaucugguggcuuucaggguuuuggaaugguaauagcggaggaugcccugacccagcuguuggugggcggguuuccucccagccuguaguugcugucggugagcugacuguauggauuguaucccacaaacccuggugugcugggcauuuguguugcaggagcuggggugggagguggggcauaagauggucuuuuugacauuuuggaagauuaaguucucaguuccuuaagaacgaaucugagacaccaugggcagaaaaagcgccugcagcuccagcuucacuucccuuuacg

SEQ ID NO: 17332 - RNA, 477 nt, Homo sapiens
cuggcccggcccucacgugcaccaugucuggcuccuccagcguugccgcuaugaagaaagugguucaacagccccggcuggaggccaggcucaacugcauaaaaguuucccaggcagcugcagacuucaaacaauucugucugcagaauguucaacaugacccucugcugacuagaguaucuucaaguacaaaucccuucagaccccagaaaaucuguucuuuuuuguaguaaaaugaauuucaaaaguuucccaaaccacuucuuaugauccaguggauauucaaaagagagcuaaauuugaagccuguacaaaagcuuaucccuguagcacaugugcuguaauauacgaacuucuaguuucaucagucuuuaacaucuaccucucugaauuucaugaauuucuauuucacaaggguaacuguuuuauccacacuggcagcagcauacaauaaaacucaguaugaaaaaaaaaguu

SEQ ID NO: 17333 - RNA, 676 nt, Homo sapiens
aauuuuauauauauuauaaauauauauaaaaaaacaaugugaacaauuauugagcuucaucuucuggacaagaaugccaaguuagucucucuucauaaaaagcaauuacaauuugaggacacuucauacuugcuucuuuugccagcaccaagucugccucaucugaaucuuuccauuucaugagaaacaucaauucuccacugcugucuguggcaccaauuauucuuucaggaucaagaccucuggcaaauccucuugguuugucagcagcaucuguuuucuucuuugauuugcugucaucagauucacugucagauaaagauuuucuuuuuuaccaucuuuuuguuugccagcuuucugagagcuaagaaaugcuucaaucaauucuggacaaucuaaauuuucuucagguucccaaguauugucagcaucuguaaaucccuuccacuucaggaaauauuccacuuucccauucacuacacgucaaucuaguacuuuuuccaccacaaauucuucaggcucugccucuucaacuuuuuacuuuucccauucuguuuuuuuuccccauuuuucacaauguaguuuuauuggaggccauuuuuuauagcagacuugaugagauauuauucaccgccuccgaacugcuccgggucgcaggucugcagcaucucuggcc

SEQ ID NO: 17334 - RNA, 672 nt, Homo sapiens
uuauauauauuauaaauauauauaaaaaaacaaugugaacaauuauugagcuucaucuucuggacaagaaugccaaguuagucucucuucauaaaaagcaauuacaauuugaggacacuucauacuugcuucuuuugccagcaccaagucugccucaucugaaucuuuccauuucaugagaaacaucaauucuccacugcugucuguggcaccaauuauucuuucaggaucaagaccucuggcaaauccucuugguuugucagcagcaucuguuuucuucuuugauuugcugucaucagauucacugucagauaaagauuuucuuuuuuaccaucuuuuuguuugccagcuuucugagagcuaagaaaugcuucaaucaauucuggacaaucuaaauuuucuucagguucccaaguauugucagcaucuguaaaucccuuccacuucaggaaauauuccacuuucccauucacuacacgucaaucuaguacuuuuuccaccacaaauucuucaggcucugccucuucaacuuuuuacuuuucccauucuguuuuuuuuccccauuuuucacaauguaguuuuauuggaggccauuuuuuauagcagacuugaugagauauuauucaccgccuccgaacugcuccgggucgcaggucugcagcaucucuggcc

SEQ ID NO: 17335 - RNA, 4825 nt, Homo sapiens
cagaaaaccucggaucaauucucagcugguggcacaacaaguggcacaacaguaugccaccccaccacccccuaaaaaggagaagaaggagaaaguugaaaagcaggacaaagagaaaccugagaaagacaaggaaauuaguccuaguguuaccaagaaaaauaccaacaagaaaaccaaguaaguuucugguuaacuaaguacaggauauuacuuugcaagugaauucaagauaucuucuaaaugccuguuuuuuuuguuuguuuguuuguuuuguaucucccucauuuagaccaaagucugacauucugaaagauccuccuagugaagcaaacagcauacagucugcaaaugcuacaacaaagaccagcgaaacaaaucacaccucaagguacuuggaaacuagaaugacauacuaaaucacugcucugauuuacuuaaucguaaucaugaauccagggugguuuugugccuuggguuuguaggcuaagaaggugaagagcuaaguauggguggggcuggugacuuuuucucuuuuuuaaauacuguggccagaacaggaaacagauaauaguaauuuuacauuggucccaagcuuugcuauccgugcuuguuggauuauugcuaaaacugaguagcacacucuguagucggcuuuggcaugugugguaggcaguucggauucauugccacagugucaugaagucuugugcguauugaugauauucugccagaagcuguuuuugauccauaacuuacuuaauuggcucuuccccugugguguugcuucuaggccccggcugaaaaacguggacaggagcacugcacagcaguuggcaguaacugugggcaacgucaccgucauuaucacagacuuuaaggaaaagacucgcuccucaucgacauccucauccacagugaccuccagugcagggucagaacagcagaaccagagcagcucggggucagagagcacagacaagggcuccucccguuccuccacgccaaagggcgacaugucagcagucaaugaugaaucuuucugaaauugcacauggaauugugaaaacuaugaaucaggguaugaaauucaaaaccuccaccugcccaugcugcuugcaucccuggagaaucuucuguggacaucgaccucuuagugaugcugccaggauaauuucugcuugccaugggcaucuggccaccaaggaauuucgcacccugacgauuacucuugacacuuuuauguauuccauuguuuuauaugauuuuccuaacaaucauuuauaauuggaugugcuccugaaucuacuuuuuauaaaaaaaaaaaaaucugcugugcacaauuuuccauguacauuacaacugguuuuuuguuuuuguuuuguugccgguggggagggcugggagggggagggaacuuuuauuuauuguguucacaaacuccauccuuucagcauauccuuuuaaguuuaguucuuucuuccaguuauacuauguacuaucaguuuugauauaacuauauauauauaaauauaaaauuauauauaaaggguuauuugaaaccaauccauggcaacgcuggugcuugauacacugugaagugaauacaacauugaacaguuacagaucugggacagucccuucuaugaaagugcugaaauuuaauuaaaaucagucuuauaugaaguauguuccaauccaugugggaacuugacucucucaucugucuaaagaguacuggacgauauaaaaauauauauuuuuuaaacaaugugaucucaaauuuaaagacugcuccagauagccugcauuugcaauggaauaacugacaaaucacaagugguuuaguugggcagggcuuugaucauucaaaaguaacuaaaguagcuccagaaugccaaguauucguguaaauuacgguuacauguuaucauuugcuguucuuacauaagcacucaugaaaauaugguauucuguaacuugaauuccauccauuuuccagaccucuacucaugucugagguaaaucuagaaauugucuuaguuuuaggauugaaacagucuauaaacuguauuuuugguccauccaggaagcuagucccuuguuucuccuuucuacaugacauugcaguggugguuucuguaauuaaaauuuguuugccucaugucccuuugucugauaaaccuucacucuaccgauucaguugugagcauucuuuuuuuccuucucaaaaccuacuaugauuuguuuuacugaacaaagguuaucaaccacacauccaguccugacauggagcuuuucaguguuuggagacauuucucaauccccugcugugguaggaacuccaguggugaacggcuugcgcgccugcagccagaguugcagggaaagcucguacuuacugcgagcagcauguaaucuuuuuucuuccuggacauaaagauagcuugaguaaacuguucuauuucauucucuucacucuuuuuacugucuugcaaaaaaaaaaaaaaaaaaaauaaucaaagaccacuaauaagauuccaccucuccuuauuaaaauaauuuuuuaaaauuuuguuuugcuuuuguuuggauguggggucucucuucuauuugacuuuuacauuuagauacagaguuuguaguacuucagagacauuucaagcaugagaauuugagguuaccucucuuuauuugaccuuuagggacucacgggagggcagccugauuuguaaugaagcaccacauuuugguguuaaaaaccugguuugcuuaauaauagcaguaauuucugucuguggaggcaacaaauaaaaaaauuaacagcuugaauugaguagccaacaggaaagguuccuuucacauuuacauuaaaacuauucuguagucacuaauguaccauaauuuaaauucuuuucucaaagguauagauuauaaagcagugccauuuguugcugugguccuauucucaaaugcauggacaauguuccccccuuuuuaaaauaaugcuugugucugggaugcaagcuuugcuuaucuuuuuaaauacauuuuuaaaguauuuauuaaugaaccaaaggaaaucagaugcuuucuauaagcaucagaauauauaauacauagugauuugacuaugaauuuuaaauccacauuuuaauauuggugggauauugcaaagacauuccuucuaaaguuuuaauauuccuuuuauuaagggucucagggaggguaaauuagucagccauauuuauuuuccagagguuuaagaaauugcuguuuuuaacuuuuugaaaaaacuuaaaugccaccaaacucauguagguugcacugcuuauugaaccaauaacuguugguaugcacuuuguucagacacacuguguacuuuuucaaaaacuaguuucauguaaagugauuggaccccauagauuaguggaaaaagcugauuaaccagcuacucauaggcugcuaauucauucaugccaauguuuugguuuuucaguuuugccuccgugauaaauuaaagaauggggaggggugaaggaaggggaagaagauugcuuuagaacaaguggcaugaaauuaccaucuuuguagaaaccgcagcuaacagugggaguuaucuaagcaaucagauguuacagggccagcccuuuagcugcugugguguauucuguuggguagugagguaguagguacuuuauagacuuuuaauuuuggaaauugaugacaucccucaggcauguauucuggaaauggaauuccuguaacuuccugugucugcaguaugcccuacaauuaguaggcagcguguaaaaacacuaguguagauuauaaagauauacauuaaaagaggaccagaaauacuugguauucaguggcacagaaagcagguuaaacaaacaaaaagcacaguguuacgcuugcaaguuuccauuuguuuuaauaccacgcaaucuuucacacucgugcgugugcgcgcacacagagcuuaccugacuugcucugcuugagucaugcaguuacaaaaaaaaagacaucuugacacccacacaauauucuaaucaaaaccuuucaguuucaaucuggauauuuaaaaacauuggcagaagcuucugugaguuuaguuccacuaagauguuucaccugccuuaucaagaccauucucagucuacuuuuuuaagcuaccguaucuuaaauuauugaaaauuuauuaauugcugaauauauaauaaccuuugcuuguauguaaccgaaaaugguuuaagagccaacauuuagaguaugacaauggagcugaacaguuuuuaaugcgcaagcaguucuguucuuguguaugacuuguaaccuuaauuuacuguguaaagaugguuacauuauuuccuuagcuuuguuuguuggagacaaauagagaaugcuuguuaaguaugucaaaacaaucuuaucuugugaauuuuuguuaauguauuauacgagcuauauuuuucauuugcccagaaagacagcuuguauaacgcuuuuggaaguuucugcucuguaaugucuuuagagcugacagucuguuagguuuguuuuuuucuucaugcuaaagugucaguuggugguuuugugaacuggucaaaaauucacaggucuuaaauguuuugggggaaauuuauauuggacacugcucuuugucuagcaaauaaaagauguuaauauauuccuguuacuggcaugugcacgacuauguuauuagaagccacuuuaucauuuuccugcuuuaaauagaaaugucuauuuaugaauucugcuuguaguuuuuucacaaauaaaauaguaaaauuua

SEQ ID NO: 17336 - RNA, 664 nt, Homo sapiens
uaagugucaucuggcaucuucuuucuguagccagguaacucuuagaucuuauucaucagccugcugaacaguuccuuuuucagagacauagauaccauccaaaaauuuccugauauccuuguuuuuaacuguuguggcuugcugaaucaaagccgcugaauuugaaacaagcucaaugucauuuccuucaaggauuaauucaucuuucugggcuugagauacugaacaagcaacaccuggucucauccgaacccugcggauguauuuuucacccaaaaaauuucggauuucaacaagagacccauucuccuggauaacaacguugauggggaagugagcauacacagaccucaucuuguaacggaagcccaguguaacacccuugaucauguucuguacaugacuacaaauaguccgaacgguagccaguuccuuucuguuaccccaccauuugucaacccggagccucuuuuuuuucuuuccaagaaggcugaguucuacauugaugugauugaagucccuccgcaggguuccucuggggcccuucacgauaacugugcgucccuucagaguaaugucgacauuuucuggaaugucgacagucugauugcugagaauagucuucauucucgcaguagacgcagcaaagaaagccuaauuucuu

SEQ ID NO: 17337 - RNA, 4701 nt, Homo sapiens
gccugcggacugggcccagcuuguccucuaugacuuacccagaaggcaacgcuucucuuucuggucaaaauggcugguaagcaggccgguaaguaacugggggucuucuuggccggcaucgucgcgcuucaccguuuauuuuugcugcagcuugcuccguuuucucucuucuuuguaaguggccaaguuugucgcggaagggaaauuggcugcuucaguccagugaaaaggaugugcuuccccacucguuugcuguccccagggcgggcuugccuguauaggguugggauguuaacccgcuguuugugaaggugcccgcgguggcucugacagcccuggaguuccagcugcccgugcuuggaaguccuuccccuuggccuuagaaaaguuaaagggcacaagaggauaacuaguggaugacuuucaacccgaaugagcucagugcuuucuaugacccaagugcucuaucgugugcauuggcccuauaaauuuucuugccauugcgacgagggagauauuaauuucccuuuuacgcugauaagauaacugaggcaaagugacccaaggaaguagaauuggaaauaucauugcaccccucgcgcuucucaaacugcgaaucagagacaguugagcaagggauacgagcgacgcuucagguugaccuuggauuaucuagagcgucagcuugaucaguagguuuggagaaauuugaauuuauuguagguucuuuuuuucuuuuuucuuucuuuuuuuuuuuuuuugcuaaucucugcccucuggcgguacaaguuggaguagccguuuuguuuguuuguuuguuuugucuuugagacggagucuugcuuugucgcccaggcuggagugcaauggcacaaucucgucucacugcaaugcaaccaaguuggaguagcuuaaaaaauguugauccuuuucuccccgcccccagcaauugugaagcuguuaggaaacaucagguugccagaaacauccguuaaccuaauugacauugagcuuuuugggggugggggagacuuuuuaaauaauuauuuuauuaauuuggcagauauugaaggagucuuacuaaauucaagacacugcuucugugcguguuugggaacuacauagaccagaucucaacucccauuagcuaacucugaccuugggugggaucacuucuguaagccagcuuccccuucuguaguaacagacauguaaauaaaucagcuaauguugguaaagcaaauaggaaaguguuuggugcacaauaagugcuuagugaauauuauuauagucacugauaggugguugaauauaaucugucuuccacaaguauguuuguagauuguugacugauacuuguuuuucuagcagcaguuuuauacaugacucuuaauuuccaaggagauuugcuaaagccacguaaucuguagugcacugaguuugcaagcaaggagaguugagugaaaggagaguuugcuuuccuuccuugguaagggcuaacccuagacaaaauuuuaaaagagaauacaaaccuguucuaccucuccuuuuguaaaaugucucuccuaaaaugucagauacgguccugcuguacuuggacccugcuggguuacuucaucaggcucagcccuguuccccaaacaguuuuaaaauuaccuauuucucauccuuuuucaauauccauucccuuggggggaacuuaguugcuuaggaggagguaaauggacuucuuuuacgaauccauauuaauguuuaaaugacuaaugguaucaaaauccuccccaaaauacauacauuuuuaaagaauguggccaaaugaaauaacuguaauaucgaguaaaaauuuuagaggaugagggucauuuagaccugccagucuaugcugaaaucucacugucuuuucccuacaacuccagcucucuugaaaugaaaaguuuacaauuauuuccugugaucuauuuaugaaacuacaaaugauggaaauuuccaaguccuuuuccuaucucccaccccuucauuucugaagguaacagggcaggcauaagggcacacgauguaccuauggaucuuuuguacauucaguguuugaguuuacccuuuucuuucaugacuugccaccauuuuccugcaaccacuuuugcucauaaauaaaauaagcacuuuuuaucaacauuuuauagaguauaaacuuuuuucuuuuaaaucuaauucuuuugauuaaauucuugcuguauauacuauauacuuuuaaaaggaaauuuauuucuauguuugcauucaucagcaagauaacugaguacugguugcuugccuaucaauguguucauauaguauaauuaaauuguagcaauuaacagugugacaauuaucaguuucagcaucaggcaaguggcuggaugguauucgaaaaugguauuacaaugcugcaggauucaauaaacuggguaagcagcugugcuguuuaauguuuuuuguuguuguuguuguuucuuuguuuuuuuuuuuguuuuucugagaguauugcuuuugcaaguguuacugugguuccaaaaaccauuucaguucuuguauacaucagaagauuuuaaaauuaaaucacauuauguuaaauccaguuccuuuuuaaaguuuuuuugagagaagagggaugaaagccucuaaaauguucgacuugguaaugauuuaaguaguaagacauuuuccuucuacacccccuuucccaacucuuccacuuaaaauuuuauuuauuuauuuauuuauuuauuugagacagagucuugcucugucaccaggcuggagugcaguggcgcaaucacgguucacugcaaccuccgccucccgaguucaagugauucuccugccucagccuccugaguagcugggauuacaggcgugugccaccacgccuggcuaauuuuuuuuguauguaguagagacgggguuucaccauauuaggcuggucgcaaacuccugaccucaggugauccaccugccucggccucccaaagugcugggauuauaggugugcacuacugcgcccggccuuccacuuaaaauuuuaauuuaaauuauauaaacauugaaaguagagaguuuuugaauauuaaaauuuuaucacguccaugcaaucauaugauuccuaagcuuuuuuagaacuuuguaauuuaccaugaacuucaucuuuuacuauugaagcuugaagaaaguguaagcaaaagucacuguuccuuaguauacuaucauuuuaagauucuuuaauaccuugaucucagauuuaaacuaugagaaaaaagagaugugguuuauuaauguguguuuaaaaacaaaguaaacauuuaaaauauuuuguaaaugguuuagauaaaauaugaauuuuguggcauuggauuuuaagaggcucauauauuguuuccauagucuaguucaagaaguaacccauuauaucaaguaauaacucauuacuuuuaauggcaaaacugcaauuacuuuugcaccaaccuauaauguaugaaaugcauugaauuuccauugaaccuagugauuugaauucgauaguucaccaaaaguuguaaguuauaagucauaaagguauuuuacuaauuuaaaaaaaccgcgauuuuugagaugcaugugcaaucuaacuuugucaucuaucauaggguuaaugcgagaugauacaauauacgaggaugaagauguaaaagaagccauaagaagacuuccugagaaccuuuauaaugacaggauguuucgcauuaagagggcacuggaccugaacuugaagcaucagaucuugccuaaagagcaguggaccaaauaugaagagguagcacagcuuuaucuaccugacaguguugcucauuaaggauggaguuuuagaaacaagagaaacauguucauuugcauaguguuagaguucucugagucaugucaaauaaauaugugagguuaauaaagcaaauguuauuuccguuuuagaagaaaaccacauugagucuuacgugugaaaugauucuucugaaauuacuaagcaagucucuaauauagagagccaggacuaaaauccaggucuguugccucccaggucuuugcuguuccagcucugcacucugcuuccuacuuagaugaaaagaucagcccauugagugucccuccagaucccaagaagagcuucugugaagcaaacucucaccccuugaacugcauugaaacuaggcaaaggccuguggacauucauuucuuuuucuucccgaaaagacuucccccucauaaccuaucaaagcaacuuaucacaccaucaccacagauuugacauuuuaaaaagcagauaguucuuagguugagaauauguuuucuaaaauuggaaauucaaaaguaauugcuuuuuucuuguuauugaagaccuguugaguguuugggauauaucaguacgugaugguaacauauaauauuucauucauucuuuaggaaaauuucuaccuugaaccguaucugaaagagguuauucgggaaagaaaagaaagagaagaaugggcaaagaaguaaucauguaguugaagucuguggaugcagcuguuaugaagaugguuaaacuugaaacaaacaauuuuaagaauuauuuggucugaagauguuuuacuuuaaauaaaugucuauuguaauggcuggaguuuuugaauuccaaaccuuauacugaauaac

SEQ ID NO: 17338 - RNA, 30821 nt, Homo sapiens
guuuuuacuuuuaucuuuuuuuaaaaagaggaaaccaaaagcuauuuaagacuguugugaaugauacuguggcucaaguuuuguucagguucuuggcuugugccacaucguuuuucagguaggugguaauacucucauuuuuaggauaaaggagcugugguacggaucauuuggggagcuugucuacaggguugcacuuaggaaacacagauucaagcccaaguaguuucgagccgaucaucugauuucugagccauggaauuagaguuucauucguacacucuccuuaauuugaugaauucuuauuuaggcucauuugagauuagugcugaaaacaaauuuagaaaaggccauuucauauuauguguggguauuguugcauuguuucuuaaagauugagggagaauuaauaucuuuagguuguuacugcuucauuaaaaagaggaucuuuuuucccccauuuuucaguuucacuguuacaugccuugaagugaugaggagguuucuguuacuauaugcuacacagcagggacaggcaaaggccaucgcagaagaaauaugugagcaagcugugguacauggauuuucugcagaucuucacuguauuagugaauccgauaagguuagagccguuacaguggauuuuaccguuuugugcuuugaagaauuuugguugggaagugauauuuaugaaacaaaaggacacuaauaccaccacauagucuuuguuuuuuaacagaaauguguuuguucaaugguauaguaagauaucaccagcauuuuuuuaauauagaaguguguaguugaauuagacuaaauggucucaaaaauugaaacaaguaacaacuccuuaacuguaaaugacagaaguagcauaugcugugucuguuucacaggguggcugugagaacaagugagauguguguuugccugcucaggugugcuuuccaccucuugaaucucagugucccacuuuuuuccccaaaagaaaggccuugccgugcguguuagaguuccuccugaugaaggaccgccuagauucuuuugugaaauagaauuuaaaguaguaguguaaggaucuggaaaaaacucggcugcuucuucagggacuaguuguuuauguucagucucugcagaaguuccuaccuuaggguauaugcaacuuuaccaucuuguguucuuuuauuuaguuugcugccuccagauuauacuauuucagacaauucaggcgauaacaguuggcaggggcuuuauaccacaagaugauuugccagccgcuaagcaguuaaaauucacuucaacauuucagagacuguccugccagugcucucucacccaagugcacaacccucucuggccuuuccuaaaacuccaguucagaacacuagacugugugcagcucaagugaauuauaaacccagcucacggaaggagacucaccuaguuccuuuaugcagcccugccacgguaacucuggacaccagagaaaagggagcuuccuggaggagacugccagucagcagacucugucauucuacaguaacuuaaguucagauugcagugccacaugaugaaguaucugaaucuguuacuuuggacaaaaccaaagccaucaguaucauaaaacuaguccugauuuggccccuugugguugaccucaguaaguugaucagcagguguuuuggcagucagaugaauggugaauuuuuuuuuuuaacaccaagauagucaugcuauuuauccucccuggcugaugguuucgucuagcuguucauaaucuaauauccuuccuauuucacauaguccuuuucaagguacugacauuacuuauacaaacucuguauguagaguuuaacacacaacuuacauagagucuuggaagcauuaaauacuucgguaaaaaguuaaguuguuaccucuuuuaucagugugaaaaauaaggugaauuauuuggagccaaauucgaugguguucaugggcaguaaagcuuguggagucuuacaaguaagacaaggaaguguucuauuugaaauacuuaaauuuacacgagaguaagaauaaagaaacuugauuuguaagaguuuauagcucagcuuauagcuaaugauauucucagaguuaagacagugaaaugcucuauaugaaauauuuaaacuuacaugagaauaagaauaaacuugauuuguaagaguuuguagcucgcuuauagcuaaugauauucucagcucucuggaaaccugagggaaugagcgguucuugauagccaggucccugauuuagaagggguaacacuuuuaauuucccaguuuuaaaaugcccuguuaucccucugccuuagugucacaugcaguacacauggcugguuuuauauuuugcugaagauuucagagcuguuguguuuuuauugcuguuuuucuuuaccacaguauucuacuuguugcuuccuugucuuggcauucuaauccugagugcuuauguaucaguucucuuuauuucugagucuccccauccccauuuuaacaccucuuuccuugcuuuuuuuuacuuucuuaugaaaagacguuuccacccaguuagcugcuguuccuccuuggcagcucaucacagugccuaggugccucaucuuggcucuuagcagugcugauuugccuugcagauuugagcucauguuaauguuuggcccaugacucaguggcaaagaguugacuauauccuauuuccucugauuuuucuaaaaaugaaagacugggacuagauggaaaccugggauggguacugucugugccugucccugccuuucguacacaacaugaagagaaagacguguuaaucccccccaaccucuugaugagcaucaacaaaacagacgcaugguuuccuugaaugacauccugcauuaggcaaauugauuaagcugagagcgccuagucacuggacuggucgucucaaaaaaacuggcaaggaagaagauugaaauacaagacaggaaacuaagcugauugcuuugcugcugaguuaaaucaaaaaugcauguaguguuaggucccugacuugauauccuuguuuuguaguaugaccuaaaaaccgaaacagcuccucuuguuguugugguuucuaccacgggcaccggagacccacccgacacagcccgcaaguuuguuaaggaaauacagaaccaaacacugccgguugauuucuuugcucaccugcgguauggguuacuggguaauggacucucucuucugaucuuacuauaguauacuauugauaucucugguaucugaauuaucuuucagaacuaugaagugugaucauauagguuuugucuuucuuauguaaauauuauguauauguauauauaaauguauguaaugugcuaccuuuucugaaucuuccccagacuuuaccccagagccacaccucugcagaaccucuugaguagcauuuuaauuaaggaugcaccucagaugcagccaugaaacauuuucagaauagcaguggcugggccucauccuaaaccuacugaaacaguccuugaagaagcaaccccucaugccauuccuccauuuagaaaagcagaacaaaacaaaacacucccaaugauuuugauaacuucucuaagaacgauucucccagaaugaaugauuuucauuucccagcuacacaucaggauuagcuaggggaguuuuuacuaaauuauaugacuuaggcccaccuccagugauucugauguaauuauuccaagguagggcccuggcaucguuauuuuuaaaagcucccaggugauucuaacauauguaucccagguuaagaaaaacugacuuaggacucugugaaccauaguuuaaaaauguuaaaggaucaaaagaaccagaucagcacaauaugauaccagaggggaauugagggucugcauuccugacuugugaccuauguuguuuuaucuuugaggauuauuuuuuggagaggguaucuagcaaggauggguugaguauaauaaauaacugauuagaaauuugagauuguaacccuggcaaugaucugucauauauaacauguucaagagaguauuucacaguauuuauaauuuuuuuuuuaccuuaaguuuuuauacuuucuguauuuucaaagagagaacacauacuuguuugaaaauccagaaaagacagaaacagaagccugucccacuguucgagucaauguuaggccuaagcguggaaccacucauuucucacccuuuuguagagaaagaacauggagaugccugcacaacugagggauuuaagcuuuuuuuuuuuuuuuuuuuuuuacaccaugagacauagaagcaauucuugauuuccccaacacagaaacauaccacauuguuaauugugguuauuuauauggcugguguaccuuucuuucuauaucaggagucaguaaacucuaugaagguccagauaguaaauauuuuaggcuuugcaggccuacucaacgcugcuguuaugaauaauauguacacaaguggacuugacugucuuuuaauaaaacuuuauuuacaaagaaaggcagugcaugguauuugucccagaagcuaugguuggcugaccccugcucaguaucagaaaaaauguacagaugacagauauugugguuuugcaaccugucugauccuuguuuuaagauuucuauauuuuuacacauagucauggagaugaaaaugugaagucuuuucuuucaacagcggccaauaaguauuuuguuucauuauaucugcuacuuuuauauuguaaaauagaagaaaacugccuacaugcauagaauuacucaaggaaaauaaaaugugaagcucugcauuauuacuccauccauaagagcaugaaauaguauuauuuuagauauuuuauuuaccuagucuuuguguccuuaaauuuaaacuuuauugugcauuaauuauguauuuggguucucuaggucucggugauucagaauacaccuacuuuugcaauggggggaagauaauugauaaacgacuucaagagcuuggagcccggcauuucuaugacacuggacaugcagaugacuguguaggguaagggcaguguucucuguuuacuccaauaagcccucuauacaugauggaaguugauuuguaaaacaugucagcuuuucacuuaacacugaaauuuuccucauguuuuacuuuuguucgcuuuuuuagcuuuaggauccaagagggucagccagagauugauuuaccuauuuugcugauuuucuuuuguguccaucucauccuugucaguauaugcuaacggcaagaguuagaaaaggugcuccaguacaguuaucuuuauuuuaaacaguguagguauuugcagaaaucagcuuguucuuuaggaacuuuaaucgugcaugugcuucucucugccaugcacguggagccuuuggauugggcucuuuacauggagggagccuggugagccacacuucgcuguuagagaacacaggucugugggccuucgcugcaggcugcauugcuuggcgugcucuuaccgucugaacggccauuugccaccaugccaaucagacguuuacagacgcauacuuuaucuuuucauuacuuuuauuuuuguuuuuacaagucaguauuucacccauugugccaccuuucaaaucauccugauguguuuauucagugguccuacagauauuguccuauaacuuacuuagccuucaacuauuuuagccagauaacagcacacacccuuaauuuuuuucuaguagguccauguguuaauuuaauuuucacucacuauguuacugaauaaucuguuuaugagaaaauuacaaauucagcaaaugucuugcuuuucggcauacuguauuucugcugaacucacccugugcccacuucuuccgucuuucccuucagcucugaugccauggguuuuuuccauaucgccagcacacauauucuuccugauugugacaaagcuuugugacauuuccuugggaauucacuuuagcucuguaccuuuauauugagcuuuuuucuuuugccagaagcucauugacauuaaaugcucagucuuguaugagcuguguuuaacuguuaauguaaugcuugugucauccauuaggcccaucacucauccauauuucacuucucuucaaaggcuuucauuuucucuguugauuuauugguguaaguauugaaaugcuugacuguauauuucaguagacuauagugcuuagauuuucaaccuaacuaccuuacuugaauuuuuccuuuuucugaaaugaagauauuuucaagacauucuugcuugaugugccaccacacuaaaugggguuacgaaugcacacuugaguccaauaccuggguucaaauccuugaucccccacuuacugacugagaucuugguugaauuaguuaagcuuuuuguuccuugguuuuugccucugugcaauagauaacaguaaucuauuuacuguguaagcuucguaggagggucaaacggauuaauacaugucguccucuuagaagagugccugucgucauguaguaaacacucagugaacguuaguucuccuccugguugugcacacuaucaccuuaauauuucugaguugugagagugauauuuuacauguagcuguuauuguugaacuguaguuuuauaaacuuguuuucacaaaggcuccucagggcagcucuaauguguaaccacauuuugaguaguguaccacaugagcaccucccgagcacagugaaaugacaaccugagucauaaugacacacgggccugaaaucugccuccucuugguauucauuucgcuuuaggaauuagaauuuaauugauccuccuuugagcugugauuaaaagugguguuauuuccacagcccugccacagucuuauccacugacucuacuuaaacuucucuguucagggaauggcuguuguuaugauaauuuguuaguaguagguggacugccacauuuaaaaaaucuauuuaugaugaauucaacuuucccaaaggaggguugcuuuuuuuuucuccuguugucagccucccugggaauuuuacuaaaauaaaaaaauaaauaaaggcuuuaacuauuuauuuaguccaaggacuuggcauuaauccauagugauuucuuggugauauuuuaaucuguaggaaacagaucaguagaucaguaaauuggcuaggcaaaaaaaaaaaaaaaaaaaggugcauuugauggauggaaugagcauuugcagcauuaugguagccuuggauuuugguuaaguucuguuagcauuaguaugccuauuuaaaauuauaucuucuuaaaauaaaguuuaccaauucuggaauauuaggaggaauucuauuccugucauccuauuacuagaauaucuuccuaucccucuucauuucuucuaccuuuauacauacucauguuuucagcuacggugcuaaugaacacauaauauauccugcuuguuaaaacuuaaucaugaaguauuuuuuguauuccgaauggucuucauaguguuucuaacaagugcauacuuugccaaauggacagacugucauuauccuguucuguguucagauggagaacuuaggcauuuguuuuguuuuucguuuguuuuuacuguccaguuuagaacuugugguugagccguggauugcuggacucuggccagcccucagaaagcauuuuaggucaagcagaggacaagaggagauaaguggcgcacucccgguggcaucaccugcauccucgaggacagaccuugugaagucagagcugcuacacauugaaucucaagucgagcuucugagauucgaugauucaggaagaaaggauucugagguuuugaagcaaaaugcagugaacagcaaccaauccaauguuguaauugaagacuuugaguccucacuuacccguucgguacccccacucucacaagccucucugaauauuccugguuuacccccagaauauuuacagguacaucugcaggagucucuuggccagguaaggaaguuuuucuuuaugcuauagaugcuauuuaaucauggauguuugcuuugggcuuuuaaauuauuauuacauuagaagagaggucaacaaacuauggcuuacuggcccaauguggcccagagccuuucuuuuguaaauagauuuuacuggaacacagccaugccuauucauuuagguagugucuaugacagcuuuugagcugcaauagcagaguuagugguuaccacaggggccugcaaugccuaaggcauuuggccccuuccaguaaaaguuuucccacccagguauuacaaaaggucuuguauuauuacuucuguauuugaagaaguagauaagaacucaguuucaucauuauuuuggagaacuaacaacuugguuucucauuuuagaugagucaaacagagaugaguugugugggcagugaguugaguaucacauugcauaauagcuaauuucuccccacaggcaguguaugguacccugaaguuuuucuaaccugcuuaaaauaaguuuccagagcaggcagucuuugaaugcagggcuaagcccucuuucuguugaguggcuguuuggaguuccacauggacuuuucuuacaaaaaccacacccuuacugcagcuauuaccaguuuuaauuucuuguuuuuuuuaaugaagacagauuuagacauuuaagaaauaauuuggaugcagcaucuuucuuguauauuagcacuguuuguaaacaccugguaugauagcaauuuuuuuuagcaucuuuuauaaugucuuucuaaagcuuucauguaaguaugauuuuguguauaaacaacuaugggcuauuguuuuugcacuuguacuucauuauuuugugaauuguuuaagugagauaauugcaguaaguguaucucagucugguuugggaacagacacaacuuaugccuggacuggugggagcagagugcaguguugcaccacagacaggaucaguucauggcagcggggauagagauuaaucauuaaucugacuaggaguuuuaaauuagccggaagaucuguuaagaguuuauggguuuuuuccgggaggcggagguugcagugagccaagauugcgccacugcacuccagccugagcgacagaguaagacuccgucucaaaaaaaaaaaaaaaaaaaaaaaguuucuggguuuuuucuuaauagaaagugucauuaaauaggcuugaguuguuaauaauguaguuaaaagauuuaacaaaucugaaguacuuaagagagacaauauaaauaugaaauaauauacugagagaguaaagaauugggaaaaaaagaauguuuuguagggcauccucuugggaccauugccuugaggcacagagggguuggaagcaggauugggcacagugagaagcugagcugcgaugcagucucaacaaaggccucagucagcuccucuccauaugguaccuuucugccauguggaaguauuaccucuaauaaccagagggucuucuggguugugugguagagcggcaggaccuguuaacgagcacugucacuuggaucugcuguagagcccucuccugcucugggccccacgcaaagcugguggccuuuucugucaccugguauuugggucucagcaguccucccagguauggaaugugcuacccacagauccugaagagacuuagcagugguucugcuucucucuagaagugagguacaaggugcacuaguguggccuucacuugggaggggauguccugacgugcaccaaacuguuagaacccuaaaaauugugcuggcacugcaggcccuuuaauugcauagggcaugggucuuaccaaagaccgcacuguccuggcuacuccucguugcucauucagucugauagcacgaugccccugauagaguaggcuaguguggugcuuugcagguguuccacauuuauucagacucuuauaacagcaggcaggacuuaugauagcccuggggcauaauuguaaauuuauacauuguuccagcgcaaagugaacuguuucugauccucuuuagugauaggguugggaaggagcacuuugacuaaaucauuguccguguaccugaggccaugcuagucuacuuuguuaaggaaaaccagcuugcacggagguuacaguggaccuguuucuuguuugaguuuccaguaguucagugucaucccccaggauuuaugugguuuuugcaguggucaaacuggugaauuaaauggagauacgauagagaccauccccuguguccuccagcuuuuuaaggaugucauuucucucaggaugcuauuuuguuucucuuguucuaucuugguguuuagggaggaggauggcgucaaauucagagacuucuucuuggcccuccccaugaugauagaucuuaacgucauaggccaauaauucgguguugcccugugccagcugcugaguggccacuggagguccugggccaggacgccauuuaccgccuggcccccaugugccuugcugucauagaugagcuaugcugaugcuuugggucccuggguaacaacauucauuugaacccccucuuaacagacccuggaauguuugcacauuccccuuagcccaguguacauuuccccuuugggagaaggacugcagaagccauugucaaguacaguuucuauagugucucacagucccuccuccuagggaccucuucucuccuacagucaguggguugcaggucuggaaacagggcaaaggaucguuuuuauuggagcagcggccuacagcuccuuuuacaugccuccuugauuucuuuucauuguaaggauugauccagugccuuugugggcugcccauuuuuuacaucuguguucugcccuccucaauuuaggaccucagcuguguugugugcauucucuccuagcuccugugggggcauagugcucugucguauacuuucuuagggguuagucccuuaccuuccuuagcuagcccagugcuuuaguggccgagugugucgcaacaaccccaguuauuggucuagcaaccagaagaggggauggggugugguaguggggguacaggcaugugcugugggcagagguccuuacaccauccagaugcgagaagggaguucuuacucuucaugggagggacuggccacaucugcaggcucaaagaguucaagggaaucuggguaggaagauuuuuaagggaaucuggguagucaagauuuuuaaggcguucuggguagucaagauuuuuaagggaaucugaguauucaagauuuuuuuucccaguuaguccuuggcuuucucugccuucacugucaugggcugcaugagaugacugugucuuucuaagcuccugaggauguccccuggcuuaguucuauuuuaguuuuacuuaguucuuaauuggugauuuguccuuuaagcuuuuugcauuuuuuuucaagugcgagugaauuuuagcaguagccccccaagucccaccagucuucucuucugcuguuucucucuaguucucaagcaccugauggaucuugcaaggugaugcauuugcuuccacuggcacucccugcuacuuacgguugcauuguugcugugugccagugccgucugucugcucucucacuggugugguguucucauugucaaacaggcagaugauccagcucuagacuccauuuuagcaucuuucccaggcuacccuggcacugacugucacaggcugguucccaggagucaaacaaugagauguuuuuagggcauccucuugacagcaucaucuuugggcauggagggauggaagcaggauugggcacagugagaagcugagcugcugugcagucucagcaaaggccucagccaaucccacaggguucucuggagcuggugggucuucagaguuguccugaguuggaacgaagaggcuggaccuuuguagucuuugaugagacauuggauguggguugccucugaaaggaggugugggcagggguaaggugugaccuaagaaugcugaaguguuucuuucagguggcagagguagucauugucagcacugccauagccuuugcagaaggcagucuucuuagggguacaucucaguacccccacauuauggcucccagacacccagaacugaccuucaucccagcuuucccauauagccacuuauccacaguuaauugacuaguacuguuaaaauauuuuguuuuuaaacuuaggaauauagaaaaggaguagggaguauuauaaagaacugggauuuuuugcaguuuuccaagaccuacuguguccaguacaggagcugcuggccacauauagcuacucaaauuuaaauuaaugaacauuuguuaagauuaauaauuaguuucuuagugacacuaccuguauuucaccagccauauuucagcagccauaugaacagcauugccccacacuaggggguuccugugaccaucuacacacauguugcauucuuaaacaucugucacauucuucaagaucucuccuuccugaaacauuugcagacauucuguuucccuugacguaguuuauuaggaaaacuacuagaucuuuacaugaacaugccaguauuuuuauuuucuauuuguauuucagaaauucuaaugucuaauagauaaagcguuugagauagaauugagcuucucuucugaaaagcuagcuccauauaucugcccucauucauuuaccuuggaaaugaauacugaguagccaggaaguuuuguaagccccuguggaucuugcguagucacuaauugaaagaaggguauaauugaaaauugcacuuacguuuugucacauuuguuuuucaaggaggaaagccaaguaucugugacuucagcagauccaguuuuucaagugccaauuucaaaggcaguucaacuuacuacgaaugaugccauaaaaaccacucugcugguagaauuggacauuucaguaaguugcaaaauuuauuucucagcacaguaauauugucaggaugugcagaaagaguuguguggugcuugguuauauaugcugaguggugugcugcuugguuacauaugcugaguugugugcggcuugguuacaugugcugaguuguguggugcuugguuacauaugcugaguuguguggugcuugguuacauaugcugaguuguguggugcuugguuacauaugcugaguuguguggugcuugguuacauaugcugaguuguguggugcuugguuacauaugcugaguuguguggugcuugguuauguaugcugaguuguguggugcuugguuauacaugcucagaagaaugagaggucucugacaggacaucuugccauuuuauuccugacccaucauuuuuuucucucuucuauuuucacaccuauuuucuuuccacuucagggaaggacuagggaagaauggcuggaggagauucagccugagaggaagaugcuggcuuacucaauaagccaugaaagaauaaugggaucagaacagcauuuuauauauaagaggcccaggaaaggaagcuguccacuaaggucagccaggaaguuagaaauagagccuaaggucaaacgagguggcucucgccuauaaucccagcacuuugggaggcugaaggcggucacuugaacccaggaguuccuggguaacauggcaagaccuugucucuacaaaaaaauacaauaaguagcugggcauggugguguguaccgauggucccagcuacuugggaggcugaggugggaggacugcuugagccugggagguugagacuacagugggcuguaauugugccacugcacuccagccugggugacagagugagacccugccucaauuuuuuuaaaaaaagaaaagaaauagaacccagacaggcagguuaggguuaauuccucagagcagugguuuugauuucuugagaaucuggaaaaaauuauggacucucccaaaaaaugauuacacuugucccuuaguaucuucgaaggauuugucccaggaccccuuucagauacccaaauccucaaagcucaagucccuuauguaaaauguuacaguauuuguauauaaucuaugcacauccuccccuacacuuuaagucaucuguagauuacuuacaguaucuaacaccacguaaguaguugcuauacuguauuuuuaaguuuacauuauuuuuauuguuauuuuuuauuguuuuuuuccgucccaaauauuuuccauucagguuugguugauucugaggguggagaaccugaggauauggagggccaacuguauauagaaacauuuacguacaguuuuagucugagaugugccucgaugcacccccuccaugggcccccuuccuacccuccacacccugcuggaauccauugaccuuagguuaagaaacugacugauaauccuaaaauaaguguuugaguaccucuucaaagucauuuagcucaaccguuuauuuuaugaaagucuugagagguuaaguggguuauucuuucagaaaagcaagggcacauuaaggcuguugguguagauuuaaucaaacuuccuaacagaaaaaaauacaaugugucaaaacuagaugguuuugcauccauaaauauuaauacuauguacaccaaaauauuuuuuauucugguauuuuacauuuuugucauaaagaggcaaggguuggucugugcuuaguccagucucucucccuugcuggcaagaaaugugagcuugugucauugugagaggcuccuccccagagcccuggccugcaucuguaucacucuggggcuuagaggcaaugggccuaguaauagacuugacuugggaaguggugacuuuuucagcccauguuugcucacaaccaguaucgagccagauaguguaauguuuuauacuuaaggaaauaaaguacccuuuccuguccccuaaaggaaaagaguaaaguaaggagaagaaaauugaaaaccaaugcauuugaccauaauuaguuucuuuuggucauaauguauguuuucgugugugugugcauguauguuuuuguaagagggauuuuuauauuuacauggguuauugaaaacaccauaggaccuuacuuuguagagaacaaggaaggucugacuuccauucuuuaaguaugauaaaaggcaaaacacuggguaacuaccagauuucguuuuaauaguaacugcuaauaaugaaaguauguuuauuugguuaguugggcuuauuuuuuaaaacaauuguguguuuuuuuuuuugaaauucuauuuucugaguucacauauuaaaaucauaauauugaaaacuauauuuuuguuacccuacagcuuaaacuauguaacacguauaauguauuuuuuuuuuuucauuuuggcucuucucuagaauacagacuuuuccuaucagccuggagaugccuucagcgugaucugcccuaacagugauucugagguacaaagccuacuccaaagacugcagcuugaagauaaaagagagcacugcguccuuuugaaaauaaaggcagacacaaagaagaaagguaacagcccugaugcugugacguugggguguugugggccaguggacuggagcugauggugagaguguggcucuaagguucaggguccuguguguuggccgcacagaugccuggggcucagcugcgcaucaaggucugggaacacaggcauacgcugguauugguaguuucuuaacuuucauguuaauugcacugaauaagaagauaauggauguucuaauuauuggacauuuguggacaugaaaacugaguguaaauguaguuuuugagaagcauuggccuagguuauuuuuaaaaauucuuuuccuauuauguuuacuucucauaguauguuuguuuuugcucauuuauuauauaaaauaauugcuuuuuccauaauuaagagaaguuauuuauuuuucaaaauauaaauauauuauuuacuuagaaucuugaaguaguccuaaauugauuuuuugagaagaauaaugcuaauggaguacugcugucuuuuuagcuuucauuuccuuaauuuuaaauaauuuuccuuucuuuuauuuggccuaucuugaauuuauagucuucuuauguuuuuguaagguggaguuuuuuacuguauucauuuuggggaauuuuuuuggcugaauaaacauugccacaagucauguugcacuuugaugcgcuguaaaguacuacaguaauuguguuuuggggaguguguaaaacauuuuauucuucaucuucuaugucaugaaccccuuucccgucuuuaccugaaaaggagcuaccuuaccccagcauauaccugcgggauguucucuccaguucauuuuuaccuggugucuugaaauccgagcaauuccuaaaaagguauuuuuuucugucuucuucagguaacuauuuuaaaauaugcuuagcuuuauuuaggauugauuaaacaaauuuagaauaugcccuuugcagucuuaaaaaaugugaucuugauagcauguuuuuaauauuaguucccaagggugugugcuaucaucguaacuaucaucuaugaaucuuuuuauguuguauuugcauuuaaauuuuuguuuucuauugaaaugagggcuuaaauagggcuuuuucuuagucuaaauagggcuuuuucuuugucuuacuuuuacuaguuauuaacuacguagcacauuccacagugauggaggugacugcaguugaccuuguguuacccagcuacacauugcugcuccuucuuuaauuggugacagaaagcuaaugagagcguaggauuccccccaaccaccacuugccacuuccuacaguuguuaagaucuacuuuguguaauacuacauaacuauuuauugcuguaacagaaagcuucaggaaaaauggaaggguuuugguagguaauaaucaauuauuaugugaacuuggagguagaauaauccacuagaugucaguauuguaccaggaacuguuuuuuuaaaacuacuuguaacugauuucuucuaaccagcucccggaaguggccauuaauggauacaauuuuucaaaugugccuugccacacuuguauugucagugagcauaaagaguguuguaauuaggccgccaucuccccagugugguuuucgugucguuuuauuaauguguuuauugcauuucuagucuugggugaguaaaguacuuuagagagaggcucagcucucuaaauaaauauauguauauuuauauauauauagauuuauauauauauauauuccaucuuccuuuccugguaaucagcucgagauguaauuugaguauuuagaauuaauuuacuguaaugaaagcuuaccgauuaagucacaauuuugguucagcucuacccuuuuaaaauuuguguaaaguguguguguaugucuguauauguguauauauauguguguguauauauguguguguauguauauauuugugugugugugugugcauauauauauauauauauauauauauauauauauauauggguuuuuucaaaaauaguaugcucauuggaaaaauucuggauacagaaauaacccaggaaaccaaaguauuuuauaaucaaacccucugaguuaacacuugaauuuuguuuuccugaggaaaauauggguauccauauuauaugugcuguuccauaacuugccuuuuuaacuuaaaucaagaaucuguauauuucaggauggaaagaguuuuaauggauacuauggauacaccauuauuuguugauguaauuaugggcaauugagucauuuuugcuuuuucacuauuaaaaaaggcaaacuuucuuguacuguauuaauuuuugaacacuuacuugaaguauauuuguaaaacaaauuccuuggaguagaauugcuguuuuaaaaauauuuacauuuuaaauuguaguaauguuugucagguuugucaucuuguucuccaaaaacagugcaguauuuccuguuguaguaccauaaaguuuuuguaguucuaaagugaaaaaaguauguuaaaggaaaaauugucacuguuuuagcuuuuaauuuaggagauuguauuggcuuuagaauuuacaaacuguuauugguagauguuuuuauuaucuugccaaagucuuugcagagauuuggggcguccauucagcaguguuuccugagucguuguuuuuggucaaugcugaguuuggcacuuggaggaacacguguaauuuguuaguguccagguauuuuagacagagauucuucagccaaaccuuuggaaaccugugacuccuuugggaacagugauuuuguccucccuguuaaggaaguccaggacacaaucaucuugagccauggaauuuaaaguagcaguacccauuagcauuucacauaacauuugaugcagauaauuacugaagugcuuuguuccuaaagagcccuugagaaauaagcuaugucugccuguaauuaauaacuuguaauugcauugaaauaaaaaauucuuacuagcaaguuugauguuuuguucaggaauuuagacuuugagaauugagauucagaauuuuauuaguuuuauuuauuuauuuauauuguggaauuuuucuaacaggucaacauuaaagcaaaugguaaauuaaauucccuccuccugacaauagcuccuaguggcuuucucauuuuuucuuggguaauugggugcaucccuaggcagacauuuaacugaauauucuaauagcucuacccacaaauugugucacaauuuaaggcgggcuccuuuuuguaggcauuuuugcgagcccuuguggacuauaccagugacagugcugaaaagcgcaggcuacaggagcugugcaguaaacaaggggcagccgauuauagccgcuuuguacgagaugccugugccugcuuguuggaucuccuccucgcuuucccuucuugccagccaccacucagucuccugcucggugaguagucgcuuucacaagcaccuugguggcuguucgugcacugguaggcgggccaccuuucuguaguaaagaaaauuugcugcucuugucuuacccuuuguauccuaugccuaaagaauauaucuaaaugaaugguggugauugguaaguaaacaucuuauaucuugucuucagggugcugugacaucugugugcccuuccagaagucacagaauuccccuuccagacuuuugguuuucuuuuuuuuccuuccagcagugucacuaucauuuucucucuuaauagagucaguuguuacucucuuuuuggcucagaauugagcaucuuuucuaauuuaacuuuuuucagaaagguuguuuagcuaaaugucuaaaaaugagcuuccuauaaaauuuucuuuuucaaagcuaacgaacaucauauuuaauugaaagaggcugaugcagucugugcugugugcagaaugcagaaaugcccccaucugagcaaguccagaucgaggguccuucaagagcaaaaggggacugugucguaccagugcaaaucaacauacucaugguacugccaggcagagaaccaucaucccauuucagaugaagaguaacccauuuuuuugcccagagugacucuucuaguccucauacuccaacagaagagaccucagcauugucccugagcagucgauguccuaggaccucucuguggcucucaggaagggauugaaaaugcuugcuaggggugaagacuaagcgcuuuauaggacuucaaagccuuuauuacuuucuugugcuuguaacuuugucaucuccuuucccauagugguaaguaguuaugccuuuaacauuugcauuuuucuuuggugacaccaaaauguauauuguccuuuuuacucuugggccagcaagauccuuuucgaugcccaguacaauuaaaggcacccuucuuugcaagucagggccugauuucuccuccuuuuucuuaguguuuuuuccacuuaggaccuccccaaaaugcuaagaccguguugcugaaugaggcugcucuucucaccauccuguccucaggcuggcccucucacccucuucagugaagucuucgagaaccaucagcaggaauaggaugacagaacacaggguggggaguucuaaguaguauuagaaaguucucuuaucgcauacuaauuuauuucaauucuuuucguagauuuuuuguuaccuuuuagaauguuagaauguuuguaacaauaccacauuacguaguuauauaaaaaaauuaaagucauugggacuuauaaaaaauuauauuauuuucuaauuaagaacaauuaaaauaucuaaagcuugauauuaaguugaacacccuacuaaaccuuauuuugauguuuaaaacucuacgccauuauacauagaccuuuucauauuuucaauuaaguaacugcuaaaaauaaaacauaccaaaacauaaaacauuucaaaguuuauuaguggauaguucaauauuuaaauacagauuauuuaaccugcuuuugaaagaauaccuacguauuuugaaaucacugauuuuuuuugauaaauuuuuaaaaaccaaacacuuuaauuauuuuaaauguaagauggaaaauauuucaagccuaagcauuuucaguaauucuugaaagaguagccuuuaaucuuuuugggaucaugacuuuauuuuaaaucugaaaacugggcaccucccugcagaaaacugcgcaccucccugcagaaaacugcacauauaccuaguaaggguuugcugagcuccucaccucugaagccaacuuauggacccauuccuagaagccuuugcuuuuaaaauucgccuuuggguagaaauacugauuuaagaguaagaaaaugcaucuuaucugguuuuuaacuuuaggaguugaaagaaaaaauaguaauauuuuacuugaacacaaaguucaagugcuuaacuaugauuuaaaacuagaacaugauuugaguauucuaaauaagacauggaauuuuuuuuuuuuuuuuuuuuuuuagguaagguuauuuucaguaguagugaauuaauaauugcuuguuuuuauuuuuuucuagaacaucuuccuaaacuucaacccagaccauauucgugugcaagguacuacuauuuauucacguaauauauagcauuguuucuccaaaaucuuagacucaggcuuccagaucauuagaguuuacuaauuuauucagugaaaacuuaccugcuuuauggaagacaguaccaggcauaauaaagcagaagaagaaucauagagcuccuguccucugggacuucauagaauuuaacaucuuggguggcuucccauggcccaguacuauguuuccccacuuaggagucucaggcuccuccacaugcuuccuguguccgugugcccagccaccuucacugaguggcagccggaggcaggggagacagaaaaguuccacuauaaaacauuugaugaguccgggcguggugacucacuccuguaaucccagcacuuugggaggccgaggcgggcggaucaugaggucaggagaucaagaccauccuggcuaacacggugaaaccccgucucuacuaaaaauacaaaaaauuagccgggcgugguggcaggcgccuguagucccagcuacuugggaggcugaggugggagaauggcgugaacccgggaggcggagcuugcagugagccaagaucgagccacugcacuccagccugggcgacagugauacccugucucaaaaaaauaaaaaaaaagaauauuugaugagcacuggcuuauaggauucucccuguggccuucauuccauugcacagccucuaccguuuucccgucuggcucucuguuuugccuuucaguaauaauacaagaaggugcaccauucuuuugguugaaaggggaauuaagaaugaacucaaguucuuucgcauuauuuaccguguaaugugaaaagaaaucuacuuuuguagggaugucuuuuaaagauguuuuuacuuugaauuuuuaguuuucuccuuucuggguguauacuucagucacuuucaaguuuuaugaucuuaccaguagauaauguauggauauuuguuagaauuuauccccauuucuucacaucuuuauaauaaauauugagugaaugaauccuuuacaugaagauccuuagggcauauuagauuuuauaaauaucaucuaguccuagugcaagcaaauaaaauuggaaacuuucuugaauaacaaaauguagggugugagagugugaagguugggggcaguuuuuaauuacguaauaauggcuuuccucugugaggauuuggaagguagauuagagccuauaaggaaauauuucuaaacugaauaaaaggauugguuugacccauauguguaguaguacugauaucgaguucaaaacuugucuguguaucuuugcagcucaaguuuauuucacccaggaaagcuccauuuugucuucaacauuguggaauuucugucuacugccacaacagagguucugcggaagggaguauguacaggcuggcuggccuuguugguugcuucaguucuucagccaaacauacaugcaucccaugaagacagcgggaaagcccuggcuccuaagguaagaaauuaguaccuuaaccucagcauuguuaacucauacucuuuguuucauuagaaaaaacaguguugucucacccacaucauucauuacugucauaagaaaauuuaugcuguucuugaauuuuaaaaucucuauugcaagagcagaaaacuguuuacuuccauguacucuuuaacuaguguguguauuuucugaauguauaaagcaugaauuuuauauaguacggucuuugcuuguccuauucauggaaaagaagaccuuuuauguugauauucuugguacauuggccuggggagggguggagaacugucuaggaaguauuuaaggggggugaugagagacagucucauuuuauguuuaagauguauacugccucucaaauaaguaguuuuacauugggagucugagggcaacuaaagauuaauuuuauauuguccaauuuuggcuaguaggguccccgcaucccuguuuuucugcuuuuguuaucuguggugucugacaucugaacuugugccauuauugagaagacauauggcuguaaauacuuuuacaacaccuaggaguaaaagguuaugugauuuucucaacagauuguggacacuuuacacuuggacucagugacaucuuuuuauguuuugauacggcacucagcagaauuucgagaccacguguguaggcaacaguuuaaaguuguccacaagaaugguugaaauaaagcaacauuucaggcuuuaucaugaaguccucuuucuucauaguaaugaagaaaucagugauucacuuggaguguugucuuaggagaaguuugguuucuuuauuagaguugaaagguucauagaccucaauaguggggauuaggacuucuugggauauacuugagaggauaagggaugauugcugcuugaaauugccguuuaacuugauguuuuuccagucugcugccuggaacagagagaugcuuuauuguguucucuauacaucauguauucauuauacaucaaaauauuaggaaccuuacagaaacuuucuuuuuugagaagaaauauuauaguacugauauacaaguauaugucacuuggugauuguauaaagauagcagaugaucuccagaacauuaaaaacaauguguguccaucauguaucguaaacacuaaacaugggugccuuucaccuacuccuccuuuccucccucccucucuucguccuuccuuccccauuuuaacagauuuuuauuaacuauccaaucuauaugcaguagaagugcagauaugaaggauauaauuuaaaacuaucugaaauuaccugugcuuguguuguguuuuauuacaaauuauacagaauguugacuuuugcaagaccuaucacccacccugcccuacuauggcggauaguacaguuauucacagauuaacccugccacugauguucagccuggcugugugaacagaaggacaucugccacaucuaagcaggagcacuaagccugugggcgugguguagcuuggcucucuucuuccuaucugccaugauauucucuccacauagacccucaagugaagcagucccacagccuucgaggaagagagccccagaacguagaaagugugcuguugucacaggaucuuuguacauguguuuuucuuuucugccaggaauaugcucuggcauggcuaacucccuugauucagaucguggucaaaggucucauuguagacaugggccuucuuugacauugguguuugaauuagcagcucacugccacacccaucauuuccuuauccuguguaauuuugcuuccuaagacauugggaagucauuacccaucauucuguggauauaugugauaauguguauguuuauuuucuuuuccuuccacuagaauguaaguuccguaaagacaggggcguuguuuuguucauuucuguauccuuaaugccugucauggugaauacuuucaguaaaucuguuaaaugaaugaagcaaagaaggcuaauguaauguuaacuaguuucauucccaaguaagagcaguaaugagacacagcuuugccauuccuucauuuaaaagguaugguguucaggcucgucauuacuuccuacagucguccuugaguuaaaaguuaaaauguauacaguuacaccaccaugcaagguggaggggaauccugucauucuuaaaucuugguaucaguaugacuuuugcauaugacagugaaacuggaagugaaacauacucagauugauucagaaauaucuuuugaaauuuuaacaaaaagauuuugauaauuauaugauuuguuuaguuauaacaaaaauaauucuggguaauauuggacccagaauagcaaauacagcaccauuaucuggaauauuuggagcagccccucaauuucuuuuuaaggugccugacuuuuauuuaaaauuuuucaaccucaucgugaugcuaaucuuuauugucuucauauuuaggguacauuucuccauaauauaugcuauugucugcccaccagaaagcagaucuuauccauagaccaagaaacaugauuugauuaucuauuuagaguucuaccucaaagacaccaugccuaucauuuuuuacaacauuuuuuauuugaauagaaaagaaaaauuugcaagacaaacuucuuucuguagugacaaaugugcucaugguuucaauaaaaucugaugccacuauuuagugauguuucuuugaugggaauuuucccuuucugauuuguuuagcaaagaucaucuugauuauauacucuugccuagguuuucuuucauacuuaccacauuugauguaauauuucagauauccaucucuccucgaacaacaaauucuuuccacuuaccagaugaccccucaauccccaucauaaugguggguccaggaaccggcauagccccguuuauuggguuccuacaacauagguauguucuuuuuuuggcuaaugggaaaauguauuccugaguaaccguuuuuguuucuuuagucauuuugaggauaauuggacuuuguaaaauuuuuauuuaaaaaauuauuauucaaugugcgauaacauaauuugucaccaugggaaaaguaaacacaauguuguagagauugugcuuuguacuagaacuuccuuuuuuacuguggcacuuuuaguuuuuucuuuucucagcuacacugguuuguagcauaugugguuggggacaaauauugggcauaccuucguacugugaugauauacagcuguuguaucuaucccuuaauuggauacaauugguagugacagagauccaauuuuaguaaaaguuucaacauuaaacucaaacaucaguaauuuucaacagaauguuaauaaguuuaacuucauaucagaacagaaguauuugauaugaaauaaguaaaauaaaauuguacuucuguuuauauuugugaaguaaugagcaagucuuagauacuauuugucagauaguagaguccuguccuucggacaguuauuuuauuucguuuuaauuuuuuccuuaagcaaaagcauaaucacagaugucucugucucaucaguguguucaccauuucguagacacuuuacacauucugccuuuaacagcccugagccacuuuuccauaguacaaguucauuuauucauaaaauugcuauuaauguuauugaauguagagcucucucuagaucucacagugugauacuuugaauuguccucauuuuguguaugucggauguagcugccucuccacacacuugccuaguguggcaucugcucgaguggccaugacagccuguggagaguaaaaugcuaauuaaaugacugaauguucaaaugcagagauggauuuuacaaauccgucugaguuuguuggugguaguuccuaaugaaagagauugguuuuacauauucuuuauaucacacaccuaaacuuuuuuuuuuuccacuuagagagaaacuccaagaacaacacccagauggaaauuuuggagcaaugugguuguuuuuuggcugcaggcauaaggauagggauuaucuauucagguauuguacaauuccaguauuguacucaaccacugaguguacaauucuaauucucagacuuuuucagcuugacaaccuuuuagugauccauuauauauuauauuucagaaaagagcucagacauuuccuuaagcaugggaucuuaacucaucuaaagguuuccuucucaagagaugcuccuguuggggaggaggaagccccagcaaaguaugugcaagacaacauccagcuucauggccagcagguggcgagaauccuccuccaggagaacggccauauuuaugugugugggugagucauuaucgugccuaagucggguaggagagggccaucagugaugucuguagaagaaaaaaaggaccgagaagccaauaaucuagauauguagggauaagacauuugauucuuaaguacaggaauagaaauaacaguucugaaaugauuuugacauauuuaauagcccagagguuguuauuaucagggaaauaguggugaaaguuaaugcuugcauuguacauucuugguaccauuuacuuaccuguuuuuagccucugaaaauuacacucauguuacuacauuaaucaugugacuugaaaucuccagauugauuuuguuauauauaagaauaggugauuugugcuguugugaacuauugauaaguaagaaagaaaaaguaugauuuuugaugcugagaauguggauacuaggauucuuuuucugcuaggcauaauucuuggugauaaaguugaaacguucuguguuacugaauuugaucuacuuucugaggcaagaucuguuacaggaacccauaauugccauagaaaaauuguuuaacgcuuauuugcuuauuuugauaagacucaaaaaauuucugcuaguuaaaaaggaguuuugaaguaagaaauucacuuuuucauccaaacacauuccuaggauuuaacacauucucuaagucagguucuuuuuuuuuucaacuguaauguagaagacaaaauacuggcaucgugacccagaacauauggauaaagauaauugaaacaaguuucaugaaacaaagcaacguuuucuguuuaguuuuuauaacacauucugaucauuucucuuccauuuuauuuaguuugcuuuaaaagcuagcuuuggcuacuaaguuaauuucauguccuuucaauagauuuugacuccuaauugaaaaacauugcuuuaggucaauaaagggcagaaauucuagacauuguuuugguuuacauuuuccuucgcuuuuaaugaaguauuuaaucugcauuuuguuuggcgaggacagugucaucgguggucaaauacaggcuggaguuuuagagaugcaccucuaaauaguagaggcagaguucauuguacagaucacagauaucuggucauugagaacuuggagaauaucuuaaauguccagacuccuaaaacauuauuccagaaauagcuccucccaaucacuggugcuuuacuuugucacauuugugaaaugcacuuggaagcauuaauagcaguggucagagggcucagaaggaaacccuggggcacuugaacauugaucguccgucagggaagcaggaacaaaguagacagaaggaacagccacugaagaagcaaaauugucccaaagccaagagggugcuguuucagagagggagccuguacugcugaugagucaaaugagaagacagcggagcaggaucuugggguauaaguucccugagaauaguggagaggagagccucuugagacaggugagacagacaccucucaagaaauuucacugugaggggccaggacauguucaguuccuaacauaguagagucuugucugacacuucgcuucauucagcaaacaccugagugcuggcuaagugcuuggggcauauucagaugucgauagauacgaggauauauuaguuuuucuguugaggaauaccugagacuaaagaaaagagauuuaaugggcucacgguuuaggcuguagaggaaacauggugccggcaccugcuucuggugaagaccccaggaagcuuccacucugacagaaggcaaagggggagcaggcaccucacacggcaagagagggagcaagaggcagggggaggugccacacacucaaauagccagaucucucaggaacucagagggagaacucacucauuacagcgagcauaacaucaagccauucaugaggcaucugcccccaugacccagacgccucccaccaagccccacuucuaacacugggaaccacauuuuaacauaaagauuuggagagggcacacauccaaacuggaucagaggauaagugaguuacacuuccuacccucaaacaacuuacucccuggugagaaagcuacauauaaacagacguuucuaacgucggaaguguuccagagaggacugcaagagcacccaggagggguaccgcccccuucuuguaaauugaagaguuaagauguagaagcacuucaaaaggaccuggcacauaguaaguccucaauaaaggugucuguuacuaacuguauguguauaaagaccuagaagugugcgagagaucugguucccuucaggagcacgagucuacugugugcuuugagaguggagggcagggaaugaggggugagccagcaggugggucggagccaggcaggaccucagaugcuucucugacaccuaggaaauccuuggccuacugucgggaccuggagccuguggaggauugggagcuguagaaccguguggucagcucugucuccuagaacagucacuguaggcaaaggccuggccugggcaugagugaggcugggagaucugugugagauguucugagaagacggagggaagaacuauggugguacagucaaaaggaauuagacuugugaauuaaggaggauuuacuaaaaaugccuguuuguaagcagucaucuuauuauuuucuuuucuagagaugcaaagaauauggccaaggauguacaugaugcccuugugcaaauaauaagcaaagagguuggaguugaaaaacuagaagcaaugaaaacccuggccacuuuaaaagaagaaaaacgcuaccuucaggauauuuggucauaaaaccagaaauuaaagaaagaggauuaagcuuuuuugacugaaaguacuaaaagucagcuuuacuagugccaaaccuuuaaauuuucaaaagaaaauuuucuuucaacauuucuugaaggacauggaguggagauuggaucauuuaacaauauaacaaaacuuccugauuugauuuuacguaucuucuaucuacgcccuuccugugccugugacucuccccaaauugcccuguugccuugagcucuucugagcuaaggcagccuucagucccuaucagcgccuccuuuacuucccagagaacuucacagagacucuguccuuccaugcaaaggcuuccugaaauagggagacugacugaguagcucauucuugugacuuacagugccaacauuuaaaaaaguaugaaaaugauuuauuuuuauaugauguauacccauaaagaaugcucauauuaauguacuuaaauuacacauguagagcauaucuguuauauguuuauguaacuaucaaaugguuauuuguuacuaaagcuauauuucugauaaaaaauauuuuaggauaauugccuacagagggauuuauuuuuaugaugcuggaaauaugaaauguauuuuaaaauuucacucuggcauaugauuuaucuaucaccauuacuuuuuuuuaagucacaauuucagaauuuugggacauuugcauucaauuuacagguaccaguacguacauauuuuaauagaaagauacaaccuuuuuauuuucacuccuuuuauuucugcugcuuggcacauuuuugaguuuucccacauuauuugucuccaugauaccacucaagcagugugcuggaccuaaaauacugacuuuaguuaguauccuuggauuuuuagauucccagugucuaauucccuguuauaauuugcacaaacaaaacaaaauguuaugauaaucuuucuccacuguucuaauauauauuguauuuuuauuugauagcuugggauuuaaaacaucucuguugaaggcuuuugauccuuuugagaaauaaagaucugaaagaaauggcauaaucuuaa

SEQ ID NO: 17339 - RNA, 9112 nt, Homo sapiens
cuaaagagcaaaauauuuucauuuagcagauaacuaugacaaaauacuuaaaaauaacauuuauucauugaauuccuuuacagcacaugaucaauuguuugauguacaaaaaguaucuaugacacuaguauuaaauuaaaauuaauuuuaaauuuuaccacaauaaauguauacauaguauaaggaaaacuacagaugcuuucagaucaccagucuagaacauauucugcaaaguggcuaauucacauuauauuuuucuuuuaauacugaguuccauaaaaaugcaaguucuuccauuguuugaguucugaagucaguauucauucuugcaaccaaugaacaguguuuugagaaaacaguuuucuuuguaaauauuccaccaauucacgucuugauuuuagcaucccaaucucaugauaggggaucuguaaagguagaaaaguaaaacuggucaagauccuucaaaaucugagguuccucuggcuauugguuacuuuguuuguuucuuacacgcuuccccacagcggaauguaagcuccuggaaggcaaauaucccaaccagcuucuucauccuguauccccaaugucuagaacagugccuggcacugagaaggggcuugguaaauauuugaugaauuaauauguagaauaugcaaauaagaauuaaacaugaucucuuguucuccaggaguucacaacuuggguggcaaguuaaauuacacaauaaauauaaaaaacaagcuguagguuggugaucuagugcuaagagggagugagcauuucauuagaugaggguggggaugccgacaaacugcuggaagguagguauucagagagcuggaggacgcagcagggacaaagagggaaugaagagggagagagcaggaggcgcagcaaaggagagagucugcucagcugggagcagaggggccagguaguaaucaugugccugcagccuggcugcaggccaaccauuggagggucuugaauguuaagauguagagaaguuuuuacuuuauucuguaagcaguaaagaaacauugaagcuucugaguagacacuggcaugauuaguuuuaggaauauucagcuggggaugugcaagauggagaaaaaagucagcagauaugaaaccacagugcugccuaguacugacagcuuagagaauuagggcagcgcucauucucacgcacugcugagcccucacauaagaccuucuuacauuaucuacagugaaauauuuaaaaggucuuaaauauuaaguguuggugaagcuccuuauuuuaauggauuaucuuguucauuuuuauuuauuaaaucaaggagaaauuaaaacagaacauauauuccaacaauugaguaauucuaaaagcaggguuaagcauagcuuauaaugaauauagguaggccccacuuuugaaaaaucaaagcucugaaaauucuguauuucaaaauauaagucaagagauuuaagccgaauuaacaacguugggauuuaaacuagacguaagaucggugguccacugggcuggcaaaccaguuaguacuguaaaagcaaauuaaaauggagccugugccugaaaaaucccugagcagaccaagccaguugggccuugaaaauaaccuuaacuuugcuuaaagugcaaauguuaagcaaaauuuaacuugggcuauuucuuguagaagcuucuacuacagaaaaacagaacuuaagcucaaccaaucagaagcaucucacaaacuaauaauuauauaacuaggaacuuuccacagaauaguucaaacaaggcagcaagaauauguaacuguaaccagucaaguagauucuuuguguacuuguguucuuccuauaaaagccucccucuuggguucccaagccauuucgaguuuugugcuguccaguucaauaauugcugccugaucaaauucuuuaaaauuuuacugugccucagauuacuuuuuaaaaguaaccuggaaaaauaauuuugaaauaggauuugcuuuugggaaacaaaaaaaauaggugaaaccguaccugaacaacuugauaaccgaguaacuguaggugucuuuguuuaauagcuucuuuccccaguaaguguuugcuauuggagcaaaaccuuuuuggaccaucaauacacagugcuauccugaaaaauaaaaaaggagaaaaauacuuaauuuuuuaaauaauccaaaauauuuauuauauauuuuaguugccaaaguuuauuugggauuuggcuauuacuaugugccaauauuauuuucaaaugaaucaugaauuugaucuuauuaauauuaauguuuauaaaauauuacaaggaauuucccaacaugguauucugaaauguaguauuuuaauuuccagaaucauaucuauuuuuuucaccuucuugagaaaaagauaccgcugcuuauuagccucaacgagucuuguaaugugaaaaacacaacauuuuccuguaccuuuuauggauaucuucauuagcuguggauggcaauacaaauccuucuucaucuaauuuaauuucaacaucuggugagagaagaaaggaaaaauuccucgugugauacccucacaaacacuaucuuccuguauucauuccuuugcuuugcuuugauuccuuccaccuugcauugaucaauuggacugaaggcugcaaaguaaugaccacaaccaaacaauggugagaauuuuaauucaauuggcuuuaugaucaaucaagucagccuuaaauuaagaaagcucaauaacgcuaaaccacagaauggguucugaaguuaucugggguaugacaagaaccaugcaugcuuucucuuuccccuuaugauagguggcagagauccuucaauccagacugugaagaaaacccuugaguuaagacauuagacaucugugcaacucauaacuuccaucauuccaacuugcagugccuccaugguaaguaaagaaagcaugccacacccagacaccuggucugcgagcacggaaggcuuccgaacuguccuuccccucugguaaacugcaguucccuucguaaagagaagagaagugaccaucugaagccuaugaacugcuguccuuuacgagaaggcuuucuucugcucaucaaguuagaagaacuguaaggacggaggacuuggagucucuugucagugcuguccaggagaaauuucugugauguggaaaucuuuauaauggugcuguccaauuuggcagccaugagccacauguggcuacugagcacuuacaaugugacugaggaauugaauuuucuuaaacuuuuaauaauuuaaauuuaaauagccacauggucuaguggcuacuauauuuggacaguacaagccuagguuauaguaguagcuaacaauuagugagcauuuccuacguuccagguacuauuuuauuuagaccuuaaguaagucuuugaggucaauauuacuaucauuuuacagaggaagaagcaagcagaaaaagguuaaauauucugcccaggauauucugcuacuacguggcuaauauuugagacuuaaacccagacagucuugacucaacggcucugcugcuaaccccaacuugccuucagggaagggaccauuccauuuugcauuuccagagaacuucuauugcuucuaagucccauauaucuccaaaaucgaacaggaugcuuagguuuaaaacaacaaaacuccuuauacuacuuaccuauuguauaacaauagggugucaacacuuuuggagcaaaauauaaucuugcuccuaaaagguuagucagcccaaucuucacauaucuauaaagcugagaauccacaggggucuccagggaacagcaugggguaagaaaugacuucacuugauauuuaggaaggaguuuuggacccuaaaaaaucauaagugcaaaugugagaaagaaaaauaagauauaacaacagagaauaaauugaagguuaccuagguagaaaaguuugauauaacauuacuuuauaggcaugauacuuuuccaggaauugggacaggcaucucucucaaaaugauaaugcaaacuucucuucuuacagugcaagucuaauaguucaaaaugucuuuuauauguguuuuuacaguagucacugguuaccauaaacagaaagaaaaguaaagaaggaagguaaaaaggagugaggagagagugagaagaaacauaauaaugcuaacaguucaagaaacauuuuuagaacugagaauugucccaagggucuuaaguacacacaacuaaaguuuucaacacagguuuaauuucucuaaucugaaaauccaaaauccaaaaugcuccaaaauccgaaaccuuuuaagcacagacaggcugcuuaaagaaaaugcucaugaagcauucuggauuucaaauuuuugaauuagggaugcugaacugguaaauauaaugagaauauuuuaaaauaugaaaaaaucugaaagcugaaacacuucugguccugagcauuuuggauaagggauacucaaucuguaauggaaaaugugauauaaaugacauuccaguuuaggaagaaaaggauagcaauauaauaaacgaugcuggagaaaaugguuauuuauuuggaaaauaacuaaauuaaacuucugucauccaugacagaugcuaauaaauuccagguguacaacaugcugacuauaguuaauaagaaugauugcgugcuugaaaauggcugagaguacuuuuuuaccuuuuuuuuuguuuguuuuuguuuuuguuucugagacagaguuucacucuuguugcccaggcuggaguacaaugacgcgaccucggcucacugcaaccuccgccuccuggguugagcgauucuccuaacucagaguccagaguagcugggacuacaggcgugugccaucaugcccggcuaauuuuuuguauuuuuaguagagacaggguuucaccauguuagcaaggcuggucucgaacuccugaccucaggugauccacccgccuuggccuccaaaagugcugcgauuacaggcaugagccacugcgcacggcaagaguacauuuuaaauauucuuaccacaaaauaaaaugauagauauggagguaauacacauguuaauugguuugauuuagccauucuacaauguauacauauuucaaaacaacaugaacauaauaaguauauacaauuuuuguuaauuagaauacauaaauaaaaauucaauuuuacuuuuagaucaaagaucuaaauaaaauuuaaaagauauuauuuuuaaaaauguaaaauauucaugcucuugagauaggaaccucggaagucauaaaagacagauucgacuacagaacauuuaaaaauacaucauaaguaauauuaaaaaguaauaaaagaguacaaaucgggaaaauauguacaacauucauaauaguuaauaucuguuuuacaaugaguccuuaaagacaaaccauccaacagaaauaaauuaagguguagaaaggcaauucaaaagaaauguaaauggccaacacauauuugaaaauaugcuaaacuucauuaaugcucauuaaaaugcaacuuaaauauaugauaugauauccucuuucauguaguugaguaacacaaauuaaagagacuacuaacacacugcaauagaaguggaggagacauggccaccuucauucauugcuggggaaaugugacaucuguaacuauuagggaaaaaaaaucugccaguauccaucaaaaauuaauccacuaaucacauuuuugggaaucuaguuuauauaugaaaaaaaccaaaaaggcucuaguaugacaggauuugcaagaauguuuauuauagcauucccgauagagacaaaaguugcaaaaaccuccaagugcaucaauaguagaauaaacaccaugaaauaucaugccuuucuaaaaagaaugcaugugaucuguaugcacuggccucgagggauggccaugauauacugcgcauaaaagcaaauuguacuuugauuagugagucucauuccuugaaaagagaaaaaaaauagacaguguuuauguaucuguauacauuugggcguagaaacugcuuuuaauacuguuccuuuagaaaugguaagagaucgggguuaacuauuauuuaucuuuauauaacuuaguacugucuaagcuguuuuaaaaaagggguauuuuuccauucuuauuaccuuauuucaaaaaucagauacucuaaacuaugauucagagucaaguagagagaagcagagagagaaugucauagucuggugugcuauuucugauucuacauaaggaaugugauagguaauaggauaaaucuuuauaggucuuuaugggaagagcgaacucuagauaaacuaaacucuauuagauaaaagugaaauuucuggcuuggcuuaaaaauauacuguacuugcaaauaauuuagguauuuguucaguccagacauucacacuuugauaacaaacagcuaugggaaaccuaguaguaaaccuaguacuaaaacccuguaaaaccuucagagagaauggagaaauacuguaacucacaugccugcagcacuugauaaaaccuccuaagaaaucuuaaacagcaggaaauuguuccuucaagaacaagaacacaaaaaugggguccauuuaucaaagaaaagccuaucugguggcaacugacuccaaguaaaugaaauucugcuuuuucagguuauugagacagaucagaaguaaaggaacuuaaaaggaaacugcacccauggggaaauaaagccacauauaguucaugcuuuuaccuuauagaaagggcauuccaggacugaggcuaagaaaaguugggucaguugugcccgacucaauguguccaaaugagauucuuuaccugaaacagaaagcaucccagucauaguuacgucugaauugagguauguaugagagaacaucaugaacauucaacaucaauuuacacacuccagacagaaguauucuauuuuuaaaugacacuaugaaaugaacuuguuagaauuaauuaugcccuccucuugccaccaaugaaauugacuuccaagaacccaagcuccuagcuacagaauacaauuaaaagagauaaaauauguucacagaauuaguggaaauuuccuuuaacuauggaguuccggaaauuugacauauuuggguggccuugaauuaagaugaauaauaccauccucucaaaaaaaaaaaaaaagauacaguugcucacucaucaaaaguucuaacauguuaauguggcuauuuccacugccauuaccauaucuccuaagaaugcugcaauuucucagauaaggcaaaagucaguuuaucugagacagcuuucuucccucuacaugauuuccuagcaugcuuuaacuguguuuaugccagcaucuguuaacuucaggucucaucuucggaucacuauggaagaaaaacuaaaggcaacauauugccuuuauaugugacuugaaaccacugccaguucaaagguuacuuuuuuccaacugucagaauuuauaaccaacucaccuugcagccguugaaggaaaagaggcuugaauauuuuugccagaaaguugacuggauggcauucauuaagugaacaugaaugaagaaguuucaauaaugauuuggguggaaaauaauugaaaugagugaauagcacguuuuccagcuuucuaaauaaagcagaggcauuugguggcaaauaauugaguuucccaaaugguuccauuaaggcagaaaucugacgaggugaaaauuuuucuguuuggcaaacaaaaguuucugccacugcauugaggauggguuuugaaagaaucaguucucuacugcaguacuccaugacccugcagacaacuucaggauccaacgugaggcacaccgcagcuacacgaugcucuagggcuuuuguaaaaaaugugucauggugcccaaaauauaugaacgccuccaagacucuccuaagcuccucguuagugaaaugugggacaugccucacgacauauuugcccaauuuuauaaucagaggaaaugcuugacuuugaucaagaaccaccagggcagugagcauuuggcuaaucaauuuaggacucagguuggaaacuauugauagggaaaaguuguuuaucuuauuuaaaaauguuugguguucauccacuuuuucaguacaugccugcaagauucuauaaagggccacaauauccuccgggguaaauguuuccaauuuuucaccuugaaguugauuuauaaugaguucuagugucacacaaccugaacugugcaguguaaucagacuuuccccaagaauacaaagauugcgaacuuccaugccaccuuuucugagacgauuuuggcauucugccaccagguucagcaacaggcuacuuugaggauccacaugcaacagaaucagagcuugcaaagcagucacuaaacuaguguuugacagcugugagggcuccuuuucaaacugaaagcauaaagcuugaaagaugcuauucuccaguauuucuuuuggcagcccuugaucaccauccuuuuuuuccacuucacaaauucguuguaaagcuccugcugccauagugucaggcaggguuuccaucgugcuuauaaaacuuagcacuucuucugaugaagucaaguugcucagucuccuguaaaacaucugacucuccucauuuuuaacauuuuguucaagccugucgcagucagauacuugagagaacacugguccaccgaguggaugaaggucauuuccauuuuucgaaugaaacuuuuuacaaugggcaugauggaauuugaccccgaaaggcucagguugucgugaacacaaccaagggcacagacgcuccuugacuaccuugugaacaugauuuagagguuuauuuuuuaaagcagccagagcucuaugcaucugaaaaucagauaaacgauaaagguucuuccucaaggugauuaaugccauaccaucagauucucaauuugauaacuaaauuaaaaaauuuaaaaacacaugguuaaauacauugagaacaugauugacccaacaucaauguuuaugaaacuacaaacgaguaucuggaaaaaaaaaaaaaaaaaaaaaaagga

SEQ ID NO: 17340 - RNA, 1102 nt, Homo sapiens
gaacucgcauccaggaacagagcccuuugcuccucccucagaaugaauggggaccagaaaucagauguuuaugcccaagaaaagcaggauuucuuucagcacuucucccagaucguuggggugcugacugaggaugagauggggcacucagagauaggagaugcuauugcccggcucaaggacguccuggaguacaaugccauuggaggcaaguaucaccgggguuugacggugcuaguagcguuccaggagcugguggaaccaaggaaacaggaugcugauagucuccagagggccugacugugggcugguguauggaacugcugcaagcuuucuuccuggugacagaugacaucauggauucaucccucacccgcuggggacagaucugcuguuaucagaagaugggcaugggguaggaugccaucaauuaugcuauccuucuggaagcauguaucuacuaccugcugaagcucuauugccaagcacagcccuauuaccugaaccugaucgagcucuuccugcagauuuccugucagccugagauugggcagacccuggaccucaucacagccccuaggacaauguggauuuuggcagauucacugaaaacagguacaaaucuauugucaaguacaagauagcuuucuacucuuucuaccuuccuguagcugcagccauguacaugguaggaaucgauggugagaagcagcacgccaaugcuuagaagauccuacuggagaucgagaguuuuuucaaauucaggaugguuaccuugaccucuuuggggaccccacugugacccgcaaaguuggcacugacauccaggacaacaaaugcagcuggcuggugguucagugucugcaacgauccacucuggaacaguaccagauccugaaggaaaauuacggacagaagaaggccaagaagguaguccaggugaaggcacuguaugaggagcuggaucugccggccguguucuugcaguaugaggaagacgguuacagccacauuaugggucucacugaacaguacgcagcgccccugcucccagccauguuucuggggcuuguguacaaaaucuacaagcagaaaaagugac

SEQ ID NO: 17341 - RNA, 515 nt, Homo sapiens
cccaccagcucaccaucgcuccaggugcauggccugcagcuuuucuggguccuucggagggaacaugguaggucggaucugggugugucugcugugaggaacagcgucccagucuguaaaccacugcccaucuuucgucauuaccugcagaaccacaggguacauuccagauuacuagcacuauccaauaccaacaaaaaucacagggcaggaguauccauucucucaaaggugacaaauggugauucucauucacuccaaagauaggaagauuauuugccaagacaaaacaaaacaaucuuuacagaaaauccccaaauuauuaauacauaaauucuguuaaaaacaaagaugaaauacauuuauucuaaaaaccaggacaagcauuauaaaauaacauuuuccaucuaguuuuuuucuuuuuaaacaagccucaggcuguuucuggccuaaaauuguaaugaauuacuucauauuggaaacaaggcuugaaucccggcccaauuuaaaaaaaa

SEQ ID NO: 17342 - RNA, 679 nt, Homo sapiens
ucuuuuuuuuuuuuuuuuccaaaucaauaggucuuuuauugcaucauuuaaauaucacaaguaggucuuaagugucaucuggcaucuucuuucuguagccagguaacucuuagaucuuauucaucagccugcugaacaguuccuuuuucagagacauagauaccauccaaaaauuuccugauauccuuguuuuuaacuguuguggcuugcugaaucaaagccgcugaauuugaaacaagcucaaugucauuuccuucaaggauuaauucaucuuucugggcuugagauacugaacaagcaacaccuggucucauccgaacccugcggauguauuuuucacccaagaaauuucggauuucaacaagagacccauucuccuggauaacaacguugauggggaagugagcauacacagaccucaucuuguaacggaagcccaguguaacacccuugaucauguucuguacaugacuacaaauaguccgaacgguagccaguuccuuucuguuaccccaccauuugucaacccggagccucuuuuuuuucuuuccaagaaggcugaguucuacauugaugugauugaagucccuccgcaggguuccucuggggcccuucacgauaacugugcgucccuucagaguaaugucgacauuuucuggaaugucgacagucugauugc

SEQ ID NO: 17343 - RNA, 381 nt, Homo sapiens
uuuuuuuugaaacacaaacgcuuuauuuaaaggagcaucucaguuacguguggcggacaaaaaaaaggagcagauugugacagaccauucccaucggccaaguggucgaacccgacauccaagacccagcgagcagccaagcucagcgcaaccuccgggcuucucgcucugacuccaaaagggugagcacgucgcccucgcgcacggggccuuuuacauugcggaugauggaucggcucgugucguccaugaauuccacgcgcaccugcgugcacugucccugagaaccgguccugcccaggaccuuggugacccuggccagcuugauaggcugcacacggcugguguccaugauggcggcgcggcggcggucuggcggag

SEQ ID NO: 17344 - RNA, 460 nt, Homo sapiens
cuuuuuuccauucuccuuuauuccauaaacaccuaguuacaaguugcacaaaucaaaaaauaaaggcagagaaggguguagggaagauucuuuugaugugugugggcaggaggagggagagaguuaggaaccagucugcuccuuccacagcccuagauagggcuacggccccucagugggggcucugaggaagaggugggcaaagauccaggguagcugagggauggagggggccccuaaacccagagcucaccccaaaaugcauugacccuucaaugcauggcaggaguaggaugggaaaggugaggggguuugaagauggaguggcagaaugaaaaaucaagucaguagaugcagaggcgaagucaucaaugguaaaccaggagauuaaagaaggaaaagguagggaaagggugccgugaaagguucucccugagacccccagggagaggugggggcc

SEQ ID NO: 17345 - RNA, 391 nt, Homo sapiens
ucuuuuuuguuguuguuguuguuacguaaauuaacccauuuauuacaggccagugaugucucaaagaguagaggagcgucuacuggucuuucaacuccuucaggcuucugauggcggacuuuaccgugauagcggaggugguauuguauguccaggcaccgccagccacugucuucacgcgggaaccacagugccagauccccgcagcucaucucuucaucuugguuuugccacagaaagagcaaguguacuuggccugcuggcugauuucaacuuucuucaccauuuuccagagggaggccccauagcgggucccguauuuaccgacgaucccgacuuucuugguagguuuggccaugucaccgcgaacuagguccgagcccagagaguu

SEQ ID NO: 17346 - RNA, 530 nt, Homo sapiens
ccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaag

SEQ ID NO: 17347 - RNA, 2143 nt, Homo sapiens
acugagacgagcgggagcgcggagcagcagccucugcugcccugacuuuuuaagaaaucucaaugaacuauuuguagagaaucacugauccggccugcaagcauuuugcacggcaaaaauaucgaucaguguuaagugaagaucacauuuuauaugcgaucuugacuuuuuugucuuacauuauauuuuuauagauuuuguuauaaacauggugcugggaaaggugaagaguuugacaauaagcuuugacugucuuaaugacagcaaugucccuguguauucuaguggggauaccgucucaggaaggguaaauuuagaaguuacuggggaaaucagaguaaaaucucuuaaaauucaugcaagaggacaugcgaaaguacgcuggacugaaucuagaaacgccggcuccaauacugccuauacacagaauuacacugaagaaguagaguauuucaaccauaaagacaucuuaauugggcacgaaagagguaaguuuuuguuauucauaagucauuggacucauuuucuuuggaaacguaccuuuucaguuuucugaauuaacgugauucuacuccuagcauaacuaagcaguuugagaaagguuagcaaaguuggaagguuuggauucuccuugacguucaucguguguuaagccguaaugcaugcaggcaucugcaaagugacugcaaacuacacuuauucagcuaccucuguacccggcucggucugugccacacgcacuuguaguccauuugcaccuuacuuauaaauucuguuugaauccaauucagucguuuuacuaauauauuuucaaaugaauugguaaaagcugcagucuuagauuuuugcccuuuuacuugcaaccuaagauguaaaaacugaacuucgaucaagaaauguaauaacauuuuuaagagacuuaauggguguguuucauuuuuaauauuggaaugcaaaagacuuuaaauaauugaugacuguucuuucauaaaagauuucuguggcuuauuuugacauaugguaucaacaccccacguguuuuuucucuauucuuuaccauuccuuuaaaaauuuacacccagcauuccuuauuuuaaaggaaugacuaucugucauuaugauagguaucgagucagguuuagaagccauuuaggaucaguaauuuucuuuuccgagcaucaugucuaacuuuggaacgugcauucaaugaaacccaugccagucaaauggaauugaaaaguauagggcacacuggauuugauuuuugguuagaagagagagauaaaggguugucaaaaggagaaggaguccugagauuuccaaucuauuguuuaaaugguuacauuguggaaauauaggagacucuaggcuuguuuuucuaaguuuccacccuuuguuagaagcgguucaauccuguuucggaccaguucugggggguggugaggaggggcgcuuguucugcucucagcagauugguuacacgcgucaggugguggcgaugacuuaauuccuagcccaagaagaauauaauguuaaaacugguuauguaauuuuugugccucuccuuuuuaaugcaguauuuaguucagauguuggcgauuuuucagaaaaaaaauuagagacauauuuuaccuuauuuuuuauauuaaaaacguacauccuggagaagugcugaugacuaaggcaagugagaaaugaaggaugcuuugagggacaguauuaaugcauuauuuuugaaacuauuaaggugaacucaguucuuuagcaggauuuucguaguuagauacagguacuuugcauccugaaauaacuaauuaaucucuccaaguguuaacacugauaggagaugcaaaugccuaaugacagccuugguauuuguugaaaagcagauagaugacuuuguguuuguaccuuucugaauauugcagccuuuuaugaaacggaugaaagaaaacagauuuuuccucaagggguuaagacuugcaguggggaaaaguagaacaacgagaugugaggacaaauauaauuucauuaguugcaccaugauuucgugguaaagaaaacuaaaugcccugcacccccaacaaaaugccccccaaacccugcaacgcguagacgagcucagucuggaauaguuucaaug

SEQ ID NO: 17348 - RNA, 14104 nt, Homo sapiens
cgugccgggcguggaccugugguuggacucccccguuuugggcugcccuccgcguccucccccgccccuucccaccuccgcccacuugacgcgaugacgcaucucagguuugcggacguggcggcggcguacggcccggaaggcggagacguuggcggcagaggcggaggcggacggggucagcccaaagcagaggcucggccaugaacuuacccgggacagcggcggcggcggaccuuuuggccaucuucucgcagagugcucccugcuaacggggacagguaaagaugguggcaggaggugaggguagcccgguccaggagggcgggguugagccccagcugcguccucacgggaggcgcugagccucggccacagguguggugggggcugcagggccgggcucggcccguguggcggacacccccgagacagggaagaacuuccagaccagcccugccaggcccucuugucacacugucggggaaacugaggcucagaggaaggacgccuaccugcuggauuaccugggcagcuaauuucccacccaaacacagcauuucucccacgacuuuauguuggcgugaaauauucgcugacggcaucuugucacaucguucaagugucaugcugugacagaagacucugagacguaaucuucgcugacgauagcagggaaagaaaaacuugacguguggaauacagagggaggagguaguuaaguuuuaaaaaacaaaauugucccuggcagcggauagggugccuuugauucugucccuuugcagcuuuaacuugugcccugugacccucuuauugcaccuugcuuaguuaaagaaggucaaggcgaaacacccagcagccauucuacaguacgaagguguuugggaaaccguuuucaguuacagacugagcugaagaaugcuuuaacacuguuuuguggccccucguaaucuagguagcacgcaggcuuguuccaaguuucugaaagggaguucgugccuuuuuccugcucuaagagaauuaagagaggugaauagaauugagccagaugacuuaaauauuauguauuuucuaaucucugaguaguagacuggagugaucgccugggucagucuguucacuucgguugaagacacagccaguucuugaucauucagaauacccagauuuguaacacgauagucagcugccugcauuucauuauaaaggggaguggagagauagugagacaggugaaguucugaccuuuaaauuauauuuagaaauauaucguggagagagguugauagaaacaaguaucuaaaauggcuuuggggcauugcuuagugauuuucaguuagcugcacuacuaagccaauuuugaaguucuaaguacaaauuauuagggugaaacugucuaacaagacacauaaguaggucgguauagccaaguguaaauugcuguauauuaagucuuaacuuuuuugaucauggaugccuuuugagaauaugaagcaaugaaaauucuccccagaaaaauauacauauguauaaaauuugccuggaaucuacaggauucaaagacauucccuagguuaaagacacaagauuaaaaaaagaccugguuaaaugaguggaaauaaaacuguuauccuuggaggaaaagauguggucaugacuucaaaacugcuuuugagauauaaaaugugauaguuuucuuuaguuucauagcugucaaguuaggaauccuaguucuugguaauaauguagcacuucagagaacaguugaaauaaucuacuuaacauauagcuauuaguuaucuguguuaucugaauaggaacucuugagcuuuuaaagcauuauaauauugccauuagagcaaggucagaaagugcuuuucaaggguuggauucaacuauauuaaauaguuuuaaagcauuuuaugauaaguauaugccuagaaaguacagguuggguaguccuuaccugaaaugcuugagaccggaaguguuucagauuucuuuggauuuuggaauguuugcauauacauaauaagauacauuggggaugggaccugucugaacaugaaauuuguguuucauauucaacuuauacacauagucggaagguaauuuuauaugauuugugcacaaaaguucuuguaccuggaaccaucagcagguaaaagugucacuaucucagccacccuuguggaaaauuugugguuguuuggcaucaccgucauuccuaacucugaauuuguaugcuacuaauaagcagucauuuucuuacacuuuuucacacauaagugcuuaacaguaaaaaaaaaaaaaaaaauaccauuaauacagugaaaaaauaauguguucaggguaccuaagcacaucaccagaauaccuguacagguuuagcauuccuaaucugaaaucugaaacgucaguuguggaauuuuccauuuguggcuucaugucagcacucaaaguauuucaaauuucagaguauuuaagauuggauuuuuggguuagggauucucaaccuuuguaauuuauugucauccauuuuauauacucagaguuuuggaguuggucuuuucuguuuuuuguuuguuuguuuuuguuucgcuugguacucauccauaguauucaaaaaauagugagucuuugagauguuauuuugcuuuggcuuccaugacauaacacuuccaugguuucucccucuucuggacacuccuuauccauauuuucaggcugauuuccuuucaccaagauacugaauuuuggacuucuucaaggcucagucuuggacccucuucuuuuucuauacucucuagguaauauauguacucacaaauucauuuucaucuaugugcaaauuagucaugaaauuuuauuucuaaccuagaccuuuucucugaguuugacuauauagcccauuugucuauuugccauuccuuuuuacuaucuuagaggaauucauaaucauagccaugcaccuccucccccagcuccucuuccauaucucagagaauggcaccacaauguauuaugcaaaucagaaaucuuggugugaugcuuaauuuacucccucucuucaugucugaaccaccuugagugcaaagaauuuuaucuccaaagugcuucuuacuacuucccuccaucuuucccaacaagaacugaaagcagucugccccuucuuaugugaauaauuaacacgaagccaaaacugugaauguggaauuaguuuuuuagguucuuguguuccuaauuaaagagaguagauagaucaacuugaugauggugaguugagaguuaguaugcaaguaaacaaaaaguauucauugaugccuguuuuuaacuuaggucagcucccagucagucuuacaaugguuuuucuaaaguauaaaugaacacaguaaccuaaaaucuguucacagucuuuauggaccauaaguugaauuugaugaggacucuaaguuggcuaaaaagcuuccagggaagaaaaauuccugcuuccagggaagcaaaaucauaaccuauauugcaggcauaucugcacuaaauauaaauaccaaaguccaggaggaaguaauacgaaagauacuccaauccugaaugaaguugaaaugcagaacaagcuggaaaguuuugaauucaugaaaguauuauguguauauaaaacaugcuuugauuccaucagagcuauaaguuauauagucacaaguuuuuaagacauaacacaauuauuucucugauuuucuucacauacucagaauaaggggaauuuacgauuuuauauuuaauguaauauuuuauaguauuuaauuuuauaaguuauauuuuuaccaaaagaauuauagcaauuugccuuuguuaauauguaauuacuccacguguuuagugauauaugaucuaauagaggagauuaccucuucuucccuuaccuuugucuccacugccaaauacguuuguucuacuuuaacaguuguaaaaccugaaccuaggccaggcgcaguggcucacaccuguaaucguagcacuuugggaggcugaagugggcagaucaccugaggucaagaguucgagaccagccuggccaacauggugaaacccugucucuacuaaaaauacaaaaauuagcugggcguaguggugggcgccuguaaucccagcuacucgggagacugaaacaggagaaucacuuaaaccugggaggcaaagguugcagugagcugagaucgcacuacugcacuccagccugggugacagagugagacuccaucucaaaacaaaacaaaacaaaacaaaaaaacgaacuuaaaccuaaauguuuaaauaacuaaaaccauuaaaacaaaaacaaaagauuguguccugaauguacgaugcaugcaaaucagucaguuggaucagcuacauuccaaaauuuucucugcuuuuuuuuuccuccagauuuuaacauuauggcagggaggcaucagaaucguaguuuuccucuuccaggaguucagucaaguggucaaguacaugcauuuggaaauuguucagacagugauauuuuggaggaggaugcugaaguguaugaacuucgauccagaggaaaagagaaaguccgaagaaguacaucaagagauagacuugacgacauuauaguauuaacaaaagauauacaagaaggagauacauuaaaugcaauagcccuucaguacuguuguacgguaaguuuuaauauuacauaaugcaauucagaagaaauuauuuguuuacgcacacugaaauaaauucuguguccuuuuuuaccuuguuuauuccuuucuccauuuuuugcucuuauuuuuugcauagaaaucugugucacaugggcugggcgcgguggcucacgccuguaaucccagcacuuugggaggccgaggcggguggaucacgaggucaggagcuugagaccauccuagcuaacacagugaaaccccgucucuacuaaaaauacaaaaaaauuagccgggcguguuggcaggcgccuguagucccagcuacucuggaggcugaggcaggagaauggcaugaaccugggaggcggagcuugcaggagccgagaucgcgccacugcacuccagccugggcgaccgagcgagacuccgucuccaaaaaaggaaagaaaaaagaaaucugugucacauuuguagauguuuacuuuuuaaauauuuaacaaauacuugaauuucuguguauuuccaaauccacgaauuucaguauugaaaaacacucaacuauguuaucuucuuauucaaaugguaagaaaauguggaaauguguaaggaaaagcuuuucccugccccaauuucuugagauaaccagcauuaacacuuuggcauguaggaaugcuuuaccuuuuuuugugcucauaaguauuuauuuauauauacauauuuggggaguuaguaaucuuuguauuuuuaaaaguggauuauauuaugcauuuuacucugcaacuugcauuuuucauucuuuaguguaucauggacacccucaugaccaucccucaaagccuuauuaacucauuauuuuaaaugguuguauaaugucuguaguauuaacguuccaguauuuuuaagccauugcccuauuaauugauacucaggauuuucuugguguuuuaccuuguguggcaaauaucaucacaacuauaucuuuaaauggcacugccuuuacuucugugggauagauccuaaaagugggauugccagauaagaggaaagguguauuuuuaauuuuaauagauacuauacucuauuuggacccauuuucucucugugucauuauguccaucuugaggccuuagcaggauauuuuuauauccacauugauauggaaacugguuagaacauuuguuuucaaacuuuuuguucucauacucccaauagaauuuugaaauauauguacuauguaccucauugcacauuuuuaagugaacuuccuaaauucuuccucaugacuuaacauaguuacaaaugguauaauuuucagaauguuguauuaacauuuaaaaauaagacuguuagagugcucuuuaaaugcauccacagaauucuaaguaccaccaggauuugcuaccugaaauuuguauuuuuaaaaaaaguggaaaguguguguaugagagcucuuuuuucaauagcaugagauuuuauaucauuccuuuuucucauuaauauuuucaucuuccccccaaauuuuucaugauguaaaguauuuuuauacuugaaaaaccuuuuauugauuaccuguaauacuucucugcaauaggaacacacaugucuauaaguuuauauuauauaaauguauuuauauucuaaaaaaauuauggucaugagguuuucuucuacauuugcaacuauugcaauaauucacauuucuuauuacaauucacaauucaucaaaacauuucaaauuuugauauuaaaauuuaauaaaauauuuuauuaaaaugaauuuuuugaugugguguaagagcuggguaguuuuuuccuccuaccuugcucauguaugaaaacaucaauucuugccauuauuaaaucagaaaauaucuaaguuuauuucuaaaugcaaauaaacaugugaguaaauguuuuguagagaaauaagaccauugauaaauaaauuacagaauaugucauagaagguagaugguggaauacacuucaaaaugagacacaaggcuaaaaaacaucaagguacagauccgagaggagaguuugugauucaguaguuuuauaagacauuagcuuucuuuuaaugaaccuagaaaauuuucuuagggaaauuuaacauaccaucugaauaauuaaaaauaggucauauuuccaaugagguguaaagauguuucaggcauucaacagugaugugaagaagauuucaaggaggaaauaugguaaacaacaaagggaauuuucauaguuauuuccgaagugaguggcacagacuauuugggaugaaaugcuuugagacacuauggaaaaguuugauccauacaguaagagaacaaauauuguaagguuuuaacaggagugauacagaauggaaaaguuugauccauauaguaagagaauacaauuauuguagaguuuuaacaggagugauacagaauagcagaggggccugcugaugaauugaaggggauccaauaaagagauuacuggaauaauaaagaugaucaggacuuagacuaaaauauuugugauaaggauagagaagaaguguuaauguauugggggaaaucacaggauauaucagcugaaugcuuaugugaaaugagaaugaugaaaaguacuuaaauggagagauggcauuggccacuguauuagucuguguucacauugcuauaaagaaauaccugagacuggguaguuuauaagaaaagagguuuaauuggcucaugguucugcagguuguacauaagcaggcagcaucuacuucuggggaggccucagagagcuuuuacuuaacggcagaaggcaaagccagagcaggcauuuucacauggcuggagcaggaagaagagcgagugagggaggagguuccacacacuuuuaaacaaucagaucucacaagaacucaggacaguaucaagggggaaaucuaccuccaugauccaaucaccucccccaggccccaccccuaacauuggagauuacaagaugacaugagauuuggguggggacauaucagccacuauagugggaaagggaugaacagaauuaguuaagauaagcagugcuccuuuuugauggaagcauaagcaacaaaaaaaauuauaaaaauauuuaucauuauaaaaggaucuaucauuuaaaaaauacaguaaguagcuagugguauauuccacuuagaaauaaucuuaagaauuauuaaaaaucugucaguuauacaacugugaugagaagaauaaaaaguccaagguuggaaucuugaaugcaaccaaggaaguuggcauagcauagaagucauuauagggauauucagggagauaacuuagguagauacuaaaccuuggaacccuaauucaaaaagaguauuaaguaguuauuaguaagaguacacaauaccaagcaaaagagcauuuaaagagaauggggucagacugggauuuuucagugaaucuucauuugcuauaagacaaaacagugcgaagguaguaagaugauaaaacacacuuuaucuuuacuguuucaucuuuuaguuauuguucaacccuuuccuuccaauccccccacacauacauugcaagauaguuuuuccagcuugaccucuuuuagucuucauuguacuugaucacgaaucuacaguggauucuguucacuacucccugcuaaagacccucucugcuugaccaccuugacuuuucagguuucugguuuuccuacuauuaacauuuaauaauagcuaacuuuuauaugacauaccauaaaucacuguucugaguguccuacaacauuuaaaucauuaauguucaccucaacccuauaauguagguaguauuauuacugccauauugcagguguggaaccuuaauggcaaagagguuaaacaacuugccccaggucauacagcuagaaagugucaaagccaugccucaaacccaguuauccaugcuuuuaaccacuauuguauauucccuuccuggccauucguaaucuccuuuguggauuuuuguuacucagcauacccaucaaauguuggaguucuucagggaugaucuuguugcuuuuuucucucaggcuuuuucuagugaaucucucuacucuuugaccucuuugacuucaauuacuuuuuuuuuuuuugagauggagucucgcucuguugcccaggcuggagugcaguggcacaaucucugcucacuguaaccaccaccucccggcuuccaguaauucuccugccucagccuccggaguagcugggacuacaggcaugcaccaccaugccuggcuaauuuuuguauuuuuaguagagaugggguuucaccuguuggccacacuggucuugaacuccugaccucaggugaucuaccugccucggccucccaaagugcugggauuacaggcaugagccaccacgucuggcugacuucaauuacauuuuugcugauaguccauaaaucugugucucuagccgagaucguucuugaguuucagacauauaucuacaacucuguccugaacaucuuccacuucuguaucucaagcagcuccaagucagcauaucuaaaaucugcauuuagccucuuuuuacccuccacaguguuccauuucucaaugaaugccaucguccaucaaguugaccaaaccagaaaucuaagcuucauacuagacccacuuuaucucucugacaugaaucaggugauacaugauuagguuuuaaaguauugauggaaaugaaugggacuaauagauggugggagagccuggcauaccaauugguaaucugccagacacuccccucuucccccaacacaguggaauaggauauacagacagguuaucucacaguggaugggauaauacaaacagguugaggaauguauaauauauagagaaaaagcuuauaaaagugauuaaucuugaaaguaguugaauaaugcauuuacacugagaaguuugggagggaaauggcuucagaaauaagggggauaaauuaccaauuuuuuaaauucuaagguauauaugcuuuuccacacauuuuagcaucuuuuuuuggaaugguggcaucuucaauuuuuggugaaguuuuuuuuuucccuagauauacauaaaauaauacugcaucuuagaguuauggcaucuuaguuuugauaaaauaugguaguuuuaguuggguagcauuugucuauauuccaguuuccaaacuggaauaaagaacauaacuacccauaauccuuccuucacaaauuguuuacaagcagaaggacugugguauuuaugcaugaugcacaaagggaagcagcaaaggauucuagaaucuacuuaaauagcauuaauuaguguuacuaacauauaugggugauaguaaaaaguaguuggugauuuccuaagauugguacaucuaaagugguguagaauucucaucuacaaauaaaauuaaaauuucucugggugcaacuuaauacuacuaauaauucaacuuuuuuuuuccuccaaaaguaacuagaaugaaugacuauugcugccuuuauuuugauuggaauucaguuguauguugcuuuuuuuucccccccacagguagcagauaucaagagaguuaacaaucucaucagugaucaagacuuuuuugcccuuaggucuaucaaaauuccaguaaaaaaguucaguuccuugaccgaaacacuuuguccuccaaaaggaagacagacuucacgucauucaucuguucaauacucuuccgaacaacaggaaauuuugccagcuaaugauucucuugcuuacagugacucagcugguagcuuuuuaaaagaaguagaccgagacauagaacaaauaguaaaguguacagacaauaagagagagaaccucaaugagguaguaucggccuuaacagcacaacaaaugcguuuugaaccugauaacaaaaacacucaacguaaagaccccuauuauggagcagacuggggaauagggugguggacagcuguagugauaauguugauaguagguauaauaacaccaguguuuuauuuguuguauuaugaaauuuuagcuaagguggauguuagucaucauucaacaguggacucuucacauuuacauucaaaaaucacacccccaucacagcagagagaaauggaaaauggaauugugccaacuaaaggaauacauuucagccaacaagaugaucauaaacuguauagucaagauucucagucaccugcugcucaacaggaaacauagcaauuagcucauaaucaaauguuaguggucacaugugcaucuggaauguggugaaucaguuauauccaauaauagcuucaaaggcagaauuuagagagauugaggaugcuuuuguuuuuaacaaaaggguuucacacuuugaaaauuuuuugagcaacuaguuguugauguugagagcaguugauccauaaaucuggugugugaauguuucaagcagaaauuaauuuaaauguguguuuaggaaguacuuaacuuggaagauguaucauuuuucuuaaaaugcauguuuaaauuuuauuuuuuuaaguaauuuuuaaaaaguuuauuaauguuaaauuuaugaugcagaaugauagcaucagaugucugcagcugaaaaaaauuuacuacuaugaacccccaaaauauucaguugcaagaaaauuugauucuaaaauuauucaugguaggauacguaacacaccccuucaaaacuuuuaaaaaauacauuuagcacaugugcuaugaaagcauacguacaaagagaaaggggaaagugauuuauaauuccuacaacagaggccaagaaauagauuaaaauauuuucaagaccccaaaauaauguauuaugguugggaagucaguagaacacuggaauaggugaagaccugacaguaauuuuugucuuaagaaugcuuucuuuaggacagacccuuuaaccucaccucugugcaucuguuuuuaaaaugauuauauuugccucugauauuugaaagcacuuuuguaguuuugaugaugaaaaauauauuaaacgugcauauuaccauuauuuaggaaauaauuccuuauauacugugauaaaucauugcuguuacauacaguaacaugccuuaauuacauuuaaugccuuacugcuuuauguaaguaaauccaaguuucagaauuaaaaauaagcauuauuucauaugguccaaucagauucguuacauaggcuauauaaauuugucuccauuuucaccaucaagcacaaauaauugggucaaaacugccuuugaggucuguugaagaaaaugguucauuaagcaaaaaagaguagagguauuuuauauuagcaguaacagacaaauuauuuaguaaucccuuaaccucuguuuuucaaagagaaaauauccaauuuagacuuuuuuccugaucucuauauauagcaucaaauugggaaacaaaggccaaagguguauagauugcuugaaagggggugguagugccucuuuuuaagaucuguugagucggcuacagucuggcuaaguaagaagcauuugcauacugauuccaucauuuaaucuuuaaaaguauguguuuuaaaaauguaaccagaaugauucuucaauagaaaugagauuugguggagucuggauugccuguuuuguauauaauauauacuuaagauauauaauaccaccucauuuucugggcauuauuuccuaauuguugauguuucaggcuuuugauaagucauuuuauauauuucaaauuuaacucagaauaaguaaauauuuauggcaaaugcaguuuuauguacuuucaggagaagaccaucaggaaaagacaggacaaagaagucaaacauuaaagcccuugcaaauauuagaggaccuuagacaauuaccaaaaaguguuuaauagggaaguugcaaaugauucucuuaguaaauuaaacauuuaaaaaguaguuuuaaugugccuugggcaucuugaaaagaagagugugauauaauuuaugcuuaguguuaacuggucauuuuacauuguauuuauuaagucugcugaaaaaugagguuuuaaggaagaaaaugcagauuauuuuaggguaaacaggccagguguccuuugaagaacuuuguuuacaucaaauugaugaaauuacagucagugauuccuuacuuuuuuugcuaguuguacuuugaaauuguuauggguucgauuuccaaaauauguaacuuauuuuuuaaaggaauaaggugugcuguguauuuguugauuaaaaaucauuugucuugcagaguauccuuuuuugaaggaaauauacauccuuauaacacaucagguaguuuucuuuuuucuguauuuaaauuauauauuugaauuaauugaauauaauuugaguuacauauaauucuauauaaagguuacauauugaauuaugguucuaaucuguuuaggaaagaaaugaauuuucuaagcauuuaauacauuuggaauaauuuuaguuucuaaaaaguacuaauguaaguuaaguuuauaucaaaugcaaauuaccuuguauaacuaacaagcacaguuauuguuuaacauuauggauuuuaauuguguugacacccuucuuugaauuuguugcuuuacaugugugucugugugugugucugcaugugugcacgcauguacuuguaugcaauguaaaaguaacagcagaaucauugcauuugguuuacuuaaaauuuuggaguuagcaaguaaacaaaaagcugauaguuuuaugaagucucgguuaaaauaaaauuucuuugcuaucucacuccuaggaaguuauggaguucauauuuucaaaagauauguuaaaaaugguuacacacucugcuggccacauuaaaaauuagaagacucauguuaaauuaucuccuccaaaggacuuuuuauuuacagcuuuucuuuuccuggacucuaccugcuugguucaguguccugaagaguuauuuaaaugaaccacuacuuaguaauuaguucuuuuuuaaaguaucuacuucuaaaauuaccuaguugaaaauaugaaggauaugcuuaguuuuagaaauaucaugaagcaaggaucuagucaguguuacaggguaaagguggaguuuuuuaaagucuguauuuaaauggugcacugauggauucauuuuuaauuugcauuacaaaaauguugcucagguaaucaguauuuucuuccacguaugugcauauugcacuguuagaucauagaaauaucugaaugcuuuaauuuuuauguaugcaaaaucuauaaaucuuuuguauaauguauuuuauacaaauguaacuguagaacauuguuagcauguguaucuguaaaaccaguuuuuaaaauuuuuugccccuuauuuuucauauuuugaaagaucuccaacauguaauaaaguuucucuuauucaaucuaaaau

SEQ ID NO: 17349 - RNA, 6486 nt, Homo sapiens
uuuaagccauaauuuuccaauuaaauuuuaguuuuuuucaaagacuuucuaauuaccuucuuuuuuuccuuuagaguaaauaauaaauaaauacuuucuucaccaugucacugaguauguucauguucucuuuauccauuucuaucuacugcuuggaacucauucaauuuuuucuugaaaacauuccccuaguugucuaucaauuuaucuuagaccaguugcuuucuaagccucuuguaucucccucuuuucucuuucaccucuuaagagguguauucguuuuuuauugcuaucauaacaaauuacuacacauuuaguggcuaaaaucaacacccacucauuauguugcaguucuguaaaucagaagucuagguacaguguggcucaacugagucuuccacuuagggucuuacaaggccuaccaaggugucaacagggcugagcuucuuucaggaggcuuugcggggugaaucuacuuccagcuuauucagguuguugacagaauucaguuccguacuuuuguagaauugagguccucaauuucuugcuggcuguuggcuggggucaucucaacuuuuagaagcagccuucauucuuuugacucaugaucucauuucauuucagccuauaauuguggauugaguucuuauacuugguuuauuuauuuaccuacuuauuuauuugagccagagucucacucuguugcccaugcuggagagugcaauggcgcaaucuuggcucacugcaaccuccaucucccggguucaagcaauucucccgccucagccuccugagcaggugggacuacaggcaugugccaccaugccuggcuaauuuuuggauuuuuaguagagacaggguuucguguuggccaggcugguuucaaacuccugaccucaggugauccaccugccucggccucucaaggugaugggauuacaggcaugaguuaucaugcccggccagaguucuuauacuuuaaaucucucuaaccucuccugcuucauuuuuucugccucuaaguggaagaaguucucugauuuuuaggacucacaugauuagacugagcccacuggauaauccaggauaaacucccuauuuuaagguuaauaaccuuaauuacacuuacaaaguuccuuuuuccaugcaguguaacauuaacaaauuucaaggauuaggacauggacaucuucgaugggucauucuaucugccacacucuuguauuuuacaucuaucuuauuuuuggauuucauucuuacuuuucuggaguacauauuucagaaagaguauaugauaauugaacuuucugaaaucuuuauuauguacucauaauugaguuuuguucugacaggaaauagaauucuaaguucaaaauaauuuucacuuacaauuuugaagguauuaucuuucgguaucuaaaguuucugaugagaaaucugauacuagcucaauucuuaaauucuuuuauaaaaggucagauucuugugacuggaagcuuuuaggccuuuuucuuuauuuuugaugcucugaaauggcuucuuuaugugucuaggugugguucuuuuacuauuauuuugcucaguacuaaauguguucuaucaauuuggagaccuguauuuaucuucaguuccucgaaguaucuuuucaaugugugauauuuuucuccuccuccucuuguucucucuuucagaaauucuuauuagucaaauaaugaauuaguccuccauuuuuuucucaaaauucuccauguuuuuguuugaauacugcaaguuuugugauauuuuuucaauuaaaucaucuugccaguuuaauuuuuacauucauguuuauuuucaacagucuuuucuuauucuccaaugcuccuuuuucagaguauucuguucucuaauauuuucuugaguacuucuuaggcagcuuauuauuauuaauuucuuauuauuuuauuuugguuccuuagcugacucagagucuuccugaaaugguuuuuaguuuuaucuuucaugcuguugauuuucauaucucugaugguuuuucauucuucauucauuuuaaagacucaggccacgugccguagcucacguuuguaaucccagcacuucaggaggccaaggcgcaaggugggagguugcuugagcccaggagguugagguugcagugagcuaugaucuaaggccaugucauugcccuccagccugggcaacagagagaacccccgucucuaaaaaaaggaaaaaaaaaagaguggaguucuagauagauguaaagagacaaaacacuggggagaggaaucuggaggaacugaaguacagugguuuccuaaagagguuuuaaauugacauuuuguuuuuagcccccuucucauuuccaccuucuacuguacaagggaacucuauuccuggagucucucugggacuuugcuagguagaucaacucucugugaaacauaagucaucucuggaaaauuauaggaugccacuucagugaucuguuucauuugucaacaaguuuccauauuucuuuugaucuuuccaauaauuuuuuaaauaccuagucugcugauggucccucuccaggucacuucagcuuuagaaauuaauuuauuggcuaggcaugggagcuaauuccuguaaucucaacacucugggagccugaggcuggagggucacuugagaccaggaguucuagaccagccugggcaacacagcaacacaguguaaaauuuaaaaaaaauuagcugagcaugguggcaugcuucuguaguccuaacuuuucaggagcugaggcgggaggauccuuugagcccaggaguuugagguuacagugaguuaugccacugcacuccagcgugggugauagaggaacucuugauuuauuaaggcuuuaggaggcagacuaaacaaauauuuaugucacuaccuuuucaaagcagacauuuuuauuuacauuuggcugucucuggaauuucuggucugauuaccauuguaccaaauacauuuuagugucccauacagcaauuuuuguauuauuauucuuuuucacaguuuaguaaguuauuuuuauagaauuguuguugagauggucuuuggaauaccuuuguucaauucaagaaaaauaugagaauuuugauugcaucaaauuuagguuuaaaauauaauuaguguaaccaccugucuuaucuuuaguaauagaugauuagaccccaaguuucagcagagcaguuuuccaucuagagauuucuugccucaaccucccgugaagcaagaagugguugucacuaguucucacuaauuaaauauaauaaaagugaugcguguaaauucccugucacucucuuaaaaggacacccuauugaaaaccuuuuaaaaucuguuugcccaaauuauuugcuuauaaaacgcacucugagaccaaaagcaucucacaaaauccuaguguuucaggaaugagguuugagaaacacugguguuuaaguauucugccgaucauauuuaaaaaaguauuuucuaaacccacuuuauauccuaauagaaaagguguuaccuauuauucagugccuuuuugacacugagaugauuuccuuaaccuaacauuauaauuauuuaacacagauuuauauuuugaauuaucuuugcacuuaacaaaaaaaaacucaauuuaguuauagagaaauguuccuuuaagacaguaucaaacugacuuugcuaacaucuaggaauuuugcacuuaaguucacaaaugaacaucaaacaugagucaggcacuggggauacaauggugagaaacaugcauagccuucaucaucacugagcuuacacugagugacuuuaaauguucuuuuaggaugugaaagauuauggcagcuucaaaaauuaagcuaagaagcucuccaucauuuucuaugacuugaguuuaaagcacaagauuuagcucuuaugauuuuuaaucauaaaucugagugggcuggaggcuuuuuauuugugaguacagaacuuuggcaucuuuguuccaguccugucuguaguuauugacuuaauucaguuuuccaccuuuuuugaguuauguuuuccuugaaaagugacuauuucauuuucuauuaauauuuauuggcgguauaaaauuguauaaaauauuuuaauaauuuuuaaaccucccuuuuauuaaauuaccaaccuuacuaguggcacuauuccuuuucuuguuacacuuccuauaagucuuugaauuucacugguauugccaaaaaccagcuuuauacuagauuaugaguacuuuaucaauuuuaccaauuuccuuuuaaaacacuguucucaaacuuuaucuuuacuaauuuccucuuccuaauuucaauuauacaauuuguucuucguuucuaacaucuucaaauaaaugcuuggccuauuuuuauucuuucuuauuuaaaauaauguucuccuauaacuuggucuguaucuuaaaauuuuaacauauaguuuuuuucaauaucauuauguucuaguaacuacaauuucucuuuccuuuuagacucaaaggugauuuauaaagguacuuuaaaauuuaaaauacgaacaaaauaaaaguuccacuuuuguuuuuuaggggugcuaucccuuagcuaauuuuuagcuuauucuaucauacuaucuuuccuugugcaaauuuagcccauccuucuaggucuaacguuuaugucaccuccuuuaagaagcauaucuuguguucucucccuucucuaaaauuuuauauacaucccuuaaacauauaauguuuauauauucuccgccuucaacucccauccucaggcuauuuuauucacguuuaugagauuugcuguuuagcucaguauuuuguggauuuucaaaagauuccacucaauuuaccgagcaccuacgcaccagacauuuuauuagguacaaggaaaagcguuaaauagauauaaucacggccuccaagaaauugaaccuaguaagagacacgaauaagcagacauucaagugagcuuuaggagacuugguuugguagugaagacagucucauguguguuaacagcuuacagcacugaaaaauaagagacagaagggaacaaauccguuucaaacaguucaaaggaggaaagagagggaaaggugguuuagauacagcuaaaucauaaauagccugauaaucuaacccugugauaauccaaguacagccacagcaccugccucagaaucacuuggaaggcuugugaggaguaaaaacgcagauucauaccuacugaaauuagaauggagaaacggacauuuaagucugcauuuuaaacacauuccccagguacugaggccauuccaaguuuuagaacagagcacagccaauuuucgcagaccuuguuccucaaguacucccuccuucuagccggaggguggccugcagcaugucccuucccuucccaccgccgaagcuguccauccaguuucugaauggcggcccacagaccgcacggcuuuacgagagaggaacacagcgcccacccgccaaacagccacacagggaucggaggccggacccgcaaaggauucggggaaaaacgcaucgagccaauccgaagggcgagagcggcccuagauugggggggcgggggggcguuaggaggugggcggggcacagaaaaaaaauuuuuuuuuccuugauugacguaaaaccuacccaaugaaaauagaacugguaaagcuuccgcccccuaauaggcagaaccauagcgacauuucaaccaauccagcucaaaagugucuauguugugggaggucccugaggccgcugaggucguucgugucuguugaacggcugugggcgucuugcugccuuggguaggggguuaaaaucguucuugagaggaacgucucugugcgaagagauaaugaguuuagcucugaggucgguaauaaggaggcggcagugcucuccacaccccggagcggggcccagggaggguguguguggaagggaggacguuuggggccgaggcgaggcaggggauguaguuugggacgcgggaaaggagccuagggcagccugcccggaucacucacccucugggcucugaugcccugcagggaacgagaccagugcauuucugcuaaggagguuauuucugucagcgcguagggcuuuggacugccagaagguugggcuuaguugcgagcgaggugggaaugaaauaucgcgaggcuucuacucuuguuucucagaucaggucgcggacaucccuucauucauccgugugccuggucagggccccaccucggcugcuccgcugcuaaugcaaucacccaccuauaaauuuuggaaauaacaaaaacucuuuccucuucucccagggcccugcuuuacgguguaauuggagacccauuuuagugacuuuaauuggcagucugucucuuggauuuccuaaauuucuugcauuuuuuuaccuuucaguucuaaccucuaacccucuguugcccucuccc

SEQ ID NO: 17350 - RNA, 6470 nt, Homo sapiens
gaaaaauaaacgcuguagccuucgagaacgguuguuucggcuccuguucugugggcggcugaggaccgccggcugcccggcucggagaagaacagguuagaggaggcagcuccagcccaugcauaaucagggcuccgcggcgccuccauucuuuccuccuccuccuccuccuccuccuccuccuccuccuccuccuccuccuccuccuccuccuccuccucuuccaccucuccuccuccuccuccuucuccuccaccuccuccuccucuucuugcucucgcuccuguugguuccagcguguauuauuuuuaauacugaugcauauguaaagguauauuugcauuuuuuaauuugcgagaauuucagauuuugucauuuuauugguucccuuucccucuuuuuuuuuuuggaggauuuuuauuguuguuauuuuauuaugucuaugugucucucuugucccuuucugucuuuuuuggcgagugucugcugcugucucuugcuagauaauauacacaguuaccucccugcuucuguuuauuuaagguuacaaauaugcacaucugucauguaugcaaugccagcuguauaaccuccugguuuggucauaaaggaaaauacacauuuuuuuuucuuucuugacauaccuugaugggcuguagugcccaucgcucaaggcucaaaguuugauugucuaauuaacuucauauuagcagaaacacaguucggggccagugcuuucgagauaauguauguauaagugaagugauuccaaagauuucuaaauaauuuuugugcugauugccugagaggugcggcauuccccgcccuauugcuuucuagcauuucuuauugaaaaaaauauauauauuuuaaaauggguagacacagcaauggacagccuucugcaaggaagacauuuucaaccauguuguauguuguaccuuauuggcugcauucaaaauuuacugaguuucauuuuuaucuuaauauggcuggaaacaaggcacauuaucuugacugaaaagcauccuugauuccugacuuugaaaugaaagcaaauacacaaauaaaacaauuggcuauauuaaaccaguugauguggcuuaaaauauacaggccuugaguuagauuucaagcaaugguaaucuuguuuauaggaucggauucucuuucuuggcaauauagcuaugcagcacgauggcuuuuuuccaccuuuuaauucccccaagcuaucauuuaaaaaagacucaaucuauaauugcaaacccugaaagaacagcaaguaugcacacaugcagcuuauucaauuaaacaaguccaaguacaugcacagguaauuaguuuucuuaugaaugacuuaccugcacagauacucaggccaagacucagcccuccccaauggccuucauguauaaauauucacauguauuucccccuauuucaaaccuaaagcgguaugccaucuuucaugcuggacuauccagcauccauuuucagcacccuuaacucuuauggaauuuccagccuuaccucuggcuguaguuuuuccaagccuacaccaaagugcucauaugauaugucacccaauaaaaaguggucagauggcuacacguaugacauuaaaaagcagaaacacauucauccuucagguucgccuuuaccuugccauauauagcaagauuacguuuccuaaaauacauuuucagcacauuuuaugaauaauugcaggauuccacaacugauugcagaauagccgguuucuggggggcaccuggcugagugaaacaauucggcaggcucaaggucucuuugaguuuggcugcaguuaaauugcgcguggcuguuuguuccugccuggacucucccacauaccugccuacuuuauguaggaucaggacaaacacaccggccacguugcagggcauagagugucggugcauauauuuagauggcaguagcaaggaacgcgugcguguacggcugagcaugcauguguguacagaugcguguguaugugcgcgcgcgcgcuaugugacaaggaacacagagagguacaccucuuaucucugaucucucuguaaucuccuuuucuguuucuaaucucccuuauuggcgcaugguaguaacccaaagcgugugaaccgucaccgucgcugccgugugcgcgcuguggcuuaccccgagggccgguggcucggugacucgcuggcuagguggguguuggggaagaggguggguagcgucgcugccgcugccgccgcggguccgggugcucugucccagcccggcagccgagcgcgcagugucggagcccccucccaccccgcccucacccccauccuccccuccccucccuucugcgccucccccaaccccccgccccgcauuaccauauggaggccgagucccugcgaaucacagcagcagcgggagguauuugaauaagccccgcaaccccgcgcagaccccaacuccuccgagagcagcaugcccugcaccaagagccaccacucuggccgguaaccuggcagcgacagacaacuccccaaagugcccugcgcgcgguggagagagggucugcugaggguacugggucucccacuugcuacuuuuauauuaacuugacauagaaucagacaauaaaugagaggagagagaagagaagaggaaagaagagacagaaaaagggagaggcgcuguaaaggggagagagaaaacagaagcgagaaugggagagaaaaaggagaaagagaacccaaaggguugaguuaaagagagaguaaaauggggaccggguggggaaacggugggagggggagaaauacccaaauaucugaauuuggacuucucaagcuaaaaauaccaccucacugaacuucacaaccuccaaugagacacguguuucuccccucaccaccacgucaccgaaugauuaauuugccgucucaaucagaaauaauuauuuagaauuguauaacagauauaggacuuagcagaaagaagcucauuuuaugaaacauagcgaaaaauauaugacauuuaaagaugauguuggcuaccucacgguaaaaauuaaggcuugccuuaacgacucggcaguuguccaaccauguccucugaaauggugagauggcggcccagggccagcaacaagagguguuccgaaauauuuuggacuuuaagugaaaauuuuuuuucuuccugucucaaauuuuauuguuacguuuuucuucuucacgaauuuauuccuuuuaccuaaauuuuacagauaauaugugaaucuuuuaaaaaauuuuacugcaaaaugucacauuuugacugaagauaugauuuuagacguuaauuuaaacacauagccaguuccauuuugcaaacuaacucugaauagcaccugauucugaauuuagccaauucaacucacucucccucucccuauccucaaaucagagcagugauuucccuguacaaaacaaucagaaucauacuaaaaucuccagucaccuagaggauguacccauuguaaaugucccuuuagguauucauaagccaaacgcccuucuuuugaaacacauacaaaaagaacgccucugauuaauaaucucuuucgcggcacacugaggccgaaggcagggagccgcaggacgccagagaagggcgcagaauucucaauaccuagcauuucaaugcagauuccaaagauucgcuaacugcuagguuuuccaagaggaaauaauauuuggcaagcaacgcuuuugggaaagacaaccacauuccaaauacuggcuccuuccugggccuggggaggggacugcgaucgcgguuacccggcacuucuguguucauguguguacaaggugguauguagcccacgcauguagccaggccuagguuucuuucuuuucuuuuucuucuucuuuuucuuuuuucuuuuucuuuuuuuuuuuuuuuuuuuuuuuugaggcaagaauauugaaaccaauccacucuuucuguagcuagcucccacgaagcugggauuuucaaccucuuguuuauucguaaagcccauauggaaccccgguugaaucuccccucuucggauuuuaccaggaggcccucagugccccaccgccgcccauggcacgugaagagaaaggagggagaguugggagccacgagagaagccggcucggagccgcuuccgucggggcccauguuucgccccaacagacccgucucuccuuucucuccccgaagguacuuccuuaggccggcagugucgcuacggugguagccaggugagcacgggcacagucccggggcgggggcggguagagcggcccucucucgggagcuccggugggucugcgaaccugccgggagcggaaggcugaguggcgcugggggcccgcgcggggcuccuggcucccgccggcaggggaacagcgacaccuacuggccgcauggguaccgcgcccgggccgucagggcugcccugggacggggugccgggcuccguggacuugggaggccgcgggaaacuucaccgaaggcucugcggacugcucuaggacucguccgcccuggagaagacaaagccacgcuuucuggagaccccugggaggacuguaggauggaacugaacacacaggcacacacgcaugcccauuuuuucuggggaaccggauaaacccucagaugcaguugcccaccgucccuugguuuuaugagagagacccaagcagaggucggagccuugaccuccucagguucaugacccaggccucuucaccgccuuucccaguucagcacugacuaaagaagauaucuuuacaaauuaggaaaagaaaagaguucauuauccucccugaagcggggaaaugagugagucaaagacacagacucacaggcagcgguuggcgccgggcacacgaaccggccgagcccuccugcuagccagcuucgggcaccuuuagugcgcccugagacugccgccagggagugaaauuugguagcucuucuuuaagaauuacaaucuucuuaauuacuccugaaauaaaggcaaauuugggcuacuggugauauuuuugagaacuacagguauauaugcauauauaaauauauauauuuaaagcauauauaccaaagcaaauauauacauaaaguauaugcauauguguguguacauauauacucacacacauacacaugugugcauacauuuacauauauaucuucugcgacauggcuucgguuguuggcuuauguuggggaagguaagagguugugaaggcauggcaggucugaugaaagcucagcaagguuggggauggcaaaaaagcaauucauguauuccagauucacuuucucuuaucuagucuuuucuguaauagcauauagccauuucauaugggaaggagaugugauguuggucccagcagcggguagaggaggggggaaccucagcuuccauuaugccccaagaugccuucuuuuuccccuuuucagguucugaggcucacuugggccuaagaaaccuggcugagugugauucuuauacuaaccugcucaaaaguaaaacauauucccuuuccucgaaacacugggguaucggagcuaauuucauuccuuaagauuucuauguaaaauauugcuuauuaacaaaccucagaacuaaaggcaguuuuuuuccauucaaauuucaagaguucauuuuggaaauuauuuuucuuagcuuuacauaccgguuagaacuagggucuaaaagauuuugccuggaaggugggagagcuuauuaggacuaaauuuuugucuucguucucuacagucacaaaaguuugcuaauucuguuuuauuuaaauacaauuggaagcuuuuagugucucuaaagccaggaguuuuaggucaggucccccucucucucccucuuaaaaagaaaucacuaaaaggcccaggaaaccuguauuucaacucuguucugcaaguauuuuuuuucuuuuuaaauuuucuuacaaguggauuugacuguguccugauaauacaggaauucacaucgaagaagagacucuuagcaguuuguaugauauacaaauaaaccuauauuauuaauaauaaaauugggcuuuauccuacuggcauuuuuucuuggcaaauccuguuucccacugcauuucaaagucagcuuucuccuuauaaaaauggaaacauucauagcacaggaaaauauuuauuaaaaaauuacacugggcacacaacaagcacccaucaacaaaacccaguucagaggugucuuuggguauuuaaagcaccuugauaaaugcagggguugauuuuuuuuuccuuuccuuuuggcuuuuuaggauguagcuuuauuugugacuccaaaaucuuagcuagaaaggacucucauuguuugauauucuuugguuuuacuaacuaaaaaauguugauuugacauuaaagaagauagaaaaauagaauuucuguuucaa

SEQ ID NO: 17351 - RNA, 32383 nt, Homo sapiens
aacugcguacgggcuggccgcguaaucgugacgacagcgcgccagcgccggcuagccggacgcccuaggcuuccgcgagaucuucgguggggguacggguguuuuacgccaggacgcugaugcguuuggguucucgucugcagacccucuggaccuggucacgauuccauaauguaccacaacaguagucagaagcggcacuggaccuucuccagcgaggagcagcuggcaagacugcgggcugacgccaaccgcaaauucagaugcaaagccguggccaacgggaaggugagguuuucccaacgguugcccaguugcccggucacuaaauucugagcagcugcgggagcucuucuggcucccaggacaaucucgcuccgucguuucucugccucugcggcgcggagugcguuuuucuaucaaaauaagcgagcaccuugccagguuccguggguacaaagacgaacaacgccauccccgucgucgaauggcagacaaguaaccagucuuuguaacguagugaagaagagaguaaguagugugcuaagguagugcguggcaagagccguucacuugucaagagaugauguuggggaagguuuuucccaguagccaaugcggagaaaaugggaaaggaaguuccaggcagucagaaccaccguucagagugggagggaggucagaaguuacagagauggugcguggacguguuuguggucguauguggccgaaguugaguaccugugcaggaauggcuggggaggguaggaagggaacuuguaaguggaagugaggcguuuaacauuuccacugaaaggaugaggaaccuuugaaauauuuaaaaugggaagcuaaccuuaucagauuuccguucuggaaacagcgcucuagcaaccucguggugaauggguuggaugagggagggagaccagagaccaaguacaaaccaagugacugaagaugguuuggacuauggcccgcuagccaaguuccuucuguuacagcucucggacugguuuaaucuuuccugcaagcuccacuccagcaaguguucagugccuccaaauuaccgauacugaguuacuuuacuuucuaccuuuaauucacaucuauuucauaucacugauuuuagcaccugaauuaguuuccuaagggcugccuuaaaaaaaucaccacaaacuggguagcuuaaaauaacagaaauuuauugaaacauuugcuguuuuuuuacaacuugugacguaaugacugaccgagaaacggauguuggaagcuuuccaaucauauuuuaaaaagucugucuacuuuuuaauuuauaaauaaugauaucacaacugugagcaugugcacacagccugucaugauuguuuauacuuuaaugaagcaaaggucuagcugacauuccgaaaagucgugaaaugaugguacaguuuuaguuuauuaaauauuuuccuacagcuauuuuguguaaugauuagcgaaucuauaaagaaaaugaggcgugauauauacccuucguuggauauauaaacuaaauuuaaucuagauagagaaaaauguuuuacaauuguuuaauucauugaauucauugaacuuguguuguaauuguugaucuaaagguucuuccgaaugauccagucuuucuugagccucaugaagaaaugacacucugcaaauacuaugagaaaagguuauuggaauucuguucgguguuuaagccagcaaugccaagaucuguugugguaaguuacaguggugaugaaauauaauguccuuuaguuggcuugugaaauuugaccucuucuaaauucccuguccacucaagucuuaaaaauucaccuuaguuacaauuaauuaguuuuuggcacauuauauauuuuucaauacaggccuuaaaucaugaguugcuguaucauaucuucaaaaguauuucaagucucacuuuguggucagaaaaaaauuugaggucagguaaugucauaaagaaagaaaaaaaauaaauuacuuuccucuaaguucucaacuaaugagccauaggacugggacuagaacauagacuacugcuuuuccaacucugugacacccaauaaauguuugaaauaaugcauucauucaucauugguaaucauaugccccagcugaaacugauaccauaagauuuuuuuaagccuugauuaguagaagcuggaguuuuaucuuuggugaaaaagauugccuuauuguuucagauguaugguucugaggaccuauuuguuuuuugcuggggugggcaaccgugaggagaaacagguagcugagauuaaaaagcagaaagauaaaaaagguagagugggaggguguucaaaauguuguuacguuauucucucacugguuuguugugaagaccaaauauaaaaguauaucuuaaguaaaagucuguuaaguuuuaaaguuauacagcgugacuagcuuacgacccaguagagaauaauuuucuaggaaauuaucuccauuuuuauaguugaaaaaaaaauugaaguauguugaaaauauuaaguccauagaauuuacaauuuuuuuucaucugagaugucaaagauucagagagaguuuuagguauacuugauuaguuuauaucuucagauuuggcuuguucuuacaaaagaacuguaaaaugaggcaguaaauuuaagugaucuuaucaaaugaagaaaaaauccuuuaaugaacuucuuuauggaauuuauuuuuaaauaacauguuuaucauuggugaauaauuuuuuguuuuacauaaugacaaaacuaaacuuuuaaaauacuuaaaaggaaauauucuuuuuucuaucauaaaauagauaagugguuauuucauugguuccagccaaaugauauaaugguuaaaaguacaggcaggucuuacuugaauucauuccuguuccuuauuagcugugugaccuagauaagucaguuaaccucauugauacucaguuuccuucucuguagagauaguaauacuucaccaagcuguuguaaggauuaaaacaugaugauaguuucguguuuagcacagagucuggcacaugguauacauucaauaaaugguagugcugcuucugccauucaguuggcagcagugaucacaaaucauggaauggauacaugguuauaucacaaauauggaguggcuuuagagagaaggcuuauugccuugcccauguuuuuuugucaguauuuuuauaagauugguuaaucugugaacguuuguauuuuucuuccugaauuuaucuaauucagaacauuuuugauagucugauuucuaauacacacacacacacacacacacacacacacacacguauuuuuaaauccagugaccauaggaaggauuagccagaguaggcuggggauagacaagcaaaggaugggaaagaaucuuuuggcuauggcauuucuguaguaauucaucacaauuuguuuugauuaaagaagaauuaaugaguauuaguauuuuucuggguaaucucuacaaagaaaccuuuccauaaauaaguucuguuucacaaaauuuaacauuuaacauuugugacuagauccugaugauauauuuuuuuuaacccuuaggguacggcuuguauguauuucaaacguuuuuaucuuaauaacucaguaauggaauaucaccccaggauaauaaugugaguaugucugucuaauauauuguuuucauuuaagaagaccuuuauaaucuuuugaguauuuuuugggaggagagaauugugagagagagagagagagaacugacuuccuaauacaggguaauuuagacuugaauucuauuuuuuuuuuuuuauucagaacuugagaucucuguuuaccuguacuucaguaauucugaugguaugugaacuucagcuuguccagauucaaauuuuguuuuucucaaauuagcuacuucucuaacaucucuuccuauuagacaccuuuguucuuccaguuguucagacugagaaucauuuauaguggccccucccacauccagucaguuuacggauccuauagcuucauacucauuucaguugaacaaaggucuguuguugcugcucucugcugagcgcugugucuaucauuaaaaaugaaauuaguaugaaacucaucaaagaguuugcucucaaugacauuguaccuguuuucucuuuuuugauucccauuuccaccagucaagauuaggcccuugaucucacugccaacuguuuuuuacaguagcuuucuuacuguuuucucauacugaacagcaugaaguggccaggugaauuucacaaguuugucccuuaaauaauagucccuuauucagaugcccuuagagacuucugccgauggccuuccacaauguuccuuuaaccuacuuuucuucccauacuuacaugguacauauguggguacugcuuuauuuuuaacucuuccaucuacauuauacaaaguacucuuauuccucaguuaauuuguuuuuccagauauuuagguuguacugcauaacacugucauugagucagugauguuugaaugccauggcaauauugguuugaccuaauuuuauaguugucuuacgucuccuaaugaagugugaacaggaagugucuuuuaaaaaacaauucuugcaaugucuagcagucgcuuuugaauauuaggcaauuauagaauauacuuuuagaaauaaauuauuuagauacuucucaaaguauaugcauguucuuccaccccacccacccccugccuccugccuccuuauuuuuuccucuaggcucacuugugcauuuuuggccugcaaaguagaugaauucaauguaucuaguccucaguuuguuggaaaccuccgggagaguccucuuggacaggagaaggcacuugaacagauacuggaauaugaacuacuucuuauacagcaacuuaauuuccaccuuauuguccacaauccuuacagaccauuugagggcuuccucaucgacuuaaagguaaacuugauguaaaauaaacuaauacuacauucuccuuuccuauucuuuaacaaaagaauccaaaauuuuaaaacucauaaucauccucguuguuauagcauggauacaaccugugggucuggccuggucaucuagggcaguuguuuucaaacuucagugggcaucaucagucaucuggagaaauuguuaacugagauuguugggugggacuuacagaguuucugauuuaagugaucugcaaucucauuuaagugaucuucauuacauccagggauguaaugaagaccauugagaguuuagaacggugcuuacuauaaaggcuuaagauaacucuucuaacuuugaauuauauugucauggaucugggccugauuuaaaccauaaaaaauucuuaaacuagaagauugcuaagugacuuauauuuuuagagguuugugaacuuaagucacuauguaggcaucaauaauauacguaaacaaacauugacaaaagcaacuuuuuuaaguuguuuuguuuggcucuaaaagagaaguuggauagucugagucgaaucaaaucaggaauugguucauucauguuagaucaguggcucaauuuggguaccuucuaugugccaaacuuugugcuugaggauguaaccagaaauaggacaggaacagucucaacuuuugugaaccuuacaaucuaaagguuuuagacaaucauauauccagugugcucaaugauacagaggggaaaauauauuuuagagggagauaacagauuaagggguaaggaaaacauucugagaacguaucauuuaaaauaaaauucagaguaggaauaggagagagaagaacauuccaaucagagacuucccugguaaaaagcucaaauucaagaaaccauuccgugcugaagagccugaacagagccuagcaaugcagggggaagagaucacagacagcugcugccagaguggaaggcagagucuagacuguggagacaauguuacagauuuugaauacagcaaagagaagcuagugaaagguuuaaauuuagagaguggcaugauuagauuugcagcuuuaaaagaucauguuggcaaccuuauggaucagguauuuaucgcgcaucuguaugugucaggcauaacguggagaauggauuagaauagauuaagucaauaacaggguaccguuaaaggaguccaagcaaaagauagugcugggcuucacucguaugaagguuguggauacagaaagagcuuccugggcuucagagauacaggaugaguaucccuuaucuaaaaaauuugggacuaaaaguacuugggauuacacuuuuuuuuuuuuugauuuugcaauauuugcauugugcuuacugguugagcaucccaaauccaaaaucugaaaugcuccaaugagaauuuccugagugucaugucagugcucagaaacuuucagauuuuggagcauuucggauuuugaauuuuuuggauuugugaugcuuagccuguaguuagguagaaucaauagaacaugaggauugauugcauauagagaugaagacagaggaagaacccccagguuucugacugggugagaguuuuuuuguuguuguguuuuguuuuauggaagagacugaugcacauuuaaauacugaggcaaagagcuaguagugagagcaagaugaaauacaaaauagucucuuuggaguaagauggaaggggguuggcaugggauuuggaagcaagguauaagaacuggccuuagagggaauaauagcucuuucucuuaacaguggaaaaggggaaaucauggguuaggauacuguuaugccucaggauuugguguugacaggaaauagcgccuuucuuugguaagagauaguuuucugagagugauggaguuucugagaauuaucaaagacauuaagacagauggaaaauauuuaugcagucacugaaaaauaggagagucaauugucuguggaaauacuaugguugcuuggcaguguuuaagagccuugcugaggucaaugaacaugaguuuauaguaacauuaccagacuucugcuuguaugguuuucucuggcagcccucagaaaucuugguauaguugcaaagcgaaaguuuguuggauucaaccacuguucaguuucugguuuugccagaaauuuguuggcagcauauuggggcagggaauucaggagagaaaugaggaccagaggacacuggugagugggagcaaguagagggauaagugagcaaagguucagaggagggagaacagcugugaaguaaaugaguaaauauauuagaaagggaggcauuguggucagaguagugggucugaauuugucauaucacaggugaggcauuuuugcauaauugacucugaauauuuuguuucagaguguagaaaagcuuucuuagugcuuuagguguugcauauggauaucugaggacuuaggauuuauaguuuauuuuauaggguaugaagaacugucaggaaauaggaggucuuccacaucucuugggcauacucuaaaacuuuuucugugggaauucgaagucuaguguguucuaaucaaaucgagauucauuuuuauuuacuucuuccugaaagcaaauuuuaaauagaaggaauuucauauaaaaauaagguguauuccuacauguggccuuacauuugaaucaccuggguugccugagagaagcauuuaccugggaauauguauuucuuggcccuacuuuagacucaauggaaucucuaagagcuucccuucccuccccuuccuacucagguggaaaaggaccaagagaagggauuaauguaaauugaggacagugucaauuacugugcuaggaacuuuagauauguuauagcauauauuucuuaauaggaguuguguaauuuuuaaacuguuguuauacuccauuuaaacccucagaaaugguaacauuugcaaacuuucuuuguagacccgcuaucccauauuggagaauccagagauuuugaggaaaacagcugaugacuuucuuaauagaauugcauugacggaugcuuaccuuuuauacacaccuucccaaauugcccugacugccauuuuaucuagugccuccagggcuggaauuacuauggaaagguauuaauuaguuuuuuaacuuaggucaaauucagucacuggguuuauuuauucauagaaucauuucugacuguaaucuuuaauauucuuuguggcugggaugguuggugagaagaagaaaugaaauugccuuuugaggaaaucuuuaaacaucaugaaaaauacuguuaaacuaagaggauacauuuaggauuaaaguagaaguaaaccaggugauccuugaaagacugauauagcuaucaguauaugacaaauuuagaaguuccugugaacuggugagcaacuugagugcagcaaaugucugccuuguuuuaucuuuauuccccuucuguagagcauguaugacacgcggaaguuaaauauuguuaacuaacugaagcacaagcuagcagccaauuagacauuuuuaguuucuauauuaaguuucucaauuuaugaccuuugagguucugcuugauuucauuccuagaaauagcugaggaagaaagaugauaaaacuuccuaaaguuaauuaaaacuauuuuacaugauuauaaucccuuauccauaauuucagaauccauugauaagguggcagcaaauagagcagauuguauuuaguuuuuauuucacuuaauaggaauauuuguguucccuugcagaaaucuuaauauuccugauuacagacaucacuuggguauuucacauuucauaauauauacaccagauaacuuuucuaagacaugaauacuuauuaauaagaauuucgcaacacaucugcaucuaggauaagggauuguagguuuauauuuuauuuaugauaugccuguucucugcaaacgcagcucaccaacuguauauaaauguauacguuuaaucccaaagugauuuauaucuccacuuauuuacuaagcaaacauuuauuagauaccuucuauguacuacuaugcacuguacuacacuuuaggaguaugaauaagauaaaucucuguguuaggaaagauagucauguaaauuacugauguauauggaguuaagauguggacuuccauuaauuuuguggggguugggugguuauuuuuuuugagacagcaucucacucucacccaggcuggaaugcaguggcacagucaaagcucauugcagccucaaccucccagccucaagcgauccuccuacuucagcuugcugaguagcuggaaccacaggcacacaccgccacaccuuggcuaaucuuuuuguuuuuuuuguagaguugggguuucccuaugcugccuaggcucaucucagucacuccuagacucgaguagucuccugccuaggccucccaaagugcuggggugacaggugcacaccaccauaccuggccugcagacuucauucuguaagggaacaaaaguccucuuuuccacaauucaaauaaccaaaaguuugauuaaucuugaagcauuguauauagugcaucuauaaauucuucagugaagguccaaaugaauuuauuucaucuuagaaguuuaguucauuauaauuccaggaaggcaaaauugaaauugccauaccuuuggcuccuugcaaauuuaauaggcuuucguaacauucccagagacuagacauugggccuuuuuuuuuuuuuuuuccuuuagggaaaugcuuuccaaacguuuuuaacuuacagcugauuuacaggcaaauuuuugggauauguggaaaugagcuuuacauuuauugcugauuucaaaagggaaagccccugugcuguugucauagucuggauaaugccucagauuauuaaucauaggauuauuaccguuauuucuggauuuucuucucuuucuugcagauuuagagcuuuauuuuucaucugcuacuuuagguauucuuauugccuguggauuuuauuaaaacaccacaauauuauaaguucaaauucaaaauugagguuaagaguugcuaacuucacagagauaaugagucuagucagccaacucuuagcaccaaaccuaugacccuuaugcuuaagaaaucaaaaggaaaugaagaguaaaaauaaaggaagaugacaaaaaugggaggaauuuuagguaggagagggaaaggaaaaaacuaguuauuuugaauuacugguagccagaaauggauuaguugucaggagauuuccugauuuucagauccaaaauuuauucccacaguagaugaugaugauguaauaucaaacaguuaccaaacuuuauaauaaaauuuaaauaaaucuggauaaagacagcaacaagaguucuuaaagcauugcuuucuauuuuucuaacuauuacccccaagagaaaaauaaguuuuuugcauuuguguuugaaaaacuauuuaacauuuugagaaucuguucauuucgccuuuuaucaaucauaggucaaguucagguauguaaaacuucagaguaacugaaauuuuaauauagaaauuauauuuucauacugucaguggcucugagaaaaacagguaauuuggguuuuauaucacauugauaaguaaguuuaacaccuuugauuuggacuugaugcaaauaagaugcaauagauuuauaaagcauuaggugguagucuuguugguuugaaugucuguuacuccacagaagugcaacuauagauaaaauggcuuucauauuaagggaauagagaauccuuacuagugccagauuccaguuuugcugcuuccuagcuuuauuacuuugggcaaguuacaagaucaugacuuguucaucccuguaacucagauuccucaucuguaaaauaagguuagccuuauugggcuucuauauuaaaagauauaaauguuauaaguacuggcuauuacuguugcuuucauacuauuuucccucugaaagguuguaccugaaugucacuaaacuuaaaggaacaauaaacaucuuuuaauguaagugguaauaaauccuuaaaauauaggaguuacagauuauacauucauaaauuuaaaaauuuuuuaauugccuuugaugaggauggaggaaaauaauuuaugaugucauguuuucucaaugugcuguauguuuucaauagauuuuuuuuucuuuucuuuacuaguuauuuaucagagagucugaugcugaaagagaacagaacuugccugucacaguuacuagauauaaugaaaaguaaguaaaagagaacacuuuacaaaauguuucuuccaauacaaagcuccuuucuaaauaaaucucuugguguuuaacuagaaauauaacagauuuuuguuuagauuucuuuucauugaauuacuguauuauggaagcaugaaagacacauuggucuagaacaaauagaagguauauagaaggaaguaguguucauuuauauagaacuuaugcaaagagugaaaauagagucagauuuagaaaggauuuagagauugacaacaggauccuuuuaaagaauaaagaaacauacuaggcacugaaaaagauguaaugggaaauaacuuaaggauaauguuuaaauuuggaacuucuauuuuguagauaaauuauuuuuuuaagagaaagguagaaggagauuugacacacucagagaaggcacuguuaagacagcagagaaagaauuaaagaugcuugccuugaaaauuggagugauguggcugcaagccaaaggaagcuggcagccaucggaagcuggaacaggcaaggaauggauucaucccuggagccuccagagagaguauggcccuucuagcaccuuaauuuuggcacagugaaacauuucagacuuuugggcuccagaacuaugagagaauacacuuccguuguuuuaagccaccacuuuugugauaauuuuaauagcaaugucaggaaacuaauacagcccugcguaaucaagacuuauccagcccaaaaagucauuagugcugguguugagaaacccugucauuagugccgguguugagaguugaguagaaucucuacuuuacuuauuggcuggauuagccagcauucuccauucuugaccguggcacacuuggucauggcugcuaagcuacucuuugggguuaaaagucgaucauguuuguuuccaaaccuucuuguguaaauuguucuuguuaauuaaauguguauuguaauuaaauauuaaaccaguagaauauaagauugaaaucuugauuuucgaugacaguaaaugggcauacauuuuauauauuuuguguuuuaaaauuuaagaugcuucagggcaucuauguaucauuuccugauucucugcucgaagugauccugagggcuuccuuugagaaugauggcugugauuuaugaauuauaaacuguaggucuuuaguuauaccacuaggggguacacuuuaaaagcuaauugugauuugacuguagcuguuaggaucauagaauuuaguagguaaaggucuuauuccacuguacucauuucauagcuuaguuuuauuacugauuucuucucaauaccuuuauuuugcuccacuuguuuuaaaaugaaauaaaaacagcucuucauaaaacacucagaaguuuaaugcuacuaagauauuuguaauuuuuggaacauagauacuguccuaaggguguugaguuacaaguauuaauucaguuaaaaauacugcuuuguuugcauuaugaaauaggucaguaguguagucauuuggaucacauggcuggcuaauaguaauaauaagcccauuggaucucucaucauuccccuaaucuugaaauuuguauucuuugguuuauuauaguugaauaacaagaucagcuagaggauguuuuugcaauuauaaaguuacugauacaguaguuugcuuuuaaccuaaaguggacauuuuuguauaggguuugcguuuuguuaaagcaaaggauuauuaacaaauuuuuacugagcauccucccuuuauugcauguuguguaauaacaguuuccuuugaaaacaggaaguauaugcuuggcccacugucuauggaauagaauacuacgaagaugguuggugauagagaacaaaacauguucacuaaaucauuuagggauuuuuuuuuuaagucuuaaaacugaacaagaagugaccccaguaggauuugccaaaaauuaaugcuagauuauagugugcuuuaugcuguauaugauaugggcuaaacagcagagagccauaauuacuugaacuaaacauacagugcuuauuggauuuuaauguagaaugaaaugcagaaugaugcaaauccugagaauaaccaugucauuugaagaguguuguuuccuaugacaaaauggaaaaguaaccagcucccuuacuaugagaaggagguuugcuuauucaguuuaaauucuuuuuuuguauccacauaggcaugagaaacuuaguaaagaaguaugaaccacccagaucugaagaaguugcuguucugaaacagaaguuggagcgaugucauucugcugagcuugcacuuaacguaaucacguaaguuaaugugacaguguuaaucaauagacauaacuguuauccaguccagcugguucguaaaucauuuuauugguguuugcucauuagaggaaagcugacugauccauaaaaucagauuuucuuuauugaauggacauuucuaaugagauuaagguaauaguucggcauucacugugcaguucugauccugcugugacucauauguucuuuggcuugcaggcccuguccuguucuguuacuucucaugggauuucaggggucagggucuuccuaaggaauccuuuuaccuuuuccuguccuuuuaaucuuuugucucuuugaaguugugauaucuggucugaggaacaaauaugcucuuccagacuucuguuagcuagaguagagaaaguuggcauacuucuuuuuuuuuuuuuucuuugagauggagucucgcucuauugcccagacuggagugcaguggcgcgaucucagcucacugcaagcucugccuuccagguucaggucauucuccugccucagccuccugaguagcugggacuacaggcgcccuccaccacgcccagcuaauuuuuuguauuuuuaguagagacgggguuucaucguguuagccaggauggucucaaucuccugaccucaugauccgcccaccuuggccucccggcauacuucuuucagugacaaacuuuauagugaccacaaagccaauaggaaaagaggccauguaauuucuucuuguggcuagccauaagaacaccuuuaaugucucuuaauugauuuguaagcugaaugugaaaaucaccauaaaauuggcaauuugugcuuugcaaauugaaagauccacugaaacuuucuuuuuuagguguuuaagcaguugggaauuuggacagguacuaggauuaaugaaacugccauuuucuauuuccugugggaugcauuuuguuacuuaaaguuauaccuuauuuguuaaaauuuaaugggaguuaucuguggcaucuuauauuuaagauguauuugagguauuauuucuguaauuggugaauaugugcugcuggauaacuaugaaaagccagaacagcaauuccaaggccuuuaugucaaauacacaugacucaaauuccuuaccuauacaguuguaguuggggaauaucuacggacuuaggaagugugcagaauaugagguuguuuuauuauaguuauagguauaacgacaaagcauguuuuagcauagaacuugaaauugguggauuucauucacuccucgguuucagugguaacaggaauuuuucagagugguuacagagaaguaauguugacuuuaaugaauaaaaguauugcagcacugauuauguccuuuuugcauugauuuugaaaugggauuagaccagggguuggcaaacuguuaccuaccaggcauauccagcccauuagcguuuuuagaacacaguuucuuggaauguagcacaccuauucguuuauauaucaccuauggcuauuuucaugauacagcagaaaaguuagguaguugcaacagaaacugguuauagggccugcaaggccgaaaauauuuacugucucuuuaaagaaaaaguuuauccaccccuggauuagaccacugaacuacuaauccuacccuuucuagcuaaguaacugaauggaccauaauccaaaauucuuaacugccauagcuuacauuguauuccagauugccaucugccuuguacugggccaaauucugaauaucuaugaguacuugaggggugcuucucaaacugcgaaggacuuuuuuaaaaaaaaaucacuagauguauacuuuuguaaaauucaauaaaaaaugaauuacuagaaaagugaagacaaaaacauaagcucaaguuuuauuagauucagcagucauaaaauuauuauaucaaauugcuauuaaaaauuucuagggccgggcacaguggcucaugccuguaaucucagcaguuugggaggcuaaggcgggcggaucaccugaggucgggaguucgagaccagccuggccaacauggcgaaaccccgucucuacuaaaaauacaauaaucagcuggacgugguggugggugccuguaaucccagcuacuuguaagacugaggcagggagaacugcuugaacccuggaggggucacagugagccaagaucacgccauugcacuccagccugggcaacagagcaagacucugucucaaaaaaaaaaacaaaaaaaaaauuaugaaacacaauuccuguacuuaacucacugcaaacuggaaacuguucauggaccagcucugguacuugcuaccaugaguagugcuacuuuaggacuaaauauuuguuuuccuugaucuucaaaauuauuuuaccuuuaguuuucaugacacaaaaacuguuuugucauugucagucaauacaagugaaaccaaaguucccuuugaucaaaacccaaaucugucaugaccucagaaguuacuuagcaguuguuuaccuuugccagccuuuucucugcacguauauccauauauuuaugaaauaagcagcguuuuuuucuucuuugcauuuuucauacauauuguacaaugggugauuaucaaugcuuagcuuuugcuagucugggugaaaaaguaucacauugguauuuuaauuugcauuuucuugauuaugggacauugaacuuuccauacuuaacagucacuuauauuucaucuguauugcuuauuuauccccuuugcccaauuuucuggcuuuuuuguuuguuuguuuguuuuugagauggagucuugcugugucacccaggcuugagugcaguggcgugaucucacugcaaccucugccucccggguucaagcaguucuccugccucagccuuccaaguagcugggacgacaggugcaugccaacaugcccagcuaauuuuuuuuuguauuuuuaguagagacgggauuuuaccguguuagccaaggauggucucaagcuccugacgucgugauccgcccgccucagccucccaaagugcugggauuacaggcgugagccacugcaccuggccacauuuuugugguuuguagugcuuuauagauucuauauacagucauccuucaguauccaugggggauugguuucaggacuuucugcucauaaccacaauccacagaugcccuaauacaaaauggcguauuugcauauaaccuauacacauccucccauauacuuuaaaucaucucuagauuacuuauaauaccuaaauacaauguaaauguuauguaaauaguuauacuguauucuugagggaauaauaagaaaaaauucuguacauguucaguacagauagaauuuuuuuccuuauuuucaauccgcaguugguuuaguccacagauguggaacccacaggauacagaaggcugauuguacuuauuuauauaugauauauuauuuauauaugauauauucuauuguuuuucacaacuuuuuuccaaauacuaauuuuugccccagcucccacaccccgcuuuuuugagaaaaagucuucucucugucauccaggugugauggagugcaguggcuugaucuuggcucacugcacccucugccuucugggcucaagugaucuuccuaccugagccucucagcagcugggacuacaggugcucaaccacauugguuaauuuuuuaauuuuuuuguagagacgagguuucgccacauugcucaggcuggccucaaacucuugggcucaggcgaucugacgccucggccuccuaaagagcugggauuacaauugugagccccugugcccagcaggucccagcucauuuuuuauuucauguuuuccuaguuacuugaaacacuucuuaucacacauuaaauucauccuucugcauagucauuacuuugcuuaucuagucugaucauugaucuguuuaauaucucacuuuuaauuaccguagcuuuuguagugugcuuuaaagauaacugggacaagguccuccaacacuguucuuuuuuauauucgcuccuauuuuuucacacucuuuccuaggucaguguuagauuugacaauuccaugaaaaauuuuauuaggguuuuaauuagaauugcauuuaauuuaaagauugauuguaaaaguaucauuuucccuaccccauagcuguuuaucuuuuuccauuuauccuggccuuguuguucaguagauacaugauauugccuauagccuugcuaguuuauuuuacauuuuauaguuucuguggcugguauuggauugcuuauugauaguugcuuaauuauaggaagaagaggaaaggcuaugaagaugaugauuacgucucaaagaaauccaaacaugaggagguauguuuuacuccaaagaugaacucuaaguuauuuuuguuauacauucuggugugacuauacuguuaagauuuauucuccaagaguacaggcauuauagaguuguggguuuuuucauuuuuugcauacuuccuuacguacaguacuguuguccauuauuaaagggauuuuucucucuucugucuuuauuuaaugaagaauccuuccuguguucauagaaagcagaagcaauauguauacauacuacauuuuugcuuuuuuucuuauucuccaaggauuuuucccuuacccccuuuuaaaaaaaauuuucuaucugucaagucaaauaagugaauaaucagaggcaaaaggucacagccauaaccuuuauuccucacuggaggagucuggugagaccaugccaacauuacuaacagugaacuauuacaaaauuuccugguuuaucuuuuguaauccacauggguaaaaggaggagaacauuuucuuaaagggagguaagagguaaacaauacugguuaugcuucaguguuauccuuaccacacuuuuuuuccuucuuaggaagaauggacugaugacgaccugguagaaucucucuaaccauuugaaguugauuucucaaugcuaacuaaucaagagaaguaggaagcauaucaaacguuuaacuuuauuuaaaaaguauaaugugaaaacauaaaauauauuaaaacuuuucuauuguuuucuuucccuuucacaguaacuuuauguaaaauaaaccaucuucaaaagagcuagaauagcaccuguuuugaauauucuuauuccaucgugacuaauaucaaauuaaagcugcaacucauuugccuaauuuuuuaagcaaaauaugauaggcaaaccuaugcuuuuuuuaaaaaaggcaccacaaaaaacaaaacuuaguagccagcuuuaaaaguguuaaggaauguguuuugcccucuagaaaccuuuauaaauggcuuuuugaaugccauccugauauauuuagcuauuuguccauuacuauuaaacugcagaagguauuucaacuguuacaugguacugaaagccagucgucuggguaaugaauauuauuuuucuuuaguuacccgaaaacauuuccaaauggguuuuuaaaaaaaaccagauauaugauuuugaauagcugucuacaucaaacucuuacgcuaguauagauaaguagguagcagcaaauuguauauucaguugugguuguuuuuuaauuuuguuuugauguaaggucuugcuauguugcccaggcugucucagacuccuaggcucuagugauccucugccucaguuuucugaguaauugggacuacaggcacacaucaccacagccuuauaauuaaccuauuagauccuauaagugaauccguguaaguagauuauaacaguuacuaggaauuuugcagauuaaauauguuagagaaauguaauucaaauugaaaugagucaauauaaaaauaugaaagcacagacuauuacagcaaauuacuuacauaugaaucauggccagcuguauuucacuaugugaccuugguaaguuauuaaaccucuaagugccaguuucccacacugaaaauggggaagauaaaaaugccuacucuucauaggauuaauuagaauaguaccugcauacacuaguauucaguaaguguuaacuauuauaauuggaaccaaacuguggacgucuguuuaccaagccagauuuuuuucaggaaaacuggcuugaaggaauuccgaguaauucaaguguccugaaucuaauuaaauugcacaaauacacacaccuccucagucucaguacaucccaggcuguacuuuccagaaagguagguaccauuauaguuacaucuauuuuaaggcaauacuuacuauaugcauauucaucucucuaacaauaauucuuuacacuguaggcuugaguuuuguggguuuuuuuuuuuucucauuccagagugaaaggaauaaaauucgugaugugagauuuuuacaaaagcagaguggaagaagccaaaaguuauaaauccuccaucgcaguccuaguuaaauauauugcugcuaggcucuagacagaauuacaagauguucacaauuugucucauuuucccuuucagaucgccaaacuuuggcaucagagcaagguccacacuuaucacugaaaauuuucccacccagccccauuaaaaacguuaaagugugagagauuuuauuucaacacugacaagcuaguuacuagagggccuacaaagguaaguaacaaguuuccauuucaacuugagagacaaaugauguuaaaauauaagaagcaggguaagucagguuugugauuuuaaauaaaagggagaaggauuucagacugaggaaugacagguuaguauggcuaaagauugaggugugauaaaugggagccaaagugcacagcaaaaauaucuugacuaauccauauccucccugucuucuaucauguaaccaaggaaggagaccaccugggauacuauguugguccaaguccagcuaaaaaacagaagggguggaaaggagaguaauuugauaaaagagccaagaagggagagaauggaaugaauugagcugauuucaaggaaaaggagcaugggacauguugagauuuuugguaucaguguuaaacggugauugaagccacauagguuagcagcccccauagaaauaacugccuuuuguagcuuggaacuacuaagcagacaucuuuuaagcccuuagcauuuuuuuuuccuguauuuuauacauuagaggaauagcauaaaguguugcucuuggaaucuagggcuuuccuuacugugggaacaccuccuuggguuccugucucacucacuuugauuaccaaugucauucugccacguauguuccauauguccuaucuaucugcccugcacaauuaugagagggaaggaauuauugcauuuauaaaauccuuuucaaaagaggccauuagcaaaaauacuaaucuaaagcuucagcuucucccugggccuugcucugaugcuaagguuuaaacugccccugaaggaggaagaaaauaaauaaauuaaaugcuuagcucuuuuagacagaaguaaucaauuaugcaagauaucccuugguuuuauuuuaacuuaaccuuugugaauacuucacaaaaauacacauacagaaguaaauaaaacuauacaguugaacuaaauauccagcagauacaacaaguagucagaaguucaaagauggauaaguuaggcagcugaugagguugucugcauaaucaaagggguagcacaaauaaugaacaaauaacuuuuaacaaaagcauucuaguuaacauaaaagaaauugguagucuauaaaaugguugaauggguaacaugcauugaucaauacaacaaccaauaauauuuacugaauucaaacuauuuacuuguaaacauuuaacaaagcauuaugagaucuaaauacagucuuugacaauuucaacaaaauaagucguauguuuaaaaaauaaagcugaugagcaauagaucauucuauauauuuucuuucaacaguuccagcaagagaaauagcagaguauuuuuuaaaaguauacagcaaagauuguuccuauuauaaugacaaacucuggaaacuguaaauacaaauaaucauugaacagucaaauggucauauuccuaaucaggaaguaguuacaguaagaacagucugcaauccaguuauacacaauugucaauaagaauguguuucuugucaguugauuucauaguucuuucucuaagagacagcaaaacuuuggcaacuggguguacugaaaauauauuuugaaaguucgagauaucaagauacagucauagcauuucguuuugugaaagguggucuguacaccaaggcucagagguuguuaaagauugauuccauguggaaauagugcaaauauccugcacagauagcuuacaagguugcuggcauaguuauucaccagcagaaucuuggauuuuguuugcauagcucacacaucacuggaauguggaaaagugugcuauuuuuuggcaagagcaaaggagacauuaaacugaagugaauuaccauguuggacaugcugaauccaugcagaacacuggggcgaaggcugcuaccugacaucauugguuuuuguauacugguuuuguuuuuguugaagcaguucuguuauagccagaagcuuuuucaauacgugcuagacagaggaaaaaugguaugaaaauaaaugaaagcucggucagcaauuucaggaugggaaccuggauuugaaaaaaacuguaucaaagcaaaaggaugcauaaaauauuaccacaauuccccucaaaacauaagucucuauuauucagucauuggcugaguauuucuggucauaacuaagagaauuuuuauacccuaaagugaacagaaauuuguuuguguuuggcaugcuccuauuuuuuaggccagaacuaucacacuaucacauguugucagaagcaguuuaucucucuuuuaaaaaaggcuuuuuuuauuuaauaucuaaggcaagucaagucauauuauuaguuuugaaagcugcggggggaggggcggggagaaacaggacuugaggauucuagaaucucagguuguagagaacucagucaccaaacucaaugcuuuaaucccuucuacaaaaucccugccaaaugguuagccagugcggugacagcauucacuaucuccugaaacuacauuagaaacuagucaaaacugucccuguggucacuuccucucaguagcccuuaugucagcugaggacauucaaaguguaacucauuuuguucuauaucuccaauaucuuaauugaccugguauuaagucccuucaaauucuggucuggucuuugaauacauccuuaucuguaucuguuuggugcagauggcagauagaagucuaucaauguagucuacuguuucucaaaguguaggccaugguucacuugcaucggaauaccuauaaauuccucuaagaguuuguuagacgugcagcuuucaaggccacacuucagaaccucuggaugugaaauuugacaaacaucccaaauaauaaucauuuguuucacaguuugagaaucacuuuggccaugcacuauaucuguaugugacagagaaaagacaagacagaaacugaaagaaaaaaaaauaaaaucaauauugacuuacuaacuagccauuuucacacaugcuaccaaaguguuauuacacuguuuuccaguagaauuaacauucagacucaagagcaaaaccugauguuuuucaguauuaaauguacaucauuuuagucggggcccguuauuucugucugcugagaucuuuuguaauaugaugcagagucucaaaaauuuaauguaacaagauaaaaauguuaaccagaauucagcuauuuauuaacucucuaaguguuaucuuugaaacaucauuguuaaugaaggcuggcgaaagccuaccugcugugcaccacgcucauuacugagcguucgaaguucaucugaaugagccacgcaaaucucaugcaaugcugcuaaaucacgggacagguccguucuagaaugcucuguaguguccggaaguucagguacauucuuuaagggaaucguaaaauugcauuuagaaauacaaaucuucuuuuuuuuuguuuuuuuugagacagaguuucgcucuuguugcccaggcugaaaugcaauggcaugaucucggcucacugcaaccuccgccucccggguucaagcgauucuccugccucagccucccaaguagcugggauuacaggcaccugccaccaugcccagcuaauuuuuuguuacaaauacaaaucuuucucuguagucucaugugaaaagauucuaauuggguauauuagauaauuuuuuuaauacucaaauuucucuuaaaauucuaaagauucuuauugaaauauaauauucaguauuaaugaugguaaaauauagacuuuguaaccuuuguauucacaugaaagccagauuccauuuuuuuccguagcaugacagauguguacaauauuauugcuauucuaaaaauaaggggugggggguguggcuuccuaacaauuagcuuuguaucugaaaaaaucuagaacauaugccaaauaguguagguuaacugcuaaucuggauuaaaugcagccuaaacuuaaaauuccuagaugaaauuucauuauuaagcuccuguaguuugucuaaguugauaaugcauauaaguaggaacugcacuaugaaaaugcaaugagaaccugucagguuugcaauuaucuguggacuaugcucagaauacuugcuaaugugugggaauaaucaguguuaauuaugguacuuucagauaagguucauaaaguaacuuagucacuauaaugaaaguuuauaguauagguugaauaucacccaaaaugcuugagaccagaaguguuucggauuuuggaauauuugcaguauacuugccaguugagcauccccaauccaaaaauccaaaauuggagauuuuccaaauagcauuuccuguuggugcucaacaaguuuuggauuuuuuagcauuucagauuucagauuagggauacucaaccuguacuuuauuaucgacacuaaaugccaguguuauuuuaagccuuggaauaacauuuaacaagggcuuggauuaccaguaaaauggugacaguauuugcuuuacauugcuaaaaacugcaaaacaauguuaucuaugggacagagaaacacaguuacucagaauacauucagugauuaaagguuuauagcgaugaaagacuccauauuugccuucagagaacugacuccaguagaaaggacuuuagaauaaaguaaucauagcaacacagaauuauauaucacagauacacaggggaugcuuaggagguaaaacaaaaguuauuuuauucauguuugggguucagcaaaagcuuccugaaggagauaauaauugaggugggucuucaaaaauaaauuuggcuuauuauacagguggugaagaaauaugguaguauuauauuuggauucuaagcaguaugaaaucuuagauuguguggcauaacuucucacacaguuccuuaaacauuauaguaaaaauauuuuccaaugauugaccaacuauaucccaguucacauauagaagcaugauggacuuuuagcauuuuuguccauuucacuauaaauuucacuauaaauauggagcuaugccauaauuuuucauacacuaguuuuuauaccugagguugcaaacuagugacucaacggcauuccugauuuguuugccacaaauugugguggucuuuuuaacugaaucugaauacauuaagacagaacauggacaccucaaucuccaauccuagcacucccuaaugccaugccuuacaccuggcucuauucacauguacaugcaccuuccugguuucucuguauaugaacugaauuacuaauaaguuuaguuuaaaacugacucaguaccugaaaaucuguucaaucaugaaaauuuaacuugauuaagaaaggcaggguccuagaaauuauaaaauacccucauucguaauuuuguaaucacaauuuauuuuauuaacaaggcccaaaugaggcacagauauucacacugaaugaaguguaacaccgaauccacgucuuuuauuccuagaaaagaagacuuuucagucuacuuauuuaaccuggucagaacugugucaucgucuugcuucacgccccacauaguagcagcaaaguaaaaaagcuaaggaggcaacagaaugucauggcagucagaugugauagcuuuaaaaggauaugaaaagcaagacagacccuaaaaaaugauggaaguagucuaaaagccacaauaauguaugcuuugguguaaacuauuuaguguaagaauaaaugguuuuaauuacaaacaaaaauauguuuuuuguuuaggaaggcagacaaaaauuugcaggcuuuuugucuuuuuaguuuuggauagaaaaucuuucuaaagauugcugcuuaaauggguuaacucagcuauaucaacuagaagucuuaaaaaaaguaccugaaaacuauauacauaccccaaguucaucuaaaaacaugaucauacgauguuuguugcuuuugaugaauggauugacaccuuccauguagggcuccugaaaaauaaaaugcuucuguuauaugcaccagaaacaaaccacuguuugaucuauuagguuggugcaaaaguaauuacaguuaacagcaaaaacugcaauuacuauugcaccaaauuaauauagcaaaacccauacauguagcaauacuucuuauaaauuagguguagcagcagcaacacauucacaagaauuaauuaaaucauauaaugacaguauuuuccuucuaguauauaagcaaauggcuauacugaggaguauggguauuuuuaaugaaagaaaauucuggacccaagcacaaaucguaacacauagccuggcagacacaaauuguuuauauauaaauucacucaaacauggccccaaaucauagguuugaauccagcagagauuacagggaauuaaaauacaauauaauaaagacugcaauaggaaaauaucuuauuuguaaccugccucaaagauucagaugaauucaaaaccuaggccauacacguaguuaacugcucaucguacuaaaauccugacuacuuaaaaccaugcuauaaauagggaaaauguuaagauuaacacacucuuuuaaaaucaguaagaaacucaaugagauaaggaccucaauaggcaauuccaaagauaaagacaugaaagucucucuaacaguaauaaaauaaugaaacacaaaauauuaugccuauccaauuggcaaaaaagaaaaaaguauaguacccaaugaguucuggcaaggcugugaggagcaauaaaaguaucuuaaauugcugacaggaaaucuuguaacacauagcaaaagccuaaaacguauuuacuuagugauuuuacuccaaaguucagcuaauaauugaguaaguaugaaaggaaauguaugcaagaauauauguuacaacaauaacagggacaaauggaagccaucuaaauauccauuauuaagaauagugaaagaguuaucuauuuccacauauggcaagaagucugucacguauuaggugacaaaagcaggaggcaugauaugaucccaacugaauaucagucauuauccuuagauaguacaauuaaguguagguguuuaaaaaaauaaaaucuugaguuuuaacauuuacagugaauguuugugaaauaaauuuuuaaaugacuuuuuguauuaaaauguacucauugauuauguuuaaaagugggagaauuugaguacacuggaccuugaaaaauucguuuucuauaauggcuaaauuuguguuuuuuaaaguuccacuauuaaaauguaaaauuuaaacaagcuacuuuaaaaacaaacauaccaacaaaaauaaucuuucaucgcuaaaaauuucacugcuaaaaauuuacuuaagccacaauuuaugguuuuaucaugucaaacuugcauucauaaauuacauuuuaaaguaucaaaauguuuuuaccuuagcuccaaauuccacaagauuugcuaaguucugcacagauuuagccacuaauaucaguguucuugcagcaauaggagauggagaaucuguaacagaauugggcacagcuaaugacaccaaguccaacagcacuuccagcuaaaccauuauaaauuuagcacuuuaauauuucuuuacuguuaaacuacuacccauucuuccauucggaacucagaauguuuuuggaaaaauguuuuuugaaaaauuuaugauccauaaaauucaaaagaacuugaauuaaaagagaaaaagugaauaugcuuaucagugcuucuaggcuugcgaaaaggguacuacaaaacucagcaguuuccaacgguugauacuauuucaaaggaccucaaagcuuuaccuuuaucacuaaaaaagauugucacuccucacaucuuuuaugacaguucacaaagcuaauuucaaccuacucagguuagcaaucugagcaauucccugcucccaacauuauuugcaguccaaauaauucgcuuaaagcucaagaagcaagauaaagucuaggaccucugcuuuauuuugaggagaaaaacaugaaauuuaauaaacuuuuaaaauauuuuaaagguaagucaggaagcacuucccuguggaacacagauaguaggauguaaaugaaaaguauuggugucuauuaaauauaagcucuggaacuuaauuauuuaacaguaaaaucccauaaauaaucuaccugacugccuaguuuuagaugguguugucugaggcgaacauccagauaaaucucuccaaaagaauuucaaacccuuaauauuaauaauuuauagauuuaaccacuuuaguagcaauaaaagauaauuacagagaugugauggcuauauagaaguaaaaauuaagacauuccaaaacauuuuuaguacaauuuugagcuucagauuauuaagguaaaaaugguuccaguuccuacuguuuauaaugguucauuauuacauucaaagucacaaauaucccuguuauccuuucuuugaaagaagcuuuuaacaccugaaagucaucucaaaauggauauauggguaauaaaacuggaucagguuuacugaaguuuaaaauggccaauuuacacuauauaacuggugacuuuaaaaaucucuaacgggaggaaccaggacugcuuucuucauaaguacucacagaauacuauuccaacuguacauaucauuuaauuugaucuugaagaucuagcuggcagcagucuagcaaugggcuaagcaaagcucuucccaacuugaaaaagccaagcugcagacuacaagaagucacuuauuauaaagguuugagacacaaauagggguagaaaaaagguggaauguguguaaucaugccaucucagaccagauaugagauggaagaaaagaaacaaaaagaaaaaagcccaagaagcacaagcacaaggaaggaagggugcuuuggaauacuucauauaugccaugacuagaauuggaugaucaaaaaaaaaaaaaagauuuaagaguauucuuaaauaguaugaaacuguuaauucuaauauuuugaauuucaaaauguaucaaaagcugauuaccugagaugauauugaacauccguggauucaggauggcaggacagaugagucgaagaaaaacaaaaccacugaaugggagggaaauuuuuuuuuuuuuuuuuuagaaaacaccuauauaauguguuacauuaaaacaauauauauaaacagaauuuuuaguacucauagaacccauaaaauucacucuaaaccaauaaaagaaagcccagacacagaaagcuuuaagaaaacaguaagccaaagcaucguauuuuaagaauauauauaucugcuucuugaauguauuacucacuuuucccaauuuagaauguggauuaacuuugggaaaauguuguuuaucuguaguauuuacugucuugcuuacuauuuauuauuccaggcuaguggucauuugauacuuagagaaaguaguauccucaggaaucuuaagaauuucugaaauaccacaggaguagaaauaaacuuuuuauauaagcauaguucuguacaauuuuagaacuucacacacccucauuucuuaauuuauuuaaacagaacagccuaaguugguugcauugauuuuguugaugauucacauaaaaauaagaauccauugcacuagagaaaaagugacuuauugaucaaugaaaaugucuauaauagaacacuggaaagguuuucuuuuuuccuuuuuucuuuguuuucuuugagauaggguuuuguucugucacccaggcuggagugcaguggcccacaaucacagcucacugcaaccuugaaccccugggaucaaacaauucucuugccucaggcuuagaguaguuaggacuacaggugcacaucaccauaccuggcaauuuuuuuuuuuuuuuaauuauuuuuguagaaagcagagucucgcuacggugcccaggacaauuucaaauuccuggccucaagcaauccuccugucuuggucuaaacauguugagauuacaggcuugagccaccaugcccagccugaaaaacuuuuaagacaagacauuaggaauucuaaaguuuuaaaaaguugucaaauuauaaaacaauagcaaaagcaaaaauuauacuaacagcugucauauaugauuuuaucugcuaauuuuacuuugggacaaugucaguguuaaaagcuugcauagauacuccuauucugccuccuuuagucacugguagggaggauauguugucauguagauaauuucuaauuuccuuuuaagaagaauccacacuaauaauuaaccucuuacuugccccauguaaagacaagcauuauuccuaaaauaaugaauuaugcaauuccuucuacagauugauagacauaauccauguaaagacaagcauuauucccaaaauaaugaguuacgcaauuccuucuauagauuaauagauacaaucucuguucucuguuagaguggauuacccaauuucuuagcauuuaccuuugaacauguaccuguuugcuaauuuuuggacucuuagaaaguaaagauguuacuucucaaacagcauuuauagaaauucuaauauauuggcugggcaugguggcucaugccuguaauccaacacuuugggaggccgagguggguguaccaccugaggccaggaguucaagaccagccuggccaacauggucuaaccccaucucuacuaaaaauacaaaaauagccagguaugguggugcaugccuguaauccagcuacuuggguggaugaagcacaagaaucucacuugaaccugggaggcggggguugcaguaagccgaaaucacaccacugcacuccagcaugggcaacagagcaagacccugucucaaaaaaauaacaauuaagucuuuaauuuuggacuucccaaauuuaaagaaucuuguaaacuuuacuugaaaauauugugauaauuauacauaguaggucuaugagccugaaaccuaaccuuggcaaaaaugcccuaaaacacccucuugcacgaaacaguuuacaauuuccugcuguguuugcuuaacaguuauacuuguuugaaacuuacaaauuuauagaacaguuuuaauuuacaucucacacguaacugugcuggaauauuaugcuuguaauucuuuucuauuccucccaaucaccacuaaugccaagaaaaacagaaucuguaguucuuaaauauuaugucauaucauaaccaagagaaauauuaccugccccccaaaaaaagaaauagaagccccuugacaaaauuuagguuggaggcaggauuaacacauuuucaaaacaaacuguguaauaaugguguuaaugguugccuaauuauuuuacauauagcaugacaugacaguguauauucuaaauaacaaauuauauuauuagaaaacugcuguauuccaugacgcuuucgcauuaaacuuccauuugccuggaauuaguugggguauuaguuggaguaugcuuaacaaaagcaaaagccuacaauaagacucaaggauaucagauugggucuuagaaaguuaccuuuaguucugccuuagccaccagcuuucuauaaaaccuuaguucaacuuaaccucuccagacagaucugcuucuucauuggaaaaauaaguuagaauaaugauaaugaaguaaccuuacguaagcucccaaauuccaugauuugccaaagcaguucuuccuauagaauaaugauaaugaagucccuuuauauaagcucccaaauuccaugauuugccaaagcaguucuuccuaauuaugguacaaugagcagacugaaacacagcuucagaacuacauguucugguucugauuagcucagagucacagauuguaacaaaccaauuaauaucuaaaucggucaauuacugcccuucucucucacugccaaucaauguguguguauguaugaagaauacuauaugaaguuagcuacagauuuuguuauauaacuuuuagccucaucuuguaaggguuuaaaaauccccaauacuugacuauaaaugaauguucauguuuuuagaaaaugcaaacggcagcuaaaucucacaguaacuuucaguuuaggagccaucuggacuuagaaaauaugcaacagggcuuugacauaaaagccaaagaaaaaagcauugaauuguauauuguuauuccucaauuuuucacaauuauccaccuauuaguaugugauuuaacaaaucaauugaugagccuuaccuaacaacucuug

SEQ ID NO: 17352 - RNA, 32383 nt, Homo sapiens
caagaguuguuagguaaggcucaucaauugauuuguuaaaucacauacuaauagguggauaauugugaaaaauugaggaauaacaauauacaauucaaugcuuuuuucuuuggcuuuuaugucaaagcccuguugcauauuuucuaaguccagauggcuccuaaacugaaaguuacugugagauuuagcugccguuugcauuuucuaaaaacaugaacauucauuuauagucaaguauuggggauuuuuaaacccuuacaagaugaggcuaaaaguuauauaacaaaaucuguagcuaacuucauauaguauucuucauacauacacacacauugauuggcagugagagagaagggcaguaauugaccgauuuagauauuaauugguuuguuacaaucugugacucugagcuaaucagaaccagaacauguaguucugaagcuguguuucagucugcucauuguaccauaauuaggaagaacugcuuuggcaaaucauggaauuugggagcuuauauaaagggacuucauuaucauuauucuauaggaagaacugcuuuggcaaaucauggaauuugggagcuuacguaagguuacuucauuaucauuauucuaacuuauuuuuccaaugaagaagcagaucugucuggagagguuaaguugaacuaagguuuuauagaaagcugguggcuaaggcagaacuaaagguaacuuucuaagacccaaucugauauccuugagucuuauuguaggcuuuugcuuuuguuaagcauacuccaacuaauaccccaacuaauuccaggcaaauggaaguuuaaugcgaaagcgucauggaauacagcaguuuucuaauaauauaauuuguuauuuagaauauacacugucaugucaugcuauauguaaaauaauuaggcaaccauuaacaccauuauuacacaguuuguuuugaaaauguguuaauccugccuccaaccuaaauuuugucaaggggcuucuauuucuuuuuuuggggggcagguaauauuucucuugguuaugauaugacauaauauuuaagaacuacagauucuguuuuucuuggcauuaguggugauugggaggaauagaaaagaauuacaagcauaauauuccagcacaguuacgugugagauguaaauuaaaacuguucuauaaauuuguaaguuucaaacaaguauaacuguuaagcaaacacagcaggaaauuguaaacuguuucgugcaagaggguguuuuagggcauuuuugccaagguuagguuucaggcucauagaccuacuauguauaauuaucacaauauuuucaaguaaaguuuacaagauucuuuaaauuugggaaguccaaaauuaaagacuuaauuguuauuuuuuugagacagggucuugcucuguugcccaugcuggagugcaguggugugauuucggcuuacugcaacccccgccucccagguucaagugagauucuugugcuucauccacccaaguagcuggauuacaggcaugcaccaccauaccuggcuauuuuuguauuuuuaguagagaugggguuagaccauguuggccaggcuggucuugaacuccuggccucaggugguacacccaccucggccucccaaaguguuggauuacaggcaugagccaccaugcccagccaauauauuagaauuucuauaaaugcuguuugagaaguaacaucuuuacuuucuaagaguccaaaaauuagcaaacagguacauguucaaagguaaaugcuaagaaauuggguaauccacucuaacagagaacagagauuguaucuauuaaucuauagaaggaauugcguaacucauuauuuugggaauaaugcuugucuuuacauggauuaugucuaucaaucuguagaaggaauugcauaauucauuauuuuaggaauaaugcuugucuuuacauggggcaaguaagagguuaauuauuaguguggauucuucuuaaaaggaaauuagaaauuaucuacaugacaacauauccucccuaccagugacuaaaggaggcagaauaggaguaucuaugcaagcuuuuaacacugacauugucccaaaguaaaauuagcagauaaaaucauauaugacagcuguuaguauaauuuuugcuuuugcuauuguuuuauaauuugacaacuuuuuaaaacuuuagaauuccuaaugucuugucuuaaaaguuuuucaggcugggcaugguggcucaagccuguaaucucaacauguuuagaccaagacaggaggauugcuugaggccaggaauuugaaauuguccugggcaccguagcgagacucugcuuucuacaaaaauaauuaaaaaaaaaaaaaaauugccagguauggugaugugcaccuguaguccuaacuacucuaagccugaggcaagagaauuguuugaucccagggguucaagguugcagugagcugugauugugggccacugcacuccagccugggugacagaacaaaacccuaucucaaagaaaacaaagaaaaaaggaaaaaagaaaaccuuuccaguguucuauuauagacauuuucauugaucaauaagucacuuuuucucuagugcaauggauucuuauuuuuaugugaaucaucaacaaaaucaaugcaaccaacuuaggcuguucuguuuaaauaaauuaagaaaugagggugugugaaguucuaaaauuguacagaacuaugcuuauauaaaaaguuuauuucuacuccugugguauuucagaaauucuuaagauuccugaggauacuacuuucucuaaguaucaaaugaccacuagccuggaauaauaaauaguaagcaagacaguaaauacuacagauaaacaacauuuucccaaaguuaauccacauucuaaauugggaaaagugaguaauacauucaagaagcagauauauauauucuuaaaauacgaugcuuuggcuuacuguuuucuuaaagcuuucugugucugggcuuucuuuuauugguuuagagugaauuuuauggguucuaugaguacuaaaaauucuguuuauauauauuguuuuaauguaacacauuauauagguguuuucuaaaaaaaaaaaaaaaaaauuucccucccauucagugguuuuguuuuucuucgacucaucuguccugccauccugaauccacggauguucaauaucaucucagguaaucagcuuuugauacauuuugaaauucaaaauauuagaauuaacaguuucauacuauuuaagaauacucuuaaaucuuuuuuuuuuuuuugaucauccaauucuagucauggcauauaugaaguauuccaaagcacccuuccuuccuugugcuugugcuucuugggcuuuuuucuuuuuguuucuuuucuuccaucucauaucuggucugagauggcaugauuacacacauuccaccuuuuuucuaccccuauuugugucucaaaccuuuauaauaagugacuucuuguagucugcagcuuggcuuuuucaaguugggaagagcuuugcuuagcccauugcuagacugcugccagcuagaucuucaagaucaaauuaaaugauauguacaguuggaauaguauucugugaguacuuaugaagaaagcaguccugguuccucccguuagagauuuuuaaagucaccaguuauauaguguaaauuggccauuuuaaacuucaguaaaccugauccaguuuuauuacccauauauccauuuugagaugacuuucagguguuaaaagcuucuuucaaagaaaggauaacagggauauuugugacuuugaauguaauaaugaaccauuauaaacaguaggaacuggaaccauuuuuaccuuaauaaucugaagcucaaaauuguacuaaaaauguuuuggaaugucuuaauuuuuacuucuauauagccaucacaucucuguaauuaucuuuuauugcuacuaaagugguuaaaucuauaaauuauuaauauuaaggguuugaaauucuuuuggagagauuuaucuggauguucgccucagacaacaccaucuaaaacuaggcagucagguagauuauuuaugggauuuuacuguuaaauaauuaaguuccagagcuuauauuuaauagacaccaauacuuuucauuuacauccuacuaucuguguuccacagggaagugcuuccugacuuaccuuuaaaauauuuuaaaaguuuauuaaauuucauguuuuucuccucaaaauaaagcagagguccuagacuuuaucuugcuucuugagcuuuaagcgaauuauuuggacugcaaauaauguugggagcagggaauugcucagauugcuaaccugaguagguugaaauuagcuuugugaacugucauaaaagaugugaggagugacaaucuuuuuuagugauaaagguaaagcuuugagguccuuugaaauaguaucaaccguuggaaacugcugaguuuuguaguacccuuuucgcaagccuagaagcacugauaagcauauucacuuuuucucuuuuaauucaaguucuuuugaauuuuauggaucauaaauuuuucaaaaaacauuuuuccaaaaacauucugaguuccgaauggaagaauggguaguaguuuaacaguaaagaaauauuaaagugcuaaauuuauaaugguuuagcuggaagugcuguuggacuuggugucauuagcugugcccaauucuguuacagauucuccaucuccuauugcugcaagaacacugauauuaguggcuaaaucugugcagaacuuagcaaaucuuguggaauuuggagcuaagguaaaaacauuuugauacuuuaaaauguaauuuaugaaugcaaguuugacaugauaaaaccauaaauuguggcuuaaguaaauuuuuagcagugaaauuuuuagcgaugaaagauuauuuuuguugguauguuuguuuuuaaaguagcuuguuuaaauuuuacauuuuaauaguggaacuuuaaaaaacacaaauuuagccauuauagaaaacgaauuuuucaagguccaguguacucaaauucucccacuuuuaaacauaaucaaugaguacauuuuaauacaaaaagucauuuaaaaauuuauuucacaaacauucacuguaaauguuaaaacucaagauuuuauuuuuuuaaacaccuacacuuaauuguacuaucuaaggauaaugacugauauucaguugggaucauaucaugccuccugcuuuugucaccuaauacgugacagacuucuugccauauguggaaauagauaacucuuucacuauucuuaauaauggauauuuagauggcuuccauuugucccuguuauuguuguaacauauauucuugcauacauuuccuuucauacuuacucaauuauuagcugaacuuuggaguaaaaucacuaaguaaauacguuuuaggcuuuugcuauguguuacaagauuuccugucagcaauuuaagauacuuuuauugcuccucacagccuugccagaacucauuggguacuauacuuuuuucuuuuuugccaauuggauaggcauaauauuuuguguuucauuauuuuauuacuguuagagagacuuucaugucuuuaucuuuggaauugccuauugagguccuuaucucauugaguuucuuacugauuuuaaaagaguguguuaaucuuaacauuuucccuauuuauagcaugguuuuaaguagucaggauuuuaguacgaugagcaguuaacuacguguauggccuagguuuugaauucaucugaaucuuugaggcagguuacaaauaagauauuuuccuauugcagucuuuauuauauuguauuuuaauucccuguaaucucugcuggauucaaaccuaugauuuggggccauguuugagugaauuuauauauaaacaauuugugucugccaggcuauguguuacgauuugugcuuggguccagaauuuucuuucauuaaaaauacccauacuccucaguauagccauuugcuuauauacuagaaggaaaauacugucauuauaugauuuaauuaauucuugugaauguguugcugcugcuacaccuaauuuauaagaaguauugcuacauguauggguuuugcuauauuaauuuggugcaauaguaauugcaguuuuugcuguuaacuguaauuacuuuugcaccaaccuaauagaucaaacagugguuuguuucuggugcauauaacagaagcauuuuauuuuucaggagcccuacauggaaggugucaauccauucaucaaaagcaacaaacaucguaugaucauguuuuuagaugaacuugggguauguauauaguuuucagguacuuuuuuuaagacuucuaguugauauagcugaguuaacccauuuaagcagcaaucuuuagaaagauuuucuauccaaaacuaaaaagacaaaaagccugcaaauuuuugucugccuuccuaaacaaaaaacauauuuuuguuuguaauuaaaaccauuuauucuuacacuaaauaguuuacaccaaagcauacauuauuguggcuuuuagacuacuuccaucauuuuuuagggucugucuugcuuuucauauccuuuuaaagcuaucacaucugacugccaugacauucuguugccuccuuagcuuuuuuacuuugcugcuacuauguggggcgugaagcaagacgaugacacaguucugaccagguuaaauaaguagacugaaaagucuucuuuucuaggaauaaaagacguggauucgguguuacacuucauucagugugaauaucugugccucauuugggccuuguuaauaaaauaaauugugauuacaaaauuacgaaugaggguauuuuauaauuucuaggacccugccuuucuuaaucaaguuaaauuuucaugauugaacagauuuucagguacugagucaguuuuaaacuaaacuuauuaguaauucaguucauauacagagaaaccaggaaggugcauguacaugugaauagagccagguguaaggcauggcauuagggagugcuaggauuggagauugagguguccauguucugucuuaauguauucagauucaguuaaaaagaccaccacaauuuguggcaaacaaaucaggaaugccguugagucacuaguuugcaaccucagguauaaaaacuaguguaugaaaaauuauggcauagcuccauauuuauagugaaauuuauagugaaauggacaaaaaugcuaaaaguccaucaugcuucuauaugugaacugggauauaguuggucaaucauuggaaaauauuuuuacuauaauguuuaaggaacugugugagaaguuaugccacacaaucuaagauuucauacugcuuagaauccaaauauaauacuaccauauuucuucaccaccuguauaauaagccaaauuuauuuuugaagacccaccucaauuauuaucuccuucaggaagcuuuugcugaaccccaaacaugaauaaaauaacuuuuguuuuaccuccuaagcauccccuguguaucugugauauauaauucuguguugcuaugauuacuuuauucuaaaguccuuucuacuggagucaguucucugaaggcaaauauggagucuuucaucgcuauaaaccuuuaaucacugaauguauucugaguaacuguguuucucugucccauagauaacauuguuuugcaguuuuuagcaauguaaagcaaauacugucaccauuuuacugguaauccaagcccuuguuaaauguuauuccaaggcuuaaaauaacacuggcauuuagugucgauaauaaaguacagguugaguaucccuaaucugaaaucugaaaugcuaaaaaauccaaaacuuguugagcaccaacaggaaaugcuauuuggaaaaucuccaauuuuggauuuuuggauuggggaugcucaacuggcaaguauacugcaaauauuccaaaauccgaaacacuucuggucucaagcauuuugggugauauucaaccuauacuauaaacuuucauuauagugacuaaguuacuuuaugaaccuuaucugaaaguaccauaauuaacacugauuauucccacacauuagcaaguauucugagcauaguccacagauaauugcaaaccugacagguucucauugcauuuucauagugcaguuccuacuuauaugcauuaucaacuuagacaaacuacaggagcuuaauaaugaaauuucaucuaggaauuuuaaguuuaggcugcauuuaauccagauuagcaguuaaccuacacuauuuggcauauguucuagauuuuuucagauacaaagcuaauuguuaggaagccacaccccccaccccuuauuuuuagaauagcaauaauauuguacacaucugucaugcuacggaaaaaaauggaaucuggcuuucaugugaauacaaagguuacaaagucuauauuuuaccaucauuaauacugaauauuauauuucaauaagaaucuuuagaauuuuaagagaaauuugaguauuaaaaaaauuaucuaauauacccaauuagaaucuuuucacaugagacuacagagaaagauuuguauuuguaacaaaaaauuagcugggcaugguggcaggugccuguaaucccagcuacuugggaggcugaggcaggagaaucgcuugaacccgggaggcggagguugcagugagccgagaucaugccauugcauuucagccugggcaacaagagcgaaacucugucucaaaaaaaacaaaaaaaaagaagauuuguauuucuaaaugcaauuuuacgauucccuuaaagaauguaccugaacuuccggacacuacagagcauucuagaacggaccugucccgugauuuagcagcauugcaugagauuugcguggcucauucagaugaacuucgaacgcucaguaaugagcguggugcacagcagguaggcuuucgccagccuucauuaacaaugauguuucaaagauaacacuuagagaguuaauaaauagcugaauucugguuaacauuuuuaucuuguuacauuaaauuuuugagacucugcaucauauuacaaaagaucucagcagacagaaauaacgggccccgacuaaaaugauguacauuuaauacugaaaaacaucagguuuugcucuugagucugaauguuaauucuacuggaaaacaguguaauaacacuuugguagcaugugugaaaauggcuaguuaguaagucaauauugauuuuauuuuuuuuucuuucaguuucugucuugucuuuucucugucacauacagauauagugcauggccaaagugauucucaaacugugaaacaaaugauuauuauuugggauguuugucaaauuucacauccagagguucugaaguguggccuugaaagcugcacgucuaacaaacucuuagaggaauuuauagguauuccgaugcaagugaaccauggccuacacuuugagaaacaguagacuacauugauagacuucuaucugccaucugcaccaaacagauacagauaaggauguauucaaagaccagaccagaauuugaagggacuuaauaccaggucaauuaagauauuggagauauagaacaaaaugaguuacacuuugaauguccucagcugacauaagggcuacugagaggaagugaccacagggacaguuuugacuaguuucuaauguaguuucaggagauagugaaugcugucaccgcacuggcuaaccauuuggcagggauuuuguagaagggauuaaagcauugaguuuggugacugaguucucuacaaccugagauucuagaauccucaaguccuguuucuccccgccccuccccccgcagcuuucaaaacuaauaauaugacuugacuugccuuagauauuaaauaaaaaaagccuuuuuuaaaagagagauaaacugcuucugacaacaugugauagugugauaguucuggccuaaaaaauaggagcaugccaaacacaaacaaauuucuguucacuuuaggguauaaaaauucucuuaguuaugaccagaaauacucagccaaugacugaauaauagagacuuauguuuugaggggaauugugguaauauuuuaugcauccuuuugcuuugauacaguuuuuuucaaauccagguucccauccugaaauugcugaccgagcuuucauuuauuuucauaccauuuuuccucugucuagcacguauugaaaaagcuucuggcuauaacagaacugcuucaacaaaaacaaaaccaguauacaaaaaccaaugaugucagguagcagccuucgccccaguguucugcauggauucagcauguccaacaugguaauucacuucaguuuaaugucuccuuugcucuugccaaaaaauagcacacuuuuccacauuccagugaugugugagcuaugcaaacaaaauccaagauucugcuggugaauaacuaugccagcaaccuuguaagcuaucugugcaggauauuugcacuauuuccacauggaaucaaucuuuaacaaccucugagccuugguguacagaccaccuuucacaaaacgaaaugcuaugacuguaucuugauaucucgaacuuucaaaauauauuuucaguacacccaguugccaaaguuuugcugucucuuagagaaagaacuaugaaaucaacugacaagaaacacauucuuauugacaauuguguauaacuggauugcagacuguucuuacuguaacuacuuccugauuaggaauaugaccauuugacuguucaaugauuauuuguauuuacaguuuccagaguuugucauuauaauaggaacaaucuuugcuguauacuuuuaaaaaauacucugcuauuucucuugcuggaacuguugaaagaaaauauauagaaugaucuauugcucaucagcuuuauuuuuuaaacauacgacuuauuuuguugaaauugucaaagacuguauuuagaucucauaaugcuuuguuaaauguuuacaaguaaauaguuugaauucaguaaauauuauugguuguuguauugaucaaugcauguuacccauucaaccauuuuauagacuaccaauuucuuuuauguuaacuagaaugcuuuuguuaaaaguuauuuguucauuauuugugcuaccccuuugauuaugcagacaaccucaucagcugccuaacuuauccaucuuugaacuucugacuacuuguuguaucugcuggauauuuaguucaacuguauaguuuuauuuacuucuguauguguauuuuugugaaguauucacaaagguuaaguuaaaauaaaaccaagggauaucuugcauaauugauuacuucugucuaaaagagcuaagcauuuaauuuauuuauuuucuuccuccuucaggggcaguuuaaaccuuagcaucagagcaaggcccagggagaagcugaagcuuuagauuaguauuuuugcuaauggccucuuuugaaaaggauuuuauaaaugcaauaauuccuucccucucauaauugugcagggcagauagauaggacauauggaacauacguggcagaaugacauugguaaucaaagugagugagacaggaacccaaggagguguucccacaguaaggaaagcccuagauuccaagagcaacacuuuaugcuauuccucuaauguauaaaauacaggaaaaaaaaaugcuaagggcuuaaaagaugucugcuuaguaguuccaagcuacaaaaggcaguuauuucuaugggggcugcuaaccuauguggcuucaaucaccguuuaacacugauaccaaaaaucucaacaugucccaugcuccuuuuccuugaaaucagcucaauucauuccauucucucccuucuuggcucuuuuaucaaauuacucuccuuuccaccccuucuguuuuuuagcuggacuuggaccaacauaguaucccagguggucuccuuccuugguuacaugauagaagacagggaggauauggauuagucaagauauuuuugcugugcacuuuggcucccauuuaucacaccucaaucuuuagccauacuaaccugucauuccucagucugaaauccuucucccuuuuauuuaaaaucacaaaccugacuuacccugcuucuuauauuuuaacaucauuugucucucaaguugaaauggaaacuuguuacuuaccuuuguaggcccucuaguaacuagcuugucaguguugaaauaaaaucucucacacuuuaacguuuuuaauggggcugggugggaaaauuuucagugauaaguguggaccuugcucugaugccaaaguuuggcgaucugaaagggaaaaugagacaaauugugaacaucuuguaauucugucuagagccuagcagcaauauauuuaacuaggacugcgauggaggauuuauaacuuuuggcuucuuccacucugcuuuuguaaaaaucucacaucacgaauuuuauuccuuucacucuggaaugagaaaaaaaaaaaacccacaaaacucaagccuacaguguaaagaauuauuguuagagagaugaauaugcauauaguaaguauugccuuaaaauagauguaacuauaaugguaccuaccuuucuggaaaguacagccugggauguacugagacugaggagguguguguauuugugcaauuuaauuagauucaggacacuugaauuacucggaauuccuucaagccaguuuuccugaaaaaaaucuggcuugguaaacagacguccacaguuugguuccaauuauaauaguuaacacuuacugaauacuaguguaugcagguacuauucuaauuaauccuaugaagaguaggcauuuuuaucuuccccauuuucagugugggaaacuggcacuuagagguuuaauaacuuaccaaggucacauagugaaauacagcuggccaugauucauauguaaguaauuugcuguaauagucugugcuuucauauuuuuauauugacucauuucaauuugaauuacauuucucuaacauauuuaaucugcaaaauuccuaguaacuguuauaaucuacuuacacggauucacuuauaggaucuaauagguuaauuauaaggcuguggugaugugugccuguagucccaauuacucagaaaacugaggcagaggaucacuagagccuaggagucugagacagccugggcaacauagcaagaccuuacaucaaaacaaaauuaaaaaacaaccacaacugaauauacaauuugcugcuaccuacuuaucuauacuagcguaagaguuugauguagacagcuauucaaaaucauauaucugguuuuuuuuaaaaacccauuuggaaauguuuucggguaacuaaagaaaaauaauauucauuacccagacgacuggcuuucaguaccauguaacaguugaaauaccuucugcaguuuaauaguaauggacaaauagcuaaauauaucaggauggcauucaaaaagccauuuauaaagguuucuagagggcaaaacacauuccuuaacacuuuuaaagcuggcuacuaaguuuuguuuuuuguggugccuuuuuuaaaaaaagcauagguuugccuaucauauuuugcuuaaaaaauuaggcaaaugaguugcagcuuuaauuugauauuagucacgauggaauaagaauauucaaaacaggugcuauucuagcucuuuugaagaugguuuauuuuacauaaaguuacugugaaagggaaagaaaacaauagaaaaguuuuaauauauuuuauguuuucacauuauacuuuuuaaauaaaguuaaacguuugauaugcuuccuacuucucuugauuaguuagcauugagaaaucaacuucaaaugguuagagagauucuaccaggucgucaucaguccauucuuccuaagaaggaaaaaaagugugguaaggauaacacugaagcauaaccaguauuguuuaccucuuaccucccuuuaagaaaauguucuccuccuuuuacccauguggauuacaaaagauaaaccaggaaauuuuguaauaguucacuguuaguaauguuggcauggucucaccagacuccuccagugaggaauaaagguuauggcugugaccuuuugccucugauuauucacuuauuugacuugacagauagaaaauuuuuuuuaaaaggggguaagggaaaaauccuuggagaauaagaaaaaaagcaaaaauguaguauguauacauauugcuucugcuuucuaugaacacaggaaggauucuucauuaaauaaagacagaagagagaaaaaucccuuuaauaauggacaacaguacuguacguaaggaaguaugcaaaaaaugaaaaaacccacaacucuauaaugccuguacucuuggagaauaaaucuuaacaguauagucacaccagaauguauaacaaaaauaacuuagaguucaucuuuggaguaaaacauaccuccucauguuuggauuucuuugagacguaaucaucaucuucauagccuuuccucuucuuccuauaauuaagcaacuaucaauaagcaauccaauaccagccacagaaacuauaaaauguaaaauaaacuagcaaggcuauaggcaauaucauguaucuacugaacaacaaggccaggauaaauggaaaaagauaaacagcuaugggguagggaaaaugauacuuuuacaaucaaucuuuaaauuaaaugcaauucuaauuaaaacccuaauaaaauuuuucauggaauugucaaaucuaacacugaccuaggaaagagugugaaaaaauaggagcgaauauaaaaaagaacaguguuggaggaccuugucccaguuaucuuuaaagcacacuacaaaagcuacgguaauuaaaagugagauauuaaacagaucaaugaucagacuagauaagcaaaguaaugacuaugcagaaggaugaauuuaaugugugauaagaaguguuucaaguaacuaggaaaacaugaaauaaaaaaugagcugggaccugcugggcacaggggcucacaauuguaaucccagcucuuuaggaggccgaggcgucagaucgccugagcccaagaguuugaggccagccugagcaauguggcgaaaccucgucucuacaaaaaaauuaaaaaauuaaccaaugugguugagcaccuguagucccagcugcugagaggcucagguaggaagaucacuugagcccagaaggcagagggugcagugagccaagaucaagccacugcacuccaucacaccuggaugacagagagaagacuuuuucucaaaaaagcggggugugggagcuggggcaaaaauuaguauuuggaaaaaaguugugaaaaacaauagaauauaucauauauaaauaauauaucauauauaaauaaguacaaucagccuucuguauccuguggguuccacaucuguggacuaaaccaacugcggauugaaaauaaggaaaaaaauucuaucuguacugaacauguacagaauuuuuucuuauuauucccucaagaauacaguauaacuauuuacauaacauuuacauuguauuuagguauuauaaguaaucuagagaugauuuaaaguauaugggaggauguguauagguuauaugcaaauacgccauuuuguauuagggcaucuguggauugugguuaugagcagaaaguccugaaaccaaucccccauggauacugaaggaugacuguauauagaaucuauaaagcacuacaaaccacaaaaauguggccaggugcaguggcucacgccuguaaucccagcacuuugggaggcugaggcgggcggaucacgacgucaggagcuugagaccauccuuggcuaacacgguaaaaucccgucucuacuaaaaauacaaaaaaaaauuagcugggcauguuggcaugcaccugucgucccagcuacuuggaaggcugaggcaggagaacugcuugaacccgggaggcagagguugcagugagaucacgccacugcacucaagccugggugacacagcaagacuccaucucaaaaacaaacaaacaaacaaaaaagccagaaaauugggcaaaggggauaaauaagcaauacagaugaaauauaagugacuguuaaguauggaaaguucaaugucccauaaucaagaaaaugcaaauuaaaauaccaaugugauacuuuuucacccagacuagcaaaagcuaagcauugauaaucacccauuguacaauauguaugaaaaaugcaaagaagaaaaaaacgcugcuuauuucauaaauauauggauauacgugcagagaaaaggcuggcaaagguaaacaacugcuaaguaacuucugaggucaugacagauuuggguuuugaucaaagggaacuuugguuucacuuguauugacugacaaugacaaaacaguuuuugugucaugaaaacuaaagguaaaauaauuuugaagaucaaggaaaacaaauauuuaguccuaaaguagcacuacucaugguagcaaguaccagagcugguccaugaacaguuuccaguuugcagugaguuaaguacaggaauuguguuucauaauuuuuuuuuuguuuuuuuuuuugagacagagucuugcucuguugcccaggcuggagugcaauggcgugaucuuggcucacugugaccccuccaggguucaagcaguucucccugccucagucuuacaaguagcugggauuacaggcacccaccaccacguccagcugauuauuguauuuuuaguagagacgggguuucgccauguuggccaggcuggucucgaacucccgaccucaggugauccgcccgccuuagccucccaaacugcugagauuacaggcaugagccacugugcccggcccuagaaauuuuuaauagcaauuugauauaauaauuuuaugacugcugaaucuaauaaaacuugagcuuauguuuuugucuucacuuuucuaguaauucauuuuuuauugaauuuuacaaaaguauacaucuagugauuuuuuuuuaaaaaaguccuucgcaguuugagaagcaccccucaaguacucauagauauucagaauuuggcccaguacaaggcagauggcaaucuggaauacaauguaagcuauggcaguuaagaauuuuggauuaugguccauucaguuacuuagcuagaaaggguaggauuaguaguucaguggucuaauccagggguggauaaacuuuuucuuuaaagagacaguaaauauuuucggccuugcaggcccuauaaccaguuucuguugcaacuaccuaacuuuucugcuguaucaugaaaauagccauaggugauauauaaacgaauaggugugcuacauuccaagaaacuguguucuaaaaacgcuaaugggcuggauaugccugguagguaacaguuugccaaccccuggucuaaucccauuucaaaaucaaugcaaaaaggacauaaucagugcugcaauacuuuuauucauuaaagucaacauuacuucucuguaaccacucugaaaaauuccuguuaccacugaaaccgaggagugaaugaaauccaccaauuucaaguucuaugcuaaaacaugcuuugucguuauaccuauaacuauaauaaaacaaccucauauucugcacacuuccuaaguccguagauauuccccaacuacaacuguauagguaaggaauuugagucauguguauuugacauaaaggccuuggaauugcuguucuggcuuuucauaguuauccagcagcacauauucaccaauuacagaaauaauaccucaaauacaucuuaaauauaagaugccacagauaacucccauuaaauuuuaacaaauaagguauaacuuuaaguaacaaaaugcaucccacaggaaauagaaaauggcaguuucauuaauccuaguaccuguccaaauucccaacugcuuaaacaccuaaaaaagaaaguuucaguggaucuuucaauuugcaaagcacaaauugccaauuuuauggugauuuucacauucagcuuacaaaucaauuaagagacauuaaagguguucuuauggcuagccacaagaagaaauuacauggccucuuuuccuauuggcuuuguggucacuauaaaguuugucacugaaagaaguaugccgggaggccaaggugggcggaucaugaggucaggagauugagaccauccuggcuaacacgaugaaaccccgucucuacuaaaaauacaaaaaauuagcugggcgugguggagggcgccuguagucccagcuacucaggaggcugaggcaggagaaugaccugaaccuggaaggcagagcuugcagugagcugagaucgcgccacugcacuccagucugggcaauagagcgagacuccaucucaaagaaaaaaaaaaaaaagaaguaugccaacuuucucuacucuagcuaacagaagucuggaagagcauauuuguuccucagaccagauaucacaacuucaaagagacaaaagauuaaaaggacaggaaaagguaaaaggauuccuuaggaagacccugaccccugaaaucccaugagaaguaacagaacaggacagggccugcaagccaaagaacauaugagucacagcaggaucagaacugcacagugaaugccgaacuauuaccuuaaucucauuagaaauguccauucaauaaagaaaaucugauuuuauggaucagucagcuuuccucuaaugagcaaacaccaauaaaaugauuuacgaaccagcuggacuggauaacaguuaugucuauugauuaacacugucacauuaacuuacgugauuacguuaagugcaagcucagcagaaugacaucgcuccaacuucuguuucagaacagcaacuucuucagaucugggugguucauacuucuuuacuaaguuucucaugccuauguggauacaaaaaaagaauuuaaacugaauaagcaaaccuccuucucauaguaagggagcugguuacuuuuccauuuugucauaggaaacaacacucuucaaaugacaugguuauucucaggauuugcaucauucugcauuucauucuacauuaaaauccaauaagcacuguauguuuaguucaaguaauuauggcucucugcuguuuagcccauaucauauacagcauaaagcacacuauaaucuagcauuaauuuuuggcaaauccuacuggggucacuucuuguucaguuuuaagacuuaaaaaaaaaaucccuaaaugauuuagugaacauguuuuguucucuaucaccaaccaucuucguaguauucuauuccauagacagugggccaagcauauacuuccuguuuucaaaggaaacuguuauuacacaacaugcaauaaagggaggaugcucaguaaaaauuuguuaauaauccuuugcuuuaacaaaacgcaaacccuauacaaaaauguccacuuuagguuaaaagcaaacuacuguaucaguaacuuuauaauugcaaaaacauccucuagcugaucuuguuauucaacuauaauaaaccaaagaauacaaauuucaagauuaggggaaugaugagagauccaaugggcuuauuauuacuauuagccagccaugugauccaaaugacuacacuacugaccuauuucauaaugcaaacaaagcaguauuuuuaacugaauuaauacuuguaacucaacacccuuaggacaguaucuauguuccaaaaauuacaaauaucuuaguagcauuaaacuucugaguguuuuaugaagagcuguuuuuauuucauuuuaaaacaaguggagcaaaauaaagguauugagaagaaaucaguaauaaaacuaagcuaugaaaugaguacaguggaauaagaccuuuaccuacuaaauucuaugauccuaacagcuacagucaaaucacaauuagcuuuuaaaguguacccccuagugguauaacuaaagaccuacaguuuauaauucauaaaucacagccaucauucucaaaggaagcccucaggaucacuucgagcagagaaucaggaaaugauacauagaugcccugaagcaucuuaaauuuuaaaacacaaaauauauaaaauguaugcccauuuacugucaucgaaaaucaagauuucaaucuuauauucuacugguuuaauauuuaauuacaauacacauuuaauuaacaagaacaauuuacacaagaagguuuggaaacaaacaugaucgacuuuuaaccccaaagaguagcuuagcagccaugaccaagugugccacggucaagaauggagaaugcuggcuaauccagccaauaaguaaaguagagauucuacucaacucucaacaccggcacuaaugacaggguuucucaacaccagcacuaaugacuuuuugggcuggauaagucuugauuacgcagggcuguauuaguuuccugacauugcuauuaaaauuaucacaaaagugguggcuuaaaacaacggaaguguauucucucauaguucuggagcccaaaagucugaaauguuucacugugccaaaauuaaggugcuagaagggccauacucucucuggaggcuccagggaugaauccauuccuugccuguuccagcuuccgauggcugccagcuuccuuuggcuugcagccacaucacuccaauuuucaaggcaagcaucuuuaauucuuucucugcugucuuaacagugccuucucugagugugucaaaucuccuucuaccuuucucuuaaaaaaauaauuuaucuacaaaauagaaguuccaaauuuaaacauuauccuuaaguuauuucccauuacaucuuuuucagugccuaguauguuucuuuauucuuuaaaaggauccuguugucaaucucuaaauccuuucuaaaucugacucuauuuucacucuuugcauaaguucuauauaaaugaacacuacuuccuucuauauaccuucuauuuguucuagaccaaugugucuuucaugcuuccauaauacaguaauucaaugaaaagaaaucuaaacaaaaaucuguuauauuucuaguuaaacaccaagagauuuauuuagaaaggagcuuuguauuggaagaaacauuuuguaaaguguucucuuuuacuuacuuuucauuauaucuaguaacugugacaggcaaguucuguucucuuucagcaucagacucucugauaaauaacuaguaaagaaaagaaaaaaaaaucuauugaaaacauacagcacauugagaaaacaugacaucauaaauuauuuuccuccauccucaucaaaggcaauuaaaaaauuuuuaaauuuaugaauguauaaucuguaacuccuauauuuuaaggauuuauuaccacuuacauuaaaagauguuuauuguuccuuuaaguuuagugacauucagguacaaccuuucagagggaaaauaguaugaaagcaacaguaauagccaguacuuauaacauuuauaucuuuuaauauagaagcccaauaaggcuaaccuuauuuuacagaugaggaaucugaguuacagggaugaacaagucaugaucuuguaacuugcccaaaguaauaaagcuaggaagcagcaaaacuggaaucuggcacuaguaaggauucucuauucccuuaauaugaaagccauuuuaucuauaguugcacuucuguggaguaacagacauucaaaccaacaagacuaccaccuaaugcuuuauaaaucuauugcaucuuauuugcaucaaguccaaaucaaagguguuaaacuuacuuaucaaugugauauaaaacccaaauuaccuguuuuucucagagccacugacaguaugaaaauauaauuucuauauuaaaauuucaguuacucugaaguuuuacauaccugaacuugaccuaugauugauaaaaggcgaaaugaacagauucucaaaauguuaaauaguuuuucaaacacaaaugcaaaaaacuuauuuuucucuuggggguaauaguuagaaaaauagaaagcaaugcuuuaagaacucuuguugcugucuuuauccagauuuauuuaaauuuuauuauaaaguuugguaacuguuugauauuacaucaucaucaucuacugugggaauaaauuuuggaucugaaaaucaggaaaucuccugacaacuaauccauuucuggcuaccaguaauucaaaauaacuaguuuuuuccuuucccucuccuaccuaaaauuccucccauuuuugucaucuuccuuuauuuuuacucuucauuuccuuuugauuucuuaagcauaagggucauagguuuggugcuaagaguuggcugacuagacucauuaucucugugaaguuagcaacucuuaaccucaauuuugaauuugaacuuauaauauugugguguuuuaauaaaauccacaggcaauaagaauaccuaaaguagcagaugaaaaauaaagcucuaaaucugcaagaaagagaagaaaauccagaaauaacgguaauaauccuaugauuaauaaucugaggcauuauccagacuaugacaacagcacaggggcuuucccuuuugaaaucagcaauaaauguaaagcucauuuccacauaucccaaaaauuugccuguaaaucagcuguaaguuaaaaacguuuggaaagcauuucccuaaaggaaaaaaaaaaaaaaaaggcccaaugucuagucucugggaauguuacgaaagccuauuaaauuugcaaggagccaaagguauggcaauuucaauuuugccuuccuggaauuauaaugaacuaaacuucuaagaugaaauaaauucauuuggaccuucacugaagaauuuauagaugcacuauauacaaugcuucaagauuaaucaaacuuuugguuauuugaauuguggaaaagaggacuuuuguucccuuacagaaugaagucugcaggccagguaugguggugugcaccugucaccccagcacuuugggaggccuaggcaggagacuacucgagucuaggagugacugagaugagccuaggcagcauagggaaaccccaacucuacaaaaaaaacaaaaagauuagccaagguguggcggugugugccugugguuccagcuacucagcaagcugaaguaggaggaucgcuugaggcugggagguugaggcugcaaugagcuuugacugugccacugcauuccagccugggugagagugagaugcugucucaaaaaaaauaaccacccaacccccacaaaauuaauggaaguccacaucuuaacuccauauacaucaguaauuuacaugacuaucuuuccuaacacagagauuuaucuuauucauacuccuaaaguguaguacagugcauaguaguacauagaagguaucuaauaaauguuugcuuaguaaauaaguggagauauaaaucacuuugggauuaaacguauacauuuauauacaguuggugagcugcguuugcagagaacaggcauaucauaaauaaaauauaaaccuacaaucccuuauccuagaugcagauguguugcgaaauucuuauuaauaaguauucaugucuuagaaaaguuaucugguguauauauuaugaaaugugaaauacccaagugaugucuguaaucaggaauauuaagauuucugcaagggaacacaaauauuccuauuaagugaaauaaaaacuaaauacaaucugcucuauuugcugccaccuuaucaauggauucugaaauuauggauaagggauuauaaucauguaaaauaguuuuaauuaacuuuaggaaguuuuaucaucuuucuuccucagcuauuucuaggaaugaaaucaagcagaaccucaaaggucauaaauugagaaacuuaauauagaaacuaaaaaugucuaauuggcugcuagcuugugcuucaguuaguuaacaauauuuaacuuccgcgugucauacaugcucuacagaaggggaauaaagauaaaacaaggcagacauuugcugcacucaaguugcucaccaguucacaggaacuucuaaauuugucauauacugauagcuauaucagucuuucaaggaucaccugguuuacuucuacuuuaauccuaaauguauccucuuaguuuaacaguauuuuucaugauguuuaaagauuuccucaaaaggcaauuucauuucuucuucucaccaaccaucccagccacaaagaauauuaaagauuacagucagaaaugauucuaugaauaaauaaacccagugacugaauuugaccuaaguuaaaaaacuaauuaauaccuuuccauaguaauuccagcccuggaggcacuagauaaaauggcagucagggcaauuugggaagguguguauaaaagguaagcauccgucaaugcaauucuauuaagaaagucaucagcuguuuuccucaaaaucucuggauucuccaauaugggauagcgggucuacaaagaaaguuugcaaauguuaccauuucugaggguuuaaauggaguauaacaacaguuuaaaaauuacacaacuccuauuaagaaauauaugcuauaacauaucuaaaguuccuagcacaguaauugacacuguccucaauuuacauuaaucccuucucuugguccuuuuccaccugaguaggaaggggagggaagggaagcucuuagagauuccauugagucuaaaguagggccaagaaauacauauucccagguaaaugcuucucucaggcaacccaggugauucaaauguaaggccacauguaggaauacaccuuauuuuuauaugaaauuccuucuauuuaaaauuugcuuucaggaagaaguaaauaaaaaugaaucucgauuugauuagaacacacuagacuucgaauucccacagaaaaaguuuuagaguaugcccaagagauguggaagaccuccuauuuccugacaguucuucauacccuauaaaauaaacuauaaauccuaaguccucagauauccauaugcaacaccuaaagcacuaagaaagcuuuucuacacucugaaacaaaauauucagagucaauuaugcaaaaaugccucaccugugauaugacaaauucagacccacuacucugaccacaaugccucccuuucuaauauauuuacucauuuacuucacagcuguucucccuccucugaaccuuugcucacuuaucccucuacuugcucccacucaccaguguccucugguccucauuucucuccugaauucccugccccaauaugcugccaacaaauuucuggcaaaaccagaaacugaacagugguugaauccaacaaacuuucgcuuugcaacuauaccaagauuucugagggcugccagagaaaaccauacaagcagaagucugguaauguuacuauaaacucauguucauugaccucagcaaggcucuuaaacacugccaagcaaccauaguauuuccacagacaauugacucuccuauuuuucagugacugcauaaauauuuuccaucugucuuaaugucuuugauaauucucagaaacuccaucacucucagaaaacuaucucuuaccaaagaaaggcgcuauuuccugucaacaccaaauccugaggcauaacaguauccuaacccaugauuuccccuuuuccacuguuaagagaaagagcuauuauucccucuaaggccaguucuuauaccuugcuuccaaaucccaugccaacccccuuccaucuuacuccaaagagacuauuuuguauuucaucuugcucucacuacuagcucuuugccucaguauuuaaaugugcaucagucucuuccauaaaacaaaacacaacaacaaaaaaacucucacccagucagaaaccuggggguucuuccucugucuucaucucuauaugcaaucaauccucauguucuauugauucuaccuaacuacaggcuaagcaucacaaauccaaaaaauucaaaauccgaaaugcuccaaaaucugaaaguuucugagcacugacaugacacucaggaaauucucauuggagcauuucagauuuuggauuugggaugcucaaccaguaagcacaaugcaaauauugcaaaaucaaaaaaaaaaaaaguguaaucccaaguacuuuuagucccaaauuuuuuagauaagggauacucauccuguaucucugaagcccaggaagcucuuucuguauccacaaccuucauacgagugaagcccagcacuaucuuuugcuuggacuccuuuaacgguacccuguuauugacuuaaucuauucuaauccauucuccacguuaugccugacacauacagaugcgcgauaaauaccugauccauaagguugccaacaugaucuuuuaaagcugcaaaucuaaucaugccacucucuaaauuuaaaccuuucacuagcuucucuuugcuguauucaaaaucuguaacauugucuccacagucuagacucugccuuccacucuggcagcagcugucugugaucucuucccccugcauugcuaggcucuguucaggcucuucagcacggaaugguuucuugaauuugagcuuuuuaccagggaagucucugauuggaauguucuucucucuccuauuccuacucugaauuuuauuuuaaaugauacguucucagaauguuuuccuuaccccuuaaucuguuaucucccucuaaaauauauuuuccccucuguaucauugagcacacuggauauaugauugucuaaaaccuuuagauuguaagguucacaaaaguugagacuguuccuguccuauuucugguuacauccucaagcacaaaguuuggcacauagaagguacccaaauugagccacugaucuaacaugaaugaaccaauuccugauuugauucgacucagacuauccaacuucucuuuuagagccaaacaaaacaacuuaaaaaaguugcuuuugucaauguuuguuuacguauauuauugaugccuacauagugacuuaaguucacaaaccucuaaaaauauaagucacuuagcaaucuucuaguuuaagaauuuuuuaugguuuaaaucaggcccagauccaugacaauauaauucaaaguuagaagaguuaucuuaagccuuuauaguaagcaccguucuaaacucucaauggucuucauuacaucccuggauguaaugaagaucacuuaaaugagauugcagaucacuuaaaucagaaacucuguaagucccacccaacaaucucaguuaacaauuucuccagaugacugaugaugcccacugaaguuugaaaacaacugcccuagaugaccaggccagacccacagguuguauccaugcuauaacaacgaggaugauuaugaguuuuaaaauuuuggauucuuuuguuaaagaauaggaaaggagaauguaguauuaguuuauuuuacaucaaguuuaccuuuaagucgaugaggaagcccucaaauggucuguaaggauuguggacaauaagguggaaauuaaguugcuguauaagaaguaguucauauuccaguaucuguucaagugccuucuccuguccaagaggacucucccggagguuuccaacaaacugaggacuagauacauugaauucaucuacuuugcaggccaaaaaugcacaagugagccuagaggaaaaaauaaggaggcaggaggcagggggugggugggguggaagaacaugcauauacuuugagaaguaucuaaauaauuuauuucuaaaaguauauucuauaauugccuaauauucaaaagcgacugcuagacauugcaagaauuguuuuuuaaaagacacuuccuguucacacuucauuaggagacguaagacaacuauaaaauuaggucaaaccaauauugccauggcauucaaacaucacugacucaaugacaguguuaugcaguacaaccuaaauaucuggaaaaacaaauuaacugaggaauaagaguacuuuguauaauguagauggaagaguuaaaaauaaagcaguacccacauauguaccauguaaguaugggaagaaaaguagguuaaaggaacauuguggaaggccaucggcagaagucucuaagggcaucugaauaagggacuauuauuuaagggacaaacuugugaaauucaccuggccacuucaugcuguucaguaugagaaaacaguaagaaagcuacuguaaaaaacaguuggcagugagaucaagggccuaaucuugacugguggaaaugggaaucaaaaaagagaaaacagguacaaugucauugagagcaaacucuuugaugaguuucauacuaauuucauuuuuaaugauagacacagcgcucagcagagagcagcaacaacagaccuuuguucaacugaaaugaguaugaagcuauaggauccguaaacugacuggaugugggaggggccacuauaaaugauucucagucugaacaacuggaagaacaaaggugucuaauaggaagagauguuagagaaguagcuaauuugagaaaaacaaaauuugaaucuggacaagcugaaguucacauaccaucagaauuacugaaguacagguaaacagagaucucaaguucugaauaaaaaaaaaaaaauagaauucaagucuaaauuacccuguauuaggaagucaguucucucucucucucucucacaauucucuccucccaaaaaauacucaaaagauuauaaaggucuucuuaaaugaaaacaauauauuagacagacauacucacauuauuauccuggggugauauuccauuacugaguuauuaagauaaaaacguuugaaauacauacaagccguacccuaaggguuaaaaaaaauauaucaucaggaucuagucacaaauguuaaauguuaaauuuugugaaacagaacuuauuuauggaaagguuucuuuguagagauuacccagaaaaauacuaauacucauuaauucuucuuuaaucaaaacaaauugugaugaauuacuacagaaaugccauagccaaaagauucuuucccauccuuugcuugucuauccccagccuacucuggcuaauccuuccuauggucacuggauuuaaaaauacguguguguguguguguguguguguguguguguguauuagaaaucagacuaucaaaaauguucugaauuagauaaauucaggaagaaaaauacaaacguucacagauuaaccaaucuuauaaaaauacugacaaaaaaacaugggcaaggcaauaagccuucucucuaaagccacuccauauuugugauauaaccauguauccauuccaugauuugugaucacugcugccaacugaauggcagaagcagcacuaccauuuauugaauguauaccaugugccagacucugugcuaaacacgaaacuaucaucauguuuuaauccuuacaacagcuuggugaaguauuacuaucucuacagagaaggaaacugaguaucaaugagguuaacugacuuaucuaggucacacagcuaauaaggaacaggaaugaauucaaguaagaccugccuguacuuuuaaccauuauaucauuuggcuggaaccaaugaaauaaccacuuaucuauuuuaugauagaaaaaagaauauuuccuuuuaaguauuuuaaaaguuuaguuuugucauuauguaaaacaaaaaauuauucaccaaugauaaacauguuauuuaaaaauaaauuccauaaagaaguucauuaaaggauuuuuucuucauuugauaagaucacuuaaauuuacugccucauuuuacaguucuuuuguaagaacaagccaaaucugaagauauaaacuaaucaaguauaccuaaaacucucucugaaucuuugacaucucagaugaaaaaaaauuguaaauucuauggacuuaauauuuucaacauacuucaauuuuuuuuucaacuauaaaaauggagauaauuuccuagaaaauuauucucuacugggucguaagcuagucacgcuguauaacuuuaaaacuuaacagacuuuuacuuaagauauacuuuuauauuuggucuucacaacaaaccagugagagaauaacguaacaacauuuugaacacccucccacucuaccuuuuuuaucuuucugcuuuuuaaucucagcuaccuguuucuccucacgguugcccaccccagcaaaaaacaaauagguccucagaaccauacaucugaaacaauaaggcaaucuuuuucaccaaagauaaaacuccagcuucuacuaaucaaggcuuaaaaaaaucuuaugguaucaguuucagcuggggcauaugauuaccaaugaugaaugaaugcauuauuucaaacauuuauugggugucacagaguuggaaaagcaguagucuauguucuagucccaguccuauggcucauuaguugagaacuuagaggaaaguaauuuauuuuuuuucuuucuuuaugacauuaccugaccucaaauuuuuuucugaccacaaagugagacuugaaauacuuuugaagauaugauacagcaacucaugauuuaaggccuguauugaaaaauauauaaugugccaaaaacuaauuaauuguaacuaaggugaauuuuuaagacuugaguggacagggaauuuagaagaggucaaauuucacaagccaacuaaaggacauuauauuucaucaccacuguaacuuaccacaacagaucuuggcauugcuggcuuaaacaccgaacagaauuccaauaaccuuuucucauaguauuugcagagugucauuucuucaugaggcucaagaaagacuggaucauucggaagaaccuuuagaucaacaauuacaacacaaguucaaugaauucaaugaauuaaacaauuguaaaacauuuuucucuaucuagauuaaauuuaguuuauauauccaacgaaggguauauaucacgccucauuuucuuuauagauucgcuaaucauuacacaaaauagcuguaggaaaauauuuaauaaacuaaaacuguaccaucauuucacgacuuuucggaaugucagcuagaccuuugcuucauuaaaguauaaacaaucaugacaggcugugugcacaugcucacaguugugauaucauuauuuauaaauuaaaaaguagacagacuuuuuaaaauaugauuggaaagcuuccaacauccguuucucggucagucauuacgucacaaguuguaaaaaaacagcaaauguuucaauaaauuucuguuauuuuaagcuacccaguuuguggugauuuuuuuaaggcagcccuuaggaaacuaauucaggugcuaaaaucagugauaugaaauagaugugaauuaaagguagaaaguaaaguaacucaguaucgguaauuuggaggcacugaacacuugcuggaguggagcuugcaggaaagauuaaaccaguccgagagcuguaacagaaggaacuuggcuagcgggccauaguccaaaccaucuucagucacuugguuuguacuuggucucuggucucccucccucauccaacccauucaccacgagguugcuagagcgcuguuuccagaacggaaaucugauaagguuagcuucccauuuuaaauauuucaaagguuccucauccuuucaguggaaauguuaaacgccucacuuccacuuacaaguucccuuccuacccuccccagccauuccugcacagguacucaacuucggccacauacgaccacaaacacguccacgcaccaucucuguaacuucugaccucccucccacucugaacggugguucugacugccuggaacuuccuuucccauuuucuccgcauuggcuacugggaaaaaccuuccccaacaucaucucuugacaagugaacggcucuugccacgcacuaccuuagcacacuacuuacucucuucuucacuacguuacaaagacugguuacuugucugccauucgacgacggggauggcguuguucgucuuuguacccacggaaccuggcaaggugcucgcuuauuuugauagaaaaacgcacuccgcgccgcagaggcagagaaacgacggagcgagauuguccugggagccagaagagcucccgcagcugcucagaauuuagugaccgggcaacugggcaaccguugggaaaaccucaccuucccguuggccacggcuuugcaucugaauuugcgguuggcgucagcccgcagucuugccagcugcuccucgcuggagaagguccagugccgcuucugacuacuguugugguacauuauggaaucgugaccagguccagagggucugcagacgagaacccaaacgcaucagcguccuggcguaaaacacccguacccccaccgaagaucucgcggaagccuagggcguccggcuagccggcgcuggcgcgcugucgucacgauuacgcggccagcccguacgcaguu

SEQ ID NO: 17353 - RNA, 2395 nt, Homo sapiens
agauacaugauauugccuauagccuugcuaguuuauuuuacauuuuauaguuucuguggcugguauuggauugcuuauugauaguugcuuaauuauaggaagaagaggaaaggcuaugaagaugaugauuacgucucaaagaaauccaaacaugaggagguauguuuuacuccaaagaugaacucuaaguuauuuuuguuauacauucuggugugacuauacuguuaagauuuauucuccaagaguacaggcauuauagaguuguggguuuuuucauuuuuugcauacuuccuuacguacaguacuguuguccauuauuaaagggauuuuucucucuucugucuuuauuuaaugaagaauccuuccuguguucauagaaagcagaagcaauauguauacauacuacauuuuugcuuuuuuucuuauucuccaaggauuuuucccuuacccccuuuuaaaaaaaauuuucuaucugucaagucaaauaagugaauaaucagaggcaaaaggucacagccauaaccuuuauuccucacuggaggagucuggugagaccaugccaacauuacuaacagugaacuauuacaaaauuuccugguuuaucuuuuguaauccacauggguaaaaggaggagaacauuuucuuaaagggagguaagagguaaacaauacugguuaugcuucaguguuauccuuaccacacuuuuuuuccuucuuaggaagaauggacugaugacgaccugguagaaucucucuaaccauuugaaguugauuucucaaugcuaacuaaucaagagaaguaggaagcauaucaaacguuuaacuuuauuuaaaaaguauaaugugaaaacauaaaauauauuaaaacuuuucuauuguuuucuuucccuuucacaguaacuuuauguaaaauaaaccaucuucaaaagagcuagaauagcaccuguuuugaauauucuuauuccaucgugacuaauaucaaauuaaagcugcaacucauuugccuaauuuuuuaagcaaaauaugauaggcaaaccuaugcuuuuuuuaaaaaaggcaccacaaaaaacaaaacuuaguagccagcuuuaaaaguguuaaggaauguguuuugcccucuagaaaccuuuauaaauggcuuuuugaaugccauccugauauauuuagcuauuuguccauuacuauuaaacugcagaagguauuucaacuguuacaugguacugaaagccagucgucuggguaaugaauauuauuuuucuuuaguuacccgaaaacauuuccaaauggguuuuuaaaaaaaaccagauauaugauuuugaauagcugucuacaucaaacucuuacgcuaguauagauaaguagguagcagcaaauuguauauucaguugugguuguuuuuuaauuuuguuuugauguaaggucuugcuauguugcccaggcugucucagacuccuaggcucuagugauccucugccucaguuuucugaguaauugggacuacaggcacacaucaccacagccuuauaauuaaccuauuagauccuauaagugaauccguguaaguagauuauaacaguuacuaggaauuuugcagauuaaauauguuagagaaauguaauucaaauugaaaugagucaauauaaaaauaugaaagcacagacuauuacagcaaauuacuuacauaugaaucauggccagcuguauuucacuaugugaccuugguaaguuauuaaaccucuaagugccaguuucccacacugaaaauggggaagauaaaaaugccuacucuucauaggauuaauuagaauaguaccugcauacacuaguauucaguaaguguuaacuauuauaauuggaaccaaacuguggacgucuguuuaccaagccagauuuuuuucaggaaaacuggcuugaaggaauuccgaguaauucaaguguccugaaucuaauuaaauugcacaaauacacacaccuccucagucucaguacaucccaggcuguacuuuccagaaagguagguaccauuauaguuacaucuauuuuaaggcaauacuuacuauaugcauauucaucucucuaacaauaauucuuuacacuguaggcuugaguuuuguggguuuuuuuuuuuucucauuccagagugaaaggaauaaaauucgugaugugagauuuuuacaaaagcagaguggaagaagccaaaaguuauaaauccuccaucgcaguccuaguuaaauauauugcugcuaggcucuagacagaauuacaagauguucacaauuugucucauuuucccuuucagaucgccaaacuuuggcaucagagcaagguccacacuuaucacugaaaauuuucccacccagccccauuaaaaacguuaaagugugagagauuuuauu

SEQ ID NO: 17354 - RNA, 110779 nt, Homo sapiens
uggggagggaggcaggcggucccuaccgcaggcgcggggagcugccuuuccgccccuccgccugcuuuccaagccuggacucuuaggaguggcugaagcugcggagcgcuuuuggagccugugaaugaacccuccuccucucccuccuccuucuucucgcugagucuccuccucggcucugacgguacagugauauaaugaugaugggugucacaacccgcauuugaacuugcaggcgagcugccccgagccuuucuggggaagaacuccaggcgugcggacgcaacagccgagaacauuagguguuguggacaggagcugggaccaagaucuucggccagccccgcauccucccgcaucuuccagcaccgucccgcacccuccgcauccuuccccgggccaccacgcuuccuaugugacccgccugggcaacgccgaacccagucgcgcagcgcugcagugaauuuuccccccaaacugcaauaagccgccuuccaagguaaucacguuucuuuuguuccccccuuaaaaaacaaaaacaaaaaacuuauagaaaaaaacccgcgagcuuagaaaaaagaagcaauugguagaaggcuuuaauuaaggcaaagagcuguaaggcgaaguuaagaaaauguaggcacuuaaaaaaugcagguaacuuucauaagggcuuuuggggagaggcauacagagggaccuugguguugaaaaagauucagacaaaagaaacccaggguggggugggggguaaaaugacuaacggaauugggggaagggagggaauaaauuguaaagaaaucauagaaaagugguggguucuugagcuggagagaagagagggaccuuuggcacuuugauuuuuuuguuguuguuguucuuaacacgcucgaggcaaaaguuugaauggggacuaccaagacuugccacagacaaguccccgaagccgccuuggugcaggccaccugguuucccagccccugguguguggucagugccugguguuccuggaaagccacucccgggcagcuccugacagugcgacccggcgcccaagcagccugggaccuugcgcggaccugaccccuucagaccgcaggcagucugggaggagguccggccgggggaggugcaggauccccgccgugucucuuugacgacuuggggacugucacgguucucucccggcgccccuggguucuuuuguccugcacgcggugcgaaggggccagcagggaaggagcagaggauggggggugggguuguuggagccccgcggaggucugggaggccccugggcgggaaaagccuguucugaaucggcagggaugugcaacaauuuuucucacccugaagagugaaauagggucugucgcucccaucucaacaagcaaaccggcacccagagcgcacugcagacaaagguggcucggggacccgaaucaggggccucugggucaguccucucgcccagacuacaggaguccuccguuuccuuacauauuccccacccucuccuaguucuccgcucuaguugagcaacuuuacuggcaggucuagcggcagcggcgcgcgcgugugccgggagccccgggggacguccucggcuggagcgccccaccguccugcagaggcgugggcgcuguagggcgacaucccuggugcgugcagaccuagggcauccggguuguucuggcccgcggucugugucacugggcguggagcggucuggguguuaggcagaggagagcgggguagaaaaauagugucauagccuaaacuauuugcucuccaauccaacugcgucucggcaaguccugcaugucccugggagaugcugcgggaagggggagaaaucuacacggcgccuggagaguuguccugccgcgcgcacacccgcggcagagucucucugggucgcguuccucaucuuugugucucccucugucuccaucuucucugccucccuuccccucucccagccucuguucucucucucuagcuucugcguccccucccccacagcugacaaaugaauggcuagugugaaaucccugccuuucccgugcuccaaggcagcagggagggaggagcgagggaggcggugcgcuccuucggaucugcccccaguucagcucacaagacuugcagaaccuagaugucuaggaauugggaguuuugcggcgggugugggcgcccccugauggagaagucccgcacaggcggagaaaaacaagccccccagaccaagcgagcaucuuucacaaccuuguguucaaggauggaaggcccuaguuuucccuuaagucauucauuuugcacuccacaaucugcggcguacaucuaggaguuuggaggacccugaaaaaaggucuuggucugugcaaagugcagagaugccuucucgcgagucggcuggaacgcacgcggcgcccuggguccaguucgccgcuuaguggacgaacgcacauggccaggguggagccagguuucggaggucuagacgcgccacccugggcgucuuuaagaaagauaauacacauaccgugcucucaaaacccaugaccacuugaacccaacgcuagggccccgccccaggauauugcaaaagaagggcuccuaauccaaaacuuaaacuuccucaacuucagggcgggcgucggacgggaaaguggagagaaggcgggcagugggaggaaaaaagaaagggaaggaagggaaguggaaggaaagaggaccguggaggggaggaaaaggagaaaggaacggagauggggcagauggcauucaaacagccaggaacggaccggaaggguucguuucgggguuugggucugaauuucgagacucguuuuaggauacucuuuucccuuucccagcggcaacaaaugugacugcagaggcgugccgggauggaagggugggaaagaacuagacaagcggaggugguccagccccgcccaaaggggcugggucuggggcccgcccccacucgcucaccucgcgccaagggaggacccgcaacgggcgcuccccgcagcggcuggguuagccagccgccacguggguuggcgcuucggcucccagccgagacgggugugacuuccugggcucagagacugcaguacagccgcacaggcggccggcgcagccgaggcccccacccaccgaggccaaugggggcggggcggggaaggcagggcccagcuuaaccgagagagccgaguggccucgcccccaggauucggggccggcugcuucuggagcugacccgaguuccauccagacagcgcugaacacucuuauuaaaaggcuauuuaaguuuuauuuuauuuuauuuuauuuuugcuugcuucuugggagugguaggaggggcaucgugcuuuuguuuugaggcaggggagagguuaaaauuuacuccaagcaaacuuuuugucagaaaaaugagacuuuauaccguauuccauuuguugacuuuuuaaauacauucaggucacucuaaagcccauucuuagucaauuaacagauuaauuucguuccagacugucauaaagaguucgccuggaauggcaaauacugccauucgacaagacuaauagaauuucaugggggcaaacauggaagggcugcgaguguaacugagguuccugugccucaaugaggaaccuuagcggggaccuggcggggacuggaagcucagcaccuauuuagggagugacugagcuggaaaccuggagaagcuuggugcagacgagacggugcuucuuagagcugcauuuuaaguccucccauuuugcugcauauuggaagaacuggauuuuaaagaucuuuuccaucaccucagauucuguagcuaacagccacgucuuuuucuuuuugucugcugaaagcugugaccuaauuguuuuaagcacuucuugacaauuucgccaaacccauccugaaaauauucacauaaaguccuaaaauaggauguugugaguguaauauaaaaauaggaagguaccaauggaagcaacaauuaguguucugagauagaagcgguucccaguuuguaacuuggaaauguuaagagcaguacaucagggagaaggucuccaagagucugacuucuuguucugagcucugaguaaagaaagaaauauguuagaauuguauugucugcccgcaguaauauuguaaaggguuccaauggauuccaaugugauugagcaauuacuuccuccagcaccaaguccacaguccuuaaucuucuugugagaagauuagguaggaagcgggaugagauucaagacaaucauuuaggauuuaugucagaauucaaaguuuugauucuuuugguagauaaaaacagaguugguuuuaaauuguauuuccugcuuucaaaaaaacgagguuugaaaggaaucccccuagauuuacauagguuuacagauguaaguuucuucuuuuucccuguguuugcaaacuggagggagaugccuuugauauuccagaauaccuguaucuauacacuuguaaauucugcuaggaaaggaccuaaacagcuaaaccaaaggugaccaugauuaauguuaaagauacuacccauuguucucucuuuuguuguauuauuaggcuuaaauacuuuggaguuaaugauuggucacuuaauugaguaacagagccuuugagagcgcaaagaucaacuaacucugucucccaaagucuggcaacuaagcccuccuuuccuggugagauuuaaacauuuuuguugacgucauucauggacaaacaucgguaaacacuguauuuaaaaugggauauugcccugugauggagcagaacuucucaagacacaugguucuuuugaaagaaagaauuaaugacuguaguaagguauuuuuucaccacccacguagagaaaccaguuaggacugacaaacacucauuguugggaguuacuugcucuggucugagaaaauaugcugauuguuacauaggucuguauuuuaccagaaaacacaaagcauguacucucccugauuuggaaucagaaaagggggauuagauauggaugucuuggccaagcuccauuucaauuagugaauuuuugccaguuuccucuuguagccuagacuugguaaauuacauauauauaaagucuguguguguguggggggugcguguguguguguauguauacaggguuuuuaaacacugcuaaguucuuaccauugaauguguuagaggugguuguauuucagaggucaguacagagaaucuuuguuuaaugugucaguucuguuuccugaaacacaccucuggguagauuuaccaacuauaaaaggauacaaauguauauacuuuccacaucuguauacauccuaccucauucuucuaaggauuuuaagagguguuuaugucuauaaaaugagauuacauauuuuacaauaaacauauuugauaaauuauaaucuuuuuauuauuaaauuauugauuugauauuacuugagguauaguggaaugagcacuagacuuggaaucagaaaguuugaguuggacucacuagcugagaaaaccaagcaaagauauuacuuuuggaccuuuagugucauaaucuauuaaaugaauaugcaguuauaaagaucaaaagaguaaguacuuugaaaaacuauacaaaaaagggaugauaauauauuaugucuugggauucauauugaucuaauucuauaauuuuaauaauaacugcauuacccaagccauguaguuucuacugaaucuauaaaauaaaucagagaggggcauauuguuuuaaaaauuguuuaguuucauuaaucagaagacagguuacagaaauugacuccaaugaaguuggacauucaguggaaaggaagaauuauucaauaaaugguuucaggacaauugauggguccaugcaaaauaagaaucagucucuaccugauuucucauccuaaaagaaauauaagaugaaucaaauaugaaauguagggaauaacuuuuuacaaaaugauaaaagaaaaucaugggauuaaaaaaaauaaguuaggaauagagaaaccuguucuaagcaaaacauaaaacccagugccauucuaggaaauacugauaggucugacuaaguaaaaauuacacaaaagcaaauaauauauuuggaaaacaucuacgacauuugagagacaaaaagcuaauaacucuugauauuccauggacuuuuaugaauaacuuugaaaaguccacaucuaucaaaauaugagcaaaaauuauguacagguaguggcagaaagagacauagaguuuuaaaauuauagaaaaaaucgcucagccucaucuguaauuaaauaaauaguaauuaaaacaccaaugauaugcuacaccauuuuuucaccaaucagaggaguaacaaaaaaaaauaauuuuuuucuuuuuuuuuuuuuuugagauggagucuguuacucagguuggagugcaguggcacgaucucagcucacugcaaccuccgccuuccagguucaagcaauucuccugugucagccucccuaguagcugggauuaugggcacccaccaccaugcuuggcuaauuuucguguuuuuaguagagugggguuucaccauguuggccauggcaguugaucuugaacuccugaccucaagugauucacccaccucagccucccaaagugcugggauuacaggcaugagccacugugccuggcaaaaauaaaauuaaaaaguuugaugcaaguuuguguuggccagguuguggagaaacugggucucucauauacuguuguaugaaaguaaauagguuccucuacuucaaaaaauaauuuggcaaucacuuuuuuuugauucuuuaucaaaaguuuuuaaaagauguauauacucuuugauucagcaauuccacuucucgacauuauuauauggauggauauugguaccaauaucacccaagacaaauggacaaggauguucuuugcagcauugcuucuaagagcaaauaucuggaaacaguguaaaggcucaucauagggaaccauuuaaauaaaaguugcuguauccaccuaauggaaaacuaugcagcugucaaaaauaacauggaaaaauuguauuugcugauuuggaacauucuccaaaauauauuguauucuaagugaaaaaauugauagauaaaacugaguauauauuauacaucuaauuauguaaaauggguguauauucauucuuuuaacaaauauuuacugaguguucuaggcauuguggauacaggagugaacaaaacaucaaagacugcucuguuggaacuuuuacuaugguagguagagaaaggcaauucccaaucacauaugcaaaauggugauaugugcuaggaugaaaauagagcaugggaaagggaauagaguacaguaugucuuagguagaguaaugagaaaggaguucaccaggcagagaacagaggagugcuaaggggcgacaaugugaaaaagcuuagccaaguccagguucaggaauucacaugaugcuauuacuuguaugaaguaaauucaugaaauuucacaccuaaaucacgugauuucucucugcuguacaaugauucuuucugugagaaagaaccagugagcaauaugauaugugaugcucauuacauccacuuuguagcugaaguauccuagaaaguugguugucuaggguaccuaauuagcagaaugguggacaaaaccaccgugucucuguccuuaagucaccccuugucagcugagcuuccccaaaaucaagggagaauacuaaauaucuauuuaauagaaucuuggcuuucucucggaggcugcccaucccuggugugucccuuauccucccugcagacauuucucauggauaggaguuccauugaccuugucuuuuaugucucccaggcaauuaaacagucucaguacccuguaccuggauuguucaaugacuuucuucccuucucauugacuucacuggaguagaaggcuaaauauaggcauucacucucauaucucucaggucuuuccaugcagacagaguuguuaucacuaguagacggugcuuauaagagagacauggaaaaguggaagaauggaaauagggauuuggaguggugcuaaaaacaaagaaagaggcuucugaaagcuuuccauuuaauaugaucaaacauagaagacaaaagauguaacuuaaugaccaaggauagggacauagccuugagaaaauuacagaaguggaaugaacgucuuggacuccaaagaagagggaauggaaauguaguucugaggcagcuaaagucaauaaagcccucugauauauuuacuguagaaauaaaugaucaucuuuuaauucaagguuugcaaacuuaggugacuacaggggcgaggcauggaguggaaauggguaagagacuaagugggggcaguaauggccuugagcacacagacuuaaggggagagacugcugcuugguuaaugcucaugaucagccagcugaaauauagacuuaguguugcuagaccuucugauuuuuugaaagaaguuagagaucuuauauuuaguguaaacagucuaauuuuuaaauugaguaacuuauucaaacauauuuaugcaacuuauucaaauguauuuagagcaugucugaucuccuccuuguauucuuaccuagucuuagggguaaucuuaaggaaagugaugcguauacuuguuguaccuauguagauggaggaccauucuccucuccccaacaaaagacacuuuuauaaggauugaguguggcacaaagaguucgauuuuuaguauuuaaauugaguaggaaacucaaauacagaagauccuuuccugggucacaccuuugguuuuuuuaaaugagauuugacucucuagauauugacaaacaucauauuauugggucaugguaaaucuucaaguggacugauucaaaaguguucaaaaguauuucagguguuaaggaauuguuggcacggaguuucaaagguguuucugcauaagaaauagaggcguugaucauguauuugaucuacaaacauuccucaaggauauacccugaaccuggcaaugaagaaauauugugggaauuauuaaguugaauaaaguacuagcucugccuuccagaagccuacuguucuacagaggagauuagacauguuuacagauaauuugaaguacauagcaauaaauuauaggaugauuuauuccaagcauaaaguguauauugcuacuauagugguaaccuagguuauaauuuucaaauguaagagccccaaauacuauucuuuuuacucuuagugauaugaaacuauguuagaacaucugcagaaagucugaauuaguaauuuuaauaauaaauauugaguacugauauauuguauaucacugagauuuauuuuauauacauuauuuuaucaauuccuaugaucacuucgguaaguacuaauuuucacaacuaaguagugacagaaaaugagguuuagagagauauaguauuuuacccaaagucacagaauauaaguagagaaugcagaacuugcauucugggcuauuugacaguggagcccagacuuuuaaaauuaggcuuauaaagauuuccuggaaaaaaagaaaaauaaaaaauagagaacaaauuuuccugaagaaaaguaggaaauuauuauuuauaaguauaauuaaagagagaucuuuaauuucuuuuuuuuuuuuuuuuuugagacggagucucgcucugucgcccaggcgcaaucucagcucacugcaaccuccaccucccggguucaugccauaaagaaagguuucuuauuuggauucagcuaauacucauggaaugcauuuucuuuaacaccuuuuuaucauaaaauacaaucuuuuacuuuggcugugcaauugauaccuuuauuuuuccuuaaaauauuguaauagcauagauauaugguauauacuuccugcuugcugugcugucuuauaagaaauccagaaacauagaaacauuauggcauuucccaguuaguguuuaacaaagucuauuagcagauccuagugauuauaggauaaauaacaaacuuaauuaucaggguuaauuuaggauuaucaaccauauguuuuucauugugaauuaucaguuggucuauagauggaaaauauaagauguauaauguauuagcuuaaaaaaugcucuucagagagugucuagaauuauagaauuuaaaaauuuuguuuugaaaaggucuaauucuuauuucaaaauauauaaagaaaucaaaugcaaaaaaauuaagagaaaaggucuuaauuaauuaaaugcuguacaacuccaagcccuauuuauguucaagaucaguuuuguaauuuaugacuaauuucagcauuagcuuguuuucaaucuagguuugcuaaauaauauagaauuucuuuuccaaugaaguuuuucagggucccagcugaaaaauauauaccaguuaggaugcuuucaacuguaaggaacaaaaagucacgauuuuauuggguuuaaacaauaaugacauuuauaaucucauauaaaaugaaguucaaaggcaugguccacucuaggucuaauccuuaaggacuuacgccuugccuuugcugauucuuucucagcuucauuuccagagguaucucacuuacucauggaugcaaaaucccuacaacaguuccagcagaaagauuccagcaugauaauguccagggaagaaaacugaccaccucuuccuuuguucucuucucaggaugaaucuaucuuucccagggacccuucacuggaggaagagauccccucacaucucacuggccaaaacuauauuauauacuguuccaaauccaaucauuggaaaagggaaugguaccucuauaauugacuuaggauaucaagaucaucccuugggcugggguuugacccaggauucuccaaaguaugugacugaggguaggcacuagaauggaaccagaguuguguuagaaaggagaaacgcauggcuauuauagaauaguucuaaaugcuaccgaggagggcacaacuguaaaaaccaaauaaucuuuugccauucuuuugaaguuggcacuuugauuucuagaugguuccccaacacagguucuucuccuccucaucauuauagcugccuugaaauuugagcuggaagggaacauucugagacccagauuguuaaaugucuuuuccaaagucaugcaauaaauuaaauggcaaagccagggcaguuucuugacucaguacaggguauuuucuuucauucuuuacucuugagacguuagaacuguugguacugcuuuaaaauucauggcaagaacuggucacuuuuguaauuaacaccuccuuauaauacauuuguuuuguuugcuuagccagcuagaaacuacauggagucugugcuuuaaaaagccugccgaaguccuuauucucuguuuugguauuaugugcaugaaccaccaauugguuccuucucaccuuacacuugaugaagaugucuuucuuucaacaucuuucucuauugcuccccaucuucucuugcucuauuuaugaucagcugucuguuucuaaauagacuuuguggucacccauuucuuuuugugccagcuccuauccacuaguuacuugaacuguggucucuguuguucuucauacagccuacucacuugugguugucacacacauccacauuguuauauguucccaaacuguauucuggaaugauuuugguaauggcugcauuggaugagauucaaacuaauaauuaaagcauugagauagcuucugcuauuacaaguuuacuccuguuuuuauaguccaagaggagcuacuucuucuacucuuauuacuuaaugcuuaauacuacccuuauuacauacaaugcacaaaaagcaugugauuuaugacccacuuuaaaccugaaugcuugugauuuacuuuguguuuuucuucauuucuaggccaagauguucauaaauauaaagagcaucuuauggauguguucaaccuuaauaguaacccaugcgcuacauaaaggugagugugcuaacaauuucuuugguguuaauugaaauaaaaauguaagugcuggaggaugaaauggcaauguggaaucacuggaauaaaagauugauuuuuaaaaucuauuaagugcugaaaacuaucaguuaaaauauuauuggaccaaaaacauuaguuuuaaauaaauaagucaaaacaaaauaauaaguaggaugcuaaagaugcaagugagcuuuuaguaacuucccugauuacuuucaggcuuugcaaaaaagcucauauaugguauugggcauauuuuaaaauucuaacacuauuucucaaaaacuuuccuaugcaaaaaaagaaacacuauuaaacacccagugggcuagaauuugaaaagaauugagaagauaaagagaaagcugacagccauguuuuugcccuuaguuccuuuucuuuucuuuuuuaaaaaagcaguuggauaugcauaugcccuaguuuuuuaauuugaaauuuuauauucuuccaaugagggcucuauaauuccaaauuuauuauuuaauauauucaaggaauuugaagaaagaugcuauccaagaguuucacucaucugcuucugucugucuaguguaccucuccagacucagauuccauuucuuccucacacuuauauuaugcaucagacucaccuuuuaugauuuuccagaugaauuccuuuugcuaaaguuuaagucauccaucuauucauuaccccuccauccauccaucaucuaucuauucauccauccauaccuccagccauccauucaucuguccaaaaucuuuccaucuguuugcuuaucaacaucuauccguguauucauccauccauccauccuuccaucuguccaaaaucuuuccaucuguuugcuuaucaacaucuauccauguauucauccauccauccauccuuccauccauccauccauccauccauccauccauccauccauccauucauccauccauuuuucccacucacccauucaucuguucacccauugaugauauuuuuugaauaccuucuuugugccagauauuauucugggugucugggaauauacccauggaugacucauaacuggccuaucguucuuuaaacuuacuucucuaguuaugggagaccagcaauaaacaaguaaacaaacaauccagguacuuucaaauugaugaacauaaaacagagugacaucauagagaguggcuugaguugggggaaguugauaagaccuccuugagaaagugaaauuuaaagugagaugagaaugauaaugaggaaccagccagccaagaccugucuguaaguuaggaagaaacaucguguguuugaauagcagaaaggucacuauaguuggagagcagugaucaaggggaaaguaggagacaugaacagagagauuagcagaaaccagcucaucuaaauaauaauaacacccaaaacuugaauagaacucccuaugauccaggaacuguuuuaagugcuuaacacuaacucacugaaacauccauuaccccuguauucuauugaggaaacugugguaccaagagaggcuaagcagcuugcucgaacgcccauacccaguaagaagcaaagcuuggagaugaaccaauucauaggagugugugcucuuuaccaccauguuauacuucuuaucuacauggaacacuguaggcuuuaaaaagucuagaauuuuuacucaggaggcugagacaggagaauuguuugaacccgggagguggagguuguggugagccgggauugcaucauugcacucuagccugggcaacaagagcuaaacuccaugucaaaaaaaaaaaaaaaaagucuagauuuuauuccaagugcaguaggaaguauugaaggguuucagcaaagaaagauaugaguugaugaauguuuugaaaauucaguuuuugauaaucuaugcagauuugauuguaggaaagcaaggguagcagcagagauaucauuuaggagguuauuguaguagccugugcaugaaaugggguggggaguaguuuagaucagguagcaguggagaugaagagaagugaauuggauauguggagauggaggagucaguccauccacugauggauuggaugggguguguagugaggacaugagaggagucaagaauaaauugacuccugggauggcucucuuuccccuuuucaccuccagauuccccuuucuaaccaauuuaaaagcuccuccuugggugggugcaguggaucaugccuguaaucccaggacuuugggaggccaaggucggaggagugauugagcccaguaguucaagaccagucugggcaacacagugagacccuaucucuacaaacauuuuaaaaaauuagccgggggugguggcuugggccuguaguagcuugggccuguaguagcccaguagcuggaacuccaccuacugggagggcugaggcaggagaauuguugaucacagggggucgaggcugcagugagucaugaucgcaccacugcacuccagccuggaugucaaagugagauccuaucucaauaacugguaaauaaauaaauaaauaaauuccuccuccauguuccccuuguccccugugcuguugcagauauaauaacaucuuccaugcucuugggauaaguuauuguuuuucuucccaaguaggcuacuauaagcugcaaaaaggccuuucaucuucuagcaaagugccugacacacugacagcacuuagucauuuuguguguugacuaaaugagugaauaaauaaauaaaugccacaguggaccaccuggauaguuuuuagagucuagguuccaccaauuggaucaugaagacaugcuaaucagauggugaagccuaggagcugucuuccucaaaguuuuugggaggugaaggugaaggucacagagaggaaaggacaacagcaaccagugaagauggagaaagggauaugaaaaggggagugguauuuggaugggcuguauuggaagggaauuuacagggaaaguaguaggcgaccauccuucagcugaaauuuagacuuuccacuuaaagaaagaacucaugcaaugaaaaacaacuuguguuguaccuccuuuacaguauuuacaacaauaauuuugauagccaacaacauugaguaauuucugcaugucuuuaccuauucuuuguaaauccaugaucacuauuauuagauguaauuaguuuggggcuaauuucaggagaauuuuuuuauaucagaggugaaaguuacaaauauacgauccacauaaaacagauuuucuggauuuauaguggaaaacacaguaguaacuuguugagucaagacaaguacuuucaucuuaagguuuuuuucuguuuauucccagucacugaugaggucaacgacuaacauaaaugaacaccuugucuauuguuaugggcuuuauuuuaacccaagaagaacuauuuccuuuaacaauacacauuauauuaucuuacaaacuguccuaaucguugauuaucuaccauuggccuaguuauuuugauguuccccuuauaguaggaaaaggagucaugcacagucgugaauaagugaaugaacuagauagugauauuugucacuugaaagagugauaaauucccauauucucaauuugacauuuauuuggccaaggucuguguguguguguuugcucaaauugugcagauggaauuuacaucaucuuuacucuaaggaaucugcugacagagaaugagggguaauugguuauucauuauuuagugauuucucccucacuguacucauuuggaccacaaaccaucugguaacagccaauguuuuguuaggauucauuuuuauuacuugaauugucagcauuucagacaaauuccuguagguagcagauuucuuuuaaacaugcauacucuguaaacauuauacucugaacuacugaauuucuuucuuaaaauauuuagauuuagugaauuucguuuuugugacccagugcauuaagaccgaagauuuaauacacaaaagauuugaccacacagcuuuuuguuaaucuuguuaaguuuguauucacaucaauauauuauuuauauccaaccaaagcuuuuaauuuucuuauauauauaaacaucuagaacaguaaacaacccuugggaaauugcuuuuuaaaguuauuuuuuuccaacauaccuuuucuuuacagcacagcuguuuagcaaugcucuauguuucagaaaccucccuauuggauagauuggguugaaucucaugucugucccuauauacuucaaauugugaagagaaauauaauuuguaagaaauauugaagaauuggaagacauauauuuuaaacuaauuuuaaaagacaugauaaagaguuucaaaauucauaccagaauuaaaguugaugauaaagcuguuuauuuuugcauuugaaaauaguacuuuauuuguggcaaaguuagucaucuaaauaauucuucaggaaggaagaugagauuuucuggaacauaugaugaauauaaauuuggagauuuuuagagcacaaaauucucacccuuucucuucucagaacaauaucuuuguguuaucaucaucucccuaauuagguccaaauuaaaggaaugugaaauagguagaagguacuuucagagaguccucugugaaccuuacggauuuauuaaaaagaucaugaaauuacuaaaauauuucaguucagauaguaauuaaauacuuauagaaauaggaugcaucuagacuuugaaaaggaacugaaaagaacacuucuuuuacuucauuuaggggcagaggaagcacaccagagcuaaaagauuccuugauuaggugucaggagacauguguucugacucaggucucucaccagccaucugggagcuuauccuuccucucaguggaggauccuuuguaaggaauucgaccaguuuuacuuuaagguugagcuaaguuagagaauuuacuuuguaagccaaggaggccauuaaaaguggaauuauucccuugcaauuuuauuccaaaaugauaauagucuuagcaauauuucaaaggauaauuuaguauagcuaauagcacacuucacuuuguuuuuauuuaauuucauuaagugccuuaagucugcuuuggauaagcuacauguagauuaauaaaauaauaaacaaaugcauaacagcaaugguuauuauacauuugaaauaaauuagugauuuauauuguaaguacauuaaauaugauacuauauuaauuauuuuggauuuauuugcaucacaugaaauguuuuauaggccaaucucuuuuuagguuaaaauuuuaaucuuuagcaagacaguauuuuuuucuuaaaggauauaucuccauaguaucuucuugcaauuuucaaaaugcuuuucuccaacuguguuuacauugagaauccacaguguuuacauugagagugauaucauuuccaaugcaugcccauguugagauguguguuuccaauauguuugaccacuagcagaguguuagauauacaucauuuuguugguuaaaaaaucauuauuucauuucaccuagaggcuacuauuaacuuguugaccauauuuucaugaaguaagcauuguuugugcauuaucaacaacuuccauuauuacuaacauauugucuagccuaauuaauagaggcuggaagauagagaggagagugggagagaaagggauggauuccucuaagagugaaaaaacauuuauuuugcagguaaugguguuaaacuguagucaauauauucuuuaucauuaaaaguuuaaaaguuuaaacagaaggacauucugcagauaaauauuuuaggacgguuaggugaacagaaaccaaccuuuccccauuauauaauugaagguaaugucucacugcaaagugaugguagcuggauuuguuauaauuaugaaagccuuugguuccaacacaggaccaaagugcauccuucaaauguuaggcuuucccugguuccaguccuaugaagcacuuuuuuauuuucacuucaucuuugaauuuuguuuucauuuccucuaagguaauguggcaguuauuguaacaaacauuuuuugucuuucgaccuguagacauaauuuucaucuuucagcugcucuuccuaauguugguccaguccuuuaaaccugcccuacggauucuagucugcccuucuuugcccuuaauugcuugaccucuuaugcuugccuuuuuuuuuuuuaucacuuauuuuguucauguuaaacacuaaguuaaaaaauuuuaaaaugaaugaugccacauuucuauauaaagaaaugagcauuauuaaucccuguuguuguaaaacaucauugaaauuguaugcuauucucuuuauauaaagucauucuaauuaugucacauguugaagauguaaccaaacuauuauaaaggcugcuuauccauucacauauugaauagauuaaguuuggguuuuuuaagauuguuaauuuguuauuuucucuuuccucuagucaaagugggaaaaagcccaccggugaggggcucccucucuggaaaagucagccuaccuugucauuuuucaacgaugccuacuuugccacccaguuacaacaccagugaauuucuccgcaucaaauggucuaagauugaaguggacaaaaauggaaaagauuugaaagagacuacuguccuuguggcccaaaauggaaauaucaagauuggucaggacuacaaagggagagugucugugcccacacaucccgaggcugugggcgaugccucccucacuguggucaagcugcuggcaagugaugcgggucuuuaccgcugugacgucauguacgggauugaagacacacaagacacggugucacugacuguggaugguaaggcuuuuauuaucugcaagaagguaguauaacaugacaccugguucagaagcauugagaaauagcacucagaaguaacuguuguuugggguuuggaugagcggaaaaacaccugucaauccaguaguccacgucuuucaccaaaaaugaacugguacucauucaaaagucaaggcaggugcauuuuuggcagccacuucauugauuccaugaaggaaaguauuguauacugaaaauaacgaauaccucaaggcaugacacauaauuuaauaaucauuacuucaguguugagucuuaucagugauucuuuuucaagacucugaaggcgaaucuacauuuuaaaaauuauuacauauguguguaugcacauguacauacauauacacacauauauacacauauacacaugaaaaaccuuucccccuuuuuucucucuuaauaugauuauuaaaauauuugaguuugcuuuuaggaaauucuaucuuaacuuauaccgaagaaauaagguauuuaauaaaaaccaugguacauaucagagucuuaaaaaggccaagacuuaauaaauauuugaauucgaucaaacagaaauuuaguauauuuuuuaagauuaauauccuaguuguuauccguuaaguauugcagugagacauuuuaguuucacccucuuuucaggggugguuuauaugucauuugaauuuaaguuaggagacaaagcaaagaaaaauugcuuuaauuggguacacacauaaugccauagcccuuggaagcguaauauuuuggcaaguuauuaagcaaaauucuaauacccagacaugauggaacagauuuucuuccaauccuccauuucccuauaaaauauuuaccuuucagaaauauauacaaaggguuuuauuaaaagucuuucuuguguagccaaaaggaaauacuuugaauuucagaugcaacacauuaacuuucugauacccuuuuauauucaaauuccauugcuuccuucuauaaaucuauuuuuauguugucuaggcauccacuaaguauccuggguucuucuaaccuuuuuaucauuauuuuuguuagccucacuacugugauuucucucucucucucucucuucuguuuacguaucacuuuuuaaaauccccaaaggaguuuaacaacuucuuaccauuuuucaucauuaaagaauuagcaauggauuugccccuugccccucugaaacaaugaaaauccuccacuuaaucuccuuagcuccauggggucuucaaauuauuccagcaacugcagauacuuauacagauugaaguucccugccuuggucgaggaggccucuuugugccccuuuacugccaaucuucagugcacauggaagauuuuuaauuaccaagaagacuauuugaagcuuugaucaacauuaaacuaaucuaaaucuauucaaauucuugcuuaagccuuagagaucauuuuaagcuaucucuuauauucaccagauagcaccauauauauuuucuggcaauuuuagagagguucuauaaagguacaaauuggcguuugauuuuuuuuuuuggcaaaaucuccuauuugagucauaaaauaucagaaaugagaaaaugaaugccaguugucauugcaucuacuuagugcccgugcaggucuuuuugcguuggcacugaucugaggcacuuaucuaugagauggguagucuuuuccccuguagucauauuacuacaguaauauaacucuggaagacagagaugaucuaaggaugaacacaugggagacagucuuauaacuagaagucaggcugcagaagauaaacuguuguccaucccaggaaauuacuagggauaagaagaguggcacguaucuuggaaaccacaguuuaucccaaauaacaacaacaacaaaguguucuuaaaugggaugacucuuaauaaaaucucauucauaagacccaguugccucaauuucuauuuuucagugacuucucuggcauauuaguucaauccacuuugaugucuugcagaaaugagucaucauauuuaccccagcuaaaaauggagagacucuuguugacauggcaagagaggauccagagcuccacccccuugcuugcucuauccuuaucccuuugaaaauuucuugagcccuggagcacaguucaaaaccacuaguuuauaccaccccuaaaauacaacaaaguggaauuugaggcaaguaucaggagcuucuacuaggaagaauuugagaauuuauuucaggcuuucuuuggauaaaaauuauacauguuaucugucauagcagagacccuacguuaugcuggucagguaaagaauaugauaaacauuugaaugguacaugguggucuacucaacauuuuaaaauccuuuaccuaauuugaccuucacaccaaucaaguaacauacauauuuuuaguuccaccuuaugggacaggaaauuaaagcucagagaaacugacuuguauaaaaguaaggaguaaauuagggauuggaacaagucuucucacucauaaauaguccagugucuuuuccacucuaguacauugucucugaagguaaauaucucauuguuuuacauuuggaagaagugguguuagugaauauuuuuaugagacaggugaguguuucaugcauaaauauuggguugaccccggauaaaguccugaaguagaaguugaucuugugguccccuuaggucuuuguaucuucugcagaaucuacucccuuuagguaucugguguucccaugauugcgugaauacugccugcaaucaggacaacuauugggauucagugacuuaaaucucuuccuugaucuaggagauccccuaggaaauuuucugguggagcagaaugggaugucuagaugaauggcauuuuuggagccccucaaaucaacaugauuuugcauaaugcugcaugaaguaaaaguaaauaauuauuaugauauuauuacuauguauccaacuaaguugauacauugcuccaaugagaaauuuugcacagugcagugggagauuugaacaggcuggcaauuguuugcuguuguuuuugcagggguuguguuucacuacagggcggcaaccagcagguacacacugaauuuugaggcugcucagaaggcuuguuuggacguuggggcagucauagcaacuccagagcagcucuuugcugccuaugaagauggauuugagcagugugacgcaggcuggcuggcugaucagacugucagguaagaggucugggggccacaggcuucauuauuaacuugagagugagaagaaagugccacuaacuagccauuuauuuccccagauaucccauccgggcucccagaguaggcuguuauggagauaagaugggaaaggcaggagucaggacuuauggauuccguucuccccaggaaacuuacgauguguauuguuauguggaucaucuggaugguaagauguuugaguuucuauaucuucguaugaacugagaaaacugagggaagaccagaaguucauuggaauagagcaagucuucgugcuuguuuggauuccaaacgguggcauuuuguuuauacgacuguaugauuuugugguaaaauaagccgaaauuaaaguggaaaggcaaggaggaguguguaaaugguuaugcagguuagaaaugucuucaguuaauggcagguuuucuuacagucaugcugcucuuggacuguuuccaauacacuuuuagaucauugagaauagaaagcuguaagggugguaccuauucuggugagagcauaagauaaaaaucaugugaugacaauccacugugaauccaaguacugauaaacaccccagagcuaacuaaauaacuccauaaacuagcccagcaggaauuuucaaguuugacuuccuguuuauuuuguuacacuaauauucagagcaauccuuccuucauucaaccagucaauacguuaaaccaguuaacacauuaaaaaucaccuacugugauuuuuguagguacucugcugguuguuagagauaugaaaucaguuaagauauagcccuuccuuucaagucgcuuacagucugauuucagcacugucauuucuccuuugccugaguuagagauucuuaaagacaaauuugaguucaauaguaccgacauuaucuaaagagcauggugcagcuuuauuauaaaggcacagggaggugggcacaguggcucacgccuguagucccagcacuuugggagagcuaggugggaagauagcuucaguucaggaguuugagaccagccuggguaacguggugaaaccaugucucuacauaaugccaaaacuuagcuagguguuguggcauaugccuguagucacaguuacuuaggaagugagagaagugugggggugggggguccugaggugggaggauuacaugagccaggguguggaggcuguagcgagcugaggagauugcgccacagcacuccagccuaggugacagagugagaucuugucucaacaaauacauaaauauaaguaaaauaaaggcacauggaauagaaguuucuacaacuuuugaaauggauuuucauuuguauuaacagcuauuauuagaauccuaaaguauagauaauaguguuaaauuaaauuauacuuuuaauuuugaguaggugcauauaaaaagaaugaucugaauuuucuuauguuuaaaaugaggaggcuggacuagauaauuucuauggucucuuucaacauuaaaauucugugauucccugauucugugaauugaauaagcaaucuuagagcccgaaagcuagaauauaagcagcuuauauuuuccuaaugccuugacuaaauuugcaucggaaggccugcuuucaaaaagggugcuuaggugugguucucuaguaucuuagcauucuuauuuucacuaucacugaagauugccagauguauuuucuaaaccaaaagugcagaugugagcaaauuuuauuuuuguauauaggaaaagggaaaacauaacauccaagcuaugguugaaauacauaaaacuagagcuuuucucuugccuuuauuuuaauugauuuaaaaaauagaagaggagaugguugguaggagaaucugauuaaauaaacuaggaaauaaauuggauuauugcuauuuugguaaggugggaauuuguaucacuauuguuuuaauuuaguguaauaucuacaagggugauaguuauaaacaauaucugaaaugcuaguaauacuagaaaugauccagagguagcuuuugcaaaaguauauguaagaucuaauuaaccuaaaagaucuuuaccaaauauuauuuaaauggugggcuuucgugauucaaauaugaauaagcaucccaagccagauuccuugguggaaagacaggcuuauguacccaugaagccaccagccagagagcccuagagaccccccguguguuuguuuuugaguuuacucugauagagcuacuaucagcucuuagcucucuaaggcucuagacugcccaaauucaaaauuauuuuuucaagcccagggagggauuuuauagaagucccagaaauuucagggccucugcaaguacuguuugaagaauuuuugacaagucuuaguggugggaguccuuccagggauuuccuagccacacugucuucauugaacgauggcuccccacagucugcucauaguaucauaaccaguguucaggaacuggacucugucagaagaggagcucugaggauguaugcauaucucccaugacgagggauuuacuagucuuauagacguccucucccacuuccauaaacacaaucacuucuaaagaagccaguuugugucccaauguaacccaacuguauuuuauaaaguuauuuuggauaaaucuacauacuuggugacugaaaacuuguaauguggaauauagcauaacuuuacuuaggcucuuuauaccaaaucaacagaauuuucaucuuuuuguuuuaauauguaaaaauuggaagagaaauauaaaagagucaguucaaauauuaauucaagcacuggcugaaaucagugucagcaaaguaacaaggcauuuauuuguuucauagaagaaacuugacaauucuggaggauauucagcauguuuacaauaacacuguuccugacauuuuuuuccuccuuguuuauuggcucuuggacuaaguaucaaaucuuuggacacuguucuuuucuuucuuggcuugaaagugagcaggaaugggggugaaagguaacuuuuauggcugaugagguaagaggaagaucacaaaaucauucuuguaaggcuucucucauuucuuaacugaaguauaugucuucccuuuugaaguacagaccauggcuaaugagugaauuaauaaaaaauucuuguggaaaguugacuacauaaaauuacgucugguauuucaauugucacguugauaaaagauuauuugaaggugagucaagauuccuuguaagaggcauugcuaaauucaugagucaaauaauucccaccuauauuuuauuauauuugggggagucaaguguguguguaugagaaaugguggggacaguaaaagauuugguauauucagaaugcaugugauggaacacacacauaggaguuaugaaccaaggugcaauuaauuuagaucagaagccauauauuccagauggucugaugaaaaagccaauuaaguauaaaaugaaaacuugcucaaaaaggcaauuaauuuuccguuuuaauuuaauuauuuauugugaaagauauauaguugacaguauguugaccuguuuuuuucuccuuucuuguuuuauaaugucauaucuuccugacauauguguuucucuauaaaauuugaauaauugcacuaaauuaaauccugcuaguuuugggagaaaaaucuaguaggguucuuuuucuaagguggugauuauaacaguuaugcauauucaaugaauauucaauucugcuuuucaaaauaaccuauuaaguuuuaaagaguaauuacauuagcuauauucacuaguaaacauuucaauaucagcucguguucuuagaaauggucuggaaauuaugauggcuuauuagagaugauucaaucaguaauagaaugcuauuauuaagaaauuaauggaauuaaaauuuuaaaaugggaaucuagaaauuaagauccacaaaauaauccuuauuaggaauuuuaaucuuuguuucccaguaagacagauuuggaaaacauugggaggguuuuaagguagaguugagaugauuaaauggcucaagaaauuagguaaaggaucggaauuauuuaagaacgaaauuaauagacugacuauuuauuugguuuccugaugguagcagauacuuuaaaaaauaaguuucuuuuuuaggcauuuaauuuauccugcagauaaauuggaggauugcagaugagguccuauuaccuucuuucauuguugacccacuuaguuuccuugcaaaugagucaauacuuccagucuuguccccagaccugacaaaugguugguucaggagcuucucuccccugugacauaggccuauccucuuauggccugcauuuucuauguagcccugccuuuugguauuuacuucaccuggguuaacuacuacccuacuauuccaauucucuguuuuuuuacacaagcuuccagcacuuugacaggccuauacugugggcacucucuuucaucucauauucccuccugaagaccuaggugauucuucucaucuuuaccaucucugaaccuugaauguaugacuauaauuacccucuugcaaauauuugcuuauacuucuuucucuccuacuaaacuauggauugggggaaagaaggaaacauacaaauucauuuuuguaugcccaauauguccuuagcauauaguaggugcuccauagguagagcugaauaaaugagugaauuaaugaauuaacuucuaaaccauuaaugccucccuacucaccuugauuuacaauugcuuucuggauaguuucacacuucuccaggauccaucaguauacuaucugcuuccugauuuuuuuauugcuuuaauuuucuuauuaguuuguuuaauuucauuuuuguucucuuguacauaacuuguaagccaaaagucuugugggacauauggggcaugaaagaauaccaaaagaacaaauacgugaacaaugaagauguuaauuucuaguuuugcauguuuagcuccugaauucuuuucugaauuucauacccauauuucuaguuugugaaucacuuuugaguuucauuuuugguuuugguugucacaaauaguccccaucacuuuaagaguccuucaggggaucuguuuuacuaccaucaaaacaguuaaacaccauugccauguaauucuccuacuuaacguuguguguugguuuuguuggcuucuuccacaagcacauacucugccuggucuucaaaaccuauaccugcucuacugcaaucuauucacccuucauucccacacucuucaaugugaccccacacacgugcaucucgcccugcacagacccuuugcuugcuccugcuugcaagucugcucuguuccucucagggaacacacacccuucaucucuucaacauugugauuuugccugugcuugaagacuuacugcuuccaggaucccccuuuuggcuauugcagcucacacugaaauuucuugacucugaacuucuacuuuacuuagaguuaguuccaugugauuuauugcuuaauuguuuucugguuucuuuguguucauaaaauauaaaauguuauauguuuguuuuauuucagcaaaauuauuguaagcuccuaguagagauaagaccauaaacuucuauauguuucccaacugcaaucaagagccuguuccaauugcagacacguaauaguuauccaauaaauaguuggugguaauuauaguauuuuuccaaccuuugucucuucuggaaacugccuuccaccaccaccuuuccauuuaucuauaacacuugaaaaaaugcuuugcuuuauuuaccaaauucaaaaagaucuacuuuuuaccauuauuuaaucaccaugauacuauuuuuuccucuuuguauuucuccucucacucuuuucuccucucacucuuuucuuugaugucucuuagaaauuacuccuucccagagauacuccuuucuggccucucaugguaaauuauuuuccuugccuuccacuccuucccagcaaauuguccucucugggauugcuuuucuuguauuaauaccuauucaucaauuauagguuauuauuuuuacuguuucuuggugucagaguccaggauggcuuugucaccucugugacuuaucuaaugccuccauaucauucuugugccucaccuagaaccaaaaacaacuuuuccauuuuuguuacuuuaugagcuccuuuagauaugaaaaucuaaacauuuagauaaacaucaucaaguaggucuuagagcaggguuaguucuagcuuuuuaaagguuuugguuggaccaaaaucagauaucgcaucuggagauuguguaauuucuuuccuauagauucucagauugccuauuaauuuuaaugagauuuacaguauguaaucuacagaauacuucacugaugaagguuauuuaagaauuagugauuugcguccuuacugggcuuauucaguuaaaaagccacauaucagcuugaagagccucuugcacacuaugauuccgccgaugguuaaaguagugauucuugauuucagaaucucuucacauuuguugcaguuggcccuagaagaugcuaaaaacuuuuuaauuauccguagcuuccuauauagacuuuggagauuaacacaccuugcuuggaguugcuucuguguacaguguuugaacagucuaccuaagagccaaugaggaaagcaaucaggcacagcauggugggagcaccucuggaagaugauguccuuauacaguguagugacuccaguaagauugagugugagguaguuucaugaguagaaugaggaaggaaaacaucuacuguguggugggaguauuauuuaacuuaaaucuuaugaaaccuuugucaggcacuuuuuaaaagaaaccucacuuuugccuauaagaaaacugaggcacagacagguuaagugauuagauaugccuuuuuucuucuucuacugccauaaacucacagggccacuaaagauuccccaguagagcagcaggcagucuugcaagccaagaagauaaaaaguacccucaaagcucccucaaaucucugauaucucauuagaaaaaaucauaauucuuauuugagcaaugauugcauuacagauuggauuacaaugauugggauugcugggucaaaugguaacuacuuugaacuuuuugaggaaaugcuaggcuguuuuucaauguggcuguaccauuuuacauucucaucagcaguguauuaggguccugauuccuccacagucuugucaacacuugcuauuaucugaccuuuuguguagccaucuuaaugaguguaaaguaguaucucugugguuuugaauugcauuucucugauggcuaaugagcuccaacaucuuuuuaugugcuugcuaguuauuuaucaaucuucuugguagaacugucuacucugaaacuuugcccacuuauaauuguguugucuuuacuauuaaauuuugagugcucuuuguauauucuagauuugcaugucuucucauguaaaugauuuacaaauaguuucucccauucagugaguugucuuuuuacuuucuugauaaggcccuuugaagcacaaaaguguuuaauuuagaugaaaaguccaauuugucuauuuuuaaaauuuuugugcuuuuggugucauaucuaagaaaacauugccaaauccccagucaugaagauuuaucucuguguuuuagucuaagagauuuauaaguuuuaacucuuuugcuuuuauuuugauccauuuggaguuagcuuuuguauauggugugagguuggaguccaaauucauucuuuuggauguggucccagcaccauuuguugaaaagauaauuauuucuccauuuaaugaccuuggcacccuguugaaaaucaauugaccauagguagaugcauuuauuucuagacucucaauuauauuccauugaucuguaugucuaucuuuaugccaguaccacaaugucuuuauuacaauugcuuuguaguaaauuuugaaaauggaaagugugaggcuuccaacuguguucuucuuuuucaaaauuguuuuaguauucuggguuucuugaguucccacaugaauuuuaaaauuggcuugucaauuucugcaaagaagccagcuaggauucugauauagauugcaaugaaucucuagaucaacuugggguauauugcccucuuagaaauauuaugucuucugaucugugaaccugagaugucuuucugcuauuuuuuagauauucuuucauuuuauucaacaauauuuuguucuuuucagaguauaaguuuugcaguucuuuuguuaaauuuacuuguaaauauuuuacuauuuuugaugcaaaugcaaauguaauuuucuuaauuuuuuugauuguuuauuacaaguguacagaaaugcaauugauuuuuauauauaggucuuguaucuugcaaccuugcugaacuugccucuucguucuaauuguuuuuuaguggauuccuuaggauuuucuuuauacacucucuuucauuuuauaaucuuacuuuacauaaguagaacugucuugacauaaacuccuugaagcaugugacagucauuugcuuuaagguuuucaugucagggucuccuggaguucugaaucaaaagagcuucuuuggaaauacagucaccauuuaccucccagcugugaaaagccaaaaaaacccaaacuaggcugauacuccuguguugaccugaggucauucugugccugucaaaccaaauaacacauucaaucuuuuguauauuuugaagacucagaaacccagaaauuuuuagaaccucuuucucacucuaauuaaaaccuacugcucugucaaugggaaagaaugaguccaaacauucugaaaaccguacaaauguguuuacauuuuagugggggcuuccugcaucuuuaaccucuuuaaauugacauagguaagaucuuguguaauaacacauuugcaaauaugcagaugcauuuucaaaugaauauaaucugauuuagagaauauuaacugacuaucauaguagacuauggauaauacucuaauaauuaauuacagguuaacauuuuuaaaacucaaagcauaugcuuuaaguuuaugcuuuaagccacguuauguucuacuucagccuaauacaagggagaaauuuggagggggcccuccuagcuuucuagucucauuauucccaaauuagaaacauuaccagccuaacacuaacucuggggucuaaaaugaaguuauuuuggcagcccuagaguuuucuugucauugauaacugaagauuggccuuugugcagguuaaauaaucaaaucuuagaggaaauugacaugcuuuuaaauuaucuacaaauauuagcccuuaaaagauuauauagcaguauauauuauguuaaccaauccaugugcagcugauggacuuugugauucaguggauaauaagcauuaguuuuuccugcuuugaucuuauguauauccauacagaaaaacaaaaaaacgauggagagagagauagagagagagagagaaaagaaaaagaaaguguugaaaaagcuuaaaaguccaacauuucaaagcuaaucauuuuguugaauuguugcuaucaccuugauacuugauauauucuguuagugauuuuaucguauggguauuuagaagcucauuucauguaacuacuuccagcuuacucaucccauuuacuuuugcauacauuuauuacuuauacaccauuuugacccagauagcaagguaaugugaaaacauuuacaaauguugaacuuuuguaguaaaauaacaacaacaacaagaacaaaaaaccaaaagagcagggagugcugcucccaaauggacaaaggaaauuaugaauuaguuuauaagaacugauuuucagaccaaacagugcaguauaguagagcuauaagcacuaaugaacagaagaaacauaaucauguaucacaucacccagcaaauauacucugcuacaaaacugguaagaucucagcuuugacugccacagagagcagcccaucugcugcagucaggaaagaauuguguaauuaucugugauuaaguccuccuuucaccuuggugauugcaagaauugucagugggggagaaauauccuauccuaguuuuacucuagacucaggcucuuuaaucauauuguugagugacuccugaguauaaacucuagcuuuugaacacuuugggucauuuuuaauguuuugauuuguuuucaucauugcuugccauuucaguaugugucauguuugagucugccaagaagcagcuuuuccacuuagcaaacagaauugugaaaaaaauauacaugguccacuuucuagggagucuuguagcagcuagugaucaaauuagaguauuuuuucccuuaauuucugauguuaauucccacaauaaauuuaguuuguggaaugucauuaaagucuuacaacaugucucccguuucuucuagagcaucccuggaaaguugaaguaacaggaauaugucaaagcuauaaguauuuaauuugaaauuuuggaaaacuauggcuuaagauacugcauauguuuuccauaugaauaugcaaauuauccuauucaugaaaggcucuguuguauaucauauuuuacauguacacuaaucugaauguauauguauauaccuugaugaauuuuuuuuuuuuuuuuuugagacggagucucucuguugcccaggcuggaguucaguggcaugaucucagcucacugcaaccucugccuccuggguucaagcgauccuccugccucagauccccaguagcugggauuacaggcaugcaccaccaugccuggcuaauuuuuguauuuuuaguaaacaugggguuucaccauguuggccagucuggucucaaacuccugaccucagaugauccaccugccuuguccucccaaaguucuaggauuacaggcaugagccacugcgcccagccugaugaauucuuauuauaacaauuuaacuuacuguaaaccugacaucuuaaguaaugcaucacuuuguuuauauaaaauauauuugguauauuuccugauguauuaguccauuuucaugcugcugauaaagacauacccaagacugggaagaaaaagagguuuaauuggacuuacaguuccacguggcuggggaggccucagaaucguggcgggaggugaaggggacuacuuagaugguggcagcaagaaaaaaugaggaagaagcaaaagcagaaaccccugauaaacccauuagaucucaugagacuuauuaacuauuaugagaauagcauggggaagaccaacccccaugauuccauuaccucccccugggucccucccacaacacaugggaauucugcgagauacaguucaaguugagauuuggguggggacacagccaaaccauauuguucugccccuggccccuccaaaucucauguccucacauuucaaaaccaaucaugccuucccaacaguuccccaaagucuuaacucauuucagcauuaacccaaaaguccacaguccaaagucucauuugagacaaggcaagucccuuccgccuaggagccuguaaaaaucaaaagcaaacuaguuacuuccuagauacaauggggauacagguauuggguaaauacacccauuccaaaugggagaauuuggccaaaaacaaagggguuacagggcccaugcaaguccaaaauccaguggagcagccacauuuuaaagcuccaaaaugaucuccuuugacugcaggucucacacccaggucacgcugaugcaagagguagguucuuauggucucgggcagcucagccccuguggcuuugcaggguacagccucccuccugccugcuuucaugggcuaguauugagugucugcagcuuucccgggcacacagugcaagcugucaguggaucuaccauucuggguucuggaagaugguggcccucuuuucacagcuccaguagggagugccccuguagggacucugucugggggcuccaaccccacauuucccuucugcacugcccuagcagagguucuccaugagggccccaccccuacagcaaacuucugccugggcagcuaggcauuuccauacaucuuaugaaaucuaggcagagguuccccaaccucaguucuugacuucugugcacccacaggcucaacaccacauggaagcugccaagguuuggggcuuccacccucugaagccacagcccaagcuguacacuggccccacucagccacgguuugaguggcuggggcacaggguaccaauuccccaagcugcauacagcacggggacccugggccuggcccaugaaaccacuuuuuccuccugggccuccaggccuaugaugggaguggcugcugugaaggucucugacauggccugaagacauuuuauccacggucuuggggauuaacguuaggcuccuugcuacuuaugcaaauuucugcagccggcuugaauucccccgcagaaaauggguuuuccuuuucuacugcauagucaggcugcaauuuuucaaaacuuuuuugcucugcuucccuuauaaaacugaaugccuuuaacagaacccaagucaccucuugaaugcuuuggugcuuagaaauuucuuccaccacauacuguaaaucaucuuucucaaguucaaaguuccacaaaucucuagggcaggggcaaaaugccaccagucucuuugcuaaaacauaacaagagucaccuuucuuccaguccccaaguccuucaucuccaucugagaccaacccagccuggaccuuauugucaauaucaucagcauuuugggcaaagccauucaacaagccucuaggaaguuccaaacuuucccacauuuuccucucuucuucugagcccuccaaacucuucuaaccccugccuguuacccaguuccaacauugcuuccacauuuucggguaucuuuucagcaacaccccacuguacugguaccaauuuacuguauuaguuuauuuucacacugcugauaaaggcauacccgagacugagaagaaaaagagguuuaauuggacuuauauuuccacaugguuggggaggccucagaaucuuggcgagaggugaaaggcacuucuuacauggcagcggcaagagaaaaugaggaagaagcaaaagcagaaagccccugauaaacccaugagaucuuuugagacuuauuaacuaucaugagaauagcacggggaagacuggcccccauuauucaaguaccuucccgugggucccuuccacaacacaugggaauuuugggagauacaauucaagcugagauuuggguggggacacagccaaaucauaucacuugacauuuuauuuacuguuuucaauuagagaaaaauaaaacauuuucucauggauagguaacauuuagaaacauguuccaaaucugugcucuaauuacaacuuugauaauuguccuaucaauuuagcugcuuugaugaggcuacuccuggaacuuauuaacaggcuucuugucaaacuacaaaaaagaugcuuguuuuccaggaaagcaacuauccguuaaaucuaagaauacauuaaauuguucagguacaaguauccaggagcagagauagaacacaacuuuguucuaugcuacuaaaauagucauuuucucucacugaaggcugugcauucccugucuaacucuaaagguuguacugugauuaaaaacucagaaagaacuuuuauuauucacaucagagauaaaaagguggcuuuaugauacccucuggguaggagcuuacacaguugggccaauuaaaucauguugagagagagcaacuaagcaaacgugccuauuugauuugcuugauuucccauguuugcugugaucaguggcuuucucuuuugucuguuccuuggauuccugauuuggcuuugccucuaggcauuagauguuaucuuuggaggcauccuucuaugagcauucauuuuuggaccaagccuggauuuacaauucuauuacuggcccagacuucauuucuauccaauuucauuccacugugcuauaguuuacaacauauaauuugacuuauaaauaauuccugacuauggguuuaaagacugaaaauggaucaauagaaacuuugaaaauguuaacaucuugauugcuuuucucaguguagaaauggacaauguuuagcuuaaaaacugcauguuuuuaaugagauacgggguugaaagacuuauuccuggaauuuauuguucuggagaaagccuguugcuaucugccauaccuugguuuacuuugugcaaaaugagcuucuuuuuaaguaaugagcucuuuccauguucagcuuaaauugcugucuuagacacuucaucaggguucccugcucugccucauuccccuuuuugcucacuugcagccuuugacauaauccugggaggcaauuggcaucauacauauuuugcuuuguaaucuccugcuuugauucugacuggguacccagucugcucacuuugcuucuaucuuaaacagguugacacauaccagaaacuuaguacuaaguuauguguguuguaaguuaauugagaguccucuucuugauuaaaauauaggucuuuagaacaguguuuuccaaaauauuccacaaaacaaauuuauguacagaugucccugccuuaauaauagaggguugauacauggaaaggacagaaguuuggacauuuaacuuaucacguuugguauagauuggguguuaguuauaagagauuaaagacauacucaauucuauaguguaaaugcuucacuauaucauuagguuuuugaggugagcaaggaaauguucacacuaaacaauuaugauuuaggaaggcuuaaauaguuauuuuuuagaacagaauuuaagucacuuuuuuccuuuucucauuauucugaaauaaaguaauuauugcugaauaaaauaacugacugcacguuaucuuaacagauuaauucuuuuaauccucaccuuaaaguaaacucaauugauucugguuaaaucuuccuuuuuuucaucugaauuacaagaaacccaaugguaauguuucuugcaauauguuuuauaaaaauuuuauuuggaaaguuugaaaaauuucuacacauaauugaaaaggauaaguugggcacaguggugccugcguguagucccagcuacucaggaagcugaggcaaggaggauugcuggaggcaaggaaguugaggacagagugugcuaugaucaugccugugaauagccacugcacuccugccuggacaauuuagcaagacucuaucuuuuuugaaaagaaagaaagaaagaaagagaaagaaagaaaagaaagaaagaaagaaagagaaagaaagaaggaaggaaggaaggaaagaaagaaagaaagaaauggcauuagggauaacagaauuuaaucaaaguaguaaaaugaucauucuauggguaucaaacaaauaaaugaauaucguauacuucaaacaagugaguuaaauaauugauagucugauauaaagucagauuuaacaagaguuucuacaugaaaaguucuauaaguaggucugaacugauuaacuacuacuaagagaauucucuuuguaacaggccagcaccuacugaagccuuucuuucuuuuaauacugcaaacauguuugcuguuuaaaauagggaaaccagcuacccaugaaaucaugcugccauuuuuuccucauuagcccuuuggucuggucuuccuuggagaaguugauguuccucaauagauagacuaacagugcaguuggagaagcagaguuuuacucaauuaauuauauuucuuugcccuuccgugguuggcugauaacacuuguuacuuaagaggaaugguaguuucgccuuaagguaggaguaucucaggaaaugcaggaaacuaaggcaacacaacuaauauuccagcuguaauaacaaguccaaggguucuaccucucagggaaaacuguuggcacgcugccuucuuuacacuugcagcccuuucaggccucaggcaaguguuauucugaggugaaggaggcuguucaggaugacguaauuucucugucugccuuucuccauguugcuuugagccaagucuauugugagauaaaaugccuguuucaggcagcagccaucucuccaaagcuuuguagcagaguuagcuuuauuuaaugugcuguugggaaggauagggggaaaaaagagaccuagcuucuuaauaagaacuugaagugccauucauuuaacaaaucuuauugaauacauacuauguaacuggcccugugacccuuaugcuuuuaaaauuuauuaggaagggagacguugugagagccgggaggggaacuuuuucuuagaguguauuguuguauuugagauuacugucuuuugccagacuagauaauuaagaauaaaaagcuauguacaccucuaccacuucuuucagucaggugaaaguaauuucucucucccuucuucaaauagcucucauugaaauuuggccuacuuuccucaauagcaauuuuagauauauagugagaaaagccgauaugugugcuuuggccauuuuccccaugacuaauuuuucuuguuuuauagugcuaucacccacucagagaaaguaauagcacuauucauuuuaaacaauugcuugauacaucuggauuuagucaggugaagauccaaaucaugacagcucuuuggaucccaguugucuaauauaucauagaaucagagaucagcuucagugagauggaaacaguacucucagcuacaauagugggcuaucaacauuuuaacuuucuguuucaguuuucauuucuccuccugacugugauauuggcuuagguauucuauaauucugcuucugucuuugguuacuuuugcucacaugugaaaaacauaauuuaauuuguguggaauuuauuucagcaaacuguuauguuaguuagcuaaguaaaauuccaacuuaacaaacucugaaguuuccagaaucuuucauuguaacauguuaaaugauaaugaauauacccucugcuaauuagacuugguaauaaacaaagcaacuguccagccuuuucuuguuaaucaaucagcaaauuaaaaaaccucuuuaaccaaucucaccacuuugggaggccgaggcggguggaucacgaggucaggaguuugaggccagccuggccaacauggcaaaaccccgucuccacuaaaaauacaaaaauuagcugggcgugguggcaggugccuguaaucccagcuacuugggaggcugaggcaggagaaucgcuugaacccgggagguguagguugcagugagcccagaucgugccacugcacugcagccugggcuacugagccuccaucuggggcccgagugagugggguguugggggagucuuucucucuuuuuuuuuucgagacggagucucgcugugucgcccaggcuggagugugguggugcaaucucagcucacugcaaccucugccucccggguucaagcgauucuccuaaaaaaaaaagaagucucuugaaccuaguuaaagccccuacuagcacuuggggugucuuuguaagaauuagcaaaaagugcucccucugcacagagcaaguaaaacaaaggcuuuauccaaagaggcuggaguuccuuuggcuggcugagugggaggcgaccuaggccuucccuacacacugggccuggugcuccugugcaggccgcgaccuucguaaccaucauggcagcccugugccugauacgggaaggcaggaaguagaauucuguaccacuucugagcccuucccaucuucacauuucuggagguuuucuuauuuuuuuuuuuuuuuauuuaauggcguuaauccacuuugucgguaguuauaaaugagaaggaaggccagagaauuacuauuugauuuuaggauaaacaaaguggaauaaccgugguggcaguucaaugcaagguuucccuuccaauaugcaauguuaggaagcacauagcagacuuuuuccuuaaaaaaacaaaaaccuggauaguaaucuaaagaaucacucagaaggauuuguucauuuuaaagaauguauuauaaaauguuauuaaaugacugauucuauggccaauguacacacacacauacacguauagaauaaaacuucucggguauguguuauuuaugauuauguauucauaauuauaacgaagcuaagucaccauuaucuuuucugcuuuaaaguaucagaagcugcuaccuugccaugaaaaaguauuacaugcuccuccaauuccuuccccaccauauuuauccaacaggaaaggaaugaauaauaaaacuuugggcuuuuuuucccuucuuuuuuuuccaggugauguguuccaccucacuguccccaguaaauucaccuucgaggaggcugcaaaagagugugaaaaccaggaugccaggcuggcaacagugggggaacuccaggcggcauggaggaacggcuuugaccagugcgauuacggguggcugucggaugccagcgugcgccacccugugacuguggccagggcccaguguggagguggucuacuuggggugagaacccuguaucguuuugagaaccagacaggcuucccucccccugauagcagauuugaugccuacugcuuuaaacguaaguguuugauaccuuuuuaaaaauuacaguuuuaaaaaaaaugcuucgaagcaugcauugauguucaacuagccguuggaguggauuccaugucuugcagugugugcacggaauggaaacaguucagugauuuucaaaagcaagcaaacugaacagcagugauaugguuaaaaccacaggaauuuuggcaaauggauuuuuagaggggugaggaaauaucagguuaagcuguaacugugcucuguuguguccagagccacagagcauuuuucuaaguauuuuauauuaauugcaguccuuaaguuuugcaauuuguuuauugguguuacaaugccaaggccaacugaggcugaguuaaauccuuaagauuguugauuuugucuucgguaucacucuguuucuuugagauggcaaagaauuuaaauuucaguaauuacaggugaguauuugaagcugacauggauacucaaaauguucaagucauaacuaaaaaugaaccauacuaucaauaaaaaucuccauuuaugucaaguaauggaaauacaugccuucuaaucauuaauucuguaguaucauauugacguacaauauguguucuuugcaaccuauaacagaguaucuuuaguuagguuuacuaauuaacauuuuuuuuuaaauaacauuucucaacauucaugauauaauuauuuuaauuuuccagauguccucaaguaauuuuagcaguaguagucacaugauauaguaucauaguuguagaaugcaaauuaaacaagcaaguaaucuagcaucucauuggaauauuuacugaaccaucuauacuaugcuagcuaaacaaagaucucccagaauuuuggugaccuuggguaauauccaagacagaguuagguuauguugaaacaaauuuguaaacaacuuugacuaaauuuccaauguaucuuguuauagcaauaugucucuaaaacgaguacaaaauguacuagcuuauuauauaauugauuucuagagugaaauacacaggcauuuuuaagcaaccaaaaauacacagacugugauguucuagguagucaguagaauggauguuaaugcaaccaaaagguuuguuuucacacuuuuaucuccuagcuaagaagccucugcucugaucuccucccuuagacucaacuuucugaguguuaaagccauguguucuguauuagcuugccacaagcuggucgcuccauaaagacuguagaaaaugcuggcuuuuguucucaggcccugaaacaacagaauucuuccuuaaucauuuucaggaaaacaacaauagcauaaaccuuaucucuaaaaguagacagauguacauuccuuuaagcuacauugucacaacaaugauuuuucaaguacuucaggcucuaaaaucaguuuuacauuacgugacugauauaauuaaggagcaaaaucagauugguaugcuguggggaaggcauuggagagguuaaauuagggaacgaauagaauuauccagccugacuuccuuauuugauauuuucuugugcuuuauuaauaaaacuggcacuggaaaacuuuuaaacaacauuuuucgucucucuguggguaaaauuuaaaucaaagccugucuguagccacaaagacuauuauuaaagaauucauccugauguguuuuaaauuauuuauuuaauugaaaaauacacaugaaauaacaagguacuuauguuuaaauagaguaaccaaaaucugcacaaaauucaaaaaauguuuaaaaguuuauauucauuuuuaucucucuaauucauuuacauguauguaacuuguaaauauaauggacucauuauuuugcuuuccuucccaccuaagcauguggcuagauucuuauuuauuuccuacuuaagacguuauuauauucagaauucauuuagugcguagaagguuaaaagcauuuagccauauagaagccuuucuuaaaccacacauaaugccaauaguuuuccaaaauuucuaauuuauuuuucaaaaaauuuuuuaguguauauguguguguguguguguguguguauuuuuuuuuuuuuuugagguggaguuucgcucuuguugcccaggcuggagugcaauggugccaucucagcucacugcaagcuucaccuuccagguucaagugauucuccugccuucuccugccucagccacccaaguagcuggguuauaggcaugcgccaccgugcccggcuaauuuuguguuuuuaguagagaugggguuucaucauguuggucagguuggucucgaacuccugaccucaggugauccacccauuuuggcuucccaaagugcugggauuacaggagugagccacugcuccuggccuaguauauauuuuuaaagaauuugaaaaauauuuucaaaaugacuuaauugauguccaccuuucccacauagucaaguagugacuaaauucuguaggguaaaauucauaagagucauggccucagcuacaguuccaaagugauuucagagauauacagcuggcugguuauguagaggaauuuagaaauauaaccauauuuuucuuguuugcuucuaccaaacguagaaaguguuuuuuaagucacuuggugaauaaacaaugccaaaucguaccuugcuuuaauucccuuugccucacaaagucacugacuaaaacauucacaaagacagauaaaagacauaaaauuaggcuuuauucuuuucaaauaaauuugaaaaguaagcaaaguaaugucuuuguaagauaaaguuuuccuguauaucuucucuuaaugauuaaacaauuuugcauauuuaguuuuuuacuucagaauuuagcaaguucugugaaaguuggagaguuauacaaggcuuugaaagaucauuucauacauccccaaacuuaagugaaucaaaaccauucaaaacucaugauaaucucucacagaaugugauuaauuaucuccaggagagggagauggaacauguuuccuagaaaacucauucuaauauuccaugaccuucacucucagauaauuuuucuaauuaaguacuuugcauuugaauuugaacccauguuuucauuuuugaguuggagaccaaaaucugaauaacagccauuucuauuguugaucacaauuguuuauuuaucccucagcaucuucuccaacugaaacaguuuucuuguuuuacaguuucaaucuccaaauuucuaauuauugauauguucuugcuuugaaguuucaucauuguuuagcacauuccucuauuuaugcuuaaguuuagaaaucaagauggugguccagagaaggcuaaauuaauucccaccacuuucuauccuaucuuauauacucauucacuguuaaaauuugccugcccuucuaaccuuugguuaguucauuaucuuuuuugugugugcccuaguucauaaucugaccacaugugccaaaacuaaccuuuccccgauugguauauuacaaauguuuccuguuuauugaauuugaauuuguuagcauuccaucacucauauaacuuuaaaaagauaguuugaauuggccgggcgcggucgcucacgccuguaaucccagcauuuugggaggccaaggugggcggaucaugaggucaggagaucgagaccauccuggcuaacacggugaaaccccaucucuacuaaaaauacaaaaaauuagccgggcaugguggcgggcgccuguagucccagucccuaacccaaacccuaacccuaacccuaacccuaucccuagccuguagucccagucgggaggcugaggcaggagaauggcgugaaccugggagguggagcuugcagugagacaagauugugccacugcacuccagccuggacuacagagcaagacucugucucaaaaaaaaaaauuauauauauagaguuugaauuguaauuucacugcuccaaucuuuacaguuuuauaaccauguuuacauuuaguuauguauaacaaauuuaauauagaagaaccaaguuaaaauuagucauuucucaauaauguagagagcaugggaauaaguuaaauugacuaucaugcugcuaauggggguuuuaaguuuuauuaggaaaaucugucucaugucucgcaacagaagcagagaagauggcccauaggacaaaaaugccauaaguacagugaugugaaacaucugugggcagacagcugcaaagguuggaaaggaacuuuugugggaaaagaaucguguugauuuauguuggcuuccucaauaauaaaguugaaggaauacugguaguuuuccagagccaaaacuucuccaugugaaugcaccuauuggaaggacacuguuagaauaaucuggaauuguuuuuaccuuuacaauagucaucagaauacagugguauuuauucuuaaaauaucucuucguagauauugugcuuuauaaaauuauuuccuuuuguggaaugguugaaacaaauggcacaaauccucagauacacugacuugugaucaaaaucagcuguuaaguugaugaaaaagccacccaaacugaaaaggaagucugagguuuuccauuccaaguaguagaauuaauuaacuuaauuauaagcagaccuuuucuuuuuuaaaauagggcucuaaaauuauugaaaacccuuguuuuuggaaacaaagucacauaaauacuggcuuucuagaacagauucucuaggacauauugcuaccacuuuauuacacagcaggacuagaggaaggaaugcaacagcaaacuccauaguaauaauugacaaugaaaucuaguuauuuaguuuuaaaaauaugagucaacuuuuaaaacacuauaaacauauuuucauagcauuguagaaaguugcuagcagagagcuuggauuggaacauaggaagccuggauucacagccccuuuggcccuaaugcaauuguaccuguuucuaaguuaauuucaucagccaaggaaauacucagagggaaaaaguaaauuuagcuuuuuuguuguuauuaauaauaauaugauuaaauuuucucuaauaugcuguuugcuaaguauuuauauuauguuuccaugggaacuuuuucuguauguaucuuuuuacuauuuccccaaagaaugcaguuauaagacaaacaugaaauuuggcaguuaaaugaaguaaugguuauggaauuucagaggauagagaauugaauuaaaauagucauccacauuuuggguuuuuaaguuguucaugucaaucaaaauagaacaacgcuucuuccaggaaaugaauguagaaaaagcuuuucuuuaaaaaggggaggaaaagguuauuuaauguuuuuaaacuccaacucuuuuuugguuaguuuuguuuuaauauuagaaagauaaauaaugacagacuuuaaagaauauuuaaauguaucauaauguaaauagcccucaaauguucaugauaaaaucagugaagcugagcuuuaaaauggucuggggaaugaccacaacuaauaacagcucgugccagacaaaaaauaaggaaccuguuacagcccuagucugauuuacaauaaaaucacaucauuuuaugauuaaguuuuuacagagcaaauggagcuaaaagguagccuguuuuguuuuuugagggcuccuguucuggaauuauuaaaaauaaaaaagaagauacuauagauacuauggcuauuacaccucuuuucagggcaaacaagcauuuacucauaaaacuagcuuuaaguccuauaggauguagcaaaacaauaacuacagguuucuucaggacaguucuuuugaguucaguggcaacuauuaauagguuuuuauuuuuaaaaauacugauuuuuauuuuaaaaaaacaaucauuauauaguaggcugcugccuuuucccuguguugagaaagaaucuuguuuacaaacuguugcuuuuauacacaauuuaaauuucuuucaacaggccaggccauucucuguaaaucuggagccauuauaaugcagcauuuuaugaugacagguuacuuuauauugccugagccuguucuuucugaugcuuaggguuguucccagugauuuguaauuacagaccuaaaauacauuauguggguacuuuacuuccuguucuacauuuguguuucaggcuaaaguaagccuggaaacaagauccuuaggagauacaaacagaguguguagaacauagaacaaaauguagaacuacaacaaaugccgacuagccucugccaggcacauuuuauaauuuauuagaaacaaaucuacaccaugaaguugaaagaaggaugaagacaaauguccaacaccugggaucaagugaagagugguauuaaaaaguuuuaauauccuguuuuuaugaaagucuccacauuauggacaauguaaugguuuauauguaacuuggauacauuucauguggcuuuuuuguuguuuugcaaucugagacacacccucuccccugagauaauaugcagcaacuugaaaagaagggagcauguggagaaagcuggagacaggguacagaagccuccagaagaauaguacuaaauucuccugcgaggcuucaaguugacgcuguaguuucugguaaauaaacaaucuacuguaucuaaaaucugcauuuauauuuuugggagcuuuuccuuaucuuaaaacuacauaauauuaauuuuccucaacugguaacagucaugcauacuuuuagguaaaagcagugauaacccuuauaacguaaaacaacugaucaauuuaugacuauuaaguguucaauuaucuguccuuggguuaauucaaguauaguuuuaagacuccucuccaucacagaacauuucugggccacccaaaaauacucccuacaaaauacucaggagcacuuaacaaacacugggcauacaaguuuuuauuagugacuugucuaaucaacucuuugaaauuauuuuucuagcuaaagaggcuacaaccaucgauuugaguauccucgcagaaacugcaucacccaguuuauccaaagaaccacaaaugguuucugauagaacuacaccaaucaucccuuuaguugaugaauuaccugucauuccaacagaguucccucccgugggaaauauugucaguuuugaacagaaagccacaguccaaccucaggcuaucacagauaguuuagccaccaaauuacccacaccuacuggcaguaccaagaagcccugggauauggaugacuacucaccuucugcuucaggaccucuuggaaagcuagacauaucagaaauuaaggaagaagugcuccagaguacaacuggcgucucucauuaugcuacggauucaugggauggugucguggaagauaaacaaacacaagaaucgguuacacagauugaacaaauagaaguggguccuuugguaacaucuauggaaaucuuaaagcacauuccuuccaaggaauucccuguaacugaaacaccauugguaacugcaagaaugauccuggaauccaaaacugaaaagaaaaugguaagcacuguuucugaauugguaaccacaggucacuauggauucaccuugggagaagaggaugaugaagacagaacacuuacaguuggaucugaugagagcaccuugaucuuugaccaaauuccugaagucauuacggugucaaagacuucagaagacaccauccacacucauuuagaagacuuggagucagucucagcauccacaacuguuuccccuuuaauuaugccugauaauaauggaucauccauggaugacugggaagagagacaaacuagugguaggauaacggaagaguuucuuggcaaauaucugucuacuacaccuuuuccaucacagcaucguacagaaauagaauuguuuccuuauucuggugauaaaauauuaguagagggaauuuccacaguuauuuauccuucucuacaaacagaaaugacacauagaagagaaagaacagaaacacuaauaccagagaugagaacagauacuuauacagaugaaauacaagaagagaucacuaaaaguccauuuaugggaaaaacagaagaagaagucuucucugggaugaaacucucuacaucucucucagagccaauucauguuacagagucuucuguggaaaugaccaagucuuuugauuucccaacauugauaacaaaguuaagugcagagccaacagaaguaagagauauggaggaagacuuuacagcaacuccagguacuacaaaauaugaugaaaauauuacaacagugcuuuuggcccaugguacuuuaaguguugaagcagccacuguaucaaaauggucaugggaugaagauaauacaacauccaagccuuuagagucuacagaaccuucagccucuucaaaauugcccccugccuuacucacaacuguggggaugaauggaaaggauaaagacaucccaaguuucacugaagauggagcagaugaauuuacucuuauuccagauaguacucaaaagcaguuagaggagguuacugaugaagacauagcagcccauggaaaauucacaauuagauuucagccaacuacaucaacugguauugcagaaaagucaacuuugagagauucuacaacugaagaaaaaguuccaccuaucacaagcacugaaggccaaguuuaugcaaccauggaaggaagugcuuugggugaaguagaagauguggaccucucuaagccaguaucuacuguuccccaauuugcacacacuucagagguggaaggauuagcauuuguuaguuauaguagcacccaagagccuacuacuuauguagacucuucccauaccauuccucuuucuguaauucccaagacagacuggggaguguuaguaccuucuguuccaucagaagaugaaguucuaggugaacccucucaagacauacuugucauugaucagacucgccuugaagcgacuauuucuccagaaacuaugagaacaacaaaaaucacagagggaacaacucaggaagaauucccuuggaaagaacagacugcagagaaaccaguuccugcucucaguucuacagcuuggacucccaaggaggcaguaacaccacuggaugaacaagagggcgauggaucagcauauacagucucugaagaugaauuguugacagguucugagagggucccaguuuuagaaacaacuccaguuggaaaaauugaucacagugugucuuauccaccaggugcuguaacugagcacaaagugaaaacagaugaagugguaacacuaacaccacgcauugggccaaaaguaucuuuaaguccagggccugaacaaaaauaugaaacagaagguaguaguacaacaggauuuacaucaucuuugaguccuuuuaguacccacauuacccagcuuauggaagaaaccacuacugagaaaacaucccuagaggauauugauuuaggcucaggauuauuugaaaagcccaaagccacagaacucauagaauuuucaacaaucaaagucacaguuccaagugauauuaccacugccuucaguucaguagacagacuucacacaacuucagcauucaagccaucuuccgcgaucacuaagaaaccaccucucaucgacagggaaccuggugaagaaacaaccagugacaugguaaucauuggagaaucaacaucucauguuccucccacuacccuugaagauauuguagccaaggaaacagaaaccgauauugauagagaguauuucacgacuucaaguccuccugcuacacagccaacaagaccacccacuguggaagacaaagaggccuuuggaccucaggcgcuuucuacgccacagcccccagcaagcacaaaauuucacccugacauuaauguuuauauuauugaggucagagaaaauaagacagguaagucuuugcuuucuagacuagcauugaaggcaauccucauuuuaucuugaaaguuacuuuuggggaaaaaaagucaacauaccaaaugcugcuauuagaagauaacuggagugugaaaaauaaauguuuuagcuucauauauuuguacaagaauuggaagaauauguuaaacaauguggaagaauguuagauacaauuuuauguuaaaagucauaagaagcccugcuuugucaucuaauauaaccaaaucaucacuguuacaucacuucaaaacaugcagaacaaaguguuuuaauuucagugucuuuucauacauuacuacucaaguguagcacuagacuguguuaacauuccauuggucuuuaacuauuaaccuucaguacuuacaauguggacggcuaaaaucguuuugcauaucccuaagguugacagaaagauauuuaaagguuugcuuugguuuuucucuuccaggauuuuacagguuuauuauaugacuugugugguggguaauaggucucuaauguaaguguuauuuuaauguaaaugcaacauauucuuaugcuauuguuuugggguauuuuacugugguuuuaucuauuuagagcaaguacaaccuagcuuaguuguagggaguauuacaguuuauuguauuaaauauaauuucagaagguggcuauauauucauuauccuugcuuccuaaaaaccaggcuguaguguuguucauuuuaugauuuaauuguuuuaccgcuaggaauauuugugaugccuucuauuccacucaaauauuuuagcucucugacagaacucuuaaaagcuguuuguuuacauugauuaauacuuggaguugucaugaucaaauacgauuuauugcugucuaaaggugagcccacaccaucuuuuacauuugauaagcugaguugagaauauauagcaaaugcaguucaauaaaucaauucagguuugucucuuucuaguuuagaaauuacgaucauggauuuuaguuaauuugcuauauuuucauuuucauauaagaauuaaaugaaugaguauucguuguuuucuugaccuggcucugagaagacaggauagaagauuuuuuuuuuuuuuuuuaagcaggguucucucuuacuguuggaauauucccuuucgaguaucauuuuucugaagacugaugcuauccucauuagagugcucaggagugcaccuauuggaaacaaacaaguagcguuauugucaaguauguuugcauguagugcuguugguggacacuucauggcuucuauagguuucuacucuccagaauuuucugugugaaagcuuuugcuugucagugaauaguagagaagagaacacacccacagaguauuaaaauuaaccuccacuucccaaugcaguuuaaaaaggacaggauuugaucaugauuuucuugcuaaugauauuguuucuuggaaaucauaacauauuuccucuuuucuacauccuuuuccaucucucggaacugguguaggaaaaagaaaaugaauugccaguaagucggaaugaggauugcguuaggcuggaaaagagacaggaauauaacggugaaagaaaaacaaaaaagagguaaaaggaagcaaaaaguaaaugacuaccaacacuuaguuucauaauuuaaaaaaaugcuugaauggauaugcagauuguuuuucaauugauacuacucuguuaguguagcuaauaaguugaguugaauaauauaaaacccaguaaaaauguucugcauuuaaaaacucuuccaagugggaaacugccaguuaggaagucaaauuacaaaauggaaaaagugaaacuugaucucucugaaagaauuggcagucaucaaaaaaaaagaacuaaguuauaaaugguugcuggaaguggagggucugaguaagcuaaaccugaaacaauuuauacaaagguguacauuuauaagugaguuguggacuugauucagcuagaccugggagacguauauagguguuucuucuccuucugcuucuaaaaugugagacuauaauccaccuugaaauuaauuuuguuuugcauaauaauauuaggucagaaaaccgugcaauacuugguuacuuccaucaggcagaauucuaaugugagaguguguauauguguguacaacaaggggauguaucuguggaauaauuauguaucuaccuaccuaccuaccuuccuaccuaccuaccugcguaccuaccuaccuaccuaccuaccuaccuaccuaccuaccuaccuaccugucaucaucuguauuuuuguguguucuguauaugcuguucuccuuaacuaaaagcauuguuuauugucuucauaagacaaugaaguuuacucaccucuaacugcucaccuauacuaauauuauuuauuuucuaugagaaauuuuauccuccaacauuuugagcuuuggcaagggaaaauccuaaagcagauguucaauuaaugaauuucaaggcagguguauaccuuaauaaggaaaagugcauaugugccuggagaaccaaccuuuuuauguaucaaggcacaauuuuccagacuggaaaguccuuggugcaugugugaacuuguauaaaucuauucacaggaauagaauacaccuuuauauauacuguauauccaaguaagcaaaaauaccacccaugcuauucuaaaccaaggcauucaauaauuuuuugcugcacucagcgagucauauaaaucuuguuuuuuuuuuuuuuuuuacuacuaugaaacaaaacaugcuacucaggacacacuuauguuauacuugcucaaauggaucuuaauagcaacuuacggugcucuagcuagagggcaacuguaguuagcaguuaaaaaaaucugaaagaacuuuucagcucauaaaaguuuuaugagcugaaaaaugcuaugggguguguuuaacagugguucaggggauacugaaaacuuuacuccugucuauuucaggaguaauuugcacaccugcauuuugaaaaauuauugaaaggcuuucuuugugaacaugcaugaaggccagaauuugaagcuguaggaagaguuucuucaacuccagauuuuuuuuaaaagagcacuccucuaaaucaccugaaauguuacaagguaguggaacagaacugugaauguuuuuaaaaacugacaaacagguauuuuuaaaucaaagaauaauuuagaaauguauggauauuaaauaccaacauuauuaugcaaaugcucuuaguuauaaccuuaaaauaggcagcuuauuaccuuuuuuaacaaacaaauucauauauacuacuuauuaugugucaggccugcuugaugcugucuuguuagguguucuuuuuccuacugguuuuguaauuuguaucuacccaaauguaugugugcaggugaaaagcaauauuaaauuaaaugauagaaagauuaagauguugguaaaauuauuaauguaaugcuauuaaagauuaauuacauuuugagaaauauacaaaaagcuaaaggcuuauugucuaaauaugguguuauggagaggauaaagaacaaggaacauuggcucugagggcaggagccaucugggcagauacccauauuuacaucauugauugcagagucaucacuuuuuuuuuuuugcgacggagucuugcucuguugcccaggcuggaguacaguggagugaucucggcucacugcaaucucugccuccuggguucaagcgauucuccugccucagccucccgaguagcugggauuacaggcgccugccaccaugccuggcgaauuuuuguauuuuuaguagagacaggguuucaccaucuuggccaggcugggcuugaacuccugaccucaugauccaccugccacggccucccaaaguguugggauuacaggcaugagccacugcgcccagccaagucaucacuuuuuaaaagguaauguuuauuuaagauaaucucauauaauuuuuuaaaaucacacauuuucuguucuuacagaauuuuaaagaacauuuuaauuauagaaaaauuacuuucugauuuguuauuauaagauccagguccuuucuucaaacaaaauguuauugagagccccuguaucuugaacagacaaaagaguagcuguguugguuaauguuugagggggacaucgagaaccucacucccuugggaccuccucaucuccuguggugguuuuuaaaauaacauguaccucacaacacagcuagaaaaagaaugauaucuagaccauucaaaauaaagcaaaaacaguuacucauuccugagagaauuaaguucuuaaaaguaaaaauguuucaaaaauuggucugauuaucuauaucuuuaucucauuacaaugauacacauuuaacauuuaccuuugaauagcacuaugcauggugcugaauaaaacacauuaaacaaauauuguuucaaucuuauugaugccuaugugucaucaagauaauauauaaugguaugucagagucucacauguaugugcaaaacuaagucaucaucaaacucacacuucgggcuucauacuuucagaccacuuuuucuauauauuaucauguuuaaacuucaaagauaauuugugagacaacuagggaaagcagauagucaaacgaagguacacugagucugacauucuuggcauugggucuagcagcccuggcccucuuuggagcauuuuugccaugaagugauucucucuccugaugagcucugagaaaacaacaacccccugcccaauggcuuagguacugcccugucugucaauuccugaaagagcaaacucugggaagacugguuucucauuggcauucuagugguuuguuaagaguauauaauuuagauuugguugcugcuaauauggggcaguaugcaugcucuucagauaccugacauagcaaggaaagagugugcugaaauugguaguacguuauucugcaguucugggcagcuucuuuccuguagaguuuuggagcacaucucugaaaguggaugggucuggugccugcacaccuccgugguuccuuuuccugagcuccagcuguggcugucugucagagaagcacauuuuucugcagauaauuagaauggcuucccccaucucucacggacugucccaagucuagaaaagaauugaguuccucuucuauuagucaaauaaaagggaagagaauguuugucuuccuuuccuuucuguaguguuaagaaaauaaacgaacuuaaugauucuaaauuaucagugagcuuaacacuguacuauagaccaaagauuaccuuuucaaaaaguccuuugaggugaaauauuuuguauacguaauacauagaugcacauauaaacacacacauauagaaucucaauauuuuaacacuucuuuggguaguuguacuaacucacuaacccugaggaaaaaguuaagaaauugaaaguguuuucuucaaaaguugagauuuaacaauaaaagguguuacuuugauaacuaaaaggaacuuuauuauccucuuccuaaaauaaaccaaugccuauucugaaaauggcacuugcaauuacaauuugccauuaucaaagcuaccacugagguagaggcauuaucuaaaacaaauaccacuuaucauuuauuggcaguuaccucgagagagacccauacaccaucuucuagcagagcacagucaaucaaauuaccuucggguaaagcuauagcaugucuagucguuugacagauauuaaagguggucauaaaagaaacauaaaccauaggcugugcuccaaaggcauauuggccagcuaacauuaacacaaucaaauacaguugucauacuaaacauauaguuacacaguagguguauggugugacagauugugaaugguaggugaggucagaaaaagaaggaaucaagaaaggcaggaaguuacagaauauuucaugagaaagaggagacuuacgucagucucuguuggagggauagauuacaauccaauuaugagaggccaguuauuagccaauugcuucccaacuuaggcucaccagugggguuaaggagccccaaguauaaacagcuguuuuucuaaauagaguuucuaaacagcuucugaaggaggccaugucaucccagugcuguuugacauggccugcuucagaagcugaauaccuucuuaggccucacgcagaaacuaguacaguucaugaaaacccgagauacucugccagcuucuugaggaagcaguguugucacacuuuucugagcuucagugauucacacauuuugauaagacagcauguucuguggguuaaguacauuuaccuuuucaaaauauacucccaugaaguaucaugguucagaauuacacacuuacaaaguuaaauggcauaaaacuacuuuguaaaaagugccuacacucuaaaaggugauuuaaagguuuaugacaucuuaauucaagugaauacugaaucaguaggauuauagagcaggugcucuaaguuagggaaucuggagucagucucuccuuugcuuaugugcaauguggacccagggauuucucaauuucucugucagaauuuuuaacaugguaaaauggcuauuauuauauggaaugauauuuccuaagcucugacacauacucuuucuccaaaucacaggguuuaugaaacaaagauacacacacacacacacacacacacacacacacacacauauauguauacacacauauauacagguaauauacagauauauuuuuucuaauuuauucaacagucaaauaauuacaauauacuaacuacauuagaacuggauuuuuuugaaguacauucugguuaauauucugaaccaacauggagauguaguuaguuugcuuuguaggauacauggaagaggcaguuauugugauagaaagagccuuuggaaagagaccuggguucacugucaacauuguuacaggaggcacucuguauccacaauucugcauccucugauuugaccaaacauggauaaagaauauuugaaaaaaaaaaaaaaagcaccacaauaaaaaagaacaauacagcaauaaaaaauaacacaaauaaaaacccaacacacuauaauaacuauauagcauuuacauuguauuaguuauuauaaguaauuuaaaugauuacuuauaauaccugauuuaaaguauauguauaugaauguaugcguaggauuccugcaaauacuaugccauucuauaaaaaaggacuugaguaccauggauuuuuguauccuccuagaaccaaucccccauggcuacugagggauaacuauauuuacagucuguuuggucuuguauaaauuacuuaaccuccacaggccucaguuguuauauaauuaaaaauuuauaauaauacuacaaccucaccacauugguuaaagaaggggaucuuugagugauugccacaugcaagucacugugacaggcauuucacauauuuaauacuccuucagugacuagaaagcaccaagcacaaugccugauacauaguaaugacuuaguacaaauuaaucuccugugggcuuuaaaaauuauuucauuuccaacuucuaaguacaggaaaauauagacuguuuuguucuaaauagguaaaagccaaaugaucuuaaaauucaagaucauuuaugccacaagaagccaaguauaauuguacuuuagugucugcuuaacugaaauaacuucuuaaaaauccgaacccgacauagguuguguuuuuuuggguggugccauuuugggugcaaaucagaagcagcugcagcccuuacuuaaaauuuaaauauaguauuggcucuauaggaccuaagaguagaauuuauuagcuuuuugcuuuuccucaguugugaaaguugggcuuaugauuuugauaacuaccaauuuaauuuuuuucucauaaacaucauuuuacaaauucuugauacauuuccccagguauugagccuagcuucuugcauauuuauagaaugaauggacauucccugcugucuuuuuguuguugucaaggaaacccccaguucucuacacagggauuacauucuucuuucuuaauagcucuuagaucguucauuugugcaaugaauaaaaaauguacucacagguccagacaguguucagaacuuuuuuggugggugaggggcguagcuaaggggagagacaugccuagugagaggagcaauaggaauaaaagaaaaggagaaagaaaugcuggcugagguuccauuuuaaugagguaaagcugaaaaauuuaugcuuuaaaaaagacauugccuauuuuugucacuuuagaaaauguauaacauuacuuuucauugaggucaguguuucauguacaaaaauguuaguuuuuaaguggcuuuguuaagcgaauagcuccaagaauggggcccagguuggugagggugggauggaugagggaguggugaugcguuuuaguagaaacuauuuuuucauuucuauagaaguauuugaacuuuuuuuacaaccuaauugaggugauacaaaauauaagaauauuccuucauccuggggcaucauguggucaucugagagcucauuugauuacauuaaaaaucguguuccuuagagagagagugccaguauuuagacuuuuugagugugaaucaggagggaaacacacauccauugacaagaagauggauauaauuauuuuuaaaaagagugauuugauccuuuggaggaaaauaaauucugguggaccuucuaaguaacugcuagaaugauuggguaauguauacagcuuuugcuucuccauaaauaauguaaguauuaaaaaggagauuuuaaacuagaaggaaggaaucucuggagugagaggaaaaguuuaauuguauuucaguaucuaugucuaugaaaaguugauauacggugucacugugguauacccaaacuuguuuauacacauguauaaccaguacacaguaaguaccaugaguggcuuuuagugauuuuaucuuuuuaccuuguaguacagucucccuggugucucacaaggcuaguuuacuuacuuuggccauaugcuucacauaguagguuucuggagguuuuguuuuuucuaagaugagagagugaaaagguaauguauauuucuggagaguauauuggaauauaguauaaucaucauuuucacuaugcugcacuucgggacggcugucuauuguauuuuuuaaauaggaaaacaaaaucuuuuuguuacacauuaaaauaaaauccauuuuaaaaaagaaaugugauccuaauauaucucugcugaguagauugguguacauuuacguuuaauuaaaagcucuuaaacuuaaauuguaaaauuccccaaagagaacgugaacuuuaaccagcugccuaugcaucuuagcaacuauguuuugugucugguaacaguaugacuggaagacuugugcucugucuacaaaacuuuguuaugaaguacuuaaaaauacuugugaauaauuugaggucagcuagcaauaaagcuuugugugaaaugucauuaaaaaaagccuauuaaccaugguacuguuauauucaagucaagcuguuaaaauacauucauauaaacauagaaaagauuaugcauacacccuguagaguucugugguuugauucuugaaauccaaacaaaaguuauauugccuuuugaguaaaauucuagaauagagcagucuuuuauaagacuaagagcuucaucuaagagcuugaaaugucaauuacaccauuggguugcucuguuccuaugaaauagagcacaucuccauuucggaaugagauaccuccucucacaguagcacagguguaccccccaacccccuuacuauacaccgcaaagaaacuuuucugguuugcaauaaucucuguugagauucucuaauaacgugugugguggguggagguggugacaggaaauggggaugaagagguaauuucagaggaagaauaaacuaagagggggcaaguaggauuuggugagaugcaaggaguuagugacaaauauuugggugauagggcagggaaaaauuuaucugcauauauuaauaguagauagguuuuauaccccaccucucccugcuaugagauguuaaaaguaugggaagaaauuauacugacagaauaaaauuuagauuguauguauaggaaaugucagcagaaaauuuuaacuugaaagcccuggguaauuaacauuucucucuccuucaaacugauauuaagaaauccagccaggugcagcgguacacacuguaaucccagcacuuugggaggcugaggcaggaggauugcucaaacucaagaguuugaggcugccuguaaugguaccccugcacucuagccuggguaacagaucaacaaccugucuaaaaaaaaauucaauaaaaccauuugcaaguugucgcgaacuuauuuaaagaauaauaauaguugcuuaauugugagacuauuacuuucagaaaaaggaaacaaaauaauuucaacucccauuuugcauauuuuuugaaauuaaagaauucccauuuaguagacaauuuuuuuucuggggaucuaauauacaaaauuaagacuguaguuaauaaaauugcauuguauuagagauuuuguuaaaaaaguaaauuucaguugcucuucucacaaaaagaugguauauauguuaaucugcuuccuuuuaccaucuauaugcaucccauaacaucauauuguaaaccucaaauacacaauagaguuuauuuuagaaaaagaaaauuucuaucauacuuauuaaaugagcauauuauuuuauuuauauguagauuuucuucucaauuacuuaauuuauuuugaugugcugccagcuucaugaugagaaacauaagaugaaacugcauaauacauuucuguuuucuaucauuuugaaggcaagucagaucaaauaguugcgagguggguggagaaaggaauccuaaucuaaauuuaaugauuaguacauuugcaauaaguacauuccaaaaguuucccauuaaaauaggagaaaagaguuuaguaaggccaguucucuaacuuacuggcaggaacauuuguuucagagagagagagaggaagggggcaaggagagacuuggaaaguauaguuaggucucucugaaguugacaagagaguguuugcccuagggucugauacauaacagguacucaguaaauuuugagaaaucaaugagcaucugaagagauauuacauucugggcagcaugcaugguuguggugguagugaauuuaauuuugugugcaaaaaccgauaugaagcaaugcuguguuugugaaauguaugcaaagauucugucucugaaaugcuuauacugcugugauugaaacauuaucauauuuauuuagguuagaaaauggaauuuacuacaucugaguugguuuuuggugagaaauucugauaugauagucuaaaauggcaaggaaguccuuauagaucuaugagcaauuggaaguguuagaguucuugaucugagagaaauaugaccuaaaagaauauuauacuuuguuaauuggagcuaaaaucagaaacuauaaagugaaugccauggucuuuaguagaauuaaguauucuuaauaugaguugauaguuagcuaaauuauuauacaguacugauuuacaauuagaguucuucuuuauuuucuuucccagaggaaaacaaaaaauuucagugagcauuaugaccauccaucaguuucuuaccauauugacaugugacauguuggcauaccuuugugucuucuuucucugcuuuucuccaccccacuuuuuuuagagccaccaacauacuugacagaacuuccaucuguaauuacucaauaagaagaucaugagauauguuuguaucagucuuauuuuuuugaaguaaagaauuuacuuagaaauucaaguaaaucuauaauagcaaugaguguucuuacccuauucuuggccuaggaguuuguaaauauacaauauuaaucagauauuuccuuauuuauccuuguguuuugcuggagaaacccagcugaauggcucguuuuaacuucauuauuuacaaaaggguacaaaauaugguagagguucuuuauaugcuugacacugacccauguuucuuauuuaaaaucuuuucucuguacuuaaaugaaaguuuuggugucaccaaacaggguaaguaagaauuuaguguaccuuugucuaauauuucuuaaucaugaauucuaguuuuauuuaaguuaaugaagcaaaauaaaagaguugcuugcauguaaaaugguagugugagcaguuuaagauaugcacauuuuuaaacuccaguuaaaucccaugaaguuguacugaauaguuuaacugagucuggcuuaauucaacuauauucaaauaguuuuagcaaugagagacuccuggcuuggauaaaauuauugaugugaauauuucaagagauucuuuuguacagaaggcauuuuaaaugcuucugcucauauaguuuaaacauuuucuucacauucuguuuucauagcacaaaguuuaccuucaaugcaaacugaauuaagaggauguuaucaucugaauauuuuaugguguccuauuuuaaaacauauacaccauggguacuauauauaagauccgaguaacaacuuuagugaccuaauauugaagaaaccuagucuuuuuaguuaccuauauuuuuaaaugacaaggcauuuaaucauuuuccugcacugagcaauuaguaacaauugcaacaucugugucagaaauaaucuguauucauuuuauguuuuuauaacacacuagaguuauguauuuaucucgcuucucuuugugguagaaauauuuucucauuuauuugaauacccauaugcuguaguuuaaguaguugaaaagcugaauauacagaauggaauggaauggagagagaagaaaugaacuguaguguguaaaauuucaauaggaaggguguuuaguuaggauaagaauaacccaguccuacacagaaguauuuuagugaaauaauuuagugaagauguggugggauacaaaagagaguuuucuuucuuguuucuauuagaauaaaagggauaaauguauaugucuuugcauuacauaaaagucuuauugucuggguuuuuuaauuuaaaaaaaauucaaggagcuucuguggaauuugucuugguaguuccuacacuucuauauuugucuugauucauaaaauagauuagaauauaagcaacacugauuccucuucaauaggguuuuuucuucucugaugaaacagcaaaagcuagauauuguuucuucuauacauagaaggaaauagcuucuugcaacaggaacaauucaggagaaaacaguuguuuucuccccuuuagaugauagguugggaagcaggguuggcuccgucauaaugauuucuccuaaacacuucucagguuuggccuaugcauguguguuauagauuggggauaguuugaaaacucauucuguaguauuauuccuaugggcaggguggugaguaguguguaaauucuuugucuucuuuaugggucaguauauccacaggcacauuuucauacugcuuugucacugaaaguaaggcagcugcaguggcaggacccuguucuaggacaguugaaugccucuaugaugagaccucagaauuuccucuuuccuagugcccaagacaaggagcuuugcugauguauuucugauagcagaaaaggccauugagcuuagugguugguaccauauggcaauuuacaaucugggaaauauucugaugauacauacuuuucgaggaaugcuaguuagaauauuuagauaggacuccugaacuuucuuugagaagauguugaugacaagaacuaaaaucagccuaaucugggucacaucccaggaaggauaaaggucuauagguguggaaggcucuuucugguccuuucagugagcuauuuccaauagagcccgccuauccagagcuucccacucuugugcauaggaugugguuaagcucaugucucagugccacaguagguagaggaugccauugcaauguaaaagggcuauaaauaaagcucucuuguuuuuccauaaaacagucugcucuagaacagauuauaaaggggccagaaggaaucucuucucauuuucuuauugaauagagaguguauaaauuauucccuuacauaaaggacaauuacuuuuucuauauagaucauauauagaaauagagcuauagaaaaaguaauuaauucuauaugauauggccucaauuuuuaauuuuuaaauuguuuuuauaugaaauagucuuaauuuuacucuuuuugcaguucacacaaagaugaauuccugcacuucaagauuacauuguauaugugauuccuugcuucauuuuaaggacuauguuguuuucuuaaauguguugaugagucuuuauaaccuguuuuaauaauguuaaauugaauucauuuuucuuauuguuaauacaaaaacaguaaauuugaagacugagaaccauauaagagggugauugcacuuauuaugaaaagauuugaauccuucuuugugugugugggugugaccagccuugcuaucaauuucuucugucauacacugccaaauuuucuauuuaaguauugugaaaacucuguuuuuuucaggucgaaugagugauuugaguguaauuggucauccaauagauucagaaucuaaagaagaugaaccuuguagugaagaaacagauccagugcaugaucuaauggcugaaauuuuaccugaauucccugacauaauugaaauagaccuauaccacagugaagaaaaugaagaagaagaagaagagugugcaaaugcuacugaugugacaaccaccccaucugugcaguacauaaaugggaagcaucucguuaccacugugcccaaggacccagaagcugcagaagcuaggcguggccaguuugaaaguguugcaccuucucagaauuucucggacagcucugaaagugauacucauccauuuguaauagccaaaacggaauugucuacugcugugcaaccuaaugaaucuacagaaacaacugagucucuugaaguuacauggaagccugagacuuacccugaaacaucagaacauuuuucagguggugagccugauguuuuccccacagucccauuccaugaggaauuugaaaguggaacagccaaaaaaggggcagaaucagucacagagagagauacugaaguuggucaucaggcacaugaacauacugaaccuguaucucuguuuccugaagagucuucaggagagauugccauugaccaagaaucucagaaaauagccuuugcaagggcuacagaaguaacauuuggugaagagguagaaaaaaguacuucugucacauacacucccacuauaguuccaaguucugcaucagcauauguuucagaggaagaagcaguuacccuaauaggaaauccuuggccagaugaccuguugucuaccaaagaaagcuggguagaagcaacuccuagacaaguuguagagcucucagggaguucuucgauuccaauuacagaaggcucuggagaagcagaagaagaugaagauacaauguucaccaugguaacugauuuaucacagagaaauacuacugauacacucauuacuuuagacacuagcaggauaaucacagaaagcuuuuuugagguuccugcaaccaccauuuauccaguuucugaacaaccuucugcaaaaguggugccuaccaaguuuguaagugaaacagacacuucugaguggauuuccaguaccacuguugaggaaaagaaaaggaaggaggaggagggaacuacagguacggcuucuacauuugagguauauucaucuacacagagaucggaucaauuaauuuuacccuuugaauuagaaaguccaaauguagcuacaucuagugauucagguaccaggaaaaguuuuauguccuugacaacaccaacacagucugaaagggaaaugacagauucuacuccugucuuuacagaaacaaauacauuagaaaauuugggggcacagaccacugagcacagcaguauccaucaaccugggguucaggaagggcugaccacucucccacguaguccugccucugucuuuauggagcagggcucuggagaagcugcugccgacccagaaaccaccacuguuucuucauuuucauuaaacguagaguaugcaauucaagccgaaaaggaaguagcuggcacuuugucuccgcauguggaaacuacauucuccacugagccaacaggacugguuuugaguacaguaauggacagaguaguugcugaaaauauaacccaaacauccagggaaauagugauuucagagcgauuaggagaaccaaauuauggggcagaaauaaggggcuuuuccacagguuuuccuuuggaggaagauuucaguggugacuuuagagaauacucaacagugucucaucccauagcaaaagaagaaacgguaaugauggaaggcucuggagaugcagcauuuagggacacccagacuucaccaucuacaguaccuacuucaguucacaucagucacauaucugacucagaaggacccaguagcaccauggucagcacuucagccuuccccugggaagaguuuacauccucagcugagggcucaggugagcaacuggucacagucagcagcucuguuguuccagugcuucccagugcugugcaaaaguuuucugguacagcuuccuccauuaucgacgaaggauugggagaaguggguacugucaaugaaauugauagaagauccaccauuuuaccaacagcagaaguggaagguacgaaagcuccaguagagaaggaggaaguaaaggucaguggcacaguuucaacaaacuuuccccaaacuauagagccagccaaauuauggucuaggcaagaagucaacccuguaagacaagaaauugaaagugaaacaacaucagaggaacaaauucaagaagaaaagucauuugaauccccucaaaacucuccugcaacagaacaaacaaucuuugauucacagacauuuacugaaacugaacucaaaaccacagauuauucuguacuaacaacaaagaaaacuuacagugaugauaaagaaaugaaggaggaagacacuucuuuaguuaacaugucuacuccagauccagaugcaaauggcuuggaaucuuacacaacucucccugaagcuacugaaaagucacauuuuuucuuagcuacugcauuaguaacugaaucuauaccagcugaacauguagucacagauucaccaaucaaaaaggaagaaaguacaaaacauuuuccgaaaggcaugagaccaacaauucaagagucagauacugagcucuuauucucuggacugggaucaggagaagaaguuuuaccuacucuaccaacagagucagugaauuuuacugaaguggaacaaaucaauaacacauuauauccccacacuucucaaguggaaaguaccucaagugacaaaauugaagacuuuaacagaauggaaaauguggcaaaagaaguuggaccacucguaucucaaacagacaucuuugaagguagugggucaguaaccagcacaacauuaauagaaauuuuaagugacacuggagcagaaggacccacgguggcaccucucccuuucuccacggacaucggacauccucaaaaucagacugucaggugggcagaagaaauccagacuaguagaccacaaaccauaacugaacaagacucuaacaagaauucuucaacagcagaaauuaacgaaacaacaaccucaucuacugauuuucuggcuagagcuuaugguuuugaaauggccaaagaauuuguuacaucagcaccaaaaccaucugacuuguauuaugaaccuucuggagaaggaucuggagaaguggauauuguugauucauuucacacuucugcaacuacucaggcaaccagacaagaaagcagcaccacauuuguuucugaugggucccuggaaaaacauccugaggugccaagcgcuaaagcuguuacugcugauggauucccaacaguuucagugaugcugccucuucauucagagcagaacaaaagcuccccugauccaacuagcacacugucaaauacagugucauaugagagguccacagacgguaguuuccaagaccguuucagggaauucgaggauuccaccuuaaaaccuaacagaaaaaaacccacugaaaauauuaucauagaccuggacaaagaggacaaggauuuaauauugacaauuacagagaguaccauccuugaaauucuaccugagcugacaucggauaaaaauacuaucauagauauugaucauacuaaaccuguguaugaagacauucuuggaaugcaaacagauauagauacagagguaccaucagaaccacaugacaguaaugaugaaaguaaugaugacagcacucaaguucaagagaucuaugaggcagcugucaaccuuucuuuaacugaggaaacauuugagggcucugcugauguucuggcuagcuacacucaggcaacacaugaugaaucaaugacuuaugaagauagaagccaacuagaucacaugggcuuucacuucacaacugggaucccugcuccuagcacagaaacagaauuagacguuuuacuucccacggcaacaucccugccaauuccucguaagucugccacaguuauuccagagauugaaggaauaaaagcugaagcaaaagcccuggaugacauguuugaaucaagcacuuugucugauggucaagcuauugcagaccaaagugaaauaauaccaacauugggccaauuugaaaggacucaggaggaguaugaagacaaaaaacaugcugguccuucuuuucagccagaauucucuucaggagcugaggaggcauuaguagaccauacucccuaucuaaguauugcuacuacccaccuuauggaucagaguguaacagaggugccugaugugauggaaggauccaaucccccauauuacacugauacaacauuagcaguuucaacauuugcgaaguugucuucucagacaccaucaucuccccucacuaucuacucaggcagugaagccucuggacacacagagaucccccagcccagugcucugccaggaauagacgucggcucaucuguaauguccccacaggauucuuuuaaggaaauucauguaaauauugaagcgacuuucaaaccaucaagugaggaauaccuucacauaacugagccucccucuuuaucuccugacacaaaauuagaaccuucagaagaugaugguaaaccugaguuauuagaagaaauggaagcuucucccacagaacuuauugcuguggaaggaacugagauucuccaagauuuccaaaacaaaaccgauggucaaguuucuggagaagcaaucaagauguuucccaccauuaaaacaccugaggcuggaacuguuauuacaacugccgaugaaauugaauuagaaggugcuacacaguggccacacucuacuucugcuucugccaccuauggggucgaggcagguguggugccuuggcuaaguccacagacuucugagaggcccacgcuuucuucuucuccagaaauaaacccugaaacucaagcagcuuuaaucagagggcaggauuccacgauagcagcaucagaacagcaaguggcagcgagaauucuugauuccaaugaucaggcaacaguaaacccuguggaauuuaauacugagguugcaacaccaccauuuucccuucuggagacuucuaaugaaacagauuuccugauuggcauuaaugaagagucaguggaaggcacggcaaucuauuuaccagguaagaucacaacauugauaaaucuguuuccaaaccuggaaacagucccuuggugcuaacguuuauauguauguaauuuuuauugugauguuaaaucaauggagaguuucauauuauucacauaacagcaggccaggccacaguauugaguucauaaugagaugaaaugacaguaaguauagauuaguuuuggacuuuagaaguagacuuuguauuuuucuggguuuuagaaauaauauacaauuacaacauggaaaagaugaaauuauuaauguuauaaaaauucaauuuguuuuuacucacaacuagaguauugcuuugucauaugucucauaguuauacauguuagguuuaaaaguagaaaaaaaguccuauuuuuaaaaacccucccauugauggaugcuauugcuguaguaucaaaaucugucaggccuuuaacauuugggaguaguacguagcucuaauaauuauuucagaguuugugcaguaucaauaucagcucauacuuauaugcaauguccuuguuuaagacagucuacauaaugcaucaaacacagugccuaccaguagugaguagucauuuauuauauaaacauacugccuguugagagaaguuuucuguguauuuacugaauguauggaaagcaugaauuugauacugauucauauaagccaucucuucugauugccacgaaaaggcuauaaaagcccugugugaaaggguaagaggugaagguucagagagguucagcaacuugcccaagguggcacagccacauugugguaaaaguaggauuugaacccagcuuagcuccacucuaaaguccauagucuuuucacugcucuuugcugguuucaguauaguauaaaaauaaacaauugauauugaauaauauaugaaccaggaaucuuggaauauuuacuuuguagaauuuauuuuccucuuaaucuagccugagaauguuaagaaaucagcucuaaugguguuuucccauaauguuauuauuuaaauuaacaaugucaguggaauccacaaauagacaucaccaccuagcugcuaccugcaaaaagaggaagaaaaaucaguacuuuaaugucugucuugguugagaauauauguuuuauuuuaauauguuuuaugccaugacuaucguuaaaauuauucuucugaucauaucaauauuaccuuuugugccaccaaugcuuuauuuugaugugcuucagaaagaguaaaauagaaaguacaauuuuuaauaaauggcuugaaauauuuugaggaaaauugaucaaagguaguugacauuggguuuuuuguuaucacuguguguuaaaucuguaaaugauaaucuaguaauuuggcuaauauuuauuguuuuuuaauuuaguuuaauauacuucaguuuguuaaaaauaugauguaaaaauaacugguaauaacuagguacauauagaguuaaguuugaugaaugagaaauauguaccaauuuuccaguuuacaauauuuaccaagauuuauaguuugcgucuucauugcaaaacaaauggucacuuuagcuuaauucaguaaacagcagcucauaugggauuaccuggucuaucuguugcagauucaacuuucagagguuaauacgaacuguuuaggggagaauaacauucauaaaaacugaaguuuccuguuaauuggaacgacuuccaguucacaggaagacucacucacucaguccuuguuucauggucucagcauggugucuagugucagugguaggaauaguaauaguacuucuucacauuuguguggcacaucacagucugauaaagcacuuucaccuagugucauuuggauucagcacagagggcagcauguggcuauggcguguguuaacugcagccuugucauccuggcagcgagcguacuuguacuuuaaaauucagaaagcuaaaauuguuagggagauuucaaauaguuuuggaacuauaggaaaaagugucuuagaaaacucgggggaguuuuuggagaaguugauguacucaucugaauuaaccuaauuuuaacgugaaucccaaacaugggaauguguaccuauccagguuuauagucauucagaauuuacuuaacacucagaaaguuugaguuugacuuucugguguggggaagucucaguuaucuuuuauagcaguaccuuguuuauccugauauucuuuaagcuaauguuucauaagaaguuagacaucuuucuucuuucauguguaauuauuucaggguuucaggacuuaagauucuugaaaguauggguguauuccauagauaaucuauuuuauuucaauuauuuuguaaaacuuucaacucucauuuggaucuuugaagauuuagaaauguaagcaagucugaaacaauauacaaagaauaaguauaaacucaaugaaaauacacuuauccaagcaauauugcaauauaaaauauaugcuucaagugguguaaaaguguuugcacuuagaaaauauauuuaaacuguuuguccucauaaauuuaugucuucggccuucauauuuaucucccaggagugucgguuuuauuuguauuuuaauaagaaaauuauaauaaaaacuugggguuucauuuuaggugagguuuuuguauuuggguuuguuuuucuacaguagaguuuaauccauguguugcuuuucuucaaguauaguuuaaaggaguacauuuggaacguguuuuuggaaaaagcauguuaauguagcagaagagacuucagugcacacuuucgaagaaaaacaguuucugagcauuaagugguaaaaggcaauaauaauucaaaugaugauaacaagccaaccugcuaaaaagaaugcauguucuguguauccagccauuucacaugaacuaaccccauuuaaaagaauacauuuuccauucacugugcacauauguguaaucauuuuugacuaaaaucaauugccauuaucaugccaacuaaaucugcaguagaauauauuaguugccagauacaguacaaaaaauaucauuuaagaguaaucgugauugaaucccagaaaugaauagaugcaauuuguaacaauuaguuauaaugccaagaaacacuccagagaguaaaguuaauguuaauuuuuauauguaguaacucuaaauugcuaugguaaagccuauaauaugguagcaauauggggcguuuuaugcuaaaauacacgcaaacauuagagacgagccuaacugcuuuucuuacuuuccugaauaugguaggaccugaucgcugcaaaaugaacccgugccuuaacggaggcaccuguuauccuacugaaacuuccuacguaugcaccugugugccaggauacagcggagaccagugugaacuugguaagaugguacuuggcugaaaaggugcaguucuuucacagaagauauauugggggagaauuuauguugucgaaucaaucagagauuucaaagaaacccauaugaagauuaauuauauguuaaaugaaguuaaaaucugaggguaauuaacuaggggcuggaaaauggguacagauauucagugaauucuguuaacguaaccaagacucagugaggccugcugagucuucuuguguuuuuuacagguagaauuuacaaauguaaaaaugcauaaauauuaacaaaaauguacauuuaucccccaaaucugcauauaaauaaaaaucaauuucaguauaaaaaucuuuuuagaaagcuagacuuaaaaauuaggaaaauaauaaaaguuagagagcuuuguccuuaguuuugggauaauuuuucuucucauuuggaaugggaaagacccuucccugacucccagcaaccagcccaacgugccucggccucagggagcugugcaauugcuguucccugccucucuuuugguuccaaggaauauaauugacccucacacucccauauucuuauuuaggcauccuucucuuuaaagaaaaaaaaaaaggcaccaguguugauuuggcuacauauagaccucacuucugagaaaagaaugaugaaauauguuguccagaugucccuuuuagagauaucaugaagguuugcuuaauuugcuuacaaugauugaguaaagaaagcucaccaauagcacuuuaaauuauacaucaauauugcgauacaaucccaacauucauauuaaaagaguacuuaaaaaaagucaacgaggccagcgcggugguucaagccuauaaccccagcacuuugggagggcgaggugggcgaaucgcuugaucccagaaguucgagaccagccugggcaacauggcagaaccucaccucugcaaaaaaaaaaaaaaauuaaccgugccuguagucccagcuacuugggaggcugagguggaaagauugcuuaagcccagaaggucgaggcugcagugagcuguguucacgcuacugcacuccaggcugggugacaaagugucuggcacucagcaagcaccauaaacauguuugguauuauuacuauauaauaucauguuuacuaagaccauuucuuuagguaagaauacauuauaugacuaagaaauuuaacuugcuuuguauauucauuuaaaaauauucuuaaacauuaaauuuuuaguguaauugcaaaaugcuauggaaauaaagucacuaauuucaucaggggagaucauauguagaaagauuagaaucuguguagaaagauuuuauuugacauagauuuuaaaguugggaagauuugacaggugguggagggagauauggacacaacaaacaaaagcacagaggccaaaaacuacagaaggcauuugaaugacagccucgauccagguaugccuacuuagggguuugggagagggagacguauugggagacaguaccagaaggcagguugggucuagaaagcccugacagucuaagaagguccugaguucaggauacugaauaguguuacuucacacucuagucaagugauucugagaccuuagcaugcaucagagggcugguaaaacagauuguugucuccaccucaaaguaugugauucaguagauuugggguggaauuggaauuguggauuuuuaacauucuuaggugaugcugauguuguuugugguccagggagcucacguugaagacugcugcccugggcaauugggauccauggaauguuuggaaguaaaagaauaaaauuaucaugacugugucuaaaaaagaugacauuuagcagagugauggauauauuggagaggaaagggccuagggauggugaggccaguuagauacuuugaguaguccaugugugagguaaucagagaaugagccaugauuggaggugggaaggcuggggcuguugauucuucauucguuuuagggcuuaucugauucauuuaucagcaauggagacaauggcccuacucugaauaccuuugacauuuucuuaggguugccaaauuuaggaaauaacaauucaggauggccacuuauauuugaguuucaaguaaaaacgaaauaacuuuguaguauagguuugcccuaaauauggcacggacauacuuaugcuaacaaauuauacuuuuuuuaaaaucugaaauucaaauuuaacuggcugucuuguauguuaucuugcaaccucacacuaaauggaauucuuugauacuuuuugaaaguauuuugugagcuuuuacuauuuuguuucagauuuugaugaaugucacucuaaucccugucguaauggagccacuuguguugaugguuuuaacacauucaggugccucugccuuccaaguuauguuggugcacuuugugagcaagguaagagcuauugcaacauuuguaugaugaacauuauugauuuuuuuuuagcaauuuuggccucaaugcauaaucuuuccugcaguggaaauucacauuuccuuagguuuccuuauucagggauagcucaaaacaucugaaucauaguguugacuugauuaugguuguuuagcugauagauuggaauugcaggcaggcaaacugagcugaauuuaaagacauccagccaauaaaaggaauauuaucguauguauuuuucuuggggacaaacuaagcacugaccuuacuguggcucauguacgaaggaguacugaauucaauauuagcuguuuuuauuuucuccuccuaagcacuugagacucaauggacuuauuuuucauagucaaucauaucuggagaaugaguugauauaguuguuagaauacauuugcuuuggcacaugcuaaguagaagauauugugaaucugcucaccaggaaauuuuccuacuaaagaaggauugacuuuuucugaaugaaagaaagcccuauguucaugauggcuugaaucucaugaucccuguaauuugcauuuuacggccaaccugaggguguauuuuaggugguuaaugggagcauuucuugguccaucaauaagaaacagauugcaugcuaagcacacucagcuuuggaaugucgauuuccucuacuuaaacucguacagugguuuggcuuugauaaaaguguucagugccaaacuuccauuccaccagacaaacugaaaaugcauuagacacucaggcacauuggucuggucccacauucugcuucaugguguuaaucuggaugucacugcgaugaaugcaaauccaaaaggagcauguauugaauugcuguuccaaguggauggaugauggcuacauuuuuagguguugguuuuuuucuuuuuuuauugcauaggguaaaucuguuuguuuuagauuuugaauauaaagauagaccaagcaagauccucuucuuaaaguaaaaacauuagaaagauggcauuuguugaagaaaacaaaagccugagacaguugagacauuccaauauguuaaacaugauucuggcuucuguuaguuccaaguacaagaagcaauucaaaaaaucguuuuuucaaugugcauuuacugucuuccaggcacuguucugggcauuggagauagaaauaugaacaaaacaaagucucugauccuggugacuuagcauaacucuuggcagagaauaaaauuuaguucuuuacagacuaucaaaugcauccuggcacauuguuucauuugguuggcauagcauuucuaugcauucagugggcuagaaauuaaggcucagagaaaaaaagugauguguuuaaugucacacagcuaguaaaucguacaaugggaaaagugaaccuaaauggcuuaacucuacagcccaaguuucucugaauaucuucacacuucuaaaguaacucucaaagauaaacacuuuauuuauauguuuaucugaugcauugaguggcaacagauuuuuggaagggacuuuggugccauugaccuuuucucuuucuuuucaaaagaauauugaaaguaaaaaguguuaauuaauuuuauuucuggugccaccugacuuucagguacuuuuuauuguauuuucaagcaaguuugauuuucaugcacauuuuuuugcugagaaacaucgaucucagucuguuuacgcagugcagcugugcuccugugauuuauugccaggauacugaaagauuuuuuuccucuuuucagguugccuaagaacaaauguuuucuucauuaacagcagcuuuguugucuaaacaauuuucuauccaaaguuuggugaugaccgugucaguguuccuucagcugacguuuucuguucucugacuaguaacuucccaagucacaguuacuccgaaauaggggacacauuuuggugcaauaauuacagauacaaaaucuagaaagggcuauuggaacaguagagaggcaguucuggcugcacaaacugcccuugccaaagucagugauacagcuugccuagugagaaguguggaggaugggcacuuucuuaggacuugacagcuauaugucagagagguugaaaacauuaccuguacagcaucaaaagaauaaauuuuuggugaauuuguuugugauaguuucaccuucuauguucaugaacaggagcugugcacacuacaaaucuggguuuguauuguaacccauugaaacaaccuauuuuuuuguaaccucuuuaaaaccuauaggaguuuuaaagcauaagaugucuuuccaugcauugaaugauuuuuaagaaaaugucauccacaaagguugccuuuuaauaaauaaaaagaguuucacauaauuuuuagguaagguugaaaaaacaaauagacuauuucuaugaauaguaucuccuaucagaauagcauccugggagaugcagcuugacaaaugauccuucauuacauauuuguugaauucaugaauaauaaaauuuaaguggccaggcaugguggcuuacgccuguaaucccagcacuuugggaggucaaggcgggcggaucaccugaggucagaaguucgagaccagccuggccaacauggcgaaaccccaucucuacuaaaaguacaaaaauuagccgggugugguggcgggugccuguaaucucagcuaaucaggaggcagaggcaggagaauagcuugaaccugggaggcagagguugcagugagcagagaucaugccaccgcacuccagccugggugacaagagugagacuccaucucaaaaaaaaaaaaaaaaaaaaagugaaucaauguggauaguuggcuuuguuuuuuuuuuuuuuacacaaaaaccacucuaagugguuuuugcagauauauuuauagucauugggaagcuaugauuuagauaguacaaauaaaugcauuuucccaguuugguuuuaacagaaaccccgccucuauuuuuuggaccuguguucugauuggaauguaugcaucugcuaacugagacaggcacuguuaguagugaaguggucacauaucuaaauuuugugaucaucuggguuuucuuguuuaggaggaaaaauacuuaaugauaaacuauuuagaagacaaaaaggggcugggugcgauagcucacgccuauaaucccagcacucugggaggccaaggcagguggaucaccugaggucagguguucaagaccagccugggcaacauggugaaagccugucuccaccaaaaaauacaaaaauuagccaggcaugguggugcacgccuguagucccagcuacuagggaggcugaggcaggagacucacuugaacccgagaagcagagguugcagugagccaagaucaugccacugcacuccagccugggugacaaagcgagacuccaccacaaaaaaaauaaaaaauaaaaaagacaaaaaaggggaaaccaaacuaaaaccaauuggguuaauagcagauaaaaaaggguauguagaaaaguuuuuucugauguauuauucaagggguuaagauccuccauaauuuuacaucauguaucuuaaauuaauguccaugguuaaggaaaguuaugccauuauaaaucacauuauuuacuuuggcaguaagaauguucuaaaaguuuuuuugauucuccuccucuguaaacuaacccccucauauaggaagagcuguguucuuccuagcccucucaccuuaccucuaaauucuuacaaaugaacuuccccaaagcagaaauacuacauccaaguagccaaaauuugcuucauuuugaggcacugagugcuacuuuuauaccaaaccaucuagcugugucuugaguccuuuccuaugagacuuggugaucuccaaacaacacuuuaauaaacgcaaagcuuccagugcacauuacucaaaagaauuagucagcuggcugcaacuaaacaacaggccugauagacuaaacugaaauaaauacugcucucagauaagcugcaucuguugugugaguaugguuuuaaucacugaagccaggaaagaaaugaaaucuuucagaauucauacuuucccacaguuauagaaagaggaguaacaggaauaagagucaagagacaaucugaguuucaauuuggccaccaaaacuaacguauaaagcaaacauuuauuuaauuuaguaggguuguguuuucuucuauuaaucagcaaauuuggguggggggagauacuuacuaggucaucuggaagguuuuguuggugccugaaauucuauaaacugcaguuuuguuaguuuuuacauguaacuacuucaauauaauugugggguguauuuugugaaagucaaccccaccuguggaugagcaauucugugggaagauugccaaugaagaauacagugcuaugaacaaugccacuuucuuguggaauuauguaaaaauuggcaaccuagaaaguguagcugauacugccaguguaaaauuuagauauauuugaaaaauauuauugucccacuggaauaucaguuauagugugcuuauugugaaacacacacacagacacacacacacacauauguauaugaccugguggaaugggggggugaguuaaauaauuuaauuuauuucauuuuuaauaaacuuaaaaucuugaugcauuuucauugggcauuaccuaucuuacccuucuuuuuaggaagaaggcauacaguucuagcuguaucccaaaacguaccuauucauaaaggauuuuuuucucuuugucaguuuuacaugacaagagccugugacuucucagauaucucuuugggaaaugggagaggacuacuuccagaaccuuugaaguuguuaugcaaauagggcauucauaauucuauuagccggaacucuuaucuaucacuugaaugagucucuuagaaaaguuguguugguaaggaauuagccccaguugcuucacaaguaagucagccagugcuauagcagcccaagagauuuuggcuggccccucuuccaguuuucucuggcuuuaaucaaggaaguugcuguuagaugcugccuuugcaauccaaagauauauagccauccacuuggcacgaaucaguugggcucacuucauaauaauuucuuugucaucgugaccaaauuuuaugaaucaguuacuucagggacauugcacagauacuggcuuggguauccuacuaacacuugguugggggugccaaguuugaaugacguaugugcguuuaauaagcuccugccuguuucuucucagauaccgagacaugugacuauggcuggcacaaauuccaagggcagugcuacaaauacuuugcccaucgacgcacaugggaugcagcugaacgggaaugccgucugcagggugcccaucucacaagcauccugucucacgaagaacaaauguuuguuaaucguauguaccaaauagauacgaguuuccaggaacuucacuucucaucacucucuuaguuuugucugugugcaagugaaaagaaguagcuuuuucaaucauaauacaacuuaucaaaucccucaucugugaauuacuuaaaaucaucucaccuauguuaagucccccauuuggggaaacauucaacuauaauauagguaggcauugguuugucugccagcaguaauaguugaaacacuugcuguagguugaaucauaagcaguugcuauuugaucauuuuuaaauauacaaaaacagcuauuucuuauggcucaauagaauucuuacuaugguuauacuuucauagucucuauuuugaauauuuauaugccugucuaaaauuacaguuguuuucaguuauuuuuguccugcuaauuaaaauugaauuguuaauaauagcacccuaaucuuaccuuuugggcauauugauucucauucaaguuucuaaauauuuuaaauuguggaaagugagcuacauccuaagaacuugaauagguggagauugaaagcuaaugaaacuuaauaucagagcuguuuaauaacuccuucaacugcagcaaaaaggagggcaacuaguuuucauguagcaauauguagaaauuuguugcucauaaagcauuuucuuaagagguagugucuugccaugcuguccaggcuugacuugaacuacuggccucaaguaauccucccaccucugcuucccaaagugcugggaucauaggcgugagccaccauucccagccucaugaagcguuguuugauguucuauuaaauauuuucucgugaugccuacuaucguuuagaaguuuguuaauuuguaaucuggauagagguucauuuaacuuuacugcgugauauccuugccagugacucaccucaugguaaaaguaaauauuuuugaggauaaaucuguagaacugucuaaucuagguguucacuaauuaaaauguuuugaaaaaaaggaacaaguggcuuccaaaaugaggguagcguggauaagaucuggcacauuuuauugggucacugaauuuuugccaauggcaucgcuuaaaaacaacaacaacaaaaaaauagaaaauuucuaucauaaaaaaaagaaaauuucuaucaugagugagggugggaaaaaauuuaauuauaguaaauugcuaggggaauuauugucuaugucuugauauuuuaaugcuucacaggguuugcacauuaaccuuuucauuuaaagcacauugggcagaagaacaaaagguagacuaggagagauuuuuaugagcaacuaaauaaaaauccagccaguaaagaggaugcaugauucaugcugaaaauaauuuucuuugauauauuuucauccauauauggaaaaguaguacaaauaucugugugguuuccuaucccuuaggugugggccaugauuaucaguggauaggccucaaugacaagauguuugagcaugacuuccguuggacugauggcagcacacugguaagaugcccuugaaaaugaugucaaguucuaccuucuggaaauuugguacugugcacugauugugcauuacagagggugcauuagacuggaggcaaguuaaaugacuugcucaaggucacucagugaaacagagaaggguuagaagaguuccaagcuaccugauccaacauccaguccucucuucaauaguugugguucucuucaaaagaggaguguaccagauuucuaucaaaccagaaaaccagacaauuaguagaauugccuugggucugucuuucagaugguuaucuuugcuuuuucuagcuucagagcaaaaagagaagaauaaaauguagcagaaaaagucauuuuaaaaaaauaccuuuccgucuuaaauaauucacuggaaauccgcuauaaggcaugacucauuuccaagcaaaaauauccauuuauuuuuaucuuaaagaagacuguugauaugaucuugugaauuucugccaacuaauuacauauuucaacuuguuuucuauuuuuugaagaaagaagugacuuggaaaugcuggccacaacuuugaguagacuguaauagguucuuagaacaggugaagcuguuuugagucacucuuacuaaacucaaauaaaucuaauuuuuauaaagaguucaaauaugauugucuauacuagugguacucagugcuggcuguucauuagaaucaccuggaauauguaauuaaaaacuggugcuuaggccuuaucccagguccauuacagcaaaaccucuagccgcuguauuuucucaguguuccacagguaauucuuaaacgcaaaguugggauccacugggcuagauaguaaguguaaauuaaauucuaaauuagaaacaaaguguaaaauauugaagauaauuuuaaaggccuuuuuguguuuuuauuacuuagguauucaguuucauucauuaucugccacuuguuuggauucaaugaguuuggcaaaauauaaaauucauucaaaaacagaugucaaaguaaucucugcuuuuggaaguucugcucugucuuaagagaagcugcuccaucauggacacacuacucacuuuaucuaugugccagccacuguauuaagcacuugcuuauguuuauuccccacaauaacuuuuaagagaggcaauggguuuuccuucaccuguuuuacagguaaagaaagggaaggucaguuagguugagcuauuugccuggaaucacaaagcuguuaacugaugaagccagaauuugaacuuaggcuugucuccaaagccacaguuucuucugaccgguaccuccucggcuuuaaaaagaguguaucccuuguuacauuuucgcuuugagcaacccaaaauaagaccugaguuucucucucugucaccacuguuuauguuuaaucagcacuguuucacuguuugucauucaaguucuuaaguagguuauuuggcaagaugugagaaaaauagggaaaaauagguuguucuuaaaauauguucccaguaagcaauaggaaacacaaccuuagaaucaauaggcucaucuucuucuauuaauaauuguccuggcuggauguauuggaucuguaucugcaauuguugccucuuuauguuuucauuuugcuguacuuagggggauaauacuggccuauuagauuaauagcgauugguauagcaugaaucuuuauauuacauuaauuuuaauugaagauaauuuugauccuauuaauuuaauuucuaagugaacauaugauucagagauuguuucuauauauuauaagcuguuuuuauaauuuuauuaauguauaucauacagugaaugcauuuaaugaguuuuccuuguuaaauguguacuucauucucauggaauacauuggguuuuagggugcccacuauuaagucuaccucccacgaauuucccuuauuuauagcccagugaaaagugcaggguuuugugagcccccaucauguauacagaagcuggcaugcccaggacucagcuggccauuucuaucuaguuacugcuuauuugugccuggcagaugcagcccaugacuuaucccaaaguguaccuguugucuggguuccuguagauuccagcccugagccuagaauagcugcauuuggccagguggaguguacgaaaaaucuuuuuuuccuacacacuuaccugacugaaccaagucccaucuauuucuaaucugucauugguuacauagauuugauguguguguuuuuauucuuagcauguauguguguuacuagauguuuauucuggucucucccuuagcaguucaccucuucaaagaaguaauucuuuccccugcuuuuuauuucucguggugucugaaauaaaguguuauccuuuauuccugugugcuugguuaaagagacuucauauuggccuauaucuggcagcuauguggauucuguagaguaucuuaggaaaauuaucuucccugccaagugccauacaggugagcuugauucaucauaugucauuauuccccuaugccaaagcaaggcaacucaacuaguuuuugucuguguccauuaauuuuuaauguagguacacaaauacucugaaaaacauaacagugacuauuuccauagucuagaaagguccuaaacgugguaaauuagugagcaucgcaccuugucaaaaaagaaauauugauuucccucugaaauuuugcucugaaacuuccagaggaagauaacauaagcuaacauagauaacuguacaacauaaacaagaacccuacucuuaauuaguuggcacuuucacuugaaacguaaggauuauggagaaugcacugagggccucaguuugaagaagacacaugaugaaauguauuaacaagcaaaguuuaucaaagaaaugacacaaguaaauccagaaaaaacucugacagacccucgguuucuucuuaauucacucucuguguaaaauaaaagugugcuaaggaaugucccuuaacuuugaaaauacuggaacagaacagaccaucugucuuagagccggucucccucgcauucaacugaucuccugcccacuuucuugcuuuuguaaccacccuuuccucuauccuuuuccucucugaaacagccuaggugucccuuaaacucguuuguaguuuuuucuacagucaccauccccuuaacggguuccauaugugugcaggccuuugaauaaaauccuucugcuuuguuucgcuguuuacuccaagguuuuugcuuuugaaaauaucccuaacaguaaagucuuggucagggggaucaguaucugcuuauacuuggaaugguguuaacuugacugugugcaguuuuaaggacuuuguuuauguuuuggagugauuucucuccucuuccacacccucucuaucuccauuuuuuucuuugaaagauuuauuagagcuucuccgucuugggugguagaacaguauuaaaacaaaaagaaccuuucauauuuaccuuaaagugucuuuugauauuuagccuuacaauccaguaagaagaaacaaguuuauauuaggucucaauuucaaugauccauuuuacucaaauaauuaaacuuugcuuucaauaaacuuacaguauaaauguaucauauuuaauguuaugcuauacagcuagacuaauucaacuaguauacuaaauuaaugauguuauuuggcuaaguuaucuaaauugcccuuauucuugagauucugauggauucauuccacauuacuggccucuauaauaggauguuguuaucauugaugaaaugccaaauucucauuucuguuauauuuuuaaaaucuauuacuuuuuuuauuugggguguuugcccaauaaauuucacaaaagugaauucaugaauaaaauugugccuagccuuacccuugugauuuauauuaagauuauuucuuuuaauacauuucaguuuuuacuuugucacuuggcuuucuccuaaccuaguuauucuuuaacuugacuauuguuaacuugacgauuguucucuauagcaaaaugugccuacugcuuuauuggaaacccuaacaaauaacuucacuaaugaauugcuuugcuugucacccaaguaauaucuucaaagacacucaguuaaaccauccaaguuaaauauacauuaaagcuggcaaacuuaaacaaacuuuucuuaucuagcuuauauacuguuagcugacuuuaaaguucuuucuuaaaccaacuguuaaaugaaugacuagucagaguguuuucuuucagaucuguuuuccagugcuaaugaccuuucccuucccuggcuaugaacucuugucgcucccuuaaaauucuucagugucugcucauugccuucaguauaaaauguuaauuauuaguauggcagacaaaaccaauccacuccgucugccacuuccugagcuauagcaucucaaaauacucucagcuccuggaauaagccauggguucucacuccugggcggcuuugccuguacuggcccuaguguuuagcauauucucacgucuuauccucauuucaucucacaaacagucaaauacccugcauagccaagggucuccuuccaggaagccuuccuugcugggaaugacuaagagcuccucuucugugcucccacaucuuuuuuguccuccacccauccuaacucaggcuccugugaaaucaacuuccugacacugagucuucugagauaggaauuaacuuucgucucuguuuuuucagcaacuagcagaguaguugacauagaacagguauuuaauaaauauuugaaugaacaaaugaucaucaguauacacacauugcucagccaacucuaucuuuugaauccugaaaugaacacauuaugucuuucagcugaaucucuuugugacauuuuuugccuaaauuaaagauuuuauuuaaaguuguaccaguaugaaaaacaucaaaacauaauagauggguuuuacggugaaaagaccaaaaaaaaaaaaagauauuccuuaaaaauagaaguauauaguugaacauacugcaucuuauaaauguaucaacccaaaggaaaacaaguguuuuuacuagaaaugaugacaauuuuguccaugguuguccuagaaacaccuuugcaauaaacuuugggaauuaaaaauggaaaguaaacuuucaaccucugccaccccugcagguuugaguuauaucagggcagguuuuccaugaaacuuuaagaaaccaacaauuacucaaaacuuuggaggaggauuuuuuuuuccagauaggcacauauuccguagguauacuuucugaagaaaaaugaguuuuagaaaccuuauuauuuauauccaaaauggagugaaacaaacaaaaggaaauaucacucccaaauauuaucagcucauuuuacuuuuuauagaugcuuuggcuaagggugauuugguugcauaaggugggauagggcuucauuuguaaauccacuaucugaggcuguuuauucaagugcagaggaagccagacaggcagggaacguuauggaaucauuuauauuuaucugucaguauaccuccuggcaaaaugauuuucacaacacuguuuucaacuaaagacuauagugucuaugggacagcccaauuaaggagcuaucagaaacucuuacaugcuuucaucauacuguucugucugacaaaccucuccaacaagugguuuaaaaucaaauuguggagcucagagauuuaaagcugucauauugcuuccuucucucuuggacccucuggaguaagauucucacgaggcgauucucugggcuccacauuguuccuuucuucaaugauuccccccagcaccaucaaagcugacccuuccccacuggacacuggugucuucaguggaucagacgcauuuacuucaaagggaaccaucacuuuagauggccauguauagaggccgaggacugaauaaaacugacauugccauuccauuuuuaaaauauuggggaguuuuuggaauauuuaguuuguucugcagaaaaagcccugacuuuauuccuaaacauuuuaaaaaacauuuucugcaucuccuucacuuuuuuuacuucugucaucucuacauugucaggacucaaaugucacaccccgugaggcugcuggcuucccugcuuccugggaaauuaucacagcuuccuucuucucacuuuccauucuacaguugggagaaaacagagagacuuucucucuucuacauuuguccaaaucuggucaggaaguucuagaacaaguuacuaaaucacagauucauaaauaucuuauuuucuagcucuaaccaacucaucuugcuaugauaguugugauauaaacuaaaaaaaaaacuaauugauaggacaauuaguacaauuaauuguacaauuaaccuucauuacuuaaauucuucuuaaaaauauuucuggaagauaacucaauuuugcauuuuguuuuucauuuugguaagcauaguucagcuuuggcaacuuaauaccuacaauuuccaacacccacuugucccccuucaccaguugauucgaguugaugcacaagaauguccagauguguggauuugacuuuaaauccagaggcuccuucuucuucuuucauaaauaaacacaucagucugucaagcaaaguauugugagaaaagccagcuuugaaaaagguagaaacaauaaagaaauagcccuuacccaggaagagacacuuaaaaggggcagaaaaaauggaguaacaaaucacggaccauaaaccauuauuguuuuucugcagcaauguaucauuauuacccuuucauaaacacaaagguucuuauuccccuuccucucccagaugucuuggacauugaaaagagaauacggaguauucauuaauuccagugcuuucuaagcuuguuguagauuucugcucauuugaaaggauuucacaugauuugacagaaaaacaaugcaaaacacaauccccacaacaaaaauuuaaguuuuccuuuuccuaccugaagaucuuagaagacuuucuauacaacauuugcagauggauguaugucagcugugauguggcauuagcucuaagucaaauaccauuucucugugaacaagucacacugcauaucaacauuaauuuaauuauguuaaacuucacaggcuuuauuguauuaauccaaaagccaaggaaaacaugcucuuuucucauucuuuaacacauuacucaugaguggaagaauucucagauucccuucugugaaagacuacugaguucuuaaugaaaauuuugacuuguguuguaguuuaauuugauuuggaaucaagaacugauucuucugauucuaaaugugagauauuaugagucauagaguaguucuagaacgcaacucugcucucugccuugucuuucaguucagauagcuagugguggguugaacagcuggaagaaccauauuuacucacuacuggaaaaucauuuuauaauugacaagauuauuauaaagaauaagaaaaggagauuuagugcaguagcaucucacagaugcuuuuccaacagucuucugugcaacuuuaaaaucucaugcagauauuuaaaucuaauugcuaauuaguuuaaggcaaugcauaaccauggaaaaggccaaaaaaaaaaaauauauugaaugagcuuuggcagucucuccuuacauuuggaucgucagcccuucaugacuggagaccugugcaaauaagcuugggguaaaggagccuacuggcaccauucauucuauggauuaaaugcaaguugcucucugggccucugccugaggcccccucucucacaguggucucacagugcgaguaacucacauccuucugaaaaugcuguugauaauugcugcuuuguagggcagugagcucacacuauuacacaagauuagugcuguucucaagagcuggccagauugucuuucccgcacagagguuugccagcuaggaaaauaaugggcauauugccacuuuaacaacuaucaggagaccccaaguuaguuuuucuucccuucagcauauucauguuuguaggauccaacuccaggcugccagcauaggguagugacaccaaaacaaacgucucuuucuccuuuaaaacaaagcugcucuuuucuuuucaguugucggucaacgaauuacccuguucaacuaaaagacagcagcaaaaccauaaccucccuuaaaacauaaauaaagaaggacccagacuagacuaaccuuaagcaaguacaaggaucagaagaagguuuaucuuuaccuugcagggaagucauuugccccuaacaaacaagacaaaguuaaaugcaccacucccccuccagacugcaaacaaaugccuauuguguacaccagccaucuagggauaaaaaagucauuuuaaagguaccaaauguuuugauuucuguaauaaguaguccucauagccucuuuucagauaaccauuugaccuguguucugaaaggcugaggcuaaccccaagugguuauucuguuuguuauuuagugaaaagaugguuucuuaucggcauauguuucaaacagguaccuguccucuugggaaaguguuuucuguuuggaauuugcuuuccuacuucggugguuaucugcuugcccuugguauccagugcguuuggauugaauuuuguagcucugggaguacagcaguggcaauaugggccccaggugaugaaaagaguuugcgcacaaagaagucagcucuuacugcaggugucauguuuucauagcuaaucuagauaaauuuuuacggaaaaacaaacuaacugugacucacgcugcagacauugcauuugugugcuuagguguuuaucuaugaucugaccucuccuaaggauuuuagguggauguugcacauuuggcuuugguucugaugcaauuucaccauugauguaaaucaucggauaauuuuaaaagacagaguggaaaagaagaaacuaccguaggugaacauuuuagacagaaagaaaauucagauuauggauagaauggcuugcaacagaauagaaugcagucagguugguaaauacugguucaccgaggucugucuucuugcaaaguguucucuuuguguuuucacucacaaaacugagagaacauaucccagacaaucuuuuauuuuuuauuuuuauuuuuuuauuuuugccacauggaguacauaauuacgauuuugggggacauauuccaaguucucuuuuguuaagugguguagccguuaauucauaauguaagaauggauauauaucaccaccuaguggucguauuguauuuuguguuucaaaaccacauucacagaacuacacccagauacacacaagaauaauacuaucuguaaaucaaguuccuguaguuuugaauaguuucuuaauucuaguauaaauugcaugauacugugauccugaaaguuaaaugugaaaugagaggauuuuucaaaugcagcaugaagcuaacacauguagucaaauacuuaguaaaauccuagcaacuaaggcaaauauuaggaccuaucuguccuguguuuucacuuuauacacaauaguagaacgcuggagaaaguuuucuuuggcuaguuuccuugggaggugaacagagagggcuuuugcaggguuuuuuagauguuuuuuuuuuuuucacugugaacuaaauuagcaauguuuggaggaaaacagaguaagugaagagcagugacugaaccguucaagagaaaaacucccaaauuauaguuugaaguucaguaaguucucccaacaauuaaaauaauguauugugaauggcuugacuacacacaugucaagaaugguuuuucucaaagggaugugcuuggcaaaauucauaaaaucuauaaaacaucaucuuuaauuggccauuuaagguaaucuaaacuauggcgaauuuuaaaaaacaaaaggugacugcaccuaagcugaaaaauuauagauaauauauggauagauagagagagagaguuggaaaguaggcccuuggcaguuacagauucaagauuugccgccccaguuauacaugagauccugaaggucugcaguaugaaaacauuuguacuuuuugcucaggcacaaauuugaacuguacccaaugacuggcuaguguguaaaaacucucagugagcucucaagucuguguauuggacagcucaguuuucccaucacaagaaguagguugcugucuacucugcugaccauuuuguuuguucucuacuguauuuauggcaggaaauuaucugcuacacagauguguaugaauggaagcauuaccaagucuuaggucuuaggcacuucuuuaaugccaagaaguauuguauguguaaggguguguguguguguguguguguguguguguguguguaugugugagagagagacagagucucaaauuuaugacucacaaaaauaugaacuugaauuuugucuagugucuaugaaaauucugucucuuuuuauuuauauuguaugauuuagaagccaguagagaggaaaagaaauagaaagauucuaaacagugucugacucuucuagagaaccagugcucauugauuauucuuuguaguuauuugaccaaguuagagaaucucagugaaaaugacuugaaauggguugaguauuauaaagaaacccuaguuauugauuagguuuugauaagaacgauugcucuuaaaacuucuuagucuuuugcucauagaugaauuugcuucuguaugugaugugcagggaucagcugggacuugacugugacagcaguaacugauacuggauggucugguuuccuuucuucaacugaaaguaguacuaaagaugaacccaagaaaacucauuuuuuaacacaaggaaaaaaaaaccuccugguuuauuucuaagucuuaucuauuucugaaaaacugcuuuuuuuuuucuuuuuuuuuugagacggugucucacucuuguugcccaggcuggagugcaauggcgugaucuuugcucacugcaaccuccgccucccggguuaagugauucuccugccucagccuuccgaggaauuacaggugccugccaccaugccuggccaauuuuuuuuauuuuuaguagagacaggauuucaucaccauguuggccaggcuggucuugaacucccgaccucaggugauccaacugccucagccucccaaaaugcugggauuguagucgugagccaccacaccuggcccugaaaaacugcuuuuuuaaccuuugcaaaaaggcaguuauccaucacugcauaaggaaaagggcuauuaguguacauuacauuuuuaucaucaguuuguuuuguucaugcuugugaugcuaguuaucugcugagauuuuaggucauugaucauggccaccugguguguguuuuaaaugauaaaagauaucucugaaugacaguugggauuuccuagacacuauguaaucagaaauucaccuugaacaguguaaaccccaucugaauuugguagauuguugguaacuuucaaaagcagagaccucuccccacccaccaucaucuuuuuuuuuccugguauguugacugaauuaaguuggagacuuugcaaagaacugggaaggagagaaauagcucuccaaccauucugagugagaaaaauagucaaaucacucugagauacauggaauugaggucacucucugaggguuaaggaugcuggcaugcacagaagucaugugcacugcagaagaccugcaggaugagucuucucuuuuguguuauugugagacagaaauaaauuuuugacaaguacagauuauuuggaacaaaauaaucgaaacauuuagaguucgauagacuucaaugaauagcuucagucugcucugaguuuucacccuguuaggaaugguucacaaugaguucucuaguuugugaagagaaacauacuuauuagcuguuagauuuuguccaggguuuuuugaaucauuuuauuauuuuggcagcugauuugcuugaauucaauuaggggaaaaagaaagaaaaacaauaacugaaaagugacugauuccagcuuaaucgaaaugguagcccuuuuuggcauguuauuacagaccuggagaacuaguuauuuaauuggacucuaaaaauaaagcaauuuuaucauauauuauccagcauuaagcaguuauauacuagauauaaaauaauuaucucuuaauaaaaugcaagaaaaauuuacaucugaguuggcuuuccucuacaucaacuauuugcguuuuuguuuguuuguuuguuuugagacggagucucaccugacccccuaggcuggagugcaauggugcgaucuuggcucacugcaaccuccaccucccagguucaagugauuuuccugccucagccucccgaguagcugggauuacagguggcugccacuacguccggcuaauuuuuuguauuuuuaguagagacgggguuucacuauguuggccaggcuggucucgaacuccugaccucgugauccacccgccucagccucccaaagugcugggauaacaggcaugagacacugcacccggcaacucuuugauuuuuaugucacaauuuccucugccaucagaagagagugaaaaugcaaaguaauuuuaggguucucuuucagguguaguagugaucuaauucuugucccuggggaggcaacaagcguuugagguguguugcaugaacuugagucccugaggcacagacaaacaugcaggggaaugaccagcauuuauuuuucccuaagggguuaaaaugaauuuccccaacccaugcuggcuucugggaauaauucuuaguuugcacauucagcucuagaagaggguugauccaagauagaucgcucaggauguuugcucauaauucaaagugaaaaauaaagaaauccaaaugggagguacugaguuuuucccugcuaauuccaagaaucuguauuccuguauauaugagacaccauauugugcaagaagaucuauuaccuucuuauaacuuagaauugauucccugagaagggauuucuucuuaacauuuaacuuuagugaaaagaaaaguacguuauugaagcuaaaguuaauuuuuuuuuuauauuuucucccuacaaguaauguuaaauaaggcuguaaagaauucagaaagacacaaaggaaguuguuaagaaaacuggaguuuucuuugcuaagucaguuuggcaauaacaugaagcaaaaucaaagcauccuagccaagauaaaucugcacaauggaaugaucagauaugagguaauagugugacaugccuguggguaucagacauucuuguaaaaaccacagagcuaaaauuugguacugcaccauuaaacuacagcucugccaagcaacaacaggaacacucauuuuaagucauugcugcaagccaaauguaauucucacccaaaacaauuaaaucuuuuaacagaggccugaaucugggcaguuugagccccgagaaucacuuuaguggcauggaguccgaaucucauuucagugugaaaaugagaugguuauuguucagaucaggaggaagugucagcugcaaaauauagggcagucaagugacuuuaguaacuugcggugauauuuguuaagauuagauuuaaaaaggguuaguuaagaaauuuguauuuuuugugagaaaugcacauaucauuuuauaaaguucauuuuuagcaauuagaaaaauaaugcucacucuagagaacuuggaaaauaucauaaguaagaauauauagaauaaaauauuaucucagucucauaucacucagacauaaacucuggaagauuuuauugcauuugcuuuuggucuuuuauauacacagacacacacgcaaacacaaacacacacacauacauccauacacccagcuguaucugagaguaugaguaaaauuuggaucauuauaauguaauaauuuaacacuuguuuuacuaccccccauuucuuuauuuauucuucaaagaaaauuuuaaauggugauauaauauucuauuugucuggcuauaucauaauuuauugaacauauguuuacucuauaaauuguuuucccuuuacugcuaauaaacguaguauuucauauaaaaugucauucacaucugugauuauuuuuuaguauagaauuuuagaaguggaauuuugggguccaaaagcaagaacuuuuugaggcuccugauaugcauugccaccuguuuuccagaaagguuauuuacuuccacuggcuaugucuguaauugucugucucaccuauuugcuagcagcaagcaggaucuuugauuagguauugguguggguugggaagaaugaaacacccucugugguucauugucucuaaauaucaaaaacuauuuauuaaacaacauaaguaugugccaaacauaguuucuggcacugaggauacaguaaugagcaaaagaaaccaaagcccuguccucaaugaauuuacauucuacuaggagaaaaaaaugcaauuaaugaguaaauuauguaggaugguagaauaugauaaauguuaugaagaaaaagaaauuaagaaagggagaugggacaguguagguagggacaaaaaaugagagaguaaugcacaguguacacauaguauuaggauguuggaaaauuuuccaccuuugaggacauuacugguuuccuguaagagacuaguuggaaaguaagcuagaaaauauugagcuccuaaauccaaauuuaauauuuggcgaacucuggaaucuuugaccauagagaguaccaaauauagauuuuuguuaguuuuaauggauucuuauucuuugguuuuuaauuuuuauccuacuuuaacucauucauuacaaacaacuuaguucuguaucagcaacaggcagaacaugacauaucucugaaauguugauuaucuauuaaaggagaguaucaaaaauguaaaaaggaggcuuggcgaguggagggugagggaugauaagggaaaugagcaaagaaaaaaaaagggaaauaauuagaaacccagugcagagccaaugugaguuccugguugcagggagaccuaccagucaaggaguacuucagugaguguggucccuugagcaucuuuuccaggccauuuggagaguaacacaguggggccauuuaggcuacgaguuggauuuaaauuugccucacuucuggauuagguuuuucccccgagaaauaaaaccacccuucaugcuguauuuugacaaaaaaacaacuuccuuaagggucucuugguuuuuugcaaguuuaucacucuucaaacagucuuuuuuacauagcagugaucucuugucucauaucuuaauuuuggcaggauugaggaggacuuuaaaguaaagcuaaaagacugaaacaaaaguagguuuucaaacuuuagaucuuuucacaaauuauuuuaugaaagaucuaaauuuuuuuuaccauauuuaaaaguuuugaaaaccacuuuuucugagaagaaaaauuacagacauccucuaguauauuaauuauacucuuuuuguuuguaaacuagagcuuauugguauacaaauccaauuucauagguaggagaauaccuuuuaaguuuuuuauugugccaaguauuagagauauaaaacacagaagaaacauuugguauugaaaacacugcagauagcuaaguauaguacuuugguaaauacaguaaaauggaucagacauauauuuuaaaagacuuaaaaauagugauaguacuguugggaguaaguagguaguagaguaauuggaccuucccuuuuuuuuuuuuuuuaauuuuugcauucacugaugcucugaauugaaaacaauugccuuaaaucuuauauacacuuuauucucuuucucuuugccaaauaaauucacuuaacucauugucucaaaccauaaacuuauuuuaaacuuaauucaaggaaagacuaacagaucuguaggcccagaaaagacagucauauuagccauugucacauaaaucuaaaucuguauuucuagcauauuuuggaaguuugucaccacuaauguugucauacuagacaugauaaagcaugagaguagccaaagcauggugggaaagugaugcucaaauugacccagaaaggcgcugaacaaacaaacuugucucauaccacauucuaguuaagaggacucaagacuaggaaacuggucucuuauuuauaggccaauauuauuuucaucuuaucaaaguuuguuauucuugaauaggcacagcgacuauguuuuuuacauaauuauuguugccaggaaggcaauauuuuaaguaacaaagaaaugaaccuaaaccggagaguucugggugcauaacaucucuaagguccaaauaauucccuauuaugcugcauuguuguaagagacaaugcauaucaaguaccuagaaaagggcuucaucuauuauagaugcuaaauaaaugacacauaugauggaaggcaaaagauauuuucaauuguauauuauugcucagaguaggauauauauauauacguguauauauaaagguaaccagcagagaaaugucaaacccauaaaguccuuuucaaugaucucaacauacauuacacacaaaaaaaaucuguaauaagauauacuuuugaagguguauuuuuuauaucaauaugcauaaaugucauaaauguuucuacuaaaaagaaaacauuucauauuaaaucauaaagcacaacucaacuguauggugcaaauaagaaucacaucuaaaacaaacuagcuuugaaagguuguauauaaaaugauuagcauagguaugucagauaaauacaaaagauaaauauugcaacuaucucaacuuuuuuaaccaaauagaugaauuugggugaaaagcaauuacaauaaaugagacaaaguuacuuuauaguaguacagauaagacaagacaggcugaaaauucgauugagguaucaucacaauuauauaaauuuauaugugcacauaagagguagaagaaaacaaugauuagagugaugagauuauuuuuucucuaguucuacuuccauuaauuuuauugaauuaauaauaugaugaaauuccuaaauugaagguugaugauauauuuagaaaucuagaauaacuaggccaaaauuuguccaugauaucucauugccaaauaguagacauucguucaauaaagacuuugagacacauauauuuucuacucacaguuuaacagucuuuuucuguaccaccaaaauaauuucagcuauaugaaacaacagaaauuguugagucuauuccaauuagauugugauauaauaccgucguugcucuuacguuacuuuuugacuagcaaguaguuaccuucucccuccauuuuuacagcaauacgagaauuggagacccaaccagccagacagcuucuuuucugcuggagaagacuguguuguaaucauuuggcaugagaauggccaguggaaugauguucccugcaauuaccaucucaccuauacgugcaagaaaggaacagguaaugaucacccuguuaauaauguguacuuaaucuucauuucaauuauaaagauaauucaggaauuugugucucaaauucauuguuugagacacaaacuggauauguccauguaugucaucucucguugcucuggaauauuucacucuuccaaaacaauugaaaaguuuguuuucaacaauguucucaccuuagauuucagguccuuaagauaacaaugugacauuaacguaggaaugcugccugguaauaucuuuaagaagaacaacugccaguccaaaggccaauagaccuuuuuauuuuuauuuauuuauuuauuuauuuauuuauuuauuuauuuauuauuauuauuguuuuuugagauggagucucgcucugucaccaggcuggacuacaguggugugaucuuggcucacggcaaccuccgccucuggguucaagcaauucuccugccucagccucccaaguagcugggacuacaggcgugcaccaucacacccagcuaauuuuuguauuuuuaguagagaugggguuucaccguguuagccaggauggucucaaucucuugaccuuguaaucugccagccucagccucccaaagugcugggauuacaggcuugagccaccgcuccugaccgacuucuuuuuuuauuuugaugagaacauuacaaaauaaaauaguugucaacaguuaaaaauuaggcuauauuuuuuaaaucuggauuuucagcuuuuuuaagaaauaagaagaccugguaccauguggcccauauucagauuugucggugguuugaaguacuagagcugagaaccacugcccucccuugguuggggcugcaaucuccauuuauugcaguccucauugaguccuuccuuuguuuuaugugaguccgugucccaauccugaaagacacaaucccaaaugccauaauccuaaauguugaaaucucaaaggauuaaaaucccaaaaauagaauucuggaaaaaaacaaauuuuaaagacauuuauuuacauuuuaaaaugaugauuuauuagagaaacauauaaaaacaugacagcgugcuucauaagccacuuuagacaauaaaauaaauagacaauaaaaacauacauauauuuucaagcauaagcacucagguauacuaauggcaguuggggaaaaaccaaaauguaugaaugcacaucacucugguuguaauugugugcaccagcuuuauaacgguggucaucugaaauaccaugaugaacaacauaaaucuuuucacaagauugaugaagaacugagauggguuaccaccgcauauucagucacucaaagagcugagaucuugagaaauuuuaucuuucauaaauggagauguauaaaagaacaucucuucauuuauugaggaaguuucaauauuuuuauauugagaaccaaggaagcugaagccaguacuguaacucucagucugagaccgaaagccucaagaccuggggggccucugguguguaaguccuggaauccaaaggcuagugagccuggaguucugauguccaugguggcagaagucugucccagcucucagagaaagaccagcuugccuucuguaucuguucucucugggccccuggcugauuggauggugcccaucaacaaugagggcagaucuuccccaccucauccacucacgcugacacauuaaucuucucuagaaacacucugagacgugccccaaauaaugcucuauuagguuucuagguauuccuuaauccagucauguugacaccuaaaauuaagucuacaggucuaccccuugcaacuuggcacccauaugcauguuuuuaaaccguauuuaaauuuccaaauaaagacaauaacaagguaauauaauaauuucuccugacaugauauaacuauccugcauacaaccaaaaaugcacuaaucccuucccuagaauuuggcuuucaggauuucaacauuugggauuuuaauauuucagaauuaugauuuuggggacuuuagauguuagggauuuuaaccucuagggauuuuggucuuuaggaauuucaaaauuugggauuaugacuuuugagauuaugucuuuugggauuauaauugucaccgguuuuugccaacugccuggucucuguaggcauuugagcuuuuuaaccauucccuuagaaguuuauuuuaugcuuauaaacuauggaucacaaaugccauccuuauaucuguaguugaauauuuacaagauauaauaaaauaagaacauguguaauauaaauuuuaugagaauuguuuaguuaacauuaaacaagaaauauuuuaaaagcgaauuuuuuaaaagguguguuuaucauuggccaauuucuaaagcacgcuguacagacuuuuucccuaaacaaauagaaauucuguaaaauauuuuaaccuauuugcaauuaauaaugguguuaucacaugaauauuuaaucccuagacccagacuuuuacccaucucaaauaagaguacgaaguacacauguaaaauauaaaccuauuugauuaauuugucuuugaauacaaaaauaauaaaacuaaaaaccauacucuauaaauauuuuaggaaagauuuaaaccccaauaaugagaaauucuauuagaagaaagagaacacuaacauacaucaagcccgagucucauaugaaagucagcuguuagcaauaaguacguuagucugcuguuuucucacccaagguagaauguauucucaauaccuuuucuacaugagaagcuuuccugaccaugucccuuacuucagcaccucugcgaugagauuuguaaaacuagcaaaucaaguauuuucuauuuuucuuuuuccgguguaggaaucuuuacuaaauuauucgucucuauccaaaugucauguuugcccucuuaugucuccaauggucccuggagucauacuuuucauuuuaugauuuaaacauucuuacauuuccuauuuuauuuucuccuauagcaggguuucucaacagcagagcuauugacauuuuuggucagauaauucuuuauuuugagaggcuauccugugcauuaaagcauguuuagcauaaucccugcccuuuguauacuacaugucaguagcaccuuuacauccuuucugcauuguaaaaagcaaacaugucucuagacauugccauaugucuccagaagaggcaaacugucccacguugagaaccacugcccuauaccaaaaaagauucacaaaaacaccaugauuguuuacauuucccaauggauaacaaguuuuauaaaauacugguucuaccucauuaaagaagaagaaggaaaaaaacccuauuuuugcauuuuaucuccccuacucgcugauuuuuauauuugugcagucaauucuuuacuaaucagaacucuggggaaguuuuuaaauguuuauaggcuuuuaaaaaagauacccuuuucucuuuuuagauauuuuaaaccuacagaccuaaguaguuuuccuuuuaauuaacuauuacauacuuguaacgauuuauaauauauacaaaaggcauauuuuuuaaaagaacaccucaaugcauacugcccauguaucuguggaguauccuguggguuccucucaauccuaucuauuuacuucucaacucccaccagagauaaugacuuaauucccuugcuuuucccuuuucuauuaugauauacacuuguuucacuaaacaauaaauuauuuaguguuguacauuuuugaacuuuaaauaagugggaucauacuguauauauucugugcuuugcucuuuuuuuuguucagcauuauguuugugagauuuauucauguugaugcauguaauggcauguucuuuguuuuuguuucuguauuguauuucuuguauaacuauacaacauuuuacuuaucaauucuccugucaguggacgcuugagucauauucgguguuuuugcuuuuauaaacaauguuucuaugagcauucuugaacuuguucuuggucaacuuuugugaguuucuguaggauauauuuccaggagugaaguugcugagucauaggauauauguaccauaaaaucuacuuuaaaaagccaaauuuuuuuccaaaguggugguaccaauuuucacucccaccaacaaucugugauagauccuguugcucuacaucuucuccaacauuuggcacuauuggacuuugaaauuuuugccaaucugguggguauaaaauguaaucucuugugacuuaauucacauuuuuugauacgucucucugaauaucuuuucauauauuuaucaaucacuugaagcucugcuuuuguaaaguuucuguucauaucuuuugguuauuuuugaaaauuguuuacuuauaaucuuauacauacuaauuuguaggaguucuuuuuauauucugguuacuaaucccuugacaauuuuauauguugcaaauaucuucucccaguuuguugcuugacuucacccuuaccuuaugauauuuucugaugaacagaauccuuaauuuuauuuauuuuuuuuccuuuaugaucuaaucuuuuuuguguuuuaagaaaucuuuaccuacugauaaccuacaggucacauuggcaggcuuccaaauuaauccgccugggggaggucuuaugauucauggcuuacauccugucccugaguaaacaauuuuaucgugaguuccucaaaucuuaucaugaauuccuuaaacuguugacauacugauuaauauguagccuacugacaguggaaaaacacugauuuguuucugaauccugaaguuuuacugauuguuuugcacauagagcauuuuagcuuguauuuuguaaaucguagccaaugauuauaaccucuguauuguacccuccaaugaaaaucacaacucgggucugaggaguugcccucccuucugaacuuccccauaaaaaccuuccaacuuguagcagauucuggaauaugcccaaauuuguggugugucuucccagguagauccuggcauuuggcuuccaauaagccuuuaucaaauuauuucugccucaacagccuuaauuuugguugacacuauccugaagucauaaagauauucuauaguuucuaaauguuuuauaguuuugccucuuauauuuauauauuucaaccaucuagaauugauuuuuaaugucuuuucugaaguauggaaccaaguuuauuauuucuguaugaauacacaaguguucaaaugaaaagacuacacuuucccucugcucugccauguugccucuuucaaauaucaagcauauguguguaaaucucuuucuggucuauuuuccuguccuugccaauaccacacucacugaauuauuauagcuuuuuaauaagucuucauauuuaguuuuagaagaaaucuauacaauuauuuccucaaaauuauaaaaaugaguucaaauuuguuagcauagcaccaaaucaaguacauugaauuauugaauugaucauuuuuaaccuucccuaucacuuuggucuuauuccaucugauacuugcuauugucuggacccuaguauaggcuuuccauauugcaauaaaagaagugugcaccauggaauacgaugcagccauaaaaaggaaugagaucaugucccuugcaggaacauggauggagcuggaggucaucauccuuagcaaacuaacacaggaacagaaaaccaaauacugcguauuuucacuuauaagugagagcuaaacacugagaacauaaggacacaaagaggggaaaaacagacacuggggccuacuugaggguggaggaugggaggagggagaagauuagaaaaauaacuguuggguauuaggcuuaguaccugggugacaaaauaaucuguaaaacaaaccccugugacaugaguuuagcuauauaacaagccuacacauuuaccccugaacuuaaaaguuaaaaaaaaaagugugcagguauccagauugaggucaagcagaaguaaauuagaagaaccaaacauuuaaauuaaaccaaaauuugucauugcagaaggauaugguuguaaacaguccucugaauauguaauaaauuuaauaauuguaaacuuuuaauauuaggauguugacauucaaauauuugguaccaagguuucugguaaucauuuucccacugaauauuugcaauauuucaugagagaauguggcauguuuuugugggccugugguguaagaauucuuaagcaauagaaauuuccacuuagggaaaauuauauuuaaguuacauuuguauuaaagauauauagguaaauauaauaauuuaaucaaaguucauuuuuuuaaagcauaucauuuaaaauaagugugcuaauguugaauaaaacuauguuaacacaaauucaauuaaaucaauuuuccaagcuuuuggauuuuuuuaaaauucaaaauuacaaaauuuuucauuguaaauuuaaaaugaugguuaagaauuccaagcuuuacccucauuugccugucucaggaguuuuaauuuauauucauuaagguauuuaugaaacucaggcaugaauauuauggucucuuuuucuugucucaauacagaagacaaaaaagagcaaauaaauauaaauggaaccaaaagauauuuguauuuaggagacuuuguccauauuucaaaacuaugauguuauuguagauuguaagguuuuuuguuuguuuguuuguuuguuuguuuuguuuuguuuuguuuuguuuuugagacacagucuugcucugucacgaggcuggagugcaguggugcaaucucggcucacugcaaccuccgccucccagguucaagugauucuccugccuaagccucccgaguagcugggacuacaggugcccaccaccaugccuggcuaauuuuuuguauuuuuaguagaaacaggguuucaccauguuggccaggauggucuuaaucucuugaucucgugauccaccccgcuuggccucccaaagugcugggauuacaggcauaagccacugugccuggccuguagauuguacguuuuuauaaggagguaauaguaauaguuaaauucauuauugucccaagugaagguaauuaagaaauaaaaacuuagggacggugaugaagacaguaugcuuuuuaauuuggaaauuuugucagaauaguggcccuuccagagggguagaugaauguaugaccauuuaguccuaugguuguuuuaauaaaacaaauuucaagauggcauaaucugagauucaaaguaggcccagagccucaacauuacauuuucuuuuugaaaaauuucauauucuuaauucuaaaagauugccuuugaugaaguugcuuacuuugguaccauaaagaaagagagaaaaauaagagacucauauuaguugaaauacuuagauuauuuggaaauaacccaauuugcuuuccuuuagucgcuugcggccagcccccuguuguagaaaaugccaagaccuuuggaaagaugaaaccucguuaugaaaucaacucccugauuagauaccacugcaaagaugguuucauucaacgucaccuuccaacuauccggugcuuaggaaauggaagaugggcuauaccuaaaauuaccugcaugaaccguaagugguccuuuagaaagaauggacuaccgugcuauaacaacuacuagacaccuucauuuuacggcugugguaucggcaguuuaggguauggagcaaguaauauuguguguuuucuuuuuuucuuucuuuccuuccauguagcaucugcauaccaaaggacuuauucuaugaaauacuuuaaaaauuccucaucagcaaaggacaauucaauaaauacauccaaacaugaucaucguuggagccggagguggcaggagucgaggcgcugaucccuaaaauggcgaacauguguuuucaucauuucagccaaaguccuaacuuccugugccuuuccuaucaccucgagaaguaauuaucaguugguuuggauuuuuggaccaccguucagucauuuuggguugccgugcucccaaaacauuuuaaaugaaaguauuggcauucaaaaagacagcagacaaaaugaaagaaaaugagagcagaaaguaagcauuuccagccuaucuaauuucuuuaguuuucuauuugccuccagugcaguccauuuccuaauguauaccagccuacuguacuauuuaaaaugcucaauuucagcaccgauggccauguaaauaagaugauuuaauguugauuuuaauccuguauauaaaauaaaaagucacaaugaguuugggcauauuuaaugaugauuauggagccuuagaggucuuuaaucauugguucggcugcuuuuauguaguuuaggcuggaaaugguuucacuugcucuuugacugucagcaagacugaagauggcuuuuccuggacagcuagaaaacacaaaaucuuguaggucauugcaccuaucucagccauaggugcaguuugcuucuacaugaugcuaaaggcugcgaaugggauccugauggaacuaaggacuccaaugucgaacucuucuuugcugcauuccuuuuucuucacuuacaagaaaggccugaauggaggacuuuucuguaaccaggaacauuuuuuaggggucaaagugcuaauaauuaacucaaccaggucuacuuuuuaauggcuuucauaacacuaacucauaagguuaccgaucaaugcauuucauacggauauagaccuagggcucuggagggugggggauuguuaaaacacaugcaaaaaaaaaaaaaaaaaaaaaaaaagaaauuuuguauauauaaccauuuuaaucuuuuauaaaguuuugaauguucauguaugaaugcugcagcugugaagcauacauaaauaaaugaaguaagccauacugauuuaauuuauuggauguuauuuucccuaagaccugaaaaugaacauaguaugcuaguuauuuuucaguguuagccuuuuacuuuccucacacaauuuggaaucauauaauauagguacuuugucccugauuaaauaaugugacggauagaaugcaucaaguguuuauuaugaaaagaguggaaaaguauauagcuuuuagcaaaagguguuugcccauucuaagaaaugagcgaauauauagaaauagugugggcauuucuuccuguuagguggaguguauguguugacauuucuccccaucucuucccacucuguuuucuccccauuauuugaauaaagugacugcugaagaugacuuugaauccuuauccacuuaauuuaauguuuaaagaaaaaccuguaauggaaaguaagacuccuucccuaauuucaguuuagagcaacuugaagaagaguagacaaaaaauaaaaugcacauagaaaaagagaaaaagggcacaaagggauuggcccaauauugauucuuuuuuuauaaaaccuccuuuggcuuagaaggaaugacucuagcuacaauaauacacaguauguuuaagcagguucccuugguuguugcauuaaauguaauccaccuuuagguauuuuagagcacagaacaacacuguguugaucuaguagguuucuauuuuuccuuucucuuuacaaugcacauaauacuuuccuguauuuauaucauaacguguauaguguaaaaugugaaugacuuuuuuugugaaugaaaaucuaaaaucuuuguaacuuuuuauaucugcuuuuguuucaccaaagaaaccuaaaauccuucuuuuacuacac

SEQ ID NO: 17355 - RNA, 1501 nt, Homo sapiens
aaugaccaccaaaaauagguucacuaaauuuauuuuaaaaaucauaaaacguuucuuacaaaagagcauuacauucugcacacugcucugaacagauaccagggacauguggacuauuguuacuuuuccucccugucccacccccaaguguuacagugaccacaaagcaagguguucacaauaauuacauggggggaauuuuuuuaaaccaccaacaauaacaaaaaauaaaauccacucacucugcugcuguuucaaaauuucaguguuaguuuuugcacacccuucccuggcccaacccuguuuguaaggaacuaaaacauuacaucuggugaacagcaaagauuucacuacaccucaaaugcagaacaccugugaagcagaggcguguuggcuuuuuaaacagaagcagauaacaaaaaaaaaaaagacguaguucuucacuagucuuagaaaaacuuuccagaauacugcgucacacuauaaaaaagaaaaaaauaucuugcauuauacuccuucaacaucugcacacugcuucacacuguucugcagcaaauacugugcauucuguaucugguccuguguuucucuaaugguaaugauccaaucuuccaauccuucuaaaggcucaucaauuuugaucgaagcucccgacucaugacggauuuguuuaaucugcagaccaccuuugccaauaauagauccagccaaaucuuugggaaucguuacuuguguaguaauaauaaguccaccaagauuaccauaugagccacgacccccugcauaggaauaaucauaucuggagccacccugugguucauaagccaucugccauucugaugggcuccauguaucuauugcagagucccaaguuucaucagcacugaaaccaaccaugccaugguaacagucuccaggucucccucuucugucauaggccaugaggucucccccucuagguggugguggaggaggaagaggaagauuccgagcucugcuaccacccucaccaccuuguccuggaggagguggaggugguccuugacgagggcucauaucaucauaaucucuucuagauggaggcaugggacgcccacccugaccaggaggcauucugucaaaaccaccucuuccccgcaugggaaaucccacugggcguccacagcggucaucaaacauaauuguaaaaccaccauaaucauagguuucaucauaaaaauugggaucauaaggcugugcacguccuuugaugggagacucauauauaagaucaaggaugaucuuuaugcacucuacaacccuaucggguuuuccuccaauaagaacaacucuugucaguggaauaaggacagcauuccuggaaaagcuugauggugguuugaguguucucucgaaguucuuugauuuuagcaccuucgaccccaauaauuccuccugcuagacucugaugaaucaacagccucaacucgcagucaaagucacuuccuuuauaguguuggua

SEQ ID NO: 17356 - RNA, 65054 nt, Homo sapiens
uuuaugucucagagugauccagcuaucaucacucuacuccuuuaacuucacaauguuuccguuacuguucaggaaaacauuucaaaaaauguaaacucaaagaccuaggcuaggcagacagcauuuggaagugucucaauuguaggugaggucugaaauuuuaguuuaauguaacuccuucauuacuaauuuuguugacuuuuucaaaauguaaaaauauucucaaaaccaucucuacuucuggaauauaauauauaauuauuuuaauccacauauccacucuucuuacguauauaaauguuaauguaugaaauugcagaacaguccaaaguucauguaaaugaaaacuugcuggcacaggaaaaaugaaaauaauuauaaccaggcuuaccuugugugaauagaugggugaggguugguagggggagcagagguagaacuuuagcaaacuaacagcaggaugcaucuaaucuguuaagugcucccaccaaaaauggagacuccuucaacuuuuaaaacguguccuugagaggaggcuagcuugccauauucuggcuugucucaugaguuaagacaaaucacagaggagaauacugaauguugaagucuacggaauaaagugcuaauguaaugguuaugaaagagaucacggucaauauucucuuucucuguaauacuacauuuuacagguaccuugugugucuauuagagcaauagacacuaaauuggucagccaccuggaauauauguuaaaugacacaaaguuguucuuauuacuaaaauugauuggauuccauuauguuuuaaugucucccuaauuuaaaucucuagacuauguaauacaucuugucaaaugcuccugacauauagacaccugcugcacgaggaagaaugccauacauuaaucaacgagucaacuuagcaaaucauuuuagauuuuauaauuuuuuuuuuggaauuucacacagaaugcauguuucaccucuguaaccuaaaaauguuuacgauaauuuaaacuaaauucaugccauuuuauagaacacauaguacugcauacaggcaauuuuccacuaucugugccccuggaagaggcagagccacagaugacuuacaacagaauucuaaagcucuuuuaaugcuaauccaaaucacugguauuugacuuaagaugcauuuuguuuuuuaacuccgucacugcauuuugcuuaggguuauauuaaauuauuuuguggccccaaagcuugacagaugucagggcuaagggugcuuggaauuaaaagugggaaauuaaauuaccaguaauugaaaguugaccuuuaaaaugugcuuacaaacccaucaucaggaggauucucuaagaacuguauacaagaggcugcuguuucuucaauggauuuugaccagccaccaagauuuccagcaaaguaaggaaggaugcuagcagacauaugguuaaaguaagauaccuguuucaaaaagaaaguacaauauuuuaauuucuuauugacuuggagcuuuuucaagaaaggaucugagucuugcugguguaggggaggcuaagacccuaaucuucugggggaccuucuggaauagaugauccgaaaggaugaccuuaggauucccauaguguggacacaaauuacaagauuacaauuaauuaggacaucuggguaaauuaagagauuuuucgcuaucuggcagagccaauuaaucugcagauguuucaucaaacuuacgaugcaugaauugcugucaauagcauggaugagaaauccggcacauaugauuucacuucugauguacuguggagacggggggaccgauggcaaaaugaccgacuucacugccacuguguaaguguuacugaaagaaaacacuuucuaagcucuugugagaaauaaagaauaguuguuagaaaauaaaucccuauaguuaacccaauuuacuuauacagguagaagugaaacuaugaaggcccagaucuucuagaagaguggucucaucagaaaacacucuacaggcuaccuucaagguaggaaauaguguuuucugccuuagaauugcauauacaaugcuuuguguaacuccaugaaacuggagucaaccaccaaacugaaguuuuauugugcccgacaggguuguaauuucagccuccuuuccuuuuuaaauuaaaaaacaggccgggugcaguggcucacgccuguaaucccagcacuuugggaggcugaggcaggcagaucaccugaggucaggaguucgaggcuauccugaccaacauggagaaacuccaucucuacuaaaaauauaaaauuagcugaccaugguggcgcaugccuguaaucccagcuacuugggaggcugaggcaggagaaucguuugaacccgggaggcagaaguugcagugagcugagauugugccauugcacuccagccugggcaacacaucaucuaaaauaauaauaauaaaaacaauacccauuguuguuaaaagaaaaacucucaacaauagagaacccuguaggcuacaaaauaaaaaucuuccuccaguccaauugcgcucccaugcuauuuucuacccuagaagugaacacgcuuaacauuuuacuguauagcccucuagacuuuuuaaaauaaguguauaagaaugacauuuauauaagcaaaugcacacaaaauuuuuuacauaaauaucauuuuacaaauauugacuacaauuugauuuuucauuuagcaauaaaucuuugaagguguuucucuaucagucccacuauagcuccuucauccuuuuuaaugaugguacaauacuuuguaguauggcucuaccauaauuuauaagauggauuuuccauuuguuucuaauaucuuuugacauaauaaaugauacaacacugaacaucuguuaauacucauaugugugugggauuauuugggacaguuucucuuagaagcuagcugccaugcucugagaaguucaauguacauggaaaaacuaugucuggauacucugaucgacagccccagcugacaaccagccaugguggaugucuagcauagucaagccuuggugaauucuaaaccaauuccugaugucuuauuuggcuuccacgacauuuuuacuaaucaugguauguuucaaagguuuacugaauaccaguuuuacauuuacguaggaaaaggaacuacuuuaggauucuugcauuguccuuugcaaacagcuggcucuuaauagaugacuguuaauuuuuaaaauaauagcuaaagauucaucuagguauaauucaaauaaacauaauucaagagcagaaauaucuacacagacuucauuauuuucacaucaacuuuuaauuucuauccuauacuaugaaauauuaauagaacacuuggacugcauauacucacccaucuuugagggguuuucuucgugauacgaguacuaccaagucuuuggguuugucaucauucaguauaggacaggugaugugauacagcugaucaucuucacucacccagucuaugacuucacaggaccuguguauauagaacagugaaaagcagguauacuuucuaccugcucaggcauucacuucccuuauuugcuuacauaaucucauuauuuguauccauauuugccccuucagcucaccuaaucaucucccuaaaagccagcauuauugcucaagucugccuuuagaagagcucuuugaggguaggcacaguggcucaugccugcaauccuaacaccuugggagucugaggugggaggaucacuugaggccaggaguucaggacuaaccugggcaaaaucuugcaaaacccuaucuuuauaaaaauuuuuuaaaaaauuauuugagugugguggugcaugccuguacucccagcuacucgagagguugaggugggaauaucacuugagccugagagguugaggcugcagugauccaugacugugccacugcaguccagcuuaggugacacagugagaucuuaaaaaaaaaaaaaaagccacaacaaacaaacaaaaaacgcaagagcucuuugaucagaaggaauaauucugcaagugauagaggaugguggccaucugacuucaaguucauaauucucaauacuucagugaaaggcauugagcuguuuuacacaaaauuauuuuucuccaggaucaaguaaaaacauugugaggacugguaaaucauauagucaguccaagaaggauuguuuauauagauaaagaaaugugguauauuggaaaccgcacuagcuuuggagucacacaacuuucuuuugacucccagauugccacuuacucgcuacauaaguugcguuaggcaagucauuugauuuuuucaucuguaaaauuuagauaaugauacgugggguuauugcaaggauucagugaaaacaccuggcauaguaccugaaucauaguacauguacaagaaaaguuaguuggauuagaauucauucauucacuccccaauuuguucaacuucaauuuggcuggaaugucaagugacauagagauagugggagaaacauuuuuaaagcauaacaccaaaguuuaggcauuguuauuccuaaaagcuuguacugguagaguaucuacuaaauugaugcaagaaaauugagaaguguuccucuucucucagaaugauuuauuaugauagcauuaaccacgauguaucauucugauacaggaggugggcagggaaauguuggguagggaagggcagggucccuggugagggcuccacccucgggccugugcccacagaccuaaaugaggacaggcauuucuguuuucacaccccaaaaguuaccuuuuggcccacugcaccccacauccugugcccauaaaaaacccgagacccuagcgggcuggauguugagaggaacagaggagcacacugccagacaccagcagacgcuggcagaccaucgaugguggaaagacauggaauucagucagggguggucagaggagagucugguggcugggcagccugacuccagaagaagaccaccuucccacuccauccuccuucuggcuccccauccaucuugcuaaaagcaacuuccaccacucaauaaaccuugcacccauccuccaaggccacgcgugagccguuuuuuccaguacacuaacgcaagaauccaggauacagaaagcccucuguucuugcaauaaggcagagggucugaucgagcugauuaacacaggcugccugcagacagcaaaacugaaagagcgcaucguaacacacacccaccggggcuucagaagccauaaacagucaacccuagaugcugccguggggucagagcucaaaaacacuccccacgacuuaagcgacuuaagcgucugcaugaucccucuagggguuugagcagcacggaagaaacaagccacacccuugucgcaggcccuaugaggaggauaagggaacuccucccauuucaacucuagcaucugugccaauguaacacgugaccucagagauguuucacuuuagugguauuaaaucauauguuacaugguauuucuaaaucucuaucacagugaguuuuagaaaauuugaagaugagccucuaucuugucaagauuaggaaacgcuuaacacauaggaagcccaucucaucaacucuuccgugucaacaaggugggccaugaagcccugcggggugcuauagccaagguggcugggccccagugcagcuggucucugucagugcaguuggcagggugcacagcucuguacuguguuccaggaaagggcuggggaguggaggagauuggauuagggaugcaggagacagggaguggcaggagugggagauguaggcuaauaggagcagggacaucaucaggagggggagcaggaaggcaugccuuucaccucggggcucacacagcuugcucucuuagcuucucaccagggaggguugcuucacagaaaaguaaggaacugccaaugaaauauugagaguaugcaggacaauuggauaaucacuuccucaagagcaaugagguugcauauuaaaguagaagaguguagaauucagagcaugacagacuuggguuccaguuuggguuccaucacuuuauugccugugcaaucuuggcacgucucagaaccucuuaaauggaaauaauauugaccuugaaguuacugguagaauuacaauagauguguguaaagcaggucaacucaauauagaugauaagugaguauaauuuuuguuuugugucucucaauaucaccugaugcaguauucuguccagaucaaacuuuauuuuuauuuuaauuuuugacagggucuccugugucacccaggcuagagugcaguggugugaucuuggcucacuguagccuugaccucccagacucaugcaauccucccaccugggucucccggguagcuaggauuacaggcaugcaccaccauguccagcuaauuuuuguguauuuuauagagaugggcuuucaccauguugcccaggcuggucuugaacucccggacucaacuauccaccugccucagccucccaaagugcuaugcugggucaaacuucuaaaaauacucuuuaaacaaugggucacacauuggacgauggagauggacuucaguauggagaucaucuuuuacauuaugucaagguugauugagaaaaauuuuuaaauuuguucuuacacaaaaugggggucccacaaaggucgcuuuguaaagucagacaagagacgauaagccaaaugugcuggacuucccacgugcuuuucaacccaaacagauaaaacaucaugcucuuccagaguauauauuuuuaucuaaaagacaacaaaaaaauuaaauuacgaaagaaaacugaugcuuuuacuuuagaaaccauaugcauauauauguagucauagaccaauugcacuaacuaaggcaucuuauuuccuggaugaaauugaagccccauggcaauuucucuucaaauacugggaugucuagaggucuguccaggaugcuguagucucguguccucuaaacaauaugugacuugagggugggcuauuuaauuauugcacaacaguuuuuuuuuuucucaugaaaaauguaaaaaccuaggccuuucucuccuugucucuuugugauguuucccugccucuacugaggaaaaaaagaaaauaucaccagacugcuaggcaggucagcaccucaucucccucaaaagagcagagucaaggcuauagcuuaggacacuuucccaggaugucaggcgugucuuuaagugggccaaggggauccaggaacugaaucaaccacuucuagaaccaucucagccucuuagcagggccccuggagcaccauauuuccucagcacgaagcacccuuucauuuccgaaucacaguggcuggaucauccuucugaaaggccaguuccugguuuccuaaugcacauuauuccuuagguaagaggaggcuuguccuggggagccauuugacauauacuuaagcaugaaugcaucccuugcuacucugagcuuuucuucuacuguguuuuugacaauaaucagagauguguguucagcuaagaacacauuucuauccuucccguuuucuuuaucucuuucaggauacuuugaaguuaguguugaaauuugcuaccuuauaaccauucccauggcaacaagcugugagaaaacaaacaaauaugggguuaggacuucacugcaggaaucaagcagaugggaaaaaucaggcuguaaaggagaaggcuuuauuuaaacauaaauaucaucaauaagagaaugagaaaaugagaaauuaacuacaagcugcucagaaaggaaacaagugauuauuugcuuacaccauuuaaccucuccaauugaacuugguuccaagccucccuuuaaauccagccugcaaaggaagacaugacugaggcugugagcacuuaucaaacaccaagaaaacuagggauggggcuccagguggcuggugagacacacccuacuuagcaugggcaugccuaacuuugcccccagcacagggggaguugaaggaguuucauugguguauauccagagagauuaucagauucaucagucauccaaucggugguugguagguaaguggcucuaggauggccugcuggggcucugcaaucucagaggagcugagggcagguggccagggugaacuccauagugccaguccuaaucugcccuuggggcagccaugcuccauucugguggaacaagauggagugggaugcaauauugugcugagcacuuauuaagaguugaauuauuucucuacccuuccacccccaaauucauaugcuguagccccaaccuccuguaccucagaaucugaccuuauauggaaauggggcucuugcagauguaauuagucaagaugagguugugcugugguaggaugggccccuaauccaauaugacuggcauccuuauuaaaaagggacauuggacauagacaugcuuauagggagaacacaugugaugacaaggguggagaucuggugauguuucuauaagccaaggaaugccaaagacugacagaaaaucaccagaagcuaggagacaagcauggaacagauugucccucacaggcucagaaagaagcaacccugcugacaucuuggucucagacuaccagcuuccagaauugugagacaauagauuucuaauguguccacuacccaguuugugguccucuguuauagcagcccuaggaaacuaauacagcacuuuucugggggugcugcuccccagguugcagucacaugcuucugcuuccuauccuggagccaaaccaaacaucaagcuaaguuguaaccaccacugaauucugcccuuacagagcucacuugacuuauccaaugucagguacaguacuggaugagcaaauucgauuuugaucuuuccccuagaaggugaggguagcagaaaguccccguugcccugcuguauaaaucaaugauauugaugcaaacaaagcagacaaggaaaugcaguaguuaguuuugguucucuuuaaacccugcuaauaaaggccagcuuuugcuuagugaaaaaauuuuccaggaacaauucuccaagaaaaugaauuaccuuucacauuugggaauauagagauucaauuuauuuauuuauuuguaaccaacugauauggauuggauuugugauuucaaccaaaucucaugucgaauuguaauccccagugcuggagcagggaccuggugggaagugacuggaucaugggaguggacuucccccuugcuguucuugugauagugagugaguucucaugagaucugguuguuugaaaguguguggcaccucccccucucucuuccuccugcucuagccauguaggacgugccugcuuccucuucaccuucugccacgauuguaaguuuccugaggccuccccagccaugcuuccugugcagccuauggaacccugaaccaauuaaaccucuuuucuuuauaaauuacccagucucagguaguucuuuauagcaaugugaggaugaacuaauacgccaacucaaacguuuucuuuaucauuugaugguuggagaauuucauucuacgaaaugaagcuuaaagcaagcaggcucaaaaucugcuggaucuugcuaacauuuuauuagugauaucauuguuuucauucuaauaagauucuuuuugaauuugaauuuaaugucuuauacaaauaguauaagagggcuugcaaucccaacacuuugggaggccgaggugggcagaucaccugaggucaggaguuugagaccaaccuggaaacauggugaaacccugucucuacugaaaacacaaaaauuauccaggggugguggcacaugccuguagucccagcuacuugggaggcugaggcacgagaaucccuggaacccaggagggggaguuguagugaaccgagaucacaccacugcacuccaaccugggcaaagagugagacucuaucucaaaaaacaaacaguacaagaggaaacaacuaaaaauuugagaauuuuuguaccaucuauugacaaauauguuauggagacuacacugugguaaagagggcaaaagugguuuuuacagaagccuaggggagccuucauuuucccuggagguaucuggagaugaccacgggggccaagcgggugggggucggaagggcggagcucugggcccagccccucccccggcuccaugagaauagcuccccucuggucuguuuccuauacuaggggucuguccuauguaaagguuuucaagugguucaugucauucuggcuuucaucauaauuuucccaguacauccccaggucuuccuuaaauaaaaaguuacuccugucaggccagucuccuacucaaugcuaauuuccaccaggagaacuuggcuuaaacuacccacugccuagaaagcccuauuucucccucagcaauccacuccugacacugucuucaaggagguaagaauggccuccucucuaaaguucucccuauauaacugucuucucuuggaauugccuauaagagcugacuuuuaugguuuaagcacuguaaucucucacuuguuaauaaacgaccuuauaauuauucuucagcuguuucacauaccugugugauguuuccaaaauauacauuuugcuccuuguauuacuacuacaauuaauucuaucauuauacaugaaacaugaaacgaauuaaaaccauaagcccuauccaauuucaucacauauacuacaaucuuaaauuuuuaccaucuaauuuauauugaaaaccuggaaaaaacaugauuuuuuuuuauagagaugaagucauuuuauguugcccaggcuggccucaaacuccuaggcucaaacaauccuucuaccucagauucccgaguagcugggacuacagguggaugcugucagacccggcuuugaggaaaguaugauucuuuuuuuuuuuuugauauagggucucacucuguugcccaggcuggagugcagcugcacaaucucggcucacugcaaccucugccucccagguucaagugauucucaugccuaagccucccaagcagcugagauuacaggugcccgccaugacacccagcuaauuuuuuauuuuuaguagagaugggguuucaccauguuggucaggcuggucuugaacuccugaccucaagugauccacccacuuuggccucccaaacugcugggauuacaggugugagccacugcgccugcccagaaaguaugauuguuuguuguuuuguuuuguuuuguuuuuuugagauggagucucacucuguugcccaggcuugagugcaguaacacgaucucggcccacugcaaccucugccgcccagguucaagcaauucuccugucucagccucccaaauagcugggauuacaggcgccugccacugccccugucuaauuuuuguaguuuuaguagagacaguguuucaccaucuuggccaggcuggucuugaaccccugaccuugugauccaccugccucggccucccaaaguguugggauuacaggcgucagccacugagccuggcccaaaaguaugauucuuaacagacaacuguguuguaagaauuauuccacuaaaagguggcagaaaaaaauuagagucauauuuugaaauuaaaaacauauaagcuguaaaacgugggagagaagaggaggaaaacucuucaaaaacaucuuuuaucagauuuuuaaaaucagauuuuuaucauaaguauaaucuuuaaaggagaaauucaaauucaauggaaauaacacaagaauauuacuuuauacaauauccucuaguaacuaucuguauaagaaugaagaauuaaucauugauagcucucccacaacacuagcaaauuuauuuggguaugcuuugggccacacccucccaaagaacugcaguuuuaauauauucuacgacuucacuaaauauguucuuucaguucauuccagacaugaauuuguucuuuccacugcugcucaugaaugcucagaugccagcaaugaugaaagaaguaaguuuuauaauaguaaaagaaaacaaaguagugaagcaucuuuuaugaaagauaaacaaaugcauuaguuaaaccuguguuucugcaucacugaaccaggcaaagacagaaauuuaacuggauccaaaugggauaaggaagacuucuaaaggauuuaauaaugaggacagagaacucauaaaaggaaacaaccaaaaacaaaacauucagaagaagucaaagucagaguugaaacgaaucaaugaaguagcaucugaauuuacuuagauuuaaagguaaaguaacaauauaauuuaucauccaaacuggaacaccaagagacuguuaauaauuaugaugggacaacagguguaagccagagcugucccaggaaaaucaggacauauggucauccuauuucauaggcugcugcuucacugaugaugaaaaucagugcauacugaaauaugaauguagccaaagugcuggcauuagugagcaucucugaagugccaggcgcuccuauggucuggguguaguggugagcagaucggcccucagggagcuuacagucuaguuauugugggcaugagcuuccgagggucuccuaaaaaaccucugaaaauagauaaaauuaugauccaaaugauguaugucucuuuaaaccugauggcaugcaaaacacuguaauagguccuaagagagauacaaagaaguccagacaaggccucuuucuuaagagguuuauaauguacuuagggaaagaagaccauguguaaaaaguuaaauuuccauguaaggcuuaaauauuaauuugagguagcuguggaagaaaugucacaagauaguguauaauuaauugaccaauuauuuauuuauuuauuuuuuuuagagacagagucuugcucuauugcccagacuggaaugcaaugaugcaaucauagcucacuggaggcugaaaugccugggcucaagugauccucccaccucaaccuccuggguagcuaagacuacaagugucugcuaccacagccggcuaauuuuuaaauuuuuuguagagauggggucucauuguuuugccugggcugguaucaaacuccuggccucaagggauccuccugccuuggccucccaaaguacuaggauuacagacgugagccagcacacucgaccaaaaaaauuaauuuuaaagaagucaugacaguuacuagaaaaagaaguccuuaagucaaguguggcaguugaggcuuuauggagaagcaucuguccugaucuagaucaggugggauuuggguagauggagaagagaaggagggagagacgggaugugagaaccuaagcucagagguaggagcauguuggguauauuugaaggacuccaaaucaaccagcuuguagagacagggcugaaaagaugguugcgucuuagaaacaguuuccucaaaagauuuuguuaccuucuuaaaagccucaguagaagcaguagaaccaccaccaccacagcuuucguuugugaugggcgauggauuaugcaaauaccuggaaguguccuaccuuuuccacagugcugguaaccucccaaccccuuuuggcugccaguuuuuugagggccuccacauugcugucacucagggaugccuagaauagaaauauuauauuuuuaaagcuauguguucaauacauggaugugugaucauauauuuucugcuuaaaaaaugggcacuguuggaggagguauguguugaguccuagugauaauguugaguuuagaacuaaacuacaggccaggugaaguggcucaugccuguagucccagcacuuugggaggccaaggcaggcagaucacuugaggauaggagcuugagaccagccuggccaacauggugaaaccccauuucuacgaaaaauacaaaaauuagccggguguuguagugcaaacuuguaaucccagcuacuuggaggcugaggcagaagaaucgcuugaacccgccaccgggaggcggagguugcagugagccaagauugcgccacugcacuccagccugggcgacagagugagacucugucucaaaaaaauaccaaaaaaaaacccaacaaaaacaaaaacaaaagcaaaaacgaaaaaaaaacaaacaaaaguaaaaagaacuaagcuacagguaacauauacuuuuuaucuugaacccuuaauucagaauucagacaaaguaacuguauacuuaacaacugcguaucauuuuaguaucauuuuaguugguguccugagcaaagacagacuaccuuucaguaugacugauaaucaauguguaauaaguaaacuuggauuucucuuuacauuuaaugguuaaaaauauucaaaugacuacuacuuuguuauuguuuuuauaaaaaugcaagcuggugggcacaagucacggugagauaccagguggcacugugccaugcuucuggaacauaucugauggcagagcauccugagucugcaguuugggaacuguaagaagucaaacaaggcuaaacugccgauugguaagcaguaacugauagccugguuuuguuucaucuugacaugacuggcugauauaauccaccuuuucacauagccugcguaggcacagccuaggccaguuaggcaagcggauuuccauuuuuguaaugaugagacuuuuauaugaagagcuccaaaucacaaaacaucaccugcuugcugauaucccaguguaugcaaaguggaaccucuucuuugugggaaauaacauauuuucuggaaaaaaaaauuaaaguguuaaaugacaguuuuuuucucugcauuuagcacacaacaauaaccauaauacuuucuugaacuucuaucagccauggauaucaguggaacaacguggaagaacuauuuccauaagucaguagucagccuuugcggccaggaaacaucagaccuucucuuuuuccguuacgugggaauagagacccagaggggggcucuuauauaauuugucagauuaacgaagacuccauaaaaucauuacaccuuauguuccuuaccugccuaggcgaauucgcuugcgugcaauagcuccccgauagcgucugaaaucauccuuuaaucaaaaacaaaguaaaaucaauaaaauaaaauaaaauaucuacuaucuuagugcuauaauccuuaaguauccuucuccuaaaucagucaaaagggcuaacugagauguggugucucuccaugaacugacuucaucaagucagagucucugugcugaauccacaaagggcaguugcacugacaaaggugcaaucuuugcagcuauuuucuuccuuuucucaaaaguggagauuauuaacauuccuguuaccagaauuauacuuaauucucacuacagaguuuuuagaaaaaauuaacauuggcaaucagguaauuuagggaugagggaaagauaugguuuccaugaaccuggcacguggcacagcaucaagagcuagaguuaaggaagugagagaagagacccagaaacaggacauagaaggugacauccuacccacagcaguguguagcccgguagaggugaggucuucagggcuuccaucauuugaacaaaugaucagagugaucggggggaaaaggaaaagaaaaaagcccacuucacuuugugaugcugaaaagagggaaaaccaaagggaaagagccaaagagguuguugccggugggaggagauucuagguagagcucucuauucacagguccggcuauugaaccucgugugauaauaacugaccuuugaaauggguuggauucugggaaacgugaugagauuuuccuuaucaucagcagcauuguaaaugagaaaagcacuguugaugugacgcccucggcccucggcccauuccugacagucaaaggccuccacgcgaacuccaacuucaacacugugaagggugaugcagggcggugggcaaagaggaucuugacccaucaggcccuccuugcacaccgcugccaccuccucgcccaccgcugccaccuccucuaagcaacaggaggauaagggccuggguuuucuuguuuguuaucagcaaaccugugcaacuauuaaaauccauuuucaggucaaugggcugcuuuuuacaagccccuaagagcauuuccauuuuacuuccccacuuucaagugggaaaaaggccaggaagggcuuuauauacauucaagaacauauuuuggcaaugugggggagggcuuaaauuaugccaaaguuaaguuuucuucccuaaaaacaauaauucuguaauuaaaaaauaaacacugaaauuagacaggaaacacagauauucauuuuuacauuuaaaaagaaaauaauacuaaaucaaaucuuuucauuguguaucaagaauaauaaaaauaacugggaagugguuuggauuucauggugguaauaccagguccauuaugaguugauugaccaucuagucacugggacugaaaggaaaaguuaauaauuaugcagggaugacagguacaaaccagguccuacuugggccaauugggacauacggcuacccuuauaagacaaaaaccaguccuucacaauuuacuaauugugaaaaggccccaagcagaacaaaggguuaaaaauauguucauggauuuugaaaauugcaugaaaaaaauggaauuucacuaaaguaguucccauacucaccuccaggcugaaauuaaaaauuacauuugugcaaguuuaaauuucuucauagcagccuaagggcucacuuuaccaggucugaaauguauuguugacaauggcagugaagacaagacgaucuccaacuguagaugguccccggaacuuaaacauaucuacggacuucagaaagggaugagcccaacacaggcggcuggggagacaaagggagggagagagaagaaagcgaucacacauucauucaucgaacaaaugcacagacaagucuucaaauaagcauuucuuuaaauuugacugaaauaaauaacuggauuauguggguugaggguaggucugcacgcuaccugccaauauuuugggaaauaccauguccccgagcaguggggucuuuacccagauguugaugcuucuacuccuuugguaacaguccuacucuugucucguuuccuguggaagucccuuggaacaacaaaccaaugcuuuuuguucuaaucugaauuacagucauccugauagcucaugacuguagucccaagaaguucugauccagguuggagugggguccaagugaaggcagguguccuuacacaauuccucagcuuuacaguuaaucaaauucacccacagaucaaaagauaaguuuuuuccccucacagaaaaauuaccuggauugcuacauaaagccugaaaggcuaggagauacacauuuuauaauuuuuguguguaugacacuuugaaauaauuauauauaauauuuaauuucagaaaguuacuuccauaauuuucuacauuuuagauucccagucaucauucaauuacucugugccaacaccaagcgaacagaugcugccauaagccuuuacaauagaacauguucaauugcuuuacugucacuaagaaugacaaucucauuuuaaaaacaagcucucuuauuugugcauaauuuuuagaaaggauaacuacugguuuguaacuauagucauaacuauagacauauuaauaauaaaauuauuuuaauuugagggaaauacaaccuuaaaaauuuucaaugguuaugaaaauugucagaagggcagauccuauucaaaugcauuuacaggguacagaguguucccuaaaacugcucaauuaccuacaucuuuccauuaagaauaaaauaaccuuuuugaaauugaggagucuuuaaaaguauucuaaauauucucuucuuucuuuuccuauuuuucaauuauuucuuuggccauaauuauuuuuaaccagcaccuuuaaaggucagaccuaacuguaaauugucuuuaaaaagguuuguaacuaacugacuuuauuuauuuacuuacuuauuuauagagaggcuggagugcaguggugugaucauagcucacuguagcuuugaaucccugggcucaagugaucgucccaccuccgccucccaacuagccaggacuauaggugcacaccacuacaccagcaaauuuuuuuuguagagucagggucuugcuauguuucccaagcuggucuugaacuccuggcaucaagcaaucuuccugucucggccucccagagugcugggauuauaggugugagccacccugcccaaccuagacugauuauuuuuaagugugaagccugucuucuauuucuguucugcauuuacuuugucauaagcuaucaagacaaugaguugcaguuucauaagaucaauauucauaauucagaauaaaguauuaaaacugucaucucauuuuuauuuuugaaccaaaauauuuaaacauucaccuucaaacaaaaggacagauuaauccuaaaguaagaaaguaaaugauuuagaaaucauuauaaaaggcaacauuuuccucaguccuuuccuugacuucuugacuaucccaagaacuggaucucagucccuuucuacuuucuccucacuggucccaaaaucauaggccgaaggucaaaaccaagaaccuugcagaaauaguagccacugucuccauccacgccauaaucuggccaccaaauguauuuccgugaugguuugcauggggugggaggaccaguucaaugcucugaacggaggugccccuuguggaaaccgcuccuuccucuucaucaaaaaugagaucugaaagguggauguaaacauuaaugaugguggagugaaccauaggcccuggggcuccagcuuuuccuucccggcaguacauucaacucggauuuauagaaaaauuaaaguguucucaaagccuuaagacugagaaaauugacagguucuacagagugacucuuaucuuaauggugaauauuugcaaugaauuggguuaagauaaucagaaagggccuuuuagagauuguauucuagccuauaaaauaagucuauuggaauuuugacuaaaagaaugguuacacugaaacuugaguuguuuguggugggguagggacagaucaggacaggaaggggcagaaauguugggggugauggauaugucauuaucuugauuguggugauguuuucacagguguaaacuuacuucaaaacuuaucaaauuauaugcuuuaaauaugggccauucauuguuugucaauuacaccacaauaaaguuguuaaagauaaaggaaucugagcuacaaaggaccagagacaccaggaagcuugaaacacuaccuucagaauggaaauguggccuccugcggaaacuguuuguaaugauugcagucacaagcaggaaagacacaaucuguuauacuucuucauguccuucugcucucucuuuuuuuuuagacagucucacucugucauccaggcuggagugcaguggugcgaucucagcucacugcaaccucagccucccagguucaagcaauucuccugccucggccucccgaguagcugggcuuacaggugcgugccaccacgccuggcuaauuuuuguauuuucaguagagaugguuuucaccauguuggccaggcuggucuugaacuccugaccucaggugaucugcccgccucggccucccaaagugcugggaauacaggcgugagccaccgcgccuagcuuucugcuucuuuugaaucauaucugcuccguuuacuaacaaauugguuuuuacucuuaacaauggaaaaaucauuuacucuggcugcaaagcaguaaaauguauucaauuaugcuuuuugcaucacgaagugaaccaccggcuagguuuccaucucacaugcuauuguugggaaggagggggaaaggauuuacaaacugggacaccaucguggcuguacugucagaggcagagcugagcuugcagugugagagggaagauaugcccagcaacuguugcugcucucggcauagucacaucuggugauccagaaggguagucacagaaacccuuaauuccacuuccuaauguaauuuuuagauuuauaauuaauugaugaucucuuuuauuuuuucuuauuuccagugaucguuucaguccccagcuuaaaacaagucaguagcuacccauuguucucguauaaaaccccaaauccuucccauggccugcaagcccugcauuccuggucuggccucacucucccucucccuuugcuccagccacgcuggucuuuuuucacuuccucugaggaaguauuaccuucaacaacagggcauuugucacaucccugcugucuacggcaaucccccuggccaccaucaccugugucuucaauuucacucauacucuguggcccccccuuggucauuacuuccucaguggagccuucucugaccuccacagcucagccccaccuucagggucucuugaaggaucuuucuuucauggcuauaguuuuauguuauuugugugcccuuuuauuaugugacccacuagauccuaagcuuuuuggugcagggacuauggauuuuuaaaauucucauauaauuccugaacauaggugcucaauaaauauuuauuaaaugaaaugaaugaauaaacuuaacuuagcugauuuccuuaacauucauaguccuuacucucaacagaauauuuuuagguaauaaaauaguuguacugacacuucugucugcuguugaugagaguccccacugguccccauuuuugcuuagaaguaucagacacucaacuauuuccaguuugguggguguggaagaguaucucacguugguuauaauuugcauuuuccugauuacuaaugaguuccaacaucuuuuuacauguauauuaaguauucuugucaccucuucaugaaaugucucuuuauaucauuugcuucaaauauugcuugucucauuuccggagaauuuuuuugcauguuagacauuucucuccauucuucauguuuccuaaccucccuuacauguuccccaucucuuugucuaucuggcugcauucuaguuaacucuuucagaucuaucuuccaguuccuugucuuaucugcuguuucauucauucacugaguuucaaauuuuaauuauuauauauucuuuuuuauagaaaucgucuuuguuucuuuguuaaaccuucuagguuaucuuuuuuguuguuguuguucuugcauuauacucuugauacucuuuuauuucuuaaaacauauuaagccucuucaucuuacuugauaaauucauuaucugcugucuuugugggccucguucagacuuuguggggccuggugucacuuccagaucuugaagccuugcuuuauuucuaucuuuuaugauuuuucacuaggaucucauauugcuuggaucuuuuucuguggaaauucuugggagcuggcuuuaaagucauuucuucacaaaggagcugcauuugcagcugcagauccccugggguccuacaacacagcaccacuuuacacuaaaguuuacuuguucuguuuuagcccagacaggucaugugacuucugaggauccaaaucuucaugaggaugcacuugugauugaauucugaaagggagagaauuuuuuuucccauuccaccuaaggcuaaggcucucuggaggguggaauuuuucugguugacucacugagggaaucaccuuuuggagguuccagcaccaaggaagguucccugauccaaccuucucccucacauggacgccugguuuugucuccugagcccaagcaggcccaccugcuggguccuccaggacaaaugccagcccccaugcuuccuugcacugcggcauuuguguuuucucaccauuucuggacuucaaaguuuucucuuauuuuucugccugcugagauguguuugcaaagauguuuguaaauauuuuuccagaaauuuuugguuuuacccaacaaugaauccacuauauugcuagaaucaaaauggaaucacuuucuaaagugaucuuugaaagaaauacacaaucuuaaucccuuucaauuucucucucuuucuaaaauugauuuuauuugaagauguuuuauacauaucccaaacuaguauuuauugagguuguuuucaggcuaauguuacuuacucaaauggcacauuuuuuguuuaaaauaaauuaauacaauuaucugacuucaaauuaugcuacagaguuguaguaagcaaaacagccaggcacuggcauaaaaacagacacauagaccaauggaacagaacugggaacccagaaacagauucacacacccacagugaacucauauuugacaaaggugccaagaacauacauuggggaaaggacaaucucuucaauaaauggugcugggaaaacuggauacucauaugcagaagaaugaaacuagaccacuaucucuuaccauacacaaaaaucaaaucaaaauggaugaaaggcuuaaaucuaagaccucaaacuauaaaaccauuauaggaaaacaucagggaaacucuccaggacauuggucuggacaaaaauuuauugagcaguaccccacaagcacagguaaccaaagcaaaaaucaacaaacggaaucacaucaaguuaaaaagcaucugcacagcaaagaaaacaaucaacaaagugaagagacaacccacagaaugggagaaaauauuugaaagcuauccaucugauaagcgauuaauaaccagaauauauaaggagcuuaaacagcacuauaggaaaaaaaucuaauaaucugauuaaaaaaugggccaaagauuugaauagacauuucucaaaagaagacaugcaaauggcaaacaggcauauaaaaagguaucgacaucacugaucaucagagaaaugcaaaucaaaacuacaaugagguaucaucucaccucaguuaaaaugccuuuuaucccaaagacaggcaauaaccagugcugguaaggauguggagaaaagggaaccuucauacacuguuggugggaauguaaauuaguacaaccccuaugaagaacaguuuggagguuccucaaaagacuaaaaacagaacuaucaucagauccagcaaucccauugcuggguauacacccaaaagaaaggaaaucaggauacugaagagauauaugcauucccauguuuguugcagcccuguucacaauagcuaaaauuuggaagcaaccuaagugucuaucaacagaugaaugaauaaagaaaauaugauacauauacacaacagaauacuauucagccauaaaaaagaaugagauccugucauccgcaacaacauggauggaacuggagaucauuauaagugaaauaaggcacagaaagacaaacgacaaacauugcauguuuucacuuauuugugggagcuaaaaaucaaaacaauugaacucauggagauagcagaagcaugcuuaugagaggcugggaaggguagugggaggguggggaugguuaauggguacaaaaauauaguuagaaagaaugaauaagaccuaguguuugacagcacaacagggugacuacagucaauaauaauuuaauuauauauuuaaaaauaacgaguaucauuggauuguuugucacacuugaaggaguggauaccccauuuuacaugaugugauuauugcacauuuguaugcuuguaucacaguauuucauguaucccauaaauauauacaccuacuguguacccacagaaauugaagugugugugauagugacggucucugaaggugggaagugagacgguaggcagacuuacuuuuuaacuauaugccuuuuuaugcguuuugcauuuuuuacccugugcauguacuaucucuuuaaaaauaguuuuuagauaauuauaaauaaaaaauuaagagaaggccuuaugagagacauuguaaagacucaaauauaaagcagcuccuucuuuucugagggauaacuuuaaagagaaaccacauacuuccuaugaagacauauacaguauauacuggaaccuguagagggaggugcuaggugagauuauacgugcaccagcaucagcuaugauacguaugcagaaauauauugaguuagaugacuuuggugcagaaguuugcuuauuuggaguuaauuuacaaccaacgaaaaaaauaggguuuucccagguucagagagcaauucaggcucgcaguucugguuuggguuaaguaaacagaacucacccuuucugcuggcuuugagugaucaaguucaauacguguacuuuggauguucuuaaaguacugugucaucaaccugcuuugacaacuuuacauucacucuacauuuguagaucaggaacuuugaccugaauugaggucaugcuagcccuaguuuucuuucugcauauccagaaaauuaaccaugauaaugcucuuaagaucugauuuucuuacucaaaaauuaaauuaaaaugcuuucaaauuuuaaguuuuuccccuauaugucaagcuugcaaauaaugauccaguaguauuucugagaugugcgugcuuauacacauuccagaaauauccugcuuuuacaaaacuaaucucaucucuuuucuuuucuuccgaaaggauaugaucuggauucaauguucucacuguucuaauaauaugcauuuccaucauacaacaucuugaaaaauauuccaaucuuuuauguuugauauuuauaaccaacacaaaccccugguuuucuaaaaacaugguacaagaacagagauggguugguucucuucuuuuagaacacacaauguccuaucaaaaaccaacuccaucugaucuaaggagcagcagguggagaaaucacauacuacacagcggcuuuaaaugucagagucuggcucuugcauucuuuaagaugaauugcuuuuaaguucucuggcaccuuugcuggcauggaaguuaguaaaauuuccaaaaacaaaaucagaucaguggaauuagguuaaaaguuguuuuaugugaaaggauguagaauaaguuagggcagauuaaacaaagcagaugauaaaagaagacuuugagaaaaaucuauaauuugaaauugaacuuugaacuagacauguagauguagaucuaaucuggccaacuuuguaacacacugaaacucaagucaauugcaaucguuuuaucucuauauuugaaugacugucaugugugccugucacuaauuuagacuaucuccaguauucaaaguacuguuaguguugugcagacaaauugucugcugcugauuucacuuauuagugcaacuugcacaacaccagaagaagccggugcagccacccauguuuaccuggcucuuguuaccuugaggggggugugaagacagcuucagucaccauccuagcaacccuucccaauagacgaacccucgcaagggagcucaggguagcagagauccccauuccuccaagauaaaaacaugacaacaauuucccagugucuaaaguacagauuugacacgaauuaucucuuucuuuuauaauuaacuucuuccucaauaauuauuuuuaucaauuaugucuuuuuuuuuuuauuuuugagucagaaucuggcucuguggccuaggcuggacugcaguggugcaaucuugguucacuguaaacuccgccucuuggguucaagcaauucucuugccucagccuccugaguagcugggauuacaguagugcaccaccacgccuggcuaauuuuuguauuuuuaguagagacaggguuucaccauggucucgaacuccugaucucaagugauccgccugccucagccucccaaagugcugagauuauaggcauaagccaccgccaggccucaucaaucaucuugaucagccuggaaccaugaccaaauuucuccuagccugaaaaacaaugccccuugacuuugagggucgccuguagcuccaggcuauuucuuucauccuuuacagcauaguuccugagaagcaucugucuuuaacucuuggcucuaauuccuccuguggaggggaccucucaaacaauaauagaaaugacagcacuuucugcaugccugacacuuucuauauuaacucauuuaaugcucccauaaacccauuauguaaguaccuuuauuauucccauuuuacaguucucguuuuguuuauuauuuaccuugcuucggcaagcugagaaaagcaaagucagagguuuugguuauagaccuguuacaguacuauucagcauaacacagaaggacauccugucauuugcaacaacauggauggaacugaggucauuaugucaagcaaaagaaguagggcacagaaagacaaauaucacauguucucaccuauuuguggaaucuaaaaaucaaaacaauugaacucacaaagauagagagcagaaggaugguucugccaagucagaggacuugguuacagaccuggauaaaaaaagcguuggauaagaaaauaaaaagagcagcuuugugcuggggcaaccacugacuaugagaaaaagaugagccaaugcauagggccagcuccuagcaauucgccuuuaggaguaaguccggugggaggagguagcucucuccaggguggaugguuuggguugagugggccgauggaugccuccugcuuccuguggggcuggguccagaggccagagaggagcaaguuccaccuuggauggcuggagugaaggaaaauaccuugagagaagugaguuccugcuaaaugcuagugcugcugugggaaacaaugccuuaguuuuccacaaaagcaaaggcucugaacuagccaagcugcucuaagagcugcaauggccacugugucccucaccguccacauguccugcaacagaugacacucgggcuguuggggccaugaggcucgcagcucuacuucccuccccaccccccgcauccuuguacaugugcuucaaacaagccuggugauaggaguguuuacuuuggccuguguauaugacauaaagguuaugguaaacugucccucaucccauuauuccucuaaguaauuaaggucauccaagugucucccacacuucuucuaaccccacacuugccgaugucaccaaugccuuccugauucccaguccaguagacagguuuuauuccucacuuccugggacgcaguugaccacuuacuauuucuucuuguaacucugcugccuuggcgugugacacugcucucuccagcucucccugcaccccucugauuagucccuccaggucuccuuaguagguuugucuuucuggauccucucuuagaugccugugcuuugcagguucuguucuuggcccagcacccugugggcugcagguugucuucauuugaacuacuucucuaagcaguugucucucagaugaaaucuccccagcuguggucucuuccuuuuggauguccacaggcacuucagacuccauaugccuaaaacugaacucaucaucuaccucccaaaaauugccguucccugccccucagauccaugaucucaguucauggcacaacugcuaaccagcugcuccaagcagacacccaggagucagccuaugcuccuucuuccucgcccuucuccccacagccaaucggugacccuauuuuguuggugugaucucguguguauuuuuaaacucuuucccuccugucucuccccacuaucacugccugguuuaggcaccccucgccuuucgccuggucucucucccucuagccagagugaccauauuaagugcaaacccagucaugccccaacccugcucaaaauccuucaauggcucccaucaagaacagaagaaaggccaagccucucgacauggcccagggagccuccaugacacaauccuaccuucuuccucucccgccucccucuaccuugcauuuucucucuagcaauacucuuguguugguggcuucccagcacacagugugcugguucaugccuccgugccuucacccucacugcuacgcaauuccucgccuucccaacuuucuucucauagccccuccugcagcgagucucucgugaacccugaagggcccuuccucugggcucccacauuacuuagagucuacagcucucuauucacuuacuauauuauuuagaaacuauuaauaugucugucuccagcacuaaacuacaaguuucuuaagagcaaagacccugcauuauucaucuuuauaccucuaguggcaagcagguuccuggcacaugacaggcguuucauacagaacuguuggaaggaacuaccagucaguguggaagucuuuccuugcugcugagagggaaggaguccuuccaccuauaugacuaucaaugauuuuauccacaaucacacacacacacuccaucuagcaugcaccggggcaaacuggccagcaccucacgcaucacagggucacccucuuccuggugggcagcagcuugaucuagagaguuccgggcaaaaggguggagaaugaccuugagaugugauucagacgagggaugacuuggagaggaugaaagcaguucuuguaagaaucucuggauaaacaugcacagauuucaaaagaacuguuccuugcugggcgcggugacucacaccuguaaccccagcacuuugggaggccaaggugggcggaucaccugaggucaggaguucaagaccagccuggccaauguggugaaaccucgucuccccuaaaaacacaaaaauuagcugggcgugguggcgcaugccuguagucccagcuacucuggaggcugaggcaggagaauugcuugaaccugggaggcagagguugcagugagcugagauugcgccacugcacuccagccugggugacagagugagaccccaucucacaaaaaaaaaaaaaaaaaaaaaaagaagaagaagaaaaacaacuguauuuugacauugucaaucagaauucugguuguuuaguggcuuauuucuacuuucuccuuaugaacucagguaguguaauuucauugaggacagaaagcuuuuuuaaaagacauaacugcagaaaggaagaccaaugaaacuaggggaaaugcauaugccuauuaaaaacuguguuaaaugcuugaguuuccuaagauguccuaagagauuuacuugucaugcauagaacggguuugcucauuaguaaguauuuuaucugucauuucauuucuuccuugggauuuaagggaugaggagacagcaggguuuuguuuuuuauuaaugguugucucaccugccucagggugccucagcagcuucucuugguucucuugguucagcuauuucauuacuugagcaacaugcauuugaaauguauuuuggugcugagaccagcuuuauaaacggagacuugcucuucuuaacaccgucauuuaaugaugaagucuucauuuccuuaaaaauaacuuggucugggcugggcacaguggcucaugccuguaaucccagcacuuugggaggccgaggcaggcggaucaccugagguugggaguucgagaccagccuggccaacauggugaaaccccaucucuacuaaaaauacaaaauuagcugggcgugguggcacgcgccuauaaucccagcuacuucggaggcugaggcaggagaauugcuugaaccugggaggcauagguugcagugagccgaguuugcaccauugcacuccagccugggcaacaagagcgaaacucugucucaaagaaaaaaaaaaaaaucaaguugguaauggguauugcccuuugaaaggucagcaaugaguagaaaccuuugaaaaaucucuuuuucaacccguaagucuucugugggguggucccaggauauccccuggggcagaauaaaggcuuugcacuucugccauacuggcugcuaccucucccuuuccucuggccuuuccaugcacucuuucuccuucucuuuugacauccuuguucugacauguucuuguccucuccuuuccuuccucuucuuccggugccuuccuuuggagccaaggguugcugaaccuucugcccucuuggcaguggugagcuuguggggccugggcgggcucacuucacuuccuccccucccucauugugcucuccaccggcaccccuuggggcuucagaagauagggucagacaaaaagaaagggcagaggaggggcaagggcggggcucugccuuucccuaccagucuggcuccaggaggcaucaaagagcccaggaaaucacugccagagaacuaaggaaguguggcucauaaaacgcagggugauuguggaaagcaccaggcaacaggagcaggaucuuaagucucugcucauaccccauaugaucuuuagcaaauuucuuuccuacucagaguugcagcuuucugcucuguugagauuacaugcagcuccuaugaaaccguggacgagaaacugcuuaguaagccacgaagcaccgugucaauguauggcauugucaucaacccuucauucagccaucauuagugaauacaugcuuacuaaugacugccuggucccugucacccuuuuuccccaucuccuuuccuggagaucuuccaauuuaaagaggccuuaggugucagcaguuacauucucaauggccagguuucuucuccagccaccggguuuguuggaaaggauaccuagugucaccaggacugaaugguaauaauaaggugaaaauaagugugcucuaagaaaagacuccuuugccugucacaguuauagaauuaaaauucuuauaaguggauuuacugaccaucaaauuugcuacuuuccuucauuaaauuguuaaagguaucuucauguuguaaucgaacuuuccuucucucagcagccagauuauguuccacaugaucuuguucaguuagaagugugacugguuuuaaaugaaucuagagaaagaaaagcauuuaucuuuuauugccuuguuaaauuauaaaagcacagcaugaauuuugcaaaacaaaugauaugcuacaugguuuucuaacucaaguaaauagagcuuuuaugaguguuuucacuaaacauguuaugacuaaauuuuuucuuaaauuauuuuuaaacuaaaaaaaucaacauaggcguaauuauuucuucaugcaauaagauaugugcuuuaaaaauucucucuauuauuuucccugauuuuaaaauuuuucaacagaacuacaaaauaagaaauuauucauauugaugaaugaggagauggacuuugacuccacugaaaucuaaacauuuccuaucuuugcaaaauuaagaaagcaaagagagggaauaaauuuugcaaaauuaagaaagcaaagagagggaauaaagauguucuagagaaaguuaucuuauaccaugauaccaauuuggaaauuucauuacauggugaaaacauuaucuaauaagcaaaacaaaagaaucaauauguaggaauaaagcuuucaccaacuuccagaaaccuggaaauaugaggcaacagaaccaagagcucaaauucuuacauaaaugcccuuugcugacccuguguguagaaggaagggucaccuugaagcuggacugggguagcuccaugcuuguuuccaagauacucaaagucugguacggacccuuggccaagauaaggaugaaauaagcuagugaucccugggugugguggcucacaccuauaaucccagcacuuuguggggcugaggugggugaaucacuugaggucagguguucaagauuauaggugugagccacugcaccuggccaacacguugaaacacugucuguacuaaaaauacaaaaaguaaccggguaugguggagcacaccuguaaucccagcuacuuaggaggcugaggcacaagaaucgcuugaacccaggagaaggagguugcagugagccaagaucaugccacugcacuccagccugggagacagagugagacuccaucucaaaaaaaaaaaaaaaaaaaaaagaaauaagaaauaagcuggugauuuauaauaugcugcuuaaaguccaaaacugcccuggacuaccuuguggaauuugguuaggaauguguagauugauggcaugcacugguuuaacuccuuuuuuuuuuuugaaacagggucucacucuguugcccaggcuggagcacagugguguaaucauagcuuccuguaaccucaaacucuugggcucaagggauccucucaguaggauugcaggcaaacgucacuaugccuggcuaauuuuuuuauauuuauuuuuuguagagaugagggcucacuauguugcccaggcuggucucaaacuucuggccucaagcaauccuuccuucucagccucccaaagcacucagauuauaagugugagccacugcacccagccugauuuaacaauuuuuguaguguuguuuuaguugugugacuagcaggguauacaagacugcuugguaaacuuguguguugguucuccugaaaccaagauaccucgcauauguuuuggugauuucuguucugcagaaguacaucuuguguuacuaaggccccagcagcauggcugugccuggagaccuccacccucucugaggcuggccugugcuugcuuucucccuccgcaccaucugcuuuagcuuaguaaggcuuugcaugaguguacccuguggagucuugcaagucccuucaaugaucuggccugugcaauuguugaacuaagucugguuaaucauugccaauuucuuuuuuguuuuuuaaucaggguacauuaugcuuugaaccaacuucauccuaaaauaaacucacugugaacagaaauucaaguaguccuauggguucaaaccaaaccacugauuuuucaugggucucuuugugaugagcugcugaaccagcauauuagcaacuaggaaauaaguuagucuggaaaggugcuuuacaauuaagguuaucugaaccaaccaauuauguuagcaccauaauggaucugauuuuccacuuucagaacccaguucuccagucucaagagagauuggacugaagugugacuauuauauucuuuuuuuuuuuuuuuuuuugagacggaguuuugcucuuguugcccaggcuggagugcaauggcacaaucuuggcucaccgcaacuucugccucccagguucaagugagucuccugucucagcuucccaaguagcugggauuauaggcaugcaccaccacgcccaguuaauuuuuguauuuuuaguagagaggggguuucuccauguuggccaggcuggucuugaacuccugaccucaggugauccacccgccucagccucccaaauugcugggauuacaggcaugagccaccaugcucggccgacuauuauauucuuauuccacacguccaugaaguuggagggagaagucugaggcuggagggggaauaugacggucuuccucugcugccccucgcaaaggaaugggauugcaagguguauuccuuugucacuugcgcucagauacgggcaccugcacccauccccuauucucucacuuccaagagucuggagauuuguggggaugccaggaaaaacagaaugguugggaagacuaucucagugucucagauuuuagugaacacaggcuccgugggaugcuuuggcaaaguacagauuccaagauuccacacuagugauucuaauuuaguagguccaugauauggcccagaaaacugcauuuuaaaaaauagaauuagcugauaugaacuuccauuugaaaaauaacacccuugggcaauaugaauuugccuugcaacauguuuaauguuagacugagagugcaggccaggcuccauagcucacaccucagaacuuugggagaucaaggcaggcagaucaccuguggucaggagcuugagaccaaccugaccaacaugacuccuccuugcuucagaguagagcuaggagaagccacugugucuagcucugggaugauccuuggagugaaagacucauauuccagauugaauuaucacaguguuuagacuaaaugggacccuccuccaggcacccugacacugaaaaaaaaaagccaagaaauuguaaggagcaaaucuccagcagccuccagaugaguggaucuggaucguguccaggcagccggcuaggcaagcucaucaggccaaaguaucacuucggaggguguuuucaccccacaugcccagaagcuuauuuuuaaacuucaauaacucagcaauguugacaguuuuccuucagguauuaacagugguuaaucuauaacaugcaacugcuugcuaaauugcucuugcuuuuuuaaaaaaagauuuuauuuuaagucaauuuugaguuauaugaccacaaaugaaaagcacuaaaccaguaggcaguauuuuaaagaaaccaauaugaccuucagaucauuuaaaacaauguggauuuuuuuuuguauuuuacaaacuuucuauaucgucuuuucucuaagguacuuuucuguaaaguuccuauuccucugauguuaccacagagugauaacuuuugcaauaaauauuggugaauaacaaaucuuggggaaguauaucucauggaaagaagaagugucauuuuuuucuauaacauucugaugcaauuguuacuaugucccugaauuacaugcuagauacaucuucacauacaaaauuuaccuuuucuuuuccaacugguuuggcuacaaauguggagaaagccacacuaacaagcuucucaaugccagugagcauauccuguaccaugaccuugauacugaucuaaaaugaaaaaaagauaaauaaauacacucuuggccaguucagauuucagcauucaaaauuuagucauauguaugcaccauuaccuucuuucauuuuaaaaaugaaaccagaauuuuaauuuauuuuuaagcaauagaauuauuucaaugauguucuauaacacuggacaauuagcuuuuuucugauuauaaaaauuauuuauuuaccaugucaaauuuauggaaucugacuauccagaguauauauuaucaguaaucccaucacccagagauaauaauuauuaaauuuuaggugaauuuucuucuagcuuuuucuauauaucauauaugauauauaaguguauaugauauauaugaugucauauaugauauauaauauauacacauacauaucacauaauacauacacauauauaauaucauauuacauaauauauacacacauuuuauauuacauacauaugacaugaaauacguguguguauauaugcauguguauauaaaauuauuguaauguauuuacaguuuuauguucuaauuuuuuuuuuuuguuuugagacggagucuugcucuguugccaggcuggagugcaguggcacgaucuuggcucacugcaaccuccaccucccggguucaagccauucucuugccucagccuccggaguagcugggacuacaggcacgcagcacuacacccagcuaauuuuuuguauuuuuaguacagacaagauuucaccauguuggccaggauggucucgaucucaugaccucaugauccacccacuucggccucccaaagugcugggauuacaggggugagccacugcaccuggccuguuccaauuuuuaaaaauuuggcauuauaugaaagcucuuuuaaauuucaugauuacuaaauaugcuuuugaaaacaagauauuggugucugccuuauaaaaccaccagagagauguaccauaacuuuuuuuagccuuuacucucagaguuuuuuuuccuuuuuuuaaaugucucuaggcagcauagucucagaguuucauaaccaagcuaacacggacagaauugcaucauguauuuacagcuuuguuucugugauuaauuuuucaggaguaauaagaagguagcugagacacuuuauguugauacuaaaaugggcuagauuucccccugugugaagagcgcugaagcuugguccucaggauugcacuucgcagaaguguugguaaacucagguacuugucuuuagauucuggcuaauaaaccuuuucccuacauauuucagaugaguaauacuaucuucugaaaauaaugagcuaucucaggcacagcucagcacuauguuaucaacgauaaagaauauccguaucuguaucuuuacuguguacaccauguaaaaagaauaaucaauaaucuaugacucauuuuaagucacucaauucauaaaugcaaauuaguauuuacaugguaaauccuaaauuaacuagaugaugauuagccaaaauuaaacuaucuauucccaacucucaacccucaaucccacacagcuuucugcuuuuagagaaauggacaaaugaaaaauaaaauaaaauaccuaacaguaaaaacaaagcaacaauucuggaguguuaaaauaaguucuaaacacugucuucuacuagaagaguuaacuuaguuauaugugauuaccaaauguuucaaaaacauaugccagggagaauuucauuguguuauaagagauuagguaagauuggaauuacauccugugaaaacaacuagaaaacuggacaaaauauaggaagcaucuacuuucacaccuacgaaaauaggcaacacaggacugugauccccaaggcgggaaaaacaacgagagcacugcguucccagguucucaggcugaagguaauuuacgguuagguuagagaagaaaaaccuaacucugcugaauugaauggagcuaaaauuuguggguuagaguaccagagaaggaaacuaaaaaaaaagagaaagaauuccagaaauaugccugugagucuuuggguugauacuaacuggaccauauacagggugaaaccccagacaagaacagcuucugaggaacaagcaauuccugggaaacuguaacauggacaauuccaagaacucacacacagcuggggaucuuuugaguucucuccagccagauuucacugaauauauaacaccuucauagacauaacagaagaucccaacuuagaagaggggcuaaaguagcccuaaaguagaguauucuaaaucuuccauagaagaguuuaaaacguaucuuuaaaggcucaaaccaaucugcaaguaacaacaucuuccugccaggaaaagucugacacucuuuuuaaagaaauauaacaaaagccagcacuaaacaauauaaaauucacaauguucagcaucgaguaaaaaauauuagaugcaagaaaauuauuaggugaaagguaauauaaauaaaacaacagauaacagaaaugauggaauaacaacaaaggauacuaaaacaacaauuaaauauaagcaccaugaacucagagauuuggaaaaggagucagcaauaucuucuuaaaggauaaggccagauaguaaauauuuuaaguuuuguggucacauggacucuauugccacuacucaacucugucaauguacugugauagcaaacacagacaaaacauaaauuaauggguguacuacaaaaaauuuuuauucauaaaaacaggucuauaggccauaguuugcugacuccuaauauagagaaaaagaugaaaauaaugaggaaagaacggaaaauauaaaaaaaucaaaguggacuuucuaagguaaaaaaauacaacaucugaaauaaaaaacaaaccagauaagauuaacagcaguuuaguuaaugcaggggaaaaagucagugaagcugaagaugacaaaagaagcuacacagaauguagcaugaagagaaaggaagacugaaagaagaaaaacgaacaguaucagugacccguggaacacuaacaagaagucuaaaacucuauaaaguccaaaaggagagagagcacaaaagacaggaaaaaaguuugaagauauaauagcugaaaaaauccacauuucuuagaaacuauaaauccauagauccaguagcucuagaaacccaagccauaucauaauuuacauaagucugcugccaggcuagaauucuauaccuacugaauaugagcaucuuuuaaauaugaagaugaaacaaacacauuuuuacacgaacaaaagcugaaaaagaaaugcuaaaggaauaucuucagacagaaggaaaaugacacuagggagacaucuggagauacacaauacgcaaaagaauaaagaacaccagaaauggcaaauauguggguauauauauaaaauacuucuuuucauuucuauucuuuuuaaaagaugauugacuguuuaaaacauaaauaauaacuauguauuguaggguuuaccuccuacauaugugcauguaaaaggcaugacaauaacggcacaaaggcugggacaugggaagggaaguguguguacuguuauaagguuauuacacuauacucaaagggauauuauauuauucgaagguagucucagauaaguuaaguagucauauugcaaacccgagaaaaacauuaaaaccaaaacaaauauguauaguuaaaacaccaacaguggagauaaaauggauuacuaaaaauuacucugcucuaaaaaaugcaggaaaagauggggacaggaagaaacaaagaacagauggaagaaauagaagacaaacagccagaugauagauuucaacucuaccauauagauaaucaaauguaaauaguuuaaauacuccagguagaaggcagagauuguuagaauaaauaaaaaaauagcauccaaauauauucuguuuauaagaaacccacuuacauguacaaaaagacagguuaagagaaaaaugauggggaaaaaaacacuaaaccaaagaaagcuugucuggcuaaauuaaugucagacaaaguagauuuuaaaacaaaaaccagagauaaaaaggcaaacuucauaaugauaaaagggucacaacaucaggaagaguuaagaauccuggcagggcacgguggcucaugccuguaaucccagcacuuugggaggccaaggugaacagaucaccugaggucaggaguucaagaccagccuggccaacauggugaaauccuuucucuacuaaaaauacaaaaauuagcugggcgugguggugcacauguguaaucccagcuauuugagaggcugaggcaagagaaucacuugaacccgggaggcggagcuugcagggagccaagaucgcaccaccgcacuacagccugggagacaguucaagacuccaucucaaaaaauaauaauaauaauaauacagaagacuugaacaacacugugaaccaaguuaggcuaacugacaucugcagaauacuucauugacuauaagcaacacauucuuuucaagcacauauagaacauucaccaaaauaguccauauuuugggucauuaaaaaagucuaaauaaauuuaaaauaauugaaauuauacaaauuauguucucucucugcaaaggaauuaaauuauaaaucaaaaacauaaagauguaucuggaaaaaucaucagagauuuggaaauuaaacaacacacaucuagacagacuagaggucagggaagaauuuacaagaaaaaaaggacauauuuugaugcagguaaagcaauauauugaagaaaauuuuacgaucuuaaaugcuuauauuugaaaaaaagaaaaguuuaaucaauuucccaagauucuaccuuaagacacuagaaaaagaaaggcaaauuaaacccaaaauaaauagaaugagaauaauauaauaaccaacagcagaaaucaaauauauuaugcuaaguaaaauaaauuagacacaaaaauuauauauacuauaucauuccauuuauacaaaauacaguaaagggcaaaaaagaaaaaaaaaaggguacugaccugaaguaaaugagugguugucacaagcuggggucugagagagcugauugcaaaggggcauaaaggggcuucguguagugaugggaacguuguauauuacagugguggugauccaacuguauaacuuugucaaagcucagcaaaauguauacuuaaaaugggagaauuuuaauguuguaaauuauaucucaauaaaacugauucuuaaagacauauucuaaggacaaaaaaaaaaaaacucacacucauauaaugugcucuuagugcaaaugagacaauaucaucuauuaauaguaaugcaucacacaccuuccagaggugggaagagggaagagacugaucaguagagucugagaauccccuggaaguagguuuggcacagagcagaguuccugcuugcuuuggauucagggagaagucagucauuuauuucugcucagcaaauuagcagagggcuggccucaguuguggcaggaaacugaaauugaacaggaagacgcuaaaggacauguccaguuugaaaaaguaaaaauaaaaauguuuaguuggcaucuauauuuaaggaaaaaaauccaagaaauuucuaccaggugguagaaaguaugacaaaauuuagaggcugccuggucaugauuugcagaagaugaaagagaacaaaauucugcacggcggaucaggccuggaaagucaguggaggcuaggguuuacuuuccccagcaucagaaaucugugguuucaaacucacuggguuuuacuuuuguuuucuuagcuuuuagauaagccuccuuuagaaauucuagccugucuuagggaagaggaggaaaaggagaaauguaaaggagguuuuaucuauauuuggacugucuaucaggagaauguguggcccucaggagacaggccaagcccagaggcuccugugugcaaaggcuaagagccccacaguugaauaaacgcuccagaaacaccauuugcugacagagcuuguuuucuucacgacauuuccuuucugcuuucuucaagugcuuuguauucugcuuauuuggauacugcuagaaagugaacacaucagccaggcacaguagcucacgccugugaucgauccuagcacuuugggaggccaaggugggcagaucaugaggucagaagauugagaucauccuggccaacauggugaaaccccaucucuacuaaaaauacaaaaauuagugguggcaugcaccuguaaucccagcuacucgggaggcugaggcaggagaaucacuugaacccaggaggcggagguugccgugagccgagaucuugccauugcacuccagccuggcaacagagugaggcucugucucaaaaacaaaagcaaaaacaaaaaaaaagaaagugaccacaucaggguaaagccaccaccaauggcaugguuacugucaaaacaguuguuauaacugaacuguguucccccuuccaaauucuuauguccuaacccccaguaccuuagaauguaaauguggaaauagcacuguugcagauguaauuaguuaagaugaggccagacugcgguggggcaggccccuaauccaauaugaccgauaucuuuauaaaaaggggaaauuuggaagcagacacccacacaaggagaacacgugaagaugaaggcagagaucgggugaugcaguggaagccaagaaauaccaaagacuacagagagccaugggaggguaggagagcagcaugaacagauuaucccuccagcccucagagaaaccauccuugcccauauuuugauguaggacuucuagcucccagaaccgugggacacuacuuuucuguguuuaggccacccagucuguggugcuuuguuacggcagcccuaacaaaugaauacaaacucuuccaugucuucaugcccagagauugaagggacugauccugagcaaccugggagguacaauaugagauccagcaacuccuuuccugcuaauuuaaccugaauggagaucucaagagccccugagaauccaguauucacaaugguagagaaaauaaaaucaaguggaugcagaauaaaaaucuucuaaauuuaccuucuuacuaaaguccaguuauccugcuuuuaaaaaacuaguuaaucaugggacuaguuucugucagagguugaggggauggagaacaaacagaauuagaauaauaguagagucagcauaauuaagaaauaaaaaccaugcuuuauaaagaauuaagacuguccuuuucucuugcagguuuacuuucuguauauccuucuauguagaaauaguguacuguaucauguuuaaauguguugguuuuuuuuguuguuguuguuucuuaagagacaaagucuugcuaugucacccaggcuggaauguugugguacaaucaaagcucauuguagccucaaacuccugggcucaagcaauccgcccaccuccgucuccugaguacccagggcuacaggcacuuaccacugugcuggcuaauuuuuuuuuuucuucuuaaagauugggucuugcuaucuugcccaggcugguguggaacuccuggucucaagugaucuuccugucucagccucucaaagugcugggauuauaggugugagcuaccaugccuggccauguugaauuuuagcugggaaacaguggaaacaucugcugcuuauuauuuaccugugaccugacuacacauuccagagccuucugaaauagagaaucucacuaacuccaaauauuagucuaggccuccugcucuacccuuuguaaacaaugaagaagugagcaccaacaggcagauguuugaaaaggugccucuuaccuccaugcuugugcugaaugcucuaguaacuuuugcuuugaugguuauaacuuguccaacucuagggaaaaacaaacaaaaaaaccucaguaguuuuagcacauuucauuucagauaagacuuaaagauuacuuaaaugcaugccauaaagcaguuccaccuuaucaugcugauaauuuucaugcaugcgaaauucagguuaaugauaauggaaaaagacaacacuuaaaaacaaaggccgauaacuguaaaccacacuuaugguguuagcggaccaccaauauuuaaacagaaaagagacuuugcagagauagugugcgacaugacuccaaaucggcaacacauacugacuauacagcagcuguuuccccaagagaaguuaaggaaaauacaccagcaaaucuauacagcugguauuuauuuuugaauguuaguuaauacauaaauggacaaauauacaaaaaggcaagcaagcaaacugaucagcuucaguagguuuguaugggcccucaaugaugcuagguggucuacucacuuccuacuauuauugaaacuucgaucauguaaccugaaguuguuccaaaacuuuuguauucaggcccuucagucagcucuaauuccuuccccuuagcagaagguaagagguaacccaauagaagcccccuggauuuuucuuccuuaacuucaauguuaaacugcauuugcaccuuucucuuugcucuucuguuucagggaaagagggaucucuugagaccuaaucucuuucuuuaccugugccauuggucccauccuccaguggcccuguccccucccuuguuggcucugccucaucagcucuguucucuuuucugccuucaaucucugccucuucccugaaucuccaucagucuaugacaaugcucaaagcuucuccuuucuaaaauuuuucucucaaaccuauucuaucucaaguugcuuuucuuuucuucaauucaaacuuccuaaaaacaucguuuauuuuucugacuuauacauuucacuaauguuuacugaguuaauuggcauuuuacugaguaguccuggcauuaagccaggucuaaagauacagugaugaauaagacaaaacuacugacuucaaggagaccaaucuuuccuugggaugcugggauguaaauagauaaagcccaaaagauuaccaaggaauuauugauaauucauuaacaauaaaaaaucccugucauuaauuaaaugaaauuuaauguuucucaguguggccauacuaauaacaaugacuacucucuacugaauguuguguguaaaucaggcaccaugggauuugcuggcaagauggccgaacaggagcagcuccagucugcagcuaucagcgagaucgaugcagaaggggggugauuuuucugcauuuccaaaugagguacccaguucaucucauugagacugguuggacagugggugcagcccauggagggugagccgaagcaaggugggucaucacccuaccagggaagugcaaggggucaggggauuucccuccccuagccaagggaagccaugaaggacugugcugugaggaauggugcacucuggcccagauacugagcuuuucccauggucuuugcaacccgcagaccaggagauucccuccggugccuaggccaucaggacccuggguuucaagcacaaaacugggcggccauuuggggagacaccgagcuagcugcaggaguguuuuuuucauaccccagugguaccuggaacaccagcaagacaaaaccauucauuccccuggaaagggggcugaagccagggagccgaguggucuggcuuggcgggucccacgcucacggagcccagcaagccaagauccacuggcuugaaauucucgcugccagcacagcagucugagaucaaacuaggaugcucgagcuuggugaggggaggggcguccaccauugcugaggcuugaguaggcaguuuuacccuuacaguguaaacaaagccaccaggaaguucaaagugagcaaagcccaccacagcucagcaaggcugcucuggccagacugccucucuagauuccuccucucugggcagggcaucucugaaaaaaaggcagcaucucccugggacagagcacaugggggaagggguggcuaugggcgcagcuucagcagacuuaaaugucccugccugauggcucugaagacagcagcagaucucccagcacagcguccgagcucugauaagggacuacacugccuccugaagugggucccagacccccguguauccugacugggagacaccucccaguaggggccgacagacaccucauacaggauagcucuggcuggcaucuggcaggugccccuaugggacaaagcuuccagaggaaggaacaggagggaaucuuugcuguucugcagccucugcugggaauaccuaggcaaacagggucuggagugggccuccagcaaacuccagcagaccugcagcagaugggccugacuguuagaaggaagacuaacaaacagaaaggaauagcaucaacaucaacaaaaaggacauccacucagagaccucaucugaaggucaccagcaucaaagaccaaagguagauaaacccaugaagauggggagaaaacagcgcaaaaaggcugaaaauuccaaaaaccagaaugccucuucuccuucaaaggaucacaacuccgugccaggaagggaaaaaaacuggauggagaaugaguuugaugaauugacagaagaaggcuucagaagguagguaauaacaaacuccuccaagcuaaaggagcauguucuaacccaaugaaaggaagcuaagaaccuugaaaaaagguuagaggaauugcuaacuagaauaaccaguuuagagaggaacauaaaugaccugauggagcugaaaaacacagcacgagaacuucaugaagcauaaacaaguaucaauagcugaaucaaucaggcagaagaaaggauaucagagauugaagaucaacuuaaugaaauaaagugagaaacaagauaagagagaaaagaaugaaaauaaacaaacaaagccuccaagaaauauaguacuaugugaaaagacuaaaucuacguugguuugguauacuugaaagugauggggagaauggaaccaagucggaaaacacucuucaggauauuauccaggagaacuuccccaaccuagcaagacaggccaacacucaaauucaggaaacacagagaauaccacaaagguacuucuugagaagagcaacccuaagacacauaauugucagauucaccaagguugaaaugaaggaaaaaauguuaagggcagccagagagaaaggucagguuacccacaaagggaagcccaucagacuaacagcggaucucucugcagaaacccugcaagccagaagagaguggcggccaauauucaacauucuuaaagaaaagaauuuucaacccggaauuucauauccaggcaaacuaagcuucauaagcgaagcagaaauaaaauccuuuacaggcaggcaaaugcugagagacacugucacccccagggcugccuuacgagagcuccugaaggaagcaccaaacauggaaaggaacaaccgguaccagccacuccaaaaacauaucaaauuguaaagaccauugacacuaugaggaaacugcaucaacuaacaggcaaaagaaucagcuaguaucauaaugacaggaucaaauucacacauaacaauauuaaccuuaaauguaaacaggcuaaaugccccaauuaaaagacagacuggcaaauuggauagagucaagacuuaucagugugcuguauucaggagacccaucucccgugcaaagacauacauaggcucaaaauaaagggauggaggaauauuuaccaagcaaauggaaagaaaaaaaaaaaagcagggguugcauccuaguuucugauaaaacagacuuuaaaccaacaaagaucaaaagagacaaagaaggacauuacauacugguaaagggaucaauucaacaagaagaguaacuauccuaaauauauaugcacccaauacaggagcacccagauucauagagaaaguucuuagagaccuacaaagagacuuagacucccacacaauaauagugggagacuuuaacacuccacugucaauauuagacagaucaaugagacagaaaauuaacaaggauauucagaacuugaacucagcucuggaccaaacagacuuaauagacaccuacaaaacucuccaccccaaaugaacagaauauacauucuucucagcaccacaaagugcuuauucuaaaaucgaccacauaauuggagguaaaacacuccucagcaaaugcaaaagaacggaaaucauaacaaacagucucucagaccacagugcaaucaaauuagaacucaggauuaagaaacucacucaaaaccacacaacuacauggaaacugaacaaccugcuccugaaugacuacuggguaaauaaugaaaugaaggcagaaauaaauaaguuauuugaaaccaaugagaacaaagacacaauguaccagaauaucugggacauauuuaaagcaguguguagagagaaauuuauagcacugaaugcccagaagagaaagcaggaaagauccaaaaucaacacccuaacaucacaauuaaaagaacaagagaagcaagagcaaaaaaauucaaaagcaagcagaagacaauaaauaacuaagaucagagcagaacugaaggagauagagacaugaaaacccuucaaaaaagucaaugaauccagaagcuguuuuucugaaaacgucagcaaauagauagaccccuauccggacuaauaaagaagaaaagagagaagaaccaaauagacacaauaaaaaaugauaaagaggauaucaucacugaucucacagaaauacaaacuaauaucagagaauacuacaaacaccucuacgcaaauaaacuagaaaaucuagaagaaauggauaaauuccuggacacauaaacccucccaagacuaaacuaggaagaagucgaaucucugaauagaccaaugacaaguucugaaauugaggcaguaauuaauagccuaccaaccaaaaaaaguccaggcccagauggauucacagccgaauuauaccagagguacaaagaggagcugguaccauuccuucugaaacaauuucaaacaacagaaaaagagggacuccucucuaacucauucugugaggccagcaucauccugauaccaagaccuggcagagacacaauaaaaaaagaaaauuucagggcaauaucccugaugaacaucgaugcgaaaauccucaauaaaauacuggcaaaccgaauccagcagcacaucaaaaagcuuauccaccacaaucaagucagcuucaucccugggaugcaaggcugguucaacauacacaaaucaauaaacauaauucaucacauaaacagaaccgaugacaaaaaccacauaauugucucaauacaugcagaaaaggccuucaacaaaauucaacaauccauucaugcuaaaaauucucaauaaacugauauugauggaacguaucucaaaauaauaagagcuauuuaugagaaacccacagccaauauaauacugaauggggaaaagcuggaagcauucccuuugaaaacuggcauaagacaaggaugcgcucucucaccacuccuauucaacauaguguuggaaguucuggccaggacaauccggcaagagaaagaaagaaaggguauucaaauaggaaaagaggaagucaaauugucucuguuugcaaauuacaugauuguauauuuagaaaaccccaucuucucagcucaaaaucuccuuaagcugauaagcaacuucagcaaagucucaagauacaaaaucaaugugcaaaaaucacaagcauucuuauacaccaauaacagacaaacagccaaaucaugagugaacucccauucaccauugcuucaaagagaauaaaauaccuaggaauccaacuuacaagggaugugaaggaccucuucaaggagaacaacaaaccacugcucaaggaaauaagacaggacacaaacaaaugggaaaauauucccugcucauggauaggaagaaucaguaucaugaaaauggccauacugcccaaaguaauuuauagauucaaugcuauccccaugaagcuaccauugacuuucuucacagaauuggauaaacuacuuuaaauuuuauauggaaccaaaaaagagccugaauagccaagacaauccuaagcaaaaagaauaaagcuggaggcaucaugcuaccugacuucaaacuauacuacaaggcuacagucaccaaaacagcaugguacugguaccaaaacagauauauagaccaauggaacagaacagaggcuucagaaauaacaccacacaucuacaaccaucugaccuuugacaaaccugacaaaaacaagcaauggagaaaggauucucuauuuaauaaauggcguuaggaaaacuggcuagccauaugcagaaaacugaaauuggaucccuuccuuacaccuuauacaaaaauuaacucaagauggauuaaagacuuaaagguaagaccuaaaaccauaaaaauccuagaaaaaaaccuaggcaauaccauucaggacauaggcgugggcaaagacuucaugacuaaaacaccaaaagcaauggcaacaaaagccaaaauagacaaaugggaucuaauuaaacuaaagaguuucugccaagcaaaagaaacuaucaucagacugaacaggcaaccuacagaaugggagaaaauuucuacaaucuauccaucugacaaagggcuaauaucgagaaucuacaaagaacuuaaacaaauuuacaagaaaaaaacaaccccaucaaaaagugggcggaggauaugaacagauacuucucaaaagaagauauuuaugcugccaacaaacauaagaaaaaaagcucaucaucacugguuauuagagaaaugcaaaucaaaaccacaaugagauuccaucucacgccaguuacaaugacaaucauuaaaaagucaggaaacaacagaugcuggacaguacauggggaaauaacgcuuuuacauuguuggugggaguguaaauuaguucaaccauuguggaagacaacguggcgauuccucaaggaucuagaacuagaaauaccauuugacccagcaaucccauuacugguuauauacccaaaggauuauaaaucauucuacuauaaagacacaugaacacguauauuuauuguggcacuguucacaauagcaaagacuuggaaccaacccaaaugcccaucaaugauagacuggauaaagaaaauguggcacauauacaccauguaauacuaugcagccauaaaaaaggaugaguucauguccuuugcagggacauugaugaagcuggaaaccgucauucucagcaaacuaacacaagaacagaaaaccaaacaccgcauguucucacuuguaagugggaguugaacaaugagaacacauggacaaagggaggggaacaucacacacgggggucugucaggggguggggggcuaggggagggauaguauuaggagaaauaccuaauguugauaauggguugaugggugcagcaaaccaccauggcacguguauaccuauguaacaaaccugcacguucugcacauguaccccagaacuuaaaguacaauaauaauaaaaaaaaaagcaccaugcuaaacgcuuuguaucauaaucuaacaacacgucauucacugagcaguaaccccaugaggugggcauuaucauucccauuucauucccaucaggaaacggccuuagaaggugacauagugacuggcaggaucagaguucaaacccuggucuuaucuggcuccaaagcuuugacgacauuacccuacucagguuucugguaaauaauugcaauucauacuauuuuaaucauaguagagaggcuuguucagauauacauaucucacucugucacccaggcuagagugcagugguucaaucauggcucacuggagccuuaaauuccuggggucaagcgaucuuccugcguuggacucccaaagugcugggauacagcaugagccagugcaucuggcccagauauauuaaagacagucuacaagaugaaccaguuggguuuaccuagaagagugacugcaucugguuaaagccuuugcacacauauuguuacucuacauaccugucauaaucuguagcauuuuuuggcagaaaaacuggagguaaagaguuuaauaauacauacauauguauauuuauuuaagcaauuaauuccuauauuagaaaucugaacaaauuuaaauuucuggcacaguuuuauuaacccuuaauuuuauaaguuugaaaacugauaaaaccuacauaacaacugcucuggagaggaauuuggcaauguuuaauaaaaugacauaugcauuuacccuuugacucagcaauccuauuucuagaaaucuaucccacaaaggccaggcaugguggcucacaccuguaaucccagcacuuugggagggugaggcagguggaucaccugaggucaggaguuugagaccagccuggccaacauggcaaagcccugucucuacuaaaaauucaaaaauuagcugugugugguggcacgugccuguaaucucagcuacucgggaggcugaggcaggagaaucgcuugaaccugggaggcagagguugcagugagccgagaucgugccauugcacuucagccugggugacagagugagacugucuuagaaaaaaaaaaaaaaaaagaaaagaaaucuaucccacaaauauacuggaaaaaauacaaacaaacauacaucugcacaagacuacaaauugaaauauuauuuguaauagcaaaagacuggaaacaauauaaauguucaucaguggagggccaguugaaaaauguagugcgucuccacaauggaguacuauguagauacuaaaaggaaugaugaauaucuacuuacaguuaugccuaguuuaaugacagggguguguucugagaaaugcuucauuaggugauuuuguuguuguggaaacaucauagaguguacccacacuaaucuagaugguauagccuccuacacaccuaggcuauacgguauagccuauugcuccuaggcuacaaaccuguagaggauguuauugugcugaauacuguagguaaccguaacacaaugguaaguauuuguguauccaaacauagcuaaauguagaaaagaugcaguaaaaaugcaguauuaaaaccuuuuuuuuuuuuuuagagaugggguuuugcucucguugcccaggcuggagugcaguggugcaaucuuggcucacugcaaccuccgccucucagguucaagugauucuccugccucagcuucccgaauagcugggauuacaggcgcgugccaccacacccagcuaauuuuuucuauuuuuaguagagaugggguuucaucauguuggccaggcuggucucaaaauuccugaccucagaugauccacccaccucagccuuccaaagugcagggauuacaggcgugagccccugcacccggccaguauuaaaaucuuaugggaccacugucacugaccaaaaugcugcuaugcagcacauaacugcauauugguauggagugauuuucuagauggaaauacuacauauuuuacaguguauauuuuauauacuauauauacuuuucuccaccucauuuuuaagugaaagaagugagguggagaagaguacacacaguguguugaaauuuauuuuuaaaauaacauggauacauauaaauauuucuuuacauuaaaaaaaagaaggauacagcacaaaauaaauaaagcuuacauagaaagagagggaggggccuagacagaagguagggaggagccaguuuccccagggugaaaugggucuguuuuccagauuugacucugguaccuguagauauuuuaaacuauaaaacaaaauuaaaugaaaauaaaagucauuccuacaaaauaaaaagcaaauuaaacaaaugaacuuaagaauguaugaagucaguagcuuaaccacauggaaaaugauuauuucaaaugacuucaaaauacagugacuuggcuguaccagaugagauacaguuugagaaagaaacugcauaaauaaucuuaagcuacuuucucuauucauuuguuagugauaauauugguacuguuauucugaaucuaauuaauguguauauacauauuaauuucaaucaaauaaguuuaugucuuuaaauaucaugauauucagcauaaaauaaaauuaaaacucagagauauagacauaaaaucaaagaaauuaaguaaaaccauauaacccuaaauuauugcaguuuauuaauuuaaaugcuuuaaaaauacauaauuucuaauucuguccgcugaaaaggccgagaacgaaugcccauuuugaugugaugugcaccuuuccugcccagguuguggucucuacuucucauuucuacugcaaggaaucaggacuccuuggagaaauaauggauucuaaguuugugggggaaaauguaaaagaugagacugaaacauuuuauaccagaaggccaaggaguuauuaagcaccuuuaacuuugggcuuuuguucaagggacuuagggauuaaacugaagaagcucccacugcucaaagauggggcagucugaacuucuguaagaauaauaacauugcccaggcgcaguggcucaugccuguaaucccagcacuuugggaggccgagguggguggaucaccugagaucaggaguuugagaccagccuggccaacaugaugaaaccccaucucuacuaaaaaauacaaaaaaaauuagcuggguguuguggcaggccccuguaaucccagcuacuucgggaggcugaggcaggagaaucgcuugaaccugggaggcggagguugcagugagcugagauugcgccaucgcacuccagccugggugacaacaguaaaacucugucucaaaaaaaaaaaaagaagaagaauaacauggaugaauuguaacacaucaaguacaugaaaauccauaggcucuuaaugaauaaagggaaagagucaagacuuuccugaacaaacuuuuccucaggauacucaggucauuagugagaguuucccucuagagaaguauuuuagaaaauaaaugaagaagaaaugauagaauuagcauauuaccauguuuccaauaucuaaugacagaaugguuguagucuaugaucauuagauaucauauggccuugacaugagaaauuuuuaccgaauaucaaacccucaccagccgggcgugguggcaggcgcauguaaucccagcacuguggaucaccugaggucaggaguuugagaccagccuggccaacauggcaaaacccugucucuaauaaaaauacaaacauuaucagggcaugguggcagcugcccuguagucccagcuacucgggaggcugaggcaggacaaucgcuugaaccuggguugcagugagucaagaucgcaccacugcacuccagccugggugacagaacaagacuccaucucaaagaaaaaacaaaaucaaaccuucaucaugucaauuuuuagauguaacugucagauuacaagaaauacaaaggacaggagaacacauuaaucaaggcuacaguggauguaaauucuauaaaacaaaugaccagguuucuuuaaaaaauaaauugcaagauaaaagaaggaagggaacauuuuauguuaaaagacacuuaagagaccuaucaccuauacugaauccugguuuaauaaaucccauaagaccuucuaguaagacaggauguggaagcagaacagugauacuggugauccugacccuguguaggccuaagguaauguauguguuugugucauuguguuuaauaaaaaaguuuaaaagguaaaaaaaaaaaauaacaaauuuuaaaaacagaaaauagcuuauagaauaagguaaggacauaaagaaaaauauuuuuaaacagcucuauaaaaggcuuguguuuuaagcucaguauuauuacaaaagaaucaaaaagauuuuuuuaaguuuauagaguaaaaaaguuacaauaaucuaagguuaauucauaauuaaagaaagaaaaauauuuuuauaaauuugguguagccuaagugugugguauuuauaaauucuaagguaguguacaguaaugucuggggccuucauauuugcucagcacucacugacuccugcacuccugcagagcaacuuccagccuuccaagcuccauucaugguuaagugcccuacauagguguacuuuuuuuuuuuuuuuuuuuuguagauagagucuugcucuugucgcccaggcugcuggaguguauuggcgugaucuuggcucacugcaaccucugccucccagguucaagcuauucuccugccuuagccuccugaguaacugggauuacaagcgcccgucaucacaacuggcuaauuuuuguacuuuuaguacaaaauuaguacaaaauagacgggguuucauguuggccaggcugguuuugaacugcugaccucaggugauccaccccccuaggccucccaaagugcugggauuacaggugugagccaccacgccuggccagguguaccauuuuuucaucuuuuauacuguauuuuacuguaucuuuuuaauguuuaacuauguuuagauacacaaauagucaccauguuauuauaauugccuacaguuuucaguacaguaacaggcugcacaaguuuguagccuaggagcaauaggcuauaccacauagccuagguguguaagaggcuguacuguugagguuuguguaaguacacucuaugauguuccuacaaggaugaagucguuagugaugcauuucucagaacauaucccgucauuaagugaugcaugacuguauagacugaaacauuuacagaugaugcuugggguuuuccucaaaacaauccaggcauaugggggaguguggagagguauugauaaagcaagagugucugugaguugauaauugcuauagcuaggggugaaggguccuugcgauacacuguacuauccucucuuguuuuauaggcugguggaaaaguaaucgcaguuuucucaauuaccaaccuaaauauguauguuugaaauguuuguguaucuugaaauuuucuacaguaaaagaugguuaagaacuuucacacauaaaauguuuuucauaauuuacucucucuacucagaugaauuaguguuuaccuaacaaccugaugaaauucaccauuauaaagauacuuauuaucauuaauuauucuucuaguacaggaaggggauguuaauaauuagcuuauaguagccgggcaugguggcucacuccuguaaucccagcaccuugggaagccaguggguggaucgcuugagcccaggaguucgagaucagccuggacaagaugaugaaaccccaucucuaaaaauaaauaaauaaauaaauacaaaaaaaauuagccaggugggcaugguggcaugugccuguagucccagcuacuugggaggcugaggcaggaggaucacuugagcccaggaggaauagguugcagugagccaagaucacacuacugcacuccagucugggcagcagagugagacaauuaaaaaaaggagcuuauagaaagucuguuuggcuguuaugccuuaugccacaaugcaucuaaggcugagagcuauuucuccacaaaauugagacugugaaguuacacuuaagaguguuucuuauaaguaggcccuaugauuauuuuuuuacuuaccuaaauugggucacauguuauuuauuuuauuaagaaacaagaucacuaccucugccugaauaagcucaggugccaccaauacaugucccagaugaacccacaaacccaggagaaaggagccauggagcaaugucacuuaccuagcugucuccucaaacuguaugucauccacugaggcuguaacgcaggaaacuccagcauguuucucagcuucaaaaaauacauaaaaaugugcugcuuuaguggugauaugagaauauuucaguauaagggaaaggaaugaaauguaagugcauugauuuuagucacccaucccucauucauuauagcaccacugugccuacacuuucuggaucaacuggcucauuacaagcuucuuugcucugugaguuauauuucuaauguaugguaauuacugcacuuuuuauccuaauuuuuaacuuacauggucuuguauuugaaauuuaauaccaagauccugcaaaucuagcuauugaaauagcaauuuuaguaaguuggugcugacuuuaaauauuuuaucagguacuauccuucuuguuuuaaaaucaaagcaucacagguguagccacuugcccacauaaccaguagcagaaucuguuuaaaugauuuaaccaccguaagcacuugagcgguaugggaaaccccgagucaucccaaaucaaagaggaucuucucuggguaucagagaaagagagaugggcacacaguagauauuuagucaauauuuauuuuauuauuaccaaauuuaugccaaauucaguauacauuaauuaccuugaaggaggaguauugaguagggugggagaguucaggaagaagcuuaguuauuuccauguucuaugucugcacguaauuugcucagauuuuuuuuuuauuguugguuuugcuuuacauaaaaaacaccagaauuuauacucuguggggaagauuuugacaugugcuucugccagauuugauuuugagaaacacaauugaaagccaaacagauuauauuggcuuuauaagaacuuuugaccucauuuuaguuuuggagacuucaguccuggugccacaugaugaagaaaagagugaauuacacugaauuugucuuccuugugcguacuggaucauuauaacuacauauguauuaauugauaguccuagguaagaagacaugagagauaccccacugcgcacguauuuaacacauuccugucuaggaucuaauucugcagaaaauuggacauucaaauguucaaggaagggaaaauggaagaaucggacucuaggaaugcucaagguggacucaacuuaauucaaugcaccaaacauuuguuaaguucuugcugauuuccagacacugaguuggaugaguuccauuuuuuuuuuuuuuuuuuuuuuucuuuuuucagauagagucucacugucacccaggcuggagugcaauggugugaucuuggcucauuucaaccuccaccuccuggguucaagcaauucuccugccucagccuccugaguagcugggacuacaggugugcaccaccaugcccagcuaauuuuuuguauuuuuaguagagaugggguuucaccauguuagccaggauggucucgaucuccugaccucgugaucugccugccucagccucccaaagugcugggauuacaggcaugagcucuaucuuuuaagcaguccacucuguggcacuuagagauccagccauagucaguacccuuuuagagcuuaaguuuuccagggaacugcugaaaccuugcaaauauaugcuuaaaucauugauuaaagaauacuuaauaaacauucauuccaguuacuugacaugagggaaugggauguugagguuauuaauucuuaguaauaaaguguuauaauguauaccaacaugaguaucuugaguaucuuuuuuuuuuuuuuuuuuuuaagagacgaggucuguaucaccuaggcuggagugcaguggcacgagcauagcucacuccagcgucgaacuccugggcucaagugaucuugccucagccucccaaguagcugggacuauaggcaugugccaccacagcuagcuaacuuuuaaaaaauuguuuaaaauauuuuuuguggagacagggucucaugauuuugcccaagcuggucccaaacuccuggacucaagugauccuccugccuuggccccucaaagcacuggaauuacaggugugagccaccaugcccggcugaguuaucaauuuugaaugacuuaaaugauaacuaaaaugcaguaaccaguaaaaaaauuaaacuuuuauuguuuauauuggguaucuauucuguauauguagcacuauacuagauuucuuaagggaucaaaaaguaauaaaaucaugacaguuacuuuuuauuaagcauuuauuauugaucaggcacuggacuagucauuuaagcaugucgauuacaugaaguugguacuauuauuagcucccuuuuauaaauaagaaaauuuaggcuuagaaagauuaaaugcauuguucuaaauagugauuuugacuauagaagcaauaggaacuuucaggaaagaguagguuagacaaaccagagaacacucccagagaaggacguggcuaaauauggguuucaggagcucaauaaucaugauuuauaccauugauuuucaagggucauuaaacuaaaaggaaaaaaaauauggggaccaccauaggguccuggcuucacaugucauuacaugcgugcuguguuuuuaaacgagugucaauuagaugacaugaacucacaggacuggcuuguucugguucuugauuuugauugcccuucauaccagcagaaguggaaaacccuaaagcuguuucugauuuccugggagaacaaagagaagcuaagugauuguaaguagguacgaaaugaugacugauaaaaauagugguaaccuuccuucauuucuuccuuccuucagcagauauugauugaacacuuguuuuauuuuauauaaggcagccucugcguaaggugcuggcaaugggaaacagccaggaccccugcucucauggagucuaguggaugagcuagagguuaauuaaauggauauugauaugguuuggcuguguccccacccaaaccucaucuugaguuguagcucccauaauucccacauguugugggaaggaaccggugggagauaauugaaucaugggggcaggucuuuccugugcuauucucauaauagugaauaagccucacgagaugugaugguuuuauaaggggaaaccccuugugcuugguucucauuuucucuccugccaccgccauauaagaagugccuuccaccuuccaccaugauugugaggcuuccccacccacauggaacugugaguccguuaaaucucuuuuucuuuauaaauuacccagucucagauaugucuuuaucagcagcaugaaaauggacuaauacagauacauaaugacaaaauggacuaagugcucugaagaaaacagggauuuuaugacagucaguaacugagauaauacacuaggugggguauccaggaaggcuggagggcagaggaggggaaggccugcugagcagagggaacagugacuacaaagguccuggugacugcaaugcagagaguaggagggagagugggugagaugaggcuggagugaaggcugaggacaggcuaugcacagggccuugaagcucuugguucaaaguuuuuguaauuauuauucuucaagauauuguugcacugccuucuggucuccacuguuucugaugaggucagugguaauucuaauuguuguucuccuauauacgguguuucagucuggcugcauucaagauuuucucuucaucauaguuugacuaugauaugccuggauguauucuuuguauuaguuuuucuuucuuucuuuuuuuaaauuggagacagagucucacucugucauccaggcuggagugugguggcacaaucuuggcucacugcaaccuccgccuccuggguucaagagauucuccugcucagccuccugaguagcugggaauacaggcgugcgccaccaugcccagcuaauuuuuguauuuuuaguaaagaugggauuucaccauguuggccaggcuggucuugaacuucugaccucaggugauuugccugccucagccucccaaaguacugggauuacaggugugagccaccaggcccagccuguauuaguuuuucuugauguucuaugaccuugaaucuguaauuguaugucuuucaccauauuuggaacucuaauuauguuuauguuuuauuuuuccacaaaucucugacacuuuauuuuauuuauguauuuuuuuuuuuuuuuuugagacagggucuugcucuguuacccaggcuggaguacaguggugcaaucauggcucacugcagccucgaccucccaggcucaagucauccucacaccucagccuccugaguagcugggacuacagguacaugcuaccaugccuggcuaauuuuaacauuuucuuuuuuugguagagacaggaucucucuauguugcccaggcuggucucaaguuccugggcucaaaccauccuccuaccugagccucccaaagugcuaggauuauaggcaugagccauuguaccuggccacacuuuauuuuuaaaauucauuuuuuucuguucuuagauuggauaauuuauauugauguauuuuugcauuuacuaacucuuuucucagccauguccauucugcuguuaagccuagccauugaguuuguuauuuuagacacuguauuuuucaguucuggaauuaccauuuggcuuuuaaaaaauaguuucuauuacucugcagaaauguacugucuuuucaaucuuuuucuucuuuuucuuuuucuuuugagauggagucucauucucaaaugagacuccagcacuggcuggagugcagugguacaaucucggcucacugcaaucuccaccucccagauucaagugauucuccugccucagccuccuguguagcugggauuaaaagcaccugccacaacacccggcuaauuuuuguauuuuuaguagacaggguuucaucauguugaccaggcuggucuugaacuccugaccucaagugauccaccugccucagccucccaaagugcugggauuacagcaaucuuuauuaucauauuuuuaauuauauuauugagcacaguuauacuagcugcuuuaaaauccuugaagcuuaauuccagcaucaggguugucuagggaugaaucuccauugaucaucuuuucucuuaagaauaaaucauguuucccucuguauuucaaguaauuuuggauaauauccuagccauugugagugauccauuguagaaacuguguuucucugaaaaguguugguuuuguuuuugguuuuguuuuuuaaagcaagcaguuaaccugaccaaaccaaaacuauaaucugucuaccuagagaugggcacaacuauuuucaguucuuuuggccucaaccaggagguuuggagucuguccuauguauacaugauucaagauuugccagauaucugggaaaagauuauagauagauuuuagggcucugucucucuggcucuuuccuuucuggaacuuucccuuuuguauuucauucaguagcugugcuuuucccaaacccugucuuugggcucuucaaaccagcaagccuguggguuuuccaucagaacuauagcugggagcagacuggcauuuucuuucaggcuucaagucauuuauaaaacaaacacagaaaaagccaacaccacuuuguucuuucauguguuaacuuucaaguguuauaagccuacuuuuguucacuuuucaccugccuuaagucucuuuuauuuaguguuuugcccagaguuuauaauuauuaucugugggagauuuuuuaguaggaagcacuugaacaucuuagaaaaauccuuaaagcccuuggugaagaaaagaaagggaaaaaugaacaaaacauaugacaugaucaaucagauuagcaucuucaaagauuacuuuagaagcaguguggagaggagaccagaacgaauggagaugaguuuggaaaucacugcugaagucugcaugaaacaugaugauagcuuggaguagauggucgcaaugggggugcagcaaagugcuuggauuucagagacuccuuuaggggguaacacugauaggacuugcuccaugcauagaguaugugaagugagaaguaagguggagagagaaauaucaaggaugacuccuagacuuuugacuugcucaacuagaugaguugggugccacuccagagauaguaaacccuggaaaagauucacaaauaaaaaaccgugugugugagauguuccaaaauaauacauggacgugugagauagaggauuacucagauagcuucaagacuuuagacuuaagggacuggaaaaauaauggggccacugacagaaguaaggauagugagaauauuucaucuuucuuuaaauauugagaagacauuuuggaauccagcagugccuaggggucauagaaaugccuugggggccaugacugggauugcaguaauguggcuaaagagauaaugcuggccuauaaaaaacucugagaaaaucccagagaaaucaguuuuauauuacuacacagauucaguuacaccuuggcuaaauaauguccccugcuuauguggugccucaggucaccauaaaguguuuaacacaggcguuauucauguugcccaaaccaacuuuaucauacagguuuucuuaauauuaguaacauuaucaguuauuaauauuauacuacuaauaguaauguaacuauuaagguauagaguaauugauugucaauuggaucuuuccaugguuuccaaagaugucaggucauagaaaugaugacaauugcaggugggccauuguuucuccaucacaagacagaggcacuaagcaagguaacuaaaagucacuucaguggucucauaauguauucaguugccuuggaaacaggcaucauuauuauuagcaaccucagugguuuauguauuauucuuuuuuccuauguguggauuaauuuuguauucauguuuccauuguuaauauaaccaaucucaaauccuguuaaaaaaaaaaaaggcuuaaacgaaucauugauuucucacaauuguggaggcagggaaguuccaaaucgaggugcuugcccauuguagguccuagugagggcucucuuccuggccuguggauggcugucuuccugcuguggccucacauggcagagagaagcucuccagugucucuucuuauaaggacauuaauuguaugggaccaggauuccacucuuaugaccucauuagccuuaauucuucacuccaaauagagucacaccagggguuaggacuucaguguauaaauuucgguggguggugugggggauauaauucaguccuuaauaaauguuuuugccauuuuuacugucauucugucacaagaacacaguggaguuuuccagagacuacauaagggugugguagcagcagggugaaugcagaagcagguaugaguagucagcaauccuccacuagccagaccuuagagagacucgccaggauguaaccuuuaucaccacuccucucgcuacacuuuuguucuuguggaaaauaguuauuucuuaauuaaaaauguuaugcuaacaauguaguccauuucuuuuuuaaaaauaauuaaaaauuuuaaauuuccauuacgguaaaugugauauaaauagccuacauaaacaaaagcugccugggugcgguggcucaugccuguaaucccaacacuuugggaggcuggggccucccaacacuucaggaucacuugaguccaggcguuugagaccagccugggcaacauagugagaccccaucucuacaaaagcaaaacaaaacaaaacucccaaagucagcugggccugguggcgugcgucugugguccuaguuacucuggaggcugaggugggaggaucgcuuuagcucaggaggucgaggcugcagcgaccucugauggcgccaccgcucuccagcccgggagagagcucaacaacaacaacaacaaacaaacaaacaaaaaaccccgcagaagcucucugggcuccucacuuguuuaauggaaugaaggagucccgagagccacacauuugggaaccaccggucucggccaugcccagcgcgggcgcacuguugcaacaccccuaucccuggcugcgcaggguucagcucuccgcaaguaccuuccucgccuuccuaccccccccagcccccagccgccgccgcucccgcagccccggucccgcgccuccccgcagccccggcgcccgccuacccgccaggcaggcgguggugucgauccacuugagcagcugccccgcgcucagcucgccgcgcgcaguggcgugcgccggcuggauggcuuggcucaugaccaccucgccgggcgccggccgcuccauggccagggcgagagcgc

SEQ ID NO: 17357 - RNA, 12378 nt, Homo sapiens
ucaaucagguaaaauuucaaaugaaacacaaaaccacuagagucauuccauuauacaguacaaugguaguguuaagccuugugaaauauauguauuaaguaugcaugaauucaucaaaucaaacaaagaagcuaaugggucucugauuaguguucuaacucuauuauggugauacuuccaucuuacucugacucaucuaaaacaugagaacaaaaugcuauuaaguuuauuauaccaucuguuaucugccaucauucugguuaaguaacaaaaacugaauuuuggcuagaaguucucucuugaaaaucaagggcaaaaaagagcugcuguuaaacugagauauuucaauuuuaacuucaguaacuuggaauccuuuaugucaaaacuaaaacaaaaaccaaaucccuguuuauucucaucuaggauucaaaaaaaaucuuguuuccaaugggauuguuacauggauauuaacgaacaauggauauuucaaucgagaaucaaguauucagaaaaauuauacacaaaaauauuucuauugcuuaauagaaaacauauuuuuauuccguacuuuaaaaauauagacuuucuagcaacuuauaaauuucuauuauaauaauaaauugauacuuugagccaagaaaacaauauaaccaaaaauucauuuguucccuuuguuuagggguguuuuacauuuaugcauaauuuugcuuuuauaaaagaugauuguuacaaucagguauacaacuacuugguuaugucuaaguucugucucuuaaaauauguucuuuuagagaauucauuuaaucaucuuauucuuuucuucaauuuucuccaaacagugguagaaguacuauuugauagacagaauaaagaaaauuguuuuuggccacacccagaucauacugauaucuacagcauaguccuggcuacaggggagcucaacucuaacucgugaagcgggccugguuuagaaaguaacaaugagguaguaacucaugauagugcuagcuguuaucaaaaauuaacaacuuuagguauuuuuguuuuggguuuuugcgguuuagguacauccaaaauuucuucauagucugcacucauucccuuugcccagcgaccaacugugaccauucgcucuguaaaggaauagaaaaaucagaauguuagaaaaacaguaaucaaaugcauccacucagauuguuauugguuugggaaaggaacucauuuugauaugaauaaucacaaggagggaagacuccaucacuaaaggaaagugagcaauucuguaauugauuauaacccuugauuucagaguaccacaggcaauuucucaucccaauuagggaaaugcagcaacuacuuugcaaugcacgaacugaugagaaagcucuuucauucuuucccagaguucaucauuacagagucaaugaauuccaagagucuguaaacagcaaggcuuaugaagcaucaguuuuaaaugcacaagauuccaccugugaaauuauacaacaucugcuugucagucuugucauuugggaaguggcaauccucccaggagggagaauucaaauuccacuucaucauuucaaucucacugccuacaauguacuaaagacuaucuucuagacaagcuuguaaauaagaacucuugguuuucaaauuuaaauguuagggauaggaaguaagaaugagcagacuuauuugcguaguguugugacuacgugaaauaaaaaaaagugcucuuuccauaagaagcacugcugggcuauccuacugucuucuugcuuuccuucacauaggauuaucauucuaguccaggcaaacuaauguaauaaugaucuccacuuccuuaaaagucugccauagguagagugaacaucucugaaguguuugaugaauaaggcugguauuucaucaggaagaaaaucgccagauacuguguagauaacacauuuuuaauauuuuugguaguuucugcaaucaacucugaaucuuuuagguacauacaaagcaaagcauacauaaggacacucaauauuaaggcuauugaaaguuauuucauauuuuuuauuuucucagugaauucauauuuuucuguaaguaacagaauuggcucuauuauauuaaauucauuaguuagcaaauauaaaugcuuaugaaucaggugucuuauaaagucaggguccccuaaggcuuacuggucacuuuuuucccccaacuauucaguuacucaauacuaugugugucuauugcugacagagauuaagucauugcuacaguaggaaaacagguugucuuaaaaucauuaguaucccaauugaguuauuaauaacaagugcagaauaaaacgcagaggaauacuaaucucaccccuucuaaguagaggcccagagaucucaccugaauucugacuuucagggcaaucuuucuuuaaauguuccacagagccacaaaguuugcaaccgccaccuauugaaagagcaaagccacugaauaccaucucauacuugcaagggguuuuuaacaucucaaagcacuuucacaucuuacuggauccucacaacccugucaguuguaaagguagcuagaccaggaucauagggaggugccacuauuccuauuaauucauucuccauuccuuuuaaccucacagagcacuaaauuguacccacccacugcuucuugcaccuggccuugagaaguaggaaaaagaaaugagauaugauggaaggcacuuguucaagagcuauugcacagaagccuggaucuuaacaaugcuuagacaaucaagagucugugaacccuuggaccuguaaacaaaagauguaagcagaugcacuuuccugaauagcaugucagauucucaaacagucaauggcccaaaaacagauuagaaacuacuguucuacuguacagaucagauggggguaagcauuuaugaaagaaauaaaguuaauuuuuguuucagugccuuccacuggccaggcacccuaacccuauaaaaaugcccaccugccuacuuuaaacaacauuccaggauugugaauuacaacacaugugguuucuaaaauaaguguuucacuuaaugaucaaacacuauugcuuaauggucaagcauuaucuugaucaugcucgaaauguuaagugacuuagaaaaaugaccuaaucagauacaaaucuggcugaauuuucuuuuuuuuuucccccaaaucuugacuuuauuuuuaacauaaaaaugcaaauguggaaacccacccuacuuuucccccaacauaaugcuuuaccucuuaaaaauaaaguacuaauucuauauacaucaaauguaccauacaaaaauguauccaguguuucuauugcuacuaaaguguucuaaauuaaaacaaaucgcagaaagccccuuauuguaaacaaaagauuacaagguauaaaaucaaggcacacacaggcaaauauggccaaauuuucacaucuaugggaucuacucuccuugcugcauuaauuuuuuuuuuuuuuuuuuuuuuuacagcuagucacuuugguugaccagugaaagccauuuuugcucacuagucauguuaucuacccaguuuuauaagcucaaaacugaaaugcaccugagcauuuuccaggcccuggccucuuuauaugccauagugaaagagaagcacuugaauaauacauuuuaauccuuauaaaaauucuuuaggcaaauaccauaauucaucaacucuaagacaccacugauuauaagauguaucauuauugcacauaccucucagaaagaaaaacagcugucaauuauaugggacccaccaacgguaagauacauucugauuuccaagagauuaaaauugaaaaacugugcaucuuagaaucaauaaaauauaguuuuaucaucuccacucuauaggugaggaaacggagaucagaguuugguaguuggccaaagccccccagcuagugaguggcagugcuggcgcuguaacccaagucugaccaacuccaaaagcuaugcuuuuucacuggacuucuccaggagggaaacccaggacaugacacaagaaacgucuagagccugauggcaccagccaucacauuaacagauaacaaccuccgccuuaaagcuuuagaccgcauagacuuuacugugugaaccuuaauuacccgaguuaaagagaaaaaagcuacaugaucccauaccagacaaauaacuaagaaaaaaaauucagaagcaaacauuacuacaauauugaaucaucuguacccaccccuccaccaaaaugauaugcuggcugaggcugaauauauaauacgauuuuaaaaaccucauauuagcuugagauauaaucucucugcuucuguuaugucuaaaaguagaaauguaugacauagucucacaaaugaugaagcaagcacaguuggaaauauacaccuuaguuuuuucugauuuguuuuauuaacaucugaagucaaauugcacaaaaagccuaguacauaugauagcacuugauaaaaauaauguaauucucaagguuuugcaauuuauucaagaauuuauucaagaacugugauugaguguaaauuaaaucacaacugcacgaugacucaccauuucugcuauaugaggguaacaguacuuaccaucagcauagaguccuuugggauuaucaggacaagaucuagacaggugccccauuucuccacaaacaaaacauuuugcaaaaggaaauucgccuguaaaaaucaacaguuccuauucaguugacaauacauauggcaagucauaaaauuaacauuauuuuaaaauacucugaauaaaaaauauauuuacauaacuuaaaauuuaaucucauaugauuuccaaauacuaaguggcacacucguaacaaauuguguuaaaaaaauacccaaggugcuauuuauuggcuuuccccaugaacaaaacaaaaaacugaaagaaacacauaccaagagccgggucuacuuuagccuuacacuugguuauuucgugcucuguggacccacaccuguaacauaucccagugcccaugucuugauuuucaagggcggcggggcaaucugcaauuccaugaccagguuuucuacaauggaaacacaccuaggaaaacaaaacguagguuggcacgcugcaaaacuauaccagugacuuuauuaauucuuguuaucaaaaacauauuuaaaacauuucucaucuuauuaagcuauuuuucugaaaucucaauauuuguagaaaaaagcuuucauacguuccuaaacaacgagauauccuuuccaucagaggguuucauugcuuuugaaaaccucaaucaauaaauccauaaaucucaggaacaauguuauauauguggcuuuguagacggcaauugcuuaaaugaauugagcaaauauggacuauucauuuuauuaacuggaaugucugcaguagaaaaauggcauuuucuauaggaaauggacaguggcuauaaaaacugucacucaaaauuuguauuuguauauaauuauguacucaaaauuuuaaaaaauuaauauuucuuuuaaaguucacauaauugaaugaauuugggucagacauuuccauucaaauuaugauucaaaccauaagauagauagauagauagauagauagauagauagauuuuuuuuuuuuuuuuuuuuuuuuuuuuugagacggagucuuacuccaucacccaggcuggagugcaguggcccaaucucagcucacugaaaacuuugccuccuggguucaagugauucuccugccucagccucccaaguagcugggauuacagguguguaccaccaccuggcuaauuuuuguacuuuuaguggagacgggguuucaccauguuggccaggcuggucucgaacuccugaccucaggugauccacccgccucggccucccaaagugcugggauuacaggcaugagccaccacgccuggccauaagauauauuucauagcaaaaaguauauccuuguuuuuuacccuaaauacuuuuuuguuuuuugagacagaaucucgcugucaccaggcuggagugcaguggcgugaucucggcucacugcaaccuccgucucccagguucaaaugauucuccugccucagccucccaaguagcugggauuacaagcacgcaccaccacgcccagcuaauuuugguauuuuuuaguagagaugggauuucaucauguuggccaggauggucucgaucuccugaugcaccugccucagccucccaaagugcugggauuacaggcaugagccaccacacccagccauacacauucuuuaauauucagaaauagguuucauuuuuagaauauaugcacaauacauuuuaaaggaauaauuuauuccaagaugaauuauuuggcuccaacauaaaacugagcaaugguuaguuguuuacagaaauuugaagaauuuuuuugcugcaauaaaugagaacaucaaccauaaucaaagauggcagauauuuaaacuauuuuauuuaaacuggaaaaagauauacauauuucuuggauaauaaauagucauuuaauuauguuuuuucaaaauaagcacagguuuuuuuaaaaagcaaauucaaccagcaaaauaaaacauuuauuuugcaacuguccuuuuuuuccuacuuaauaaaauauugaaaaagaaugagucccuuuaaauucuucaguaacuuguacauuuagaaugagcugguccaaaaaaaagaagcuguauuuauuauacaaaugcaggaaaagcuacugcuaaaaccugcaucaccaccauaagaagucuuggcuucuuggugaagucaagguggucucuacuaagcugagacuacugccuuaguucacugccuucucuuuuaaaaccuaaucaucaccuaauacaacauuuuugaaugguccuuaaguuuaauguagaugggauugugaagcacugauuguaaauuucuauagcauaucauuuuauuagcauuuaaggaccgaugcuuaguauaagguauuaaaaaaauaccaaggaaguaaauuuaacaacaggucauaacaagccauauacuauuuauauagcacuccccuuuuuaaaaaacaauauccuuccccacuuaauuacaaacauaaugcuuuucuuaagcggucauaacaguaaauguuuucaaaugguaugugauucaccauaccgccuaugucaacuaaacuaaaaugacuuaaaauauuuaaaaaucguuaacuuacacaaaacucuauccugauaccaacagaaauguuauccuuucuauucaaauuuauccauaaggaauguuucaucaguauuaucucuaaauaacuaucuuuaaauauaacaaugcauagacuaaucuugcaaacagccaaaagacacauuuauagaggcuguuaacauuuuaagccugcaauggugcaaacagugcucuacauauaguaauacuaauaaaaaauaaaaguauaauaacuagcaacaaguccucauucuuaugaagugguguacuaggaggcuugggaaacucacuuagagaagggaaauaauuauaccaaguauuucauccccuuugccugacauacuuuaaaaucuagggcuaggcauuagagaaagaaaccugcugcccccagcauucuucugaauguaauaugggggagggaggaagcaaugacuagggagucucaaggacuuucaauucugcuauuacucugcucuaacuaguaugacuccuauguaucucuuuccugugcuucaguauuucauagauaaagaacauccuuuccaaguaauagggacccacacacauuuaaccuguucuacuucaucuucuucauaauuuugacauuuucucaaugcuaauuugaaaaaggggcuauuggaaggugaggauagguuuugguuuuuuuggaggacgaacucucguuuugucacccagacugaaaugcagcgguugaucacaugguucacuguagccucgaccucccaggcccaauccuccugccucagcuggcaguaguagcugggaucacagguguguaccaccacaccuggcuaauuuuuuuuuuuuuuuuugguagacauggcgucucccuauguggcccuggcucgucuuuaauuccugggcucaagugauccucccgccucagcuuccuaaagugcugggaucacgggcaugggccaccacaucuggucuauaacguagguuuugaagucaggcuggguuugaaugucaccucugcuacuagcuaaguggcuuccacagguuauuuaaucuaucugcacuucaguguuugccauccauaauaugggaauauaugccaucaccuuugcuguguuguuguaauaauuaaccaguacaucaugugccuagcauauaugugcuaaaaaaguacuaguccuuaaaacgaugcucuauaaaucugggacauaaugguaaccagagcuggcuaagguauauaugugugugaauauaagaauaguuuccagcuaaauaaaguaaauaacaugguagaagugaugcucucaccauugcauuuuucuuugccgcuugucuuuuuaaucuucuuccuucccgucgacugucuuucuuuaaagcaacugcaauuucuucccuuacuuccucacugucuguugcuauaauuugcccauugugaaccaucugugaauucugucuuagguauuccaugaauccauucacaucuucauuuaaguacucuuuuuucuuuuuguucuuuuuauguuuugcuuggggugcaucauuuuugagggauagccuauuggcuucaaguuguuuacgcuuugguagguuuuggcuuguucccucaaaggaucccuucuucauguccucccaugauguugcaggcaagggucucuuguuauaugugguacuaacucgggcccaccuggucauaauuucaucagugguaccuuaucaauuuuuaagacaagcaugggugguuagccaucaacaacaaaaacaacaaaacuaaagagacaugcuauaucacuauaugucacauaugcccauauguuaaacuuuuaauuauuaaaacacuuuuuauuucaguuagauaucuguauacauauuuaaugcuauaauaugcugcauagacaugcuucuaacauaaaucuaccacuuaccagaaaagcugccacaccaguuaaaaaaggugugcuuaaaauugaaaaacuaucuuaagaaaccaaauuauuucauaaaauauaaaucagauaguaauacaaugaaugcaauuauuccucccacauucugcaguuuucccggcuguuuauuuuccuaucuccaagucccacagcuacuuucucccaaucuucuugcuucgucugccauuucaaugcaacaauuugcauagcagauuacuaaguauacagaaaucauguccuuuaauaugaaguuuguugaaauuuccuggcaaaguuauaaguaaaacauauaaaaguguuuaccaucacaggaugaucccgggcuuccucuuacuaaucaagguauaagcuacuuccagcccagugauuucacaucaucuucaauucuauuuaaauuaugacuugaaucauaagauauauuucacaccaaaaucuguaucuuguuuuuauacucuuaauacauaugcuuuaauauucagaaauaacuuuucauuuuagagcacauacauaaagaaguaauuuauccuaacacuaaugauuuggcuccaacauaaaauggaaaaaaguuuuggucacuuacauacuaccuagugauuuggaggauauuuuuuuccugcaaugaaugagaacauucagccauaaucaaagauucaucagcuagucacaugcuacauaacauuuaggucaacagcgacugcacacaugauacuggucucagaugauuauaauggagcugaaaaauuccuauugacuuuguagcccucauaacuuguaguguaacacauuacucaugucugugguaaugcugguguaaacaaaccugggaugccagucauauacaagcauaaugcuuacaaugauguacuguacauaauacuagacaauuauaaguauuccagaaaaaagcaguuauuauaggagaugacagcuccauucauguuacugccccugaaaaccuuccaguaggacaagauguggaggaagaaaagagugauauugaugcuccugacccgguguaggcacaaugugugugucuuaguuuauaacaacaaaaaaaauuuuuacaggaaaaagcuauagaauaauguaagggaauaaagaaaauauuuuuauauagcuauacaacacauuagcauuuuaagcuaaguguuauuacaaaagagugggccggguaugguggcucacgccuguaaucccagcacuuugggaggccaaggccagguggaucacaaggucaggauaucgagaccauccuggccaacauggucaaaccccaucucuacuaaaaauacaaaaauuagcugggcgugguggcgcacucuuguagucccagcuacaggcgcgcaccaccugggaagcugaggcaggagaaucgcuugaacucaagagguggacguugcagugagcugagauugcgccacugcacuccagccugggugacaagagcaaaacucugucucaaaaaugagagacagagagaauaaacuccgucucaaaaaaaaaaaaaaaaggucaaggaguuaaaauuaauuuaaaaguuuauaaaguuaaaaaagcacaguaagcuaagguuauuaccuuauuuuuaauaaacuuagacuaagcauaccgcauuuauaaagucuacaguaguguacaguaauacccuaaauaauaucguaggccuucacacucacauaccacucacugacucacuuaauagcuaccgacagcccugcaagcuccaugcguaagugcccuauucagcuguaccauguuuucuuuuacacuauauuuuuacaguaucuuuucuguguuuagauacacaccauccuuuuacaacugccuacaguauuuaguaguuauacuguacaggucuguagacuaggaguaacaggcuaucccauacggcccagcuguguagguuugugcaaguacacuaugauguucacacaaccacgaaacggcccaaccauuucucauaacuauaccaguucuuaaggggagcauggcuguauuaagccaccaccuuuuuuguuguuguuguggucguuguugagacggagucucacucuguagcccaaccuggagugcagugggcgaucuuggcucacugcaaccucugccgccagggcucaagcgauucucgggccucagccucccgaauagcugggauuacaggcgcgugccaccacgcccagcuaauuuuuuguauuuuaguagagaagggguuucaccauguugcccaggguggucucgaacuccugagcucaggagaucugcccgccucgaccucccaaagugcugggauuacaggcgugagccaccgcgcccggccuaaauuaucaccuuuuaagaccagcaucccuggcaaccccccaagucucagcuccuaguaacagaaagaccccuuccacagaagcugaaggguggacccaaugaauuggugugagaaacuccaugccacuuuaccagcgcacucuucgcugaaguuuaugcgacugucauaguggggaccgaagcuguucaaaaggaaguagauuauccuuccccuacguacgugggaagggggaggcucuggguuaucaagagggugaagugggagagccaagcggcccacccacaggcggauuccagggcggcuggacgcacagcccccagcagccggagcccaacagcugaggucgccgccccuagacagcccgcgcuccagccagcucagggacccagcggcuaagccuucuguccucccagcuucccacgcaaguuccgccaggccagagggaacgaacgacgagacccugcagcuuugguggcugagaaccucaccucaccgcgcuaccgcgcagcuucuuaccgcgcacgaaucccccagagcagccgaguuggcgagccggggaagaccgcccuccugcgguauuggagaccggaagcacauagugcccgagagcgcgucacuuccggcgucacagacggucuuuacaagcgacucgugggcgucaauacugggcugaguuuguggcgcgcuuagugaugggauggcccugugcaggacgccgacacgaaaagaugaagaguucaauccgugcugucugaacucacaguguagcaggcgagauagacgggaagaucgguagggugggagaugccggaaaggcuucccgugagacuggauaagaaaucaaaaaucuggugaaauugccggcaagagggaguuaaggacauucca

SEQ ID NO: 17358 - RNA, 222424 nt, Homo sapiens
ccugagcgguggccagggcagguccccguucuugccgaugcccauguucugggacacagcgacgaugcaguuuagcgaaccaaccaugacagcagcgggaggaccuccgagcccgcucguuacagcagaacgcgcggucaaguuuggcgcgaaauuguggccgccccgccccccucguccccauuugugcaggcgaggccccgcccccccgccccggcgcacgcagggucgcggcgugcucgcgcccgcagacgccugggaacugcggccgcgggcucgcgcuccucgccaggcccugccgccgggcugccauccuugcccugccaugucucgccggaagccugcgucgggcggccucgcugccuccagcucagccccugcgaggcaagcgguuuugagccgauucuuccagucuacgggaagccugaaauccaccuccuccuccacaggugcagccgaccagguggacccuggcgcugcagcggcugcagcggccgcagcggccgcagcgcccccagcgcccccagcucccgccuucccgccccagcugccgccgcacauaguagguucugucugggacugggcagggccaucggggcugggggggcggggcuuguggguaaggcgggcggaggcggggacccuccgcccgaugauagggcuggaggaggaaggggcgggcugaagaaggggaaggugggaagagcccagccggggcuacaaauugggugaagcgcugagguuuuaguacuuccguuugaggagauaggcaaagguuaugcagguuuuuaauggcaggccugagacaggaacucaggucuccugacucccauucugaugagggggcuugugggcaaggggugcgucuuuuaaccuccauccuuuuuuuuuuuccuugguggucgaagaguuuuacugauuuuuuaaaaaagugcuggauugggugacuagaagaaagcugcccuuaggucuccaguuuuuaagacugcaacagcauggcucaauauuugaaaucacuacgguuaaaagcagucauauugugcaguuccccagugaacucuuuuuguaguuuagauuauaaagucugaaauacaguuuggguggauaaaguuucuuaggaugguauagaugugacuaaucauggaguccuuccuguugccauccuucaacgcaauaaguacguuuguuuguuuuuaaaccagagauacugccacaggaaaagcccaagggugaccccucacuugggucaccugcacaguauuuuucagauugaggcuguggaagggcauugaagacugguguuuagccaccuaccguguuuuaauguagguggcagcuugggugcuucaaaaucuuguuccuuucguauauauuucucccuuaaaaugauuacuccucuucuguuuuuuuugaggacgagcuacguuuucaugaauucaccaaaauuuugcacccaccauuuaaaggguagcuggugaaggacuuauguaugcuuuuggcaaguuuucugccaagaaaaaauucauaaucuugucacaucuuuagugaugaacauaaaccuuuuaaacaggaaacacuuaaauugcagugaacaugucaaaaaugauacuguucuuuuauuaccuaucuuuuccccucugugccuuugcuacauaacuguuuauuucuuagagguauuuuauuuagcauauguaaguagggugauucaaguuuuauaauuagagaaagcugaaggcucauugaaucaagaccgguagcagccuugguuucaauuaauucuaaacacggcuugaguugcugaggcuccugacuaucagacucuaccuugucuuuuaugguguuaaaaacaguucacccauaggguuuuccagagcuaaaaguagaggauucuuugaagaguggauggcaaggaaccuugucauucaguuguaagguuuaaauugcuucacauacgucaggccuucucagaguagagauaacacaucauuuucuaaccuucccgauauaggcuacagaaauugacagaagaaagaagagaccauuggaaaaugaugggccuguuaaaaagaaaguaaagaaaguccaacaaaaggaaggaggaagugaucugggaaugucuggcaacucuggugaguugugggggauucuuuuuucuccucagucauggcucugguauucuggaauucuccagagggcagaagagcguauuagaauugugucuuuuuucuuuguggagaaaggucccuuuuguuccugagcagaguggcccccuauaggugauggugauguguauaggagguuaaggggaugguagagcuacaauucugcaauuuagcuguaguucucccaacuuucuccuuuauuccuucuagcuauuuuuguccugguuauaaaauuaaaacauucuugcuacagaaauuucaaacaguacagaaauguggaagguaggcagugauagaccccauaaucccucccuuugagugaggcccacugcuauugguguucuguauauacuuccagauuuuaaaaauuuguacauguguauaugugcauagucauaagcucaaaaauuaguuuaaauauauuuuacagauuauauuauauucuauacuaauuugcuacuaucuuuuucuacuuaauagaaaauuuugaacaauuuucaguaucaggaccugcagaucuacucuccccgcuuuuuuuugcuuagagcugcucuuuguguauguaaaaggcauugaauaaaaacagcaugccuaggcugggcgcaggggcucacaccuguaaucucagcacuuugggaggccaaggcagguggaucaccugaggucaggaguuuaagaccagccuggccaacauggugaaaucccaucuccacuaaaaauacaaaaauuaguugggcgugcugguaguugccuguaaucccagcuacuugggagguugaggcaggagaaucacuugagcccaggaggcggagguugcagugagccaagauugugccacugcacuccacccugggcaacaaagcgagacucugucucaaaacaaaaaacaaacaaaaaacagcacaaaaauaaauaaaaacccagccugccugagugccugaguuccuggauuucuagaggugguguugcauauagacaguugagcagauuuuucucuaguuuuaugguaccagagaauuugugauaagggaagacaggaaauccaucuuuauucauuauccucaggaaauuagguaaagagaaugagaaaaaaaaaaaguuccaauucagauagagguaucuguccaauggagauauauguaaaauauuaauccuuccauaaaagguaaaauuugaauuuuagggucaacaugaaaguguuaguaugaaauaacuacaggaauggagauguguggcuaaggagaaaaguaaaucuaaaacuucaccuuucuggaggggucaugcaaggaggcgugacuugagagaauuugccacgguuaauguuacaauucuggggcagccuaccuuucauugcuugauuauucugcauagacccauuuuuuaggucuacaaacacugaaugagcaccuaugauuuuuauucuagaggcuuuuuguagcucauuuauuuuuccuaagaaugcuuuuugcccucuuuuuuuuuuuuugagauagggucucucgcucugucacccaggcuggagugcacuugugcaaucucagcucacuguaaccuccuggguucaaucucugcucacuguaaccuccuggguucaagcaauucuccugccucagccucccgaauagcugggauuacaggugcgugccaccacaccuggcuaauuuuuguauuuuuaguagagucagaguuuugccauguuggcuaggcuggucucaaacuccuggccucaagugaucugcccgccuuggccucccaaagugcugggauuacaggcgugagccacugcacccggccuguuguucucuuuuuauagaggaagaagugggugauagaugaagagaauugaugauuaucacaguuaaguaacuuaacuaagaccacauggggacaguugagauggaauguuguugaaauaagacaacacacuuggcauauuuuaaaauaggaccuuugccacuuguuaaaaauggcacuaaggaagaagggggaggaucauucacuagucagaagcugggugacuguuccacuucaguuuauuuuauuuuuuagagacaggucuuacucugucauccaggcuggaguguaguggcagggucauugcucauguagccucaaacuccugggcucaagccauccuccugccuuagcuuccuaguagcaaggaccacaggugcaugccaccaugccuggcuaauuaaaaauauauauauuuuuuuagagacaggguuuugcuguguugaccagauuggucuugaauuccuggucccaagccauccuccugccucagcccuucaguagcugggacugugcuccugagccaucauaccuggcaaguuuuuuguuuuuguuuuuuucuaauaacagaauuauuaagauauaguucuuggggccaggcacgguggcucacgccuguaaucccagcacuuugggaggccaaggcagguguaucaccugaggucaggaguucgagaccagccuggcccacauggugaaacccugucucugcuaaaaauacaaaaauuagccggaugugguggcgggcgccaguggucccagcuacucaggaggcugaggcgggagaaucccuugagucuggaagguggagguuguagugagccgagaucgugccacugcacuccaagcugggugacagagugagauucugucucaaaaaaaaaaaaaaagauacaguuaugcaauaugauucacccauuuagcaugcacaauucgguggcuuuuaggauauucccagaguugugcaaccaucaucaaagucaauuuuagaacauuuucaucaccccaaaagaaacccugugcccauuaacagccaccuccuguucugccccagcacuccccagcccuagguaaccacuaaucuacuuucuguguauagauuugccuauucugaacauuucauauaaauggaaucauacaauauguggccuuuggugucugguuucuugcaguuacuguaauguuuucaaggcucauccguguuguagcauguaucaguacuucauucccuuuucuaaaaauauucauuuucuuuauugugguaaaauauacauaacauaaaauuuaucauccuagacauuuuuaaguauacagcccagggguauuuaguacauuuauauuguuaugcacccaccaccaccauccaucuccagaacucauuuuaucuugcauuccuauaacucuguacccauuaaacacugacucacuguaacccccuucccccagccccuggcgccuaccauucagcuuucugucucuaucauuuuggcuacucuauaaugcauucauuccuuuuuauuuccaggcaguauuccauuguauauauccaccucaguucuuaacucuucaauuaacaaguuauuuuuuauaccugggauccacgggggaaggaaacuuuuauacucacaagcaaacuuagauacauuugaaaagccaguuaaguacguauuuuugaaaaccaagggaauaauaauaaaguaagagaugcauaguccauuuucacacugcugauaaagacauaccagagacugggaagaaaaagagguuuaauuggacuuacaguuccacauggcuggggaggccucagaaacauugugggaguugaaaggcacuucuuuuuuuuuuuuuucuuaauuuaaguucugggauacauguguagaacaugcagguuuguugaaaggcacuucuuacauggcgguggcaagagaaaaugaggaagaaggaaaggugggaaccccugauaaacccaucagauuucaugagacuuauucacuaucaugggaauagcaugggaaagacuggcucccaugauuccucccacuggguccucccacuggguuaccucucacugggucccuaccacaacacgugggaauucugggagauaaaauucaaguugauauuugggucggggcacagucaaacuauaucacauuggaaaagauucaaaaauauauuuuuagcauaaaggaagucaugguaaacaagguaacuguauauuggaaaagucauauuuagaagaaaagagucacuguauuucuucggagauucuuagccuuuagcauauaagacaucaaagguuuuuuauuuuuaauuauagaggguugucuuuuucucugguugcuuuuaagauuuucucuuaaucacugauuuucauguuugauuuucuuucugccccauauaaucugcaggaacccauauuugauuuugguggaccuugucucuuucccccacacccgagacagccugugcugucuagcacaggcuggagugcaguggcacaaucucagcugacugcaaccucugccccgccaaguuuaagcaauucuccugccucagccucuggaguagcugggauuacaggcacucgccaccacgccugguuaauuuuuguauuuuuaauagagaugggguuucaccauguuggccauguuggucuugaacuccugaccucgugaucuacccgccucggccucccaaagugcuaggauuacaggcaugagccaccgugcccagcugccuuugucugguuuuuaauuuuuauuucuucauuuauuuuuauccuguuuagagcucauuuaaagcuucucgagucuguggguuuauaggucuuauuaaaugugggaaacuuuuuugguuguuauuguuucacauuuuuucugucuuccugucucuugugucuccuucugagaguuuauuacggggauguuaacuauuugguguuaucuguuaagucauugaggcucuuuccauuuguuuuccaggcuuauuucucuuuguacuucauuguggauagauucuacugcucuguuuucaaguucaguggucuuuuuuucugcuaugucuaaucugcuguaaaucucguuuaauaaaauguucguuuuccauauuguauguuucaucuccagaaguuccauuuuguucuuuuaaaauauuuuccaguucucuauaugaauuauaucucaguaaagcuaaaaaaaauuccuuuugcuccucuuuuugcucauguuuuccuuuacauucuuaauuauauggagcauauuuauaaauuguauuuucuuguucuuauaugcuaauugcaucauaucugucauuucuggggcugcaucccuugacagauuuuuccuauuuuuugcaugucuaguaacuaauuauuuggaucauggauauguugaaucuguguugucuccugcuggaguuuguauuucuuuagaguguuggacucuguucuggcaagcaauuaaauuccuuuggaucacuuuggucuuuuuaaggauuguuuuuaaacuucgguagagaauaauagcccuuacucuagagcaacuuuagucacauucuacggcuugaccuuuuuagaguuagaaagggggugcauaguagcaguagcacaccauuauaucguauuuccacaauacagagacaguagacauuaguaacauuaagaauguaaacacagccauaugcuaccuaaugacagucagugagggaccaccuauacaacauuaaucucauaagauuauaauagguauuuuugcuguaccauuucuauguuuaaauauguuuagauacacagauacuuaccauuguguuacaguugucucuaguauucaguacaguaacaugcuauacagguuuauaacccgggagcaauaaacuauaccauauagccuagguguguaggaggcuauaccaucaucuagguuuguguaaguacacucucugaugugcacacaaugaugaaaucaccuaaugacacauucuucauaacauauccccaucauuaaaugaugcaagacugucaacaccuguaguaaguuuuaggcagugaguauuuauuauucaucuaguagcaucugccagacauaagagucccugauuauuucaucucuguuuuuaacacuuugguuuuaaauacugucaaagucaaauaaaauauagggacaaaucucuaaaacauuuuauuuggggcggggcacgguggcucacgccuuuaaucacagcacuuugggaggcggaggcaggcggaucaccugaguucaggaguucgagaccagccuggccaacaugaugaaaccccgucucuacuaaaaauacaaaaauuagccagauaugguggcacacaccuguaaucccagcuauucaggaggcugaaguaggagaauuacuugaauccaggaggcagagguugcagugagccgagaucgcgccauugcacuccagccugggugacagagugagacucugucucaaaaaaaaaaaaaauuuuauuugggaagcaagaauugcaauuugggacauacacacagaccagguggucuuugguauguuugaagcacaaagagaaaauuggagguuuuauuaaaaaggagaaauaagccaggagcaguggcucacaucuguauuccuaacgcuuugagaggccaaagcaggaagauuauuugagcccaggagucagagaccagccuaggcaacauagggagacccugucuauacaaaaaauuaaaaaaaaauuaguuggccaugguggcacuugccuguaguuccagcuacucaggaggcugaggugggaggaucucuugagccugggaggucaagguuggaaaaagaaaauguauuguuuugaacgaagguucauugguacuuggaaaauuuggaguaacuggcaagcucugauuagugaaugacugcaauggguaaaacuagccauagagucacagcagguuguuuuagcagcuaucagguaaaauugguuucagguuacaguaggcaguuucagcagcuaggcuugcagagaauuacauuuuuggagcaaugauaugugcucucagugcuuuuuccccuggccucucuacuccauuucaauugaguaugacaagaaugacccaauuuauaugaucaacuuucacaauacuuuuuuuuuuuuucccagcaaauacaacuccaagaucuucaucccacuuucauuccaggcaguuuuuuuuuaugucuauaggagggaaacucuuuguauaacauacacacuuauaguauauuuuugaagagcgauacaaauauacauuucaaaaaagagaguaauaguaaacaaggugaauauacauuugagaaaagagucaaauuuaaauuuuuguggcuagaaaauucacaggagaucuaaugaaagccugugaagagguuuaaauauaaauagggaaaauuuuaaacuauuuuuuuugaagcaacaaaagcagagauuuauuggaaacaaaaaguacacuccacagggugggagugggcccuagcaagcagcuugggagcaauuuuaaacuuuuagaaaugaacaaaacacaacucuugcccucagaguguuuuugcuuuaauagggaagguaagaggugauaaaugugugcagucccaguuccuuuacauuuaauagcaccaaccuaauaguagugcucuaaacggugaaauacuguguucuaguacaugguagggauccagaaaaugauaguuucccuucuuuuauggauugcuuguuuaugaaaaacugccaauuggcagacugugaugagugccacagggagaugugaucuuguuagaggaacacagagaaagaaaagaugauuuuaagcugugaaaauuagcagaagguuuuaugggaaagguagauuugagaugggucuugaagaaugaauacaauuuugacaugcagaaagcauaucaugggcaaagugaugguguuucugaguauggugauuugguuuucuugguaaaccccugaugucaauaucaagucuuuccgcuugagcuaguaagauuucccagucaagaguccucccagcuucugccuggaggggaguaggagugcucuggcuuccuggguucuggagaggccguggaucucagcauacauugugucuguguuccuaaucguccuucuggguuagguacaguacuccaucaacugugcuuguuuugccuuuccagggaagaaaucuccaguuggcugcugauguggaggaaggacaguugucuuugagcuuggaguaugguagggguuuagggaacaaauugcuuugaaccaauccucuuuauuuuagaaccucccuuuauuccuuuccagagcuacugguacucuaauuccugagucuuuugagcauuuuguguuguaauuagaguuggcucuugguuuuccuaauuacugacuuaguauuuagcucucaggugugcugaauugguuacuguucauuuguuuuccuuucuagcuuuagauaucucauuugcaguuguuaccucuccucucuguccuuaugggcuuaugucuucaaaaaaaaacaaaaacaaaaaagaaaaaaaaccucuacuauaguaaugagguuucaggaaugagugaaauugcaucuguguuuaauaugccaucuuuacccugaacccaguguuucuuucuuuuuuuaaaaaaaucacauuauaguuagauucauugcuuuauugggaaucuaccucuuuaaaaaauucuaugcugguuaugaauugacauaaugagaccaaaauuacuauuguucuguuuucuucuuauuugcugccuaagagccaaagaaaugucugaggaccaggaauguuucaaagucucuggaaaaauugaaagaauucugcugcgauucugcccuuccucaaaguagaguccagacagaaucucugcaggagagauuugcaguucugccaaaauguacugauuuugaugauaucagucuucuacacgcaaagaaugcaguuucuucugaagauucgaaacgucaaauuaaucaaaagguauguaacugcuauagaugaguauccaguuaccuagaauaguggguucugaaguacugucagguucucugaggucauucauggcaaugguuccuaaacuuggauggucuucugaaucaucugagggagcuuuuguguuuuaguuuaguuuucuuacaucccuggagauucgauuuacuguguuuugggagggauuaauugguuuguaugggaacaaaacaaaagccuuccagguaauucugagguauugccuggaucaggagcccuugacuuggagggauucuuuauugagaauuaauacaagcacaguuucuuacagucuuccuuagaguuuccaugauuaccguggaaaaucaugaugggcaacuuagauauuuugagguuucaguugaaagcuugauagauagaaaguaaauucaaauguaagccaaaugaacaugggcuuuuuacuuuauccacuauuuguuuugagacuuuuaaugguuuucauaacugcagaaucagggaauuuaacucaugcuccaucauugaaaucuguaauucagaauagugauugguucgcaaccuuagcuuuacauuggaaucaccuggagaacuucaaacaaaaauugccauuaagaaccuucccucagaaucuuaucuaauugguuuucacugacaaaugggcauggauauuuuuuaaaaguuuacauuuuauuuuguauuuuauuuuuauugauggagucuugcucuguuguccaggcuagaguacaguugugcgauuauaguucacuguagucucaaacuucuggucucaagcaauccucccaccuuagccugcagaugaggugagacuaaaggaaaagcagucauuuuaaucuguagcugugauugacaaccauugaauuagagaaaugguucuauauauguauauguauguguguauguauauauaugagucauugaaauucuaaugaaagcuguuggccuuuuucuucagaaaaauucucaagccaacaaaauuuugccuauaauuuucaagauuucacaccuuucccacaaagcccagauccaugaacuccucccucagccaggcuaauauugauugacuuaucuuagaucaucaagaaaaaaaagguguuuuuguuuuuagucucuuuuaauacuuagaagcaguucaccuaaguauagugguuauuaagcauagaagucauaaaguuuauccauuaaagcucacuuuauugauaggagcauuuacuccaaggucucagaagagcguauacauuauugcuuuauacauagaaugaccaacuuggcauguccacaucacaggaaauuagaaguaaguagacagagggggcacguagaagcagugccauuauuacaggugauaagcuguuugauggcauggauagacguggaugaauggcaaaaagcuacugagugaacauaaaugccccaugguccaggaccauuaggguggggucagcaaugccauaacucucaauagguuucgaaauauauucugaucacucugaauuguccagacaagguuaaauugaguucagcauacugucucugggaauaugaaauagaauguaauguaucugaugaguauuucuauccaaaucauuuuuuuuaaaguugcuuauuuuguuacccagguauuaauauguacaacaaacccucaugacacaaguuuuccuauauaacaaaccugcacauguaccccugaacuuaaaaugaaaguuaaaaaaaaguugcuuaauauucaaguauuuagauugauuuaauuguuagcaucccauaaggauaaaacuuuuuuuuccuggaagcuuaucucauuuccuaaaagaauaaaguauaaaguaagaauaaguuuuuacaauguaagaaauauauuuucuguguugauuaacuuuuauacuacauaguauauaccugcauuuaauauagaauacauacuauauuccaugacauaaaagucauggaaacaaaauaggaaacucaucaaaauuaaaagcaaaggcauucuuagguauaggaaaauuguuaugcaauccuugggguguugcuucgccagcuguaaaccucuguggcugguggugccuuugcccgaguuuuuacuugggccugcugggcucauuccucccacucggccuggcaggcugugcuuggcuuuugcuuuuggccugaaucucgcagcugccaagggugagccaggaguggaguggugagggugaggggugugugagcaggugaccauggggucuggccccugugcacugccaggcaugcuggcuucggcagggugggcagcuccaggugccagcgugagugagggcuggaccaggcguaccacaaacagcuuccacagcuggcaccagggaacacaguggcgcccagaagcuuggagauuccaggaacugcagagccccagagagggugucauagaccuggcuuaggagccccuaggucugagcuccccagagguccacagcucuucucuccugucuucucuccuucuuguugcugcaauguggcaagcaagagauggguuucaggccuguuuguguuacagcucuuuuagcccugccauucggugggucccagguucuuguccugcuuccaggaagaaugaaguauguggacgaguggagggugagcaaggcaaagaggggcuuccuugagugacagaacauugaggggagacccgcagugggugcuucuuucugcaggcagggcaucccaucaagugagaagugaugagccuucagccgagaggggacccuggaguggguagcuccucuccgcaggcagguugucugcuugucucuucaaguuuggccgagucuggggauuuguaugggcuugagaggaggaagugugugcugauugguucaugggcugccaugggcgggcucagaaaacaccguaaguucuaauucugguucgucagccuggcccccaggcuucaggcuguuccuggcuugaagguggggcuucacccggaccugacccuuucugcucaggagccugucugccuccugccgucauccauggcacccaggcuguuugugccauggggcaccugcaggacagcucugagcugcccucagcccucuccuuggccuccuucccauguucaucaguguccaaaguccagagggggccgaggcagcagggggcuggcauguuagcacugcccugagcaugugcacacccagccagguugcaacaguuccuaggcuuggccuuaacuuugagaucagagugggugcugggagcugggagaggccaggcagucggagcagguacuucugagccugcagagggagggggaauucccuuucugggcccuugagauugcagagaugcccggguccacagccacagcuuggguggcuguggcugcagcugcacccaggaggguggggcuccugccugcucccagcccccaagagcacagggaugcccagguuugcagccacaacugggcagccacagcugugcccagggagcgugaggcucucacccugccaacucagaagggggcgaggcuucuuccacccauuucuggcuccugucgguucuguggagcaugcagcccuggcugcgccucuccuacugcagcuggcguuacggcaguggcugcuccagaugggcugccauugccaucauaaugaccuggauuucucuugccaaccucuccaugccucaccgucuucuuauugcugaucuuuggagguuugcuggacugcacuguucaaauaaauugaguuuuuuuugaaaaguuaguaucuuuaccugaugucccggugaagcugaauuguuuuaaacauuugggaacuacaaaguguacauguuucuggguuuucuuuuggauugggguucccauuucugggccauuuugcuucucucucacucuccccucuucuuuuuggucacuagauuuuuaggccauauuuuucauuguagggggagcuggguaaauuuuuagaaguuggcagugacagaguggcaauuaauuagaaguuggauuuagccaacuauaaauuugucucauuuacauuuuucuaaauuaagucuaauaagcgaggaauuuucccuaagcugugaauuggaauuaauuaugguuccucacagaaagguaagaauaguaggaguacuaauguugaaaauguggccuugugcuguaaauuuuuuaacagcucuuucucauguuucuuuaccaagagaaucaugguucuuucuuucuauaagaauuuauagaaugugcugucuuuuacagugugcuuggaaguauaaaacauuaagugcagcuuuaucuguuggcaugcuuugcucaaagugguuuugcccuacuccugagagagagccagauuuguccccauuggccuuuugugcauuacacaccuuagaauaaauaauaaaaagaaaauaaguguuaauaauaauagauuuaaugaaaucaaauuuaaaaacaaguauguaaaacauuaagauauuuagacuuucaaaauuugcauaaaaauucuaugauagcuuacuugguucauaauuuuuuuuaaccuucuacuuugaaaauauuuguaaccuauggauaguuugccggaaugcuacaaugugcuucuauaaacuuuucaucuagauucacuaaguguuagcuuuuugccagauuugcauuuuccgucucugggaacuuauuauugugguuaauauuuuuaaaacuuuauacaucuuuugguugccaggacacaacacuuuuugaucucagucaguuuggaucaucaaauacaagucaugaaaauuuacagaaaacugcuuccaaaucagcuaacaaacgguccaaaagcaucuauacgccgcuagaauuacaauacauagaaaugaagcagcagcacaaagaugcaguuuuguguguggaauguggauauaaguauagauucuuuggggaagaugcagagguaagucgucuuuucaggcacuauuuuauauuuuucuugucuagccuuagauauuuuucaguauuuuuguuucauuuucugaccuuauauaaaagcugauuugaucaaucaccuuuuaaaaaauacuguuauguaaaguaaaaacuaaaaaugaacacaagaaacuuggugggaaccagacuuggugggaaaaagugaggggucucuauuggaauguuagcgcuuauucuccgugguacuaggccaguacuuuuuauccauccaaaguuaauuggaugagucaauuagugaauaaaccguaaucauguaaauauguuuucuaaugaagacucaagcaagaaaacauuuuugagauguauagaaguuccucuguuuacucuuaauuuaugaauuuucauagccaggaacaaaguuaagucucaauggaagaacacgugaacuuuaccagcuaccaccagaaguuguuugaaguuuuacagaucucuuugggugucagucaacuuggugucuuagucuaaauugggauugugccaggugugguggcucaugcuuauaaucccagcacuucgggaagcugagguggguggaucacuugaggucaggaguuugagaccagccuggccaacauggugaaaccgcaucucuacuaaaaauauuaaaaaaauuagcccggugugguggugcaugccuuuagucccagcuccucaggaggcugaggcaggagagucgcuugaacccgggagauggagguugcagugagccgagauccugccauugcacucuagccugggcggcacagcaagacucugucucaaaaaaaaaaaaaaauugggauuguauuuaauguugaaauauuuauuauaggcccuagucaagaagguugaaagugaaauuugaacauuucauaggcaaacuuagggaaaguauugcagaugacaccuuuguuggaagucaugaaugcuugugaugauucuauaguuugggaccugguuggauuguacacuagagagugaugagguagcaugucugugcuucuuggaugggaaguaaagacuuggccaacuuuuuuucuucaaguuuccuaaauccucuguggcaggcaagcagcguucucaaagucagaugcauuaugcaauguucugugauauuaaauuaggcucugagauaaugucaccauguuuucugagggcaggaacaaauauguaguugucauccccuaggcgaaggagagaaacugucuagguuaaacgguaaauucagaccugaccacgguaaaggcugauguuuuucugcccuucugugagggacuaauagaguucagagaaggggugagguuggggagcgagaguguuagaauuagaguuccauggcuucagugggcaauaucuaagccauggugcuuucuagaggaaaucagggaaucacauggugcuucaugguucuauauuucuaucagucgugcaucauuaauuaguuagccagccugggguuucucuuuuuacuuuuucaaugauuucucuguccggauggguucaucauuucugcauacucuguagugucuucuaaaugucagucauuugcacaugccauguagcaaauucuuacucuuuuacagucucaugaucucuguauuggauagucuuuguguagggaaagcucuaaggauguagaagaccugucauauuuuucugagucuuuuauagauacagauguugauacugaaguuaggucacuggaacugcccaaaauacauuaaaccauaggcuucuauacagggaacauuuuuuuaaacuuuuuauugacauaguacacauuuagauuaaguguacaaauccuaaauguauaccuugauuaauuuuuaauaaagugaaccaacaucacauagggaaucuuaaaauauaaauuuauugauauuuucuuuuuucauuuuuuagauugcagcccgagagcucaauauuuauugccauuuagaucacaacuuuaugacagcaaguauaccuacucacagacuguuuguucauguacgccgccugguggcaaaaggauauaaggucagcuuuggcuuuaacuuguggggaaaggaaauugggauucuccuccagagagugcaaacguguuuuguaaggugguagguaggcuucaauugguuuagaauuuugcauuuuacagaacugaaaguguuucauaauuauuaguauuauguauuuaugaguuuuuaacauauuguuagauauuuaggguaaauuuuuaaacucuaugauaguguuucuuagcaaauuauccacccuugucaacuccuuuaaacccuacaucugaacguuguggacugauuauuuuaaccauuucagaauugacguuuaaacauuucgaaaugaguuuuuacaagucauuuuuuauccuuugauagcaauauuucuuauuuuuguugaaggugggaguugugaagcaaacugaaacugcagcauuaaaggccauuggagacaacagaaguucacucuuuucccggaaauugacugcccuuuauacaaaaucuacacuuauuggagaagauauccuuuuuggacgggaguuuuucucuuaaaugauacaagggcuuuguuggcagguuuuguuuguuuguuuguuuguuuuuuaguugcucuuugggaacuuuuuagaugagcugagaggcauuaaggugaacccuugauuaggugugcuauucaagagggaaguaguggcuggaaacaagcaucuuuucacaugucauaguagaaggcaaguucaucauacuucaagagcaagaaaaaaagcaacccuaauaaaagacgaugucagguuaguaucugauuugaaauuauaucuuccuuagcccauuugugggaaguaguuaggugcuuagggccuacaagcuccucagggucuuuccaaagugagaccuaaaaaguaacuuauugaagccaggcgcuguggcucaugccuuuaaucccagcacuuugggagacugaagugggcagauugcuugagcccaggaguuugagaccagccuggacaacauggcaaaaccccaucuccacaaaaauacaaaaaauuagcugggcauguuggcacuugcccguagucccagcuacuuggguggcugaggugggacaaucacgucagccuaggaaguagaggcugcagugagccgugaucaugccacugcauuccagccugggugacaggagugagacccugucucaaacaaacaaacaaacaaacaaaccaaaaauucaaaaugugaaaagagaacuggcugaagucagaauuaagacagaguuaaaugccuauaaaauauagugguagcccgucuucauuaauuguuaacuuuauaaaaauuuuauuacuuuugaaaaugggcugugggugaaguuuucucacuugguaagaauuuucaaugugcauaaugauugccccuaaauuuacggucauuuauaaaugcaguguguuauuugaugccaaauaauuucaaaagcaaaauugucaguuucaaaagccaaauaauuauauguaaaauuagaccagggugcauuuaaaaaaaauuacuauggggguggaaucaguucucugauaauggaagaauggagagauaagaaggccuuaaaugauacugugugaaaguauuauuucuguuaugguuuauuacagaucugcuuauuucucagcucaucuaauucuaaggacuguuuuguuccaugaauacuauaaauagggaacagcuaucacucaaaaugggcuccaaacuauuaacagccuuguguuguucuaagcugaucaggcuguaagaaccugguauuuuuauuuuuucuuuugcuaaagcuugagucuguuauuugaagcccauuucuaguacagucccccucccugcuuuuccuuugcugcuuuuauggguccuauguccugauguccaaagauauguccagacuuugccccaaaucagcuuucaucccugagauuuaguuaauggacucauuuuauacacacauacacagacauacaugcacauauaauguauauauguuucuguuuucucaugucuuuaaaaaauugucuugcuauaucugggagcuuuuagguacauuaaaaaaggaaaauaauuuacacccuuuuaguguauuuauacuuugaauuguggaauuaaacauuaugggauuguuaaggauucaagucucagcaucauccaagugaugaaguggguugauauuugggccuccauggggucugguguacuccacuaagcccuuuggaaguaagauacugguuaucugucuuuaugcucuuuauaucuuaggaaagauaaggcaugcaacuaugauccaaauaaaucagaagaaugaauacugggcagaagauuuuugcaaagggcagaaguacugugugaaaugaaccaucauuuuauuauuuuuuucuuuauuuuuauuuuuuuauuuuguagagacagcaucuugcuuuguugcccaggguggucucucaaacuccuagccuuaaguaauccuaccaccuuggccuccuaaagugcugggauuacaggugugagccacugcgccuggcugugaaccauuauuuuaaaggagaaaauaguuaauauuauuggaaauuuagcauauuaggauuuagaauuuagcauauaauuauuuuucuuuaauuauuauuaaaugugaauccccuaaucaagcuggaugaugcuguaaauguugaugagauaaugacugauacuucuaccagcuaucuucugugcaucucugaaaauaaggaaaauguuagggacaaaaaaaagggcaacauuuuuauuggcauugugguaaguacuuugcaggugaggaacaaauguuagauguucaugguaucucuaaauaugaucuaucauguaugguuuauaauaaggauaucugaugaaguguaccuucagauaauuauacaagaaaaacauuuuucucacaauauuauauguuaaaucgcuaguuacaauuuucucauggcuacuugguacuuguagcaguccauucucacguugcuauaaagaaccacuugagacuggguaauuuauaaagaaaagagguuuaauuggcucaugguuccacaggcuguacaggaagcauggcugaggaggccucaggaaacuuacaaucauggcgaaaggcgaaggggaagcagugacaucuucacaagcacaaggcuagcaggagagagagugaagggggaagugcuacacacuuuuaaacaaccagauauugugagaacugucaugagaacagcaaggaggaaaucuggccucacaaucuaaucaccucccaccaggucucccccucagcauuggggauuacaauucaacaugagguuuggguggggacacagccaaaccauaucaauacucuaugcuauggagagauccagauggucuugguccaugugcccugagauuuuaagguugaagauagacacaauggcagacauauguguggacaauguacagauagcagaauaaaacacuaagccaacacaagcaugguggcaaaguguucuauaaauuuccucuagggauuugaaauuaaacaugaaugacuaugguauuauaucuagauuuggaggaggggauaguuaaagagaaaugauaauuggcugauauaaaauaccauacuaaauuaauauuaggauuauuuacagucaguuuucuagauaaauguaauuugugaauuauaguuuuauuuauuuauuucuuugagacggaguuucacccuugucacccaggcuggagugcaauggcgugaucuuggcucacugcaaccucugccuccuagguucaagcaauucuccugccucagccucccgaguagcugggacuacagucacccaccaucauaccaggcuaauuuuuguauuuuuaguagaaaugggguuucaccacguuggacaggcuggucuugaacuccugaccucaggugaucagcccaccucggccucccaaaauguuaggauuacaggcgugagccaccacgccuggccaacucauaguuuuauugauuuucuggcaguuuaugaauaaauuugcucauuuacagacuuacguggacucugcuaaaggucuuagacuuuuuaaggcccuucagaacaaucagacaccccuuuucuguuguaaguuaagcacaaauggaacucuguccaagugaaaacuaauucucuuugcuuuuucuaauuucuacggucaguggcaauaucaacaaaaauucuuaccaucugaaugucuccaaugugccuuuuaauaccuuauuuugacugcauaacucuguguuaacuugacauuugcuuaaccaauaagcccuucuuucagagaguuagcauuccuguugguguuagacagcucuaaaugauauuuuuauccuugagaagcacguuuuaucuagcuacaggcauuuggaccuauauacaaauaguaaaguuauuuacuuuuaagcuuuaacauauguaaugugcuauuuuauauuuaccuaaaacuccuucuaaagaacagaguugauaguauauaauuccuacuuagugcauuuagaaauaccaucuggcuuaccgccagaguuaaccaugugugcgaacugggacucggaaaaaugaaaacagccguuugcccuucaagcauuuucuuuggggcuguccuuuacuucagcaaccacuuuugggcugaugacauccugagcucuggguccaggcugcaccucucucgagcuccaggcuccugcauccaaauuuuuauugaacagagauacuuagaauuuacucuggcuccucaaacucaguguggccaaaauugaucuuaucuucuuuuacccucgacacuguuuucccugucacaaugggugucacucauugccuggucaguaccugggagucaccuuuugaguauugguaauuagucugaaauucaaagggcuuugcuguuguaguaucacugcagucaggcucugugccuucagucugggcagugcaguuuuauacacacugauuuuagguuucucagugugauacauaucacacagggugauagauauuguggguauuacaguguagaccauuucucugauuaaagaaaaagggaauuuggcugacugaaaaauuuguuacuuuaacaucuguaccugguuuuuguaaaugcuugguuuguagauugguauauaaauuuacauguguauccuuauguacugauaguccaucucucuaggcucuagagaaagccucugggcuagaauuaaggauguuccuuaauuacaguuagaggagcuauaacacugccuccaacccauaagaucccuggguguccauucccuccagaggugucuguaauccagacuuugaagaugauaauuuccuugcuuuuaguuggagcuucuaguuccagccuugccaccuuaaacguuauauacaaauguaaauauaguguguguauucuuuuggguuuugcuccuuuuguuuaccauuuuguaugugagauuuauuuacaugugucgcuguaguucucucauugccuuuuccuauuucauuuuaugaucuacaguuuauucauuccuguugauggacaugugcauucuuucuaguuuacaguuguacagagaaugcugcuguaaauauuuuuguaugucuuguaucguauacaaaugccugaguuucuccagaguauauccuugggggaggaauugcugaauuauaggguguggauacuucaacauuccuagauaaugccuugcuguugucagaaguggcuuuccaucaguaguauaugaacauagggauuggugauuuuuccucuuuuuagcuaaugcagccuguaacuagcccccauggcuuucauaagcauccguaguggcuaacaguguggauuggggaguagucagauuuccuggguuugaaucuugacucuacuccauugucacucugggaccuuggcuagaaacuuccuaucacuucuccaaaccaugaucuuuuccaguuuaucuuugcuauuauuggcuuaggauguuagggagcagguucaaguuggcaugauuauucuacuggauagacugucuacuugggcuucauucagaguuugauaaaguauacauuuuauguguuacuuugauguaugaaguaguaauuuacuacaguacugguggucugguuacuaggaccaugucacuuguuacuuugagugauaacuacuauuuguacagugcuuuauaguuuacaaauaauuccuguuuauuuuauaauuugauccuuacaauaaccuuaugagagaaguaggcugguuugguuccauuuacagaggaagaaacugaggccuggcaguguuugguaacuugccauagucacuccguuagguauauuaacuccaggccuuguauucagggcggcucucggaaaucugauuuauaguaucauuuagauaucugugagucugacucuucguguaagaguccugaaaagcagacagguuucuaacacuuuagaaauagaguacauacauacuccugaguguaucaucuuuacuuuuuccauguuuaugcuguguuauagccauaacuggggaaauacauuuuuucuguaacauuauauuuguauuuguuuuuagggagugcagccugccacaggcgagguuguguuugauaguuuccaggacucugcuucucguucagagcuagaaacccggaugucaagccugcagccaguagagcugcugcuuccuucggccuuguccgagcaaacagaggcgcucauccacagagccacaucuguuagguaaguuggcacaucacuggaauauaauaccgauucugaaacuuagguuuaguuccaaaacugauacuuauuaaaguugcuaaaaauaguuuuuacuuacaaaaauuauauuuccacuguaguaguggaaauuuaaaaaaaaaaguaaaacaacaaagcugggcaugguggcacaugcauguaaucucagccacuugggaggcugaggaggaaggauugcuugagccccggaaucugagaccagccugggcaacuaaggugagaucucauaucuaaaaaacaaauagaagaaacaccaccuaccccuacuaucaccuuaauguagaacuuuagaaggcagucuuuuugaagagguuucugauauuuaaugauauuauuugauaauuaugggguuuaugauauuuaauuauugguaaucuucaguuucuagagauaauuuagaguucacuucuuacaaaguuuauguaacuuuggagaugcuuugucugugcugcaaguuucaauucauggcuguguccagugguuuuguuuacuggaucuaagaucagaccacuuacguaugaagcagugugcuaggcgcugugcguacagaggaagaagaugugguuaugauauaugucuggcagaguuuacaaccucacaugagagucagaugugugcauaccuaacuggacuuaaaggcaugauguauuaagugcuaaacgugaaggugccuuguuggaaagacuccguacugccaccuggaguguggugggaaagagaccagaaaggugugcuggggcuucagcgaaguagacuguauauugacgaauuuggacuuuggacuaggcagagaagcccaugaggauuuucauguaguagguagacaaaucauuuagaaaaucgaggccaggcacgguggcucacgccuguaauccuagcacuuugggaggcugaggcggguggaucaccugaggucagcaguucaagacagcuuggccaaaaccccguuucuacuaaaaaaaaaaaauacaaaaauuagcugggugugguggcagacaccuguauucccagcuaccccggaggcugaggcaggauaaucgcuugaacuugggaagcagagguugcaaugagccaagaucacaccacuucacuccagccugggcgaaagagcaagacucuuaucucaaaaaaaaaaaaagaaaaucaaacugauugauuaagugaaguuccauauguuucuuuguccuuaguguuguguucauuuucauuugaauuuaauuucuuucgaaguagcuuucauaauuuguuuuucugauuauaaaacuaauauauguucauucagaagacaaaaaaaaaaggauaaauucauaaguugaauucuguaacccagagaaaaugacuguuaaacauuuuggcacauuauuuccguguguguauaucacuuuuuuccauuugugaacuugcauuccugcugcaaaaucacuuuucuauucugugguuuuuuuuuuuuuaacuuuacaauuccccauuuuuaaaaacuuuauugcagaacauuucaaacauacacaaaauuauacagaauagugucaugaacuccugucacucuauuagccagcuucagcauuucucaggaccauucucauuuuucuacacucccuccccuuuucucucucccuugauuauuggcuuugaagcaaauccuagggagcaucaguuuauccucuaauauuucaguagguacccuuaaaaacaaaauaaguacaugacauugucauauaaguguaucauaauuuauccauuccauuuuuauuauauucauuuuuccaguauuauaaauacuguuaugaugaauauccauauacagaaauacucaugugcguuucugaugauuuccuuaagauaaauuccugaaaauggaauuaacuggaucagaagguaugaauguuuauaaagcucuugauugcuugcuagaaaugguaauaucaauuuauacuucuaccaguauagucuaggaggguucuuugaaccuuugcucacauugagggugaucauuuaaauaaucuuugccagucacauagaugaaaaauuuugcaucaaaucucuucauuuugaucuuaauccuuuucugaccauguguucaaacuugaauaauuaaaagucaaacaguaaacuuguaaggagagcugcuuuuacagaacuaaaaaaauuaauaaaaucuggaaaaaaauuuuuaaagguaggcuucuauauuguauuuucaauauuuccuaucauuuccuugcuagaaaugguaauaugagaaauggugaucaagagcuuuauaaacauucauacccucugauccaguuaauuccauuuucaggaauuuaucuuaaggaaaucaucagaaaugcacaugaauauuucuauauauggauauucaucauaacaguauuuguaauacugaaaaaaugaauauagaaauggaauggauaaauuaugauaaauuaugauaaauggauaaauuaugauuuccugucuuugauuuaguucauuuuucuuuauauuuuauuaacuuaguauauauuuuauuaacuuaguauauauuuuauuaauuuagauugaguaaagucaaucaauuuuaucaacacauucauuuuuuuguuuucugcuuaauuuuauaaaauaacaauggcgaaauucaauaaaauaucaaaauauuucauaaugacauugucaaaagugaauuuuuguuugucaagcagcauucauugacuggugauauuccuaaauguuuguucaucacaugagauuuaaaagcuugaauuuggcauaucaaagauaauuuaggugucuuauguggguuuuaccaaauuuaaugccugcuuuugucuuauuuuaauuugaauuucucuaguuagcauuguaaauaauuuucucuauguuuacugaccguguguaauuuuucaaucuuugcacuuuuuuuuguauccuuugaucauuuucacuuuauuugcauauuggacuaagcgaagucaaaaguuaaaucugcauuucuguggaguuccuacagcuaauuuauaucuauggacagaaugaaguagaggaaauucaaaaguuagcaggggucaaacaguguggacucuugugacucaggguuugaguuggaaaacuagcucuucccuuuagugacuuugaguaaguuaucuacuguauuguccuucaguguccuuuauauuggggguauuaagagugcuuaccucaugggguuguugugaggauuaaauaaguuaauauagguaaagcgccugaaauaguaccugcuguagaaggcucucuguaagaggaaguuuuuuuuuuuauauuuuaauuaaauuuucuguggcugggcgcaguggcuuaugcuuguaaucccagcaguuugggaggccaagucaggcggaucacaagaucaggaguucgagaccagccugaccaacauggugaaaccccaucucuacuaaaaauacaaaaauuagccaggcauggcuaaaguuuuuuguagguacauaauagauguauauauuuauggguuacaugagauacuuucauacaggcauacaaugcauaauaauuacaucaggguaaaugggguauccaucuccucaagcauuuauccuuuguguuacaaacaacccaauuauacucuuuuaguuauuuuaaaauguacaauuaaaugauuuuugacuguagucauucuguugcacuaucaaaugcuaggucuuauucuuucuauuuuuuuuguacccauuaaccauccccaguucccuucucagccucugguagccaucuuucuacucucuaucuccaugaguucaguuguuuuaauuuuuagcucccacaaguaggugagaacaugcaaaguuuaucuuucugugccuggcuuauuucauguaaaauaaugaccuccaguuccauccauguuguugcaaaugacaggaucucauuccuuuucauggcagaaugcuacuccauuguauauauguacuacauuuucuuuacccauuugucugcugacagacaccugggugcucgcaaaucuuagcucuugugaauagugcuguaguaaacaugggagugcacauaucucuucuauauacugauuucccuucuuuugaguauauaucuagcagugggauugcuggaucaugugguaguucuauuuuuaguuuuuugguaguuuuuuuucaaacuacucuccauagugguuguacuaauuuacauucccaccaacagucugugaggguucccuuuucuccacauccucaccagcauuuauuauugcaugucuuuggauaaaagccauuuuaacugaggugagaugguaucucauuguaguuuugauuuggauuucuguaaugaacgaugguguugagagcuuuucacauaccaggcugccauuguaugucuucuuuugagaaaugucuauucaauuugucuauuuuuaaauuggauaauuagauuuuuccuguagaguuguuugagcuccuuauauauugugguuauuaaucccuugucacauggguggucuacauacauuuucuuccauuccauggguugucucuucacuuuguugauuguuucuguugcugugcagaagcuuuuuaacuucaugugaucccauuuguccaucuuugcuuugguugcccuauuaagaaaucuuugcccaguucaguguucuggagaguuuccccaauguuuuauuuuagucauuucauagugugacauuuuagauuuaagucuuuaauccauuuuugauuugauuuuuguauauggugagagauagggucuaguuucauuguucugcauauggauguccaguuuucccagcaccauuuguugaaaagauucuuuccucaguguauguucuuggcaccauugucaaaaaugaguucacuguagauguauggauuuauuucuggguuuucuguucuguuccaguggucugugugucuguuuuuaugccaguaccaugccauuuugguuacuauagcucuguaguauaauuugaagucagguaaugugauaccuccaauuuuguccuuuuugcuuaggauauauuuggcuauucugagucuuucguugcucauauacauuuuaggcuaauuuuuuccauuucugugaaaaaugucacugauauuuugauagggauugcguugaaucuguagauugcuuuggguaguauggauguuugaacuauucuuccaauucaugaacauguaauaucuuucccuuuuuuguguguucucuucaauguuuuacaucaguguuuuauaguuuucauuguagagaucuuucacuucuuugguuaacuccuagauauuuuauuuuauuuguagcuauuguaaaugggauuacuuuuuugauuucuuuuucauauuguucacuguuagcauauagaaaugcugcugguuuuuuguauguugauuuuguguccugcaacuuuacugaauuuguuugaucaguucugacaguuuuuugguagucuuuagguuuuuccaaauguaaguucaucucaucugcaaacaagaauaauuagacguccuccuuuccaauuuggaugcccuuuauuucuuugucuugucugauugcccuaguuaggacuauuauguugaauagcaguggugguagugggcaucauuaucguacuuagaggaaaggcuugcaauauuucucaauucaguaugauaauagcugugggucuguuuuauauguugcuuuuguuauguugagguauguuccuucuauacccaguuguuugagaguuuuuauuaugaagcguuguugaauuuuaucaaauccuuuuucagcaucaaaugaaaugauuauguguuuuuuuuucuucauucuguuaauaugauguaucauagugacugauuugcauauguugaaccgucuuugcaucucugugauaaauucuacuuggucaugauaaaugauauuuuuaauguguuguugaauucaguuugcuaguauuuugcugaggauuuucgcaucaauauucaucaagagauauuggccucuaauuuucuuuauuugauaugaauuugucucauucugguaucaggguaauacuggccucguagaaugaguuuggaaguauucuccuuuuuuuuuuuuuuuuuuuuuucccagaauaguuugaggaaaaugggucuaguucuuuaaauguuugguaggauucagcagugaagcuauuggguccugggcuuuucuuugcugggagacuuuauuauggcuucaaucucguuacuuguuauuggucuguucagguuuuggauuucuucgugguucaaucuugguggauuguguguguuuaggaauuuauccauuucuucuagauuuucggauuuauuggcauaugguugcucauaguaaccacuaaugauccuuugaauuccuguaguaucaguaguaaugucuucuuucucaucucuaauuuuguuuauuugggguuucucucuuuuuucacagucugggaaagucuuaccaauuuuaucuuuucaaaaaacuaacuuuugguuuguugaucuuuuguauuuucuuuguuucaguuucauuuauuucugcucugauuuuuauuuuuauuuuauauuaauuuuggguuugguuugcucuugcuuuucuaguucuucaagguuuaucauuugguuauuuauuugaaauguuuccucuuuuuucauguaggugcuuuuagcuauaaacuucccucuuaguacagccgucacuguaucacauagguuuugguauguguuuucauuaucauuuguuucaagaaauuuuuaaauuuccuuguugaucucuucauugacccacuggccauucaggagcauauuguuuaauuuccauguguuuguauaguuuccaaaauuauucuuguuuucgauuucuaguuuuauuucauuguggucagagaagauucuugauauuauuucaguuuuuugaauguuuuaagacuuguuuugugaccuaacauaugaucuaaucucgagaauguuuagaucauucaugcuauaaugaucagauccucuacaugcugaggaaaagaaaguguauucugcaaccauugaaugaaauguucucuaaauaucuauuaggaucauuuggucuguaguaaagauuaagucugacguuucuuuauugauuuucugucuggaagaucuguccaaugaugaaagugggguguugaaguauccagcugcuauuuuuuuucucucucuuuuuuuugagacagagucuugcucugucacccagggggcagugcaguggcaugaucucaguacacugcaaccucugccucccggguuuaagcgauucucgugccucagccucccgaguagcugggauuacaggcgugcaccaccacgccuggcuaauuuuuuuuguauuuuaguagagacaggauacgggguuucaccauguuguccaggcuggucucgaacuccugaccucaagugauccgccugccucaggcauguauauuuacaauuaucguauccuuuugcugaauugaccccuuugucauuauauaaugaccuucuuuguuuccauauuuacaaccaguaaacaauacaguauuaaauuugcaaguacaaaauuuguuuuguuuuuggugauaucuucuugucuguuuuaaacacugguaaguaguuucuuguaucucagacuaaguaccccauuuuuuucuuaugcuauauaccuaaagguaaaaacagcaguuuuugucaguuacugguuaauaauauuuuauuaauuuugaagacauaauauguuaaagcugugugaggaaaggcaaaagaauggcuuggaauuguggagugucuaucuuaaaauauuaggguuuuugguauucuuaacuuuaaccacaagaggucuccaaaggauuugauauuuugugaauuacuguuuaaugguuacuaaaaucuucacauuucuuuuuauaucugaaaguacagguuuauuuacuuuguaucauauugugacuuagaacaaauauuagagaugauaguaaucuaaaauuauuacuccuaaauaaugauacacuaucaauuuuucuuagauuauuuauuuuuauuuauguaaaguauguuuguaagauuucagccugugucuuagggaaucagucuuacuaucuuguuacacuuucuuuuguuguaaaaauguagagaaagaaacaaauggaaagcaauagucucgagcccuuuaucaauugcaguuaagguugcuuuagcuuagaaauguuguauguuuauagaaaugguugagaggaaagcuuuagaaagcgauaaacaaauaauauuuacuaguucucaaggaaacugacuuuucaggugaaucaggugaacaucacaaaugacacucaauuuugcguucaaagaaaugagagcuuccugagcacuggcauagccaaggaaggcuguaugaaggaggugggguaggcugguacauuugcagaauagaaggcuuugaguugguaauggggaggggggaaggguauguuguguguguauggaaaugauaugaggucugaggcacacaggcuggaaauauuagagaagugugaagacagaagggagauuucucugauuagagggaacuuucauguugagaauugagaaagaaagggugaaggccuaugaaauccagcaaacugguauggauuccuguagaaggcaguaagguuucugggaaaaggaauggcaugauagaagggaagagaugaguguacugccuagaugggacaguugaauuuuaaaaauaaauauuucccuaaaggaaaaagcggauacagagaaaagaaucagaucaaggagcuuagagaaugccaauaguugggaauaggagcaagaauacaaacagaaggggaggaauuaaagagcuagguggagaaccaggacaagguagggauguguaguuauaauuugucacacgugguauaaccaaugaugugagcuaauuuuuuacauuauugacucuguuauaguuuacugaaacuguaugacauucagaaagauacuugguuaaaaacuagccuuagcucauugauaucauuugaaaaagacauguggaagaauguccugugguaccacagugacuuuagcuaucugaccuuugaaauaaaugcuugaacacauaagugcuuccucaaagauagauguguaugcugcagauuuaaagaaaacauugaaaucuuaauguuggggaauaagaauaaccucuacuauguuuacuuucaguguuagaaauaccuuauuauuaugucuuuuuggccacagagagccuuacaucaucugagguuuaaccaaaaguauuaucuaacaugauucuuuaugcggaggcauaguaccaccugaaugucacuuauggugacacguguuugaaauuaccauaguagcauuuucauuuuguguucaucucuuauuaaauuaauuuauauaguagaaaucacuuauuacuuuauguuauuguacuuugacuuucaaguuuuuaauggaaaauauuuagcagaguuuuggugccaaaaugaagugauaacugugagacuauauaauuaucagaggaauuguuaugcaaauuagguaucuguguuaugacugaaguccaacuucuuucuaaugucauuugaauuaaacauuaguauaaagguuucaauuuuuuuuuuuuuaaagaaugagaguaaaagaaacaacaggucuuacucauuaauuugguuaagaggaagugcuucacacauacgaaauguuauuaaguggucgguacuugaugguaccaauuucgugauugcaguguuacaguucuaucaaaguuuaauaagcucaauucuguggguucauaugaagucauuucaauauaauucuuagauauuuagagccaaguaaauguggaauggcauaccaaacaguggguagcauauagauaugaauaacauggugccuaaauuaggugggaaggugggacuggguagaaagagggcauuccaggaaguguggucacaggaugagaaaagggaauugggaacaucgaguugacuggaguguuaggaaaauaugggucaagaguagccugcaacagaauguagugcagaagagcuguucagugaguauuugcugaaugauuauguuuaaggccagagaggaagacuggagcuguuucauugaggaugcuggcugggcacuagugggaggagcuuauacuuuauuuagauguuucucaaauuuggccuaccaaccuuuuaauuuacuacuuuguguuagaauuuucuuauuuaaauuuguuaaauuauaauuuuaaaauuuacaaaguuaauacauguuuguuguaaaagugaaaaaagucuauuuuaaaggaaaaaauaauucuugcuaaccuccucacccauuucacuuaaauuaguuuuauuauaaugugacuuaaauauuuauaaacugaaaacuuagugcucuagguuuuauaccuauuuuaacaggaauaaaguccaagcaaaauuugagauuaaaguaaauguaugaaacaaauaaaauauaaaugaaugauuguuugguaugaagggugauguucugcugcuaaaaauaaacuguuccuaccaguucaaggggauauauccccaacggaagaccgaguucuuuuuuuuuuuuuuugaucuuuauuuuauuuuauuuuauuuugagcaguuugaggcucacagcaaaguugagaguaagguacagaauaaaagugucauaucaucaguauucuccaccagauccugugcuaugauauugcuguaauaugcuguguaaaggcucaaaccuuuccugcaugauuuuuuuaaagaguaggggucucgcucugcuguccaagcuggauugcaguggugcggucauagcucauugcagccuugaacuccugggcucaagagauccucucacuucagccuccugagcagcauacuaaucaggcacauaccuguaguccuggcuacucaggcaugcaccaccccuuacagcuaauuuuuuaaaaaaaauuuuguagagauggguucuggcuauuuugcccaggcuggucucgaacuucuggccugaagugaugcucucaccucagccuugcgaguucuuggaauuauaggcaugagcgacugcauuuagcaucuuccagucuuuuucuuucuucaaaccacaguaugacuuaagugguuugcccuccguuggguaccaguguaccaguuccauuuuuguuguuguuguuguuguuuuugagaggaagucuugcucugucacccagacuggagugcaguggcacaaucuuggcucacugcaaccucugccuccuggguucaagcgauucuucugccucagacuccccaguagcugggauuacaggcgcccgccaccacacccggcuaauuuuuguauuuuuguagagacguauuuucguagggguuucgcuguguaggucaaacuggucucgaacuccugaccucaaaugauccguccgccuuggccuccaaauugcugggauuacagacgugagccacugcaccuagccauccaguucaauuuuaaaacuacuguuuuauuuuucucauuaaacuuuaaccguuaagugcuccuuauuacuaaugugaucuuaaacauaaacagaaaugcagaaacugaagcacguagcaauauucauuuuaaaagcugauaauccaguugaucuaagaccuuaaccuaagaucaugaaaucaguucgguagguugugacuaacauuuuaaaaaaauacaguagaaguuaccagaguauaucacguguaguaaggguaaguauuucaugaaauuccuuuuuuucaguuuuaucuguuuauagauaaucugucuguauaugccuucuaauccucucuccaauuccuaucauguuuguaauuguccaugaaaauaauuaaacucauaauuuaauauauuaauaugauuaauaaauguuauucauagauuauuuuauauauacauucuuauuaccugaaacugaucagauacugcccagaaauauauuuuugaauagcacaacugaaaaguaguuaauauuuagacuacguauuuaaaauccuaaagcugacaugauucacagaccagauauugccuacauagaaaaucuagaagugacaaauuaucagaaguaauaagaauucagcaaugccauuaaauauaagaucaguuuauaaaaaugaauaguguuucaguacagcagcaacaaauagaaaaugaaaaaaauuuuaaaagauacuauuuaaaauagcaaccacaauaauauuaucuaagacucuauuuaccaaaaagaaaauaaggucuuaacgaaaauuuggaaacuuuacugaaagauauuaaagaacuaaauaaauacuggaaagaugcaacacguucaugaauggaaagauucagcauaaagauaucaguucuccuuaauauaaauucaaugcaauucuuuuuuuuuuuuaaauaacaauuuugugaguacauaguaggguacaagagauguuuuucagugcaauucuaaucaaaagggcaaugagguuuuucacagaaacugacaagcugcuuuuaaaaagauagaucaaagggccaauaauaaguaagacagcacugaaagacuuagagcuauuugcccuaucaaaacucaaaacuuacauauauauguguguguauauauauauuuauauauguacauauauauguuuauauauuuauauaaauauaucuaaauauauauguauguuuauauagauaaauaaacauguauauauuuauauagcuaaacauguauguuuauauagauaaacguguauauguuuauauagauaaacauguauauguuuauauagauaaacauguauauguuuauauagauaaacauguauauguuuauauagauaaacauguauauguuuagauagauaaacauguauauguuuagauagauaaacaguauguuuagauagauaaacauguauauguuuagauagauagauaaacauguauauguuuagauagauagauaaacauguauauguuuagauagauagauaaacauguauauguuuagauagauagauaaacauguauauguuuagauagauaaacauguauauguuuagauagauaaacauguauauguuuagauagauaaacauguauauguuuagauagauagauaaacauguauauguuagauagauagauaaacauguauauguuagauagauaaacauguauauguuuagauagauagauaaacauguauauguuuagauagauaaacauguauauguuuagauagauaaacauguauauguuuagauagauaaacauguauauguuuagauagauaaacauguauauguuuagauagauaaacauguauauguuuagauagauaaacauguauauguuuagauagauaaacauguauauguuuagauagauaaacauguauauguuuauauagagagauaaacauguauauguuuauauagagagauaaacauguauauguuuauauagaugaauauauauaaacauguauauguuuauauauguuuauauagauauauauauacacauguauauguuuauguuuauauagauaaauauacauacacauguauauguuuauauagauaaauauacauacacauguauauguuuagauaaauauacauacacauguauauguuugauaaauauacauacacauguauauguuuagauaaauauacauacacauguauauguuuagauaaauauacaugcacauguauauguuuagauaaauauacaugcacauguauauguuuagauaaauauacaugcacauguauauguuuagauaaauauacaugcacauguauauguuuagauaaauauacaugcacauguauauguuuagauaaauauacaugcacauguauauguuuagauaaauauacaugcacauguauauguuuauauagauaaauauacaugcacauguauauguuuauauagauaaauauacaugcacauguauguuuauauagauaaauauacaugcacauguauauguuuauauagauaaauauacaugcacauguauauguuuauauagauaaauauacaugcacauguauauguuuauauagauaaauauacaugcacauguauauguuuauauagauaaauauacaugcacauguauauguuuauauagauaaauauacaugcacauguauauguuuauauagauaaauauacaugcacauguauauguuuauauagauauacaugcacauguauauguuuauauagauauacaugcacauguauauguuuauauagauauacaugcacauguauauguuuauauagauaaauauacaugcacauguauauguuuauauaaauaugcacauguauauguuuauauaaauaugcacauguauauguuuauauaaauauauaugcacauguauguguuuauauaaauauauaugcacauguauauaaauauauauaaacauacauauauacacacacacauauacacacacacacacacacacacacaaacacauauauauauauguuuuuuggagaugggagucucacucugucacccaggcuggagugcaguagcacaaucuuggcccacugcaaccuccaucuccuggguucaaguaauucuccugccucagccucccgaguagcugggacuacaggcaugugucaccacgccuggcuaauuuuugcauauuuuuaguagagaugggguuucaccauaguguccaggcugaucucgaacuccugaccucaaaugauccuccugccuuggccucccaaagugcugggauugcaggcaugagccaccaugccuggccaaaacucgaaacuuauaaagcaaugguaaguuaguauggaauuggcauauggagagaguagcaaaugaagcaauggagcagaagaaagauggagaaaacaaauucaugcauacauaggaaguucauauggcagagauggcauuagacauccugggagggagggauuauucaacugaugcugcagggacaaacagcuuuccauacuguaaaauuaaacccuacuucagaccauacagaaaauuucaguuggaaaauauauauguauucauuaccucaggaucugaaaagauauccuauaaaugacauacacaaaaagcacaaaucaaaggaaguaauuaguaagucauguagcuuuuuuacagguugcucuagguauuacauuauauauacauaacuuaucacaguguacuugugucauuguuuuaccaguuugagugaaauauaaaaacuuuaccucugucuaugcuucuuuauccucccccauuuauaauauaauuaccuuaaauauuauaauugucuuaaauauuuagaaagcguuauaauuuuuccuugaaccaucacacauaauuuaggaaacucaggagggguuccuauugcuuaccuugcuguuucuuuccugauguucuaagguuucuuuuuuuuuauuuuuuccuuuuuguuuagagaacuuccuuuaaccauucuuuuagaguagcucugcuugugucagagucuguuaguuuuucaucaucugagaaugccuugauuugccuuucauuuuuuggaagauauuuuuugccaggcaugggauucuggguugacaauuauuuuuucagcacuugaaaaauauuuugccacuuccuucuaaccuuuaugguuucagaugagaaaucuacuaucauucaaauuguuuuacccuauagcuaagguaugauuucuuucuugcugcugucaagaauuuuuuuuuuuuuuuuuuuaguuuuuagaaguuuaauuaugugucauggaacauauaucuuuggcuuuauccuuuuugggguucacucagcuucuugaaucugaaaguugaugucucuugccaaauuugugaauauuucaucuauuauuucuucaagguuuuuguuguugguggugguguuuuuuuuguuguuuuuuuuuuuuuuugccuuucuuuucuccucuugggacuuugaucacaagaauguuagaucuuuuguuauagucccuggggcucuauucauuuuauuuuuauugcagucuguauccucucugcuuuccagauuugguaauuucuauuguucuguuuuucauuucacugauuguuucaucuguuuccucuauugugcuguugagugcauccacuguuauuauauuuuucacuucuaaaauuuuuguucauuuuuucuuuuuuuuugagacagaguuuugcuuuugugcccaggcuggagugcaguggcaugaucucagcucacugcaaccuccgccccccggguucaagcaguuuuccugccuuagccucccuaguagcugguauuauaggcgccugccaccacgcccagcuaauuuuuguauuuuaguagagaugggguuucgccauguuggccacgcuggucucaagcuccugaccucaggagauccacccauccuagccucccaaagugcugggauuacaggugugagccacuguguccggcccauuuuuuuguuuaugccuucuauuacguugcagagaauuuuuccuugccuugacuuucuauuuuuccauuuguuucaagcauguguguaauugcuguuaaaacauuuagcauggcugcucugaaagcuuugccaguuaauucugacaucucuguuaucuugguguuggcaucuaucgauugucuuuuuucauucaguuggagguuuggagguuuuccuguuauuugguaugaugagugauuuuugguuggaaccagugcuuuuuuguauuauguugugagauucugggucucauuuaagccuucuguucuagcuggcuuucccugacacugcuucagcaggguaggggugugcugccuccuuauugccagguggagguagaaacccagguugcuugguuuccguugaaacccgagggagaugggugcuucuuguuacugcugggucccuggaggaguuccagcuucccauguggccuccacugggccuucucugacaccauccccguaaggagugagaagggagucucaguacugccuaguggguguggaaguccagucucugucugguguuucgccugauaccauggggguuaaagccucaguauuggccagcaaggaugaaccucuuguuugcuacuguauggcugacacugacacaaucccaacuggaguuuggagugccuucuuucaccagugagaauggaaaucuggggucccagccuuugcuagcaugggugggaccacagguuuuucucugaugcuuggcuagaguagagcgguuauuggcuaaaaguuuucugucuugcuaggcuuccucuucucuggggguuuguugaggcuuuuuugucugugccuguuggucuuuccggguugucagcuuuuucagcuccaagucuggguuuuaugcuacaaaaaguaaaccuggggaacucaccgucauacuguuccucacaucccaaguucacuagcuggucugcuuucugcucaccuuucagagucgucuuauguuuguuugacauguaauaugcagggagugguacuuagaguaggaguggggaaacauaucuccauuccuucuucccagaagcagaaguucuucaaucaagaucuuauuuuagagauugcucuauguauaaaugaacuuugcuuccuugguguuauuuugaucuaauuauaauaaaauuuggacuuagauuauauugauaaugccagugugcaaauuuuaacugcaauagaauugaauuuugcacaugggugaaucugauugagaaaaagaaaauccuauuuuuuauaauuaaaaaacugcuuuuaauauuuuuagugcuguuuacaguuuaagaauguuaguauauuuuuaaaagcacaaccaguggggaaaauucuaucccuuuucuuggcaaauuaacaaucuaagcauacaaaaauuuauaggaaaauuuugccagcucuccaucagagugcugucaugaugauuaguucauauuuccuucuuacgaagcuugcccuuucuuguuuaucacccacagaaaagcaucaaaguuaaaaauuaaaaguauuugaaggaaccuccauaccaaguggauucagagagcccagaggucagaaaucgugcagagucuuauguugacagaggaauggcccugccauaagaaaggugccugaguuauacaagguguuggcagcuggagccaaguuacaccugguuuacuuaccugauauaauuuuaagugcuucacaaauaacguuuuuuaccuucauaguuaaauauuuacuuaagguauauuaaaaacauauaaucagugaaucaaaccugugauuucauaaauguguugcaaagaaagauucuuaaguugguauuugaguuaaaaaugugaguuaacuuaacaagaacuaucagguuauaguagugauguccuuacaaauaugucaguauuauugaagguaaaggggaaugacugaaguuaaggaaacauguuggagcaauuguaaaggcaaugugugucacauuuucugccacuugucauuuagauuguguaagcuaaaucuaguauaagugggaccauuguuugaaugaaaaaaaauccaaacuugagauguagagaaauauagaugaauuugaagcccagaaaggacauuuaagcucucuuaagaugaguuacuccauuuuuuauaguagcucaccuuuuuaaagguauuuuauccugcugucaaguuuauuuuauuaaauuggauaccaggaaauucuaauugauuuuuuuauaucaaacaaaucgauguuauuuauuuauuuuugagacggggucucacucuuccucaggcuggaguaugguggcaccaucgugguucacuguagccuugaccccccaggcucaagcaauccucccaccucaaccuccugaguagcugggacugcaggugugcucaaccacacccagcuaauuuuuuuuguagagaugaggccucucuaugucuucuauacugguuuuaaacuccugggcucaagcaauccacccaccuuggccuccccaaaauguuggaauuacaagcguggaccauugcgccuggccaaaaucugcauuuugauggauguuuccaguagauucucaaguuguugauacaucuucuaaguugaacauuauuauacagucauucauuuauucauccuuaaacacaguuauugaguggcugcugugcgccagcuuuguuacuagguggcaaggauacagaaaugagaaagaucccuccuuuccaaguucuuauagucuagaggggagguagucauggaaauaauuguaaugaaagcgcugguugaaaauaucuuagaguuacuggcagcccuugagcaucaugcuaguuugcuagagggguguguuagaauugagacuggaagaaugaaugccagucagguggaggugugagagagcgugcuuuucuuaggaagcagaaacuaguuuggcuggguuacucugccagcaugagcaggcaaccugaggcaggacagacguguuuuggagagaaaggguguauaaagcuggaaaccaucauucucagcaaacugucgcaaggacaaaaaaccaaacaccgcauguucucacucauaggugggaauugaacaaugagaacacuuggacacaggaaggggaaccucacacaccggggggccuguugugggguggugggggggacggauagcauuaggagauauaccuaauguaaaugacaaguuaaugggugcagcauaccaacauggcacauguauacauauguaacaaaccugcacguugugcacauguacccuagaacuuaaaguauaauaaaaauauacaaauaaauaaaaaauaaaaagagaaucaagagugaaacgguggagugagaaagcggcauuacacagggccuggauaaagaguuuccugugacagagacugagcugagauggcuggugauggggaccguagccuagugacccuuuguguacccagcaccuaucaaaguagcucacacauaauaggugcuuaauaaaugcuugguaaaugaaugauuaaauaagugauguuuagaauaaagagaauaauggguaucuccuauuuguuuuucuuaacaaaacugauuuggguuuuuuaaacauagaaggguuguuguaaggcugggcgugguggcucauaccuguaaucccagcacuaugggaggacgagauggguggaucaccugaggucaggaguuccagaccagccuggccaacauggugaaaccccaccucuacuaaagguacaaaaauuaguuggguguggugucagcaccuguaauccuagcuacuugggaggcugaggcaggagaauggcuugaacccgggagguggagguugcagugauucaagauugcaccacugcacuccagccugggcaacagaguacaacacugucuccaaaaaaaaaaaaaaaaaaaaaaagguuguuggaguagcuggaaaucuauacauuaacauauaugguaaucaaugucuauuuacauuauauagauuuacauuauacagauguagccaauucauuuacucuuuuggaaagaucauauugauuucuuaucguuuuuuccccauuauguuuauuucuuuaaaaaauuuuuuaauaucacuguaaauugauugaagcauccugacauuuccauagauauuccuuuacagcaaauauuaaugggaucuacauggcuaaguuacuguuuaaagauugauauugaugauaacuaggcacuagccuccccucuggcgcuugaaaccuuuucuguugugguauucguaggaaaucucuuuuuuucuuuauauuuugucuuccccauuuuccucauuccucuuuucgagagcagaagauaaauauaaaguugacuacuuugucauucuguuucauuauguuuauuagacgguaguuucacuuaacuauuuagauaaucuagaauuagaaaauaaauugugggccuggcaggguggcucaugccuaaaauccgagcacuuugggaggcugaggcggguggaucacuugagguccggaguucaaggucagccuggccaacauggugaaaccucaucucuacuaaaaauacaaaaaauuagcugggcaugauggcacgugccuguaaucccaccuucucaggaggcugaggcaggagaauuguucgaaccugggaggcagagguugcagugagucgagaucuccccacugcacuccagucugggcgacagaacaaaucaauucugguaguagagaugguagugacuaaauggaagaaauaaaucucauaugcuguaggaaaauguuugccacugggaaaccauuuaaagaggaaguguuauuaguauuaaaaaaucugucauuuugaaauuucuuuuuaaaaauuacauuaauuucuucccuggugguaaugccauuguauuuucaguagguuuuuuuuuuaguccugauacuuuuuguauaucuagcuagcaauuuuaauggaugugcuuaacucaugaaaauccagauuuuaaaacaugauaaguuaauaggugauaguuauuuuauaagaacauuugccaugaguuuauuuaaagaaugagagcuucuuugugcauuuucaucaagugcauucuccucaggaauauaucuccuugaaaagaaaaaaugggguguauuugcaguagguuuauugauagucgaauaggaagaaacagcauuugagaaguguggagaaaagaucuuccugauuacuacagagaccuccuaaaguggggccagacugcuugaacagaaaguuuggaagcaauugugugaggugugcugcauuuguuuuacuaauucgacuugauuuuuguaaauacaccuguucauuuggguuugaggauuuaauugcauaaagacucuuuauuuagcuaaagcgucuuguccucauggcuuuucccagaaguuuguguuauaaauguuaauauauuaaaagugcuuuuaaaugauuuauuauuagcaucuuaaaaaaauccuacacuaaauauuaaaguagucuuuauuauuucaggugaaggcaaagggaaacaguacgaguugcaagguaggggguaaauggaaaggaagaaaaaggaaagacaggagaugaagggaaagauugagucccaucauucuugaagacacauuguucauggcuucaauaacccuggcacagcccucugaagaaaguguaguuauccucuucuuucugcaaggaggcagagaugcugugaaccucucuugaaguuacaggaucacuuagguaguaaguggcaaagcccacuagagcccuaacccuguuugauacuggugaguucaccugcuaucauuaagguguaaccugacagcaauguaaaagacaaaaaucccccuucacugaacuccaaauacaguuacugucuguccucaggaucucuuuauuuuuuucuucuccuuuucaugguucaaggagagaucccuuuuaaucucuucccuuccagcaaagcuuccuuucacuuucuaccugaagucaaaaacuugaggccagcuuaguucagagcuccucugggcuugcuuaucucccagccuuuguggacuccuucuuguccauuugucuuuguaaugacuucuuccugucgaaccucccugcugaagggagacuucuuacuaauuucucuuauuuucccugcuugcuugcuuugagauuauuuucuuaucucuuguuuucaggccaggaauuucuuccuccugccagcuuuuuugugaauccuuuuuaaccucuggcccaagucuugaucccuaaagcaguaaaagccuauggaggccugguaugguuuuucuguacaguuuuuccucccucccuucuuuuucuacccuucuuucugaaaaaacaacagaaacaaaaaaaacccaaaaacccucugauacuugauuuuguaucaauaaucaauauacauuaauauaaaauuuauuaauauaaauugacuuaauauacacaauacugaguuuuuuccaggcuuuuguggaagcuccccacugcaguccagaaugcuccgugaccagguccuaggauucuuucccuuggugccauugugacugcucccuuauuuuauaccuucagcucuguccaguucucuucuuggccuggcugagcugggcucugcaccucaugggaguggacaugaauccugaacacaccauguggguguacuggguuguccccaaccuuaaugugaaggcaaguuuagagaagaaugcaugaugagugggcuugcaugccucccugauggccauaugggagcaugaccacaccacaggguuaguccuuaccuggugggagccacugggagcagaggagugcuagguaucgcauggcauauuuaagauaguuuguguccagccaugacauuucaagugcucauuaacugcaugugguuaguagcuacuguauaaggcaauguaguuuuauagacaguagcacagcuguaugcaagagaugggccuagaaagacagguaacacuuaacuagacagauuugggggaaaauacauuccucaaugaaagcaaaguuuaaacaagguugaaauaauuuauuuaaaaaaaaaaauagcuggcugggugcaguggcucacgccuguaaucccaguacuuugggaggcugaggaagguggaucgcuugagcucaggaguuugagaccagccugggcaucaugguaaaucccugucuuuacuaaacauacaaaaauuagcugcgcaugauggcaagcagcuguagucccagcuaauugggaggcugaggcaggagaaucacuugaacccggguggcugagguggcagugagccgagaucaugccacugcacuccucccugggcgacagagcgagacaagcaacagcaacaaaacaaaaauaaaaacagcuaaugaaguucuuauuauguaccugguacauucugccauuacugaaauuaacugaugucaucuucacaacaauccuuugaggugauuacaauuauuauuuaauauguccauaauaaaugacagguuuaggaauguacauuugaauugugguucugacugaaacauugggcaguugaggaaguacuugauaaagugauuagugcccuuuuuaagugugagcaauuucuaguugcuaagucaggguaucauuuauguaugaauuaccuuauagguaaguauacuuuacauucuuuuauguaacuccuaacuaucaaccuccagauaucacaaaguuuacuugugggugauuaaauugcuuaagacaagagauugcccacccauacagaauuucuauugcuucugccuuccagagaacagugggagcagccuggccugcagguugauugucagauucugccucccucccaccuacuuauuccuccagagagacacauagcuuagccuccugucacacucugucauuuuccuggggcugcagagcaaagggcucccucagguuaauucugaaguccuguguaugcugaagucugcuugaagaaggagagaagcuuccaucuugcauauuuccuaauacuuuaucuuuccuucuguaacaacagugcacagauuuuacuucaggaauguguuuuuauucacuccugcuguuauccuguauacuaaaguaguccuuugucaaugugcugaugugcucuagaaacauauaaagaguuuuuuuuuuaauugguuuguugacuggacguaaacacuaguauaacacuaaaucuaagugcagagagugggcagccugauuuuguucauaaucucaggggaaucuuuuauaaugggccaggaagcacgugucugugguuucugcauagggcguguucuguggugcccagccagcuguaguauguccugcgagauuuggccugcaggccacaauggugggcuucugggaggaagaaucuuccuuagaaguccugcccuuugacacuccuucugcugaaguguccugaucucaguggggcucccugauuuucuguuccggggucuaucagcacugggucuaucagugcuacccacgccgccgugacugugggucacugagggugaccugcgugggucccaugggcucagccuggccuucccagguccuacaagguccuccuuacuguccgucccugcucagucaccaaagaaugacuuuuuugaaaguacaauuccagaguuaaauacuggcuaaguguagaaaacaauacuggaauucagucuucaccuccaccaguccucauggugagaugaaguguuuauggguuucuuuguuguaaccucaaaaguggaaugcauuuccugguuggugcugcuugcccuccaggugcuuagugagugaagcuucaucuuccagauuucucuuuguggcuuaggguaucuguaugauuuuccugcuuuuguuuucagaggugcuaggcugugcugaucucucuggagugauuauggugcuuuuugccugguaagcccauccuuauguguaaaaaucaggauuuagaugugaggcaaauaaggugguggugauuuuguuuuacagagagauuuucacuuugcaaacuuuuagaccuuuucaaauucuaauuugauuugauguauuuaaauaacaaguuauguaaaaacauugaaaugacccauuuuacagaaguuugguuuacaaacccauuguuuguguaagguaacauaccugaggccaggagcaugauaccuuuccucuagucuugcccuugucccucgcuuugggcuccagcuacaucagaguaauugccaugcucacaaccccauacagugagagcacagaauaauggucuggguacagucuggggccagacagccuguguuuggacucuauuuuucuuacuaccugugaaucuuaaccucuccauggcucaguuuccccauucaaaaacaaguauauguugauagaacguuuuauagaguagcaagcauuaaaugaguuaauacagugcaugaaacauagugcucauuaaauauuaccuccuguuauucauucagcauuuauuucucuaccauucuuaagcuauucucacauugugcaaugcauuuuugucacaucugucuuuuuaaauauucuguauacuaacagucuuauugcuuucaugaagcugcccuacaauuuccaguugagguucuaaucuuagcuguacauugggauuacauguggauuuuaaaaaaugccgaugccugaguuuuuggccugugcuagagccgcuuguagcugcuuguaagaauugacuguuauaguuccaggacuuuguaccagacggugaaagcauugguaacuugaaaucaacuauguugggaauauuugcacucguaauuggcaaauacuaccacagcucucucuucaaucuguuugauguucuagugauuuguuuauaagccugucucucucaauagguguugaccauuuugguggaauguauuaguuugccagggcugcuguaacaaagugccaccaacugagggcuuaagcaacagaaauucauuauuucauaguucuggaggauagaaguaaaaauaucaaaguaugaacaguauuggcuccuucuugaggacugugaaggaaggaucuguuccaggccucuccuugacuuguagacggccaccuccuucuuacgucucuucauaucgucuuuccuccaugcaugucucuguguccauguuuucccuuuuuacguggacaccggucauauuggauuagggcccacccugauggccucacuuuaacucucugcaaagacccuaucuucaaauaaagucacauuauauacugaggguguggacuuccacauuugaauguuauagggacauaauucaacucauaacauagggcgaggacauucuuuuccaccucccuccucaguccguuugugccugugguaguugcacaguaaagauuuguagauuugaaaaggaaauaccuuuuggcugauguuauuuguauauacuuuuuuauucauugagcuaugaacuccagaguuaguaugguuuaaaaaaacuuuuuuuguuguuuuguuuuggaaacagcuccuucuugggaaaauaagaguuaguauuucuagagaaaaauguuaguuuagaaagaguaguuauuuuaggcuaaggcagaccugagcuuguuaaugaacuuguggacucaaaaggcguaugauugagugaaguggucuugauuuugugucaguggcugacaaaaagcuuuuaaucaugcaugaaaaaaauguuugugaugaauuuccacugauuugaaaaugucuuaauguugcuaguccucuucaggauuauguaagacuguagaguucuuagaagaguauggccuuucuugcuuuuucucaaaggcaaauauaaugucagguaauuuugcuguuaugcuauugaaaaaauaccuccugagucacaggaagcauaaauuauuuuuuaaagauuuaccauguguuaggaugauugugucauauauuaaauauauaauggaugacauuuagacuauuaucaucucgaagcauguaaauauagaauauacuuuuugaaguuaguuuucuucaaaacgagagauauuucucaccauugcuuuuugcugaguaaauaccagaauuagaaucuuaugccaaaaauauauuuggaguacacauuugcacaggaauuuguuuuuuuccagacuuuuuaauagaaaaucuuuagguauaaauuacauacggcaaauauaaaaaguuuuauuuuuaaucaauuuuaaucagguguaauuuauaugcaauaaaauuuauacauuuuaaguguaugagucaaucaauuuugacagauacacacaucaauauaacuaccacccaaauuaagaucuagaacauuucaucuucccaaaacguucucuuugccuuuuugcagugguuuucuccccaccuccaccucccacuccaagcaacuacuguucugauuucugucacuauaggauaguuuagacuguuuuagaauuucacauaaguggagucaguacagugcauacuuuuuuguguccagcucguuuuacucagcauaaugccuaugcaauucacccauguuguugaguguaucaguaguucauuccuuuuucucacucaguuguauugcaucauaugcauauaccaacauuuguuuauuuacuugcugaacauuuggguuuccagcuuuuggcuauuuucauuaaaguuacuaacauuuguguacuagucuucucacagaucuauauuuucauuuucuucacauaauuaggaguggaauugcuggauuauguggguaaguauauguucacuguauaagaaacagccaggccaggcacagugguucacaccuauaaucccagcacuuugggaggccaaggugggaggacugcuugagcccagaagcuugagaccagccugggcaacauagugagacccuggcucuaaaaaaaaaaacaaaaaaaccccaaaaagccagaugugguggcacaagccuguaggccuagcuacucagaaggcugaggugaaaggauggcuugagcccccgagguugaggcuucagugagccauaauugugccccugcacuccagccugggugacagaacaagacccugucucaaaaaaacaaaacaaaaaaguaacagcugaaguagguuuuggaguaguaguuaauuuacccuccucucagcagugugugagagcuguaguugcuccacauucuugcugacucuugucagucuuuuaaacuuuagcuauuauaguuaguguauggugucauguuuuauuuuuaacuugcuuuuucuugaugacuagugauguuuucaugugccuauugguuauucauuuauguaucucuuuugcccauuuugagacuuggauuacuuguauuuuuuaguuauaagaauucuuuauacauucugaauaaaaauccuuugucaguuauagguauugugaauauuuacucccaguguauggccugccuuuuaauuuuccugauuaugaccuuggaacaacagaagguuuuaauuuggugaagucagaugcauuagugucuucuuuuaugguuacuagugcuuuuuguaucuuaagaaaucuuugccuacuccaacaucaugaacauuuucucauauuuuauuuuaguucuauaguuuuagcuuuuaauuuuaauauauuaaauaguuggauuuaacuuuggggcaucaugauaugaggcagggauugagguuccuuuuucuuuguacguuuaccaguuguuuccacacuguuuauagaaaagacuuuuauaugcauugaauuauguugaugccaaaggcuucauuuugucuuuguuuuuaauuaauauuuauuuauuuauuuuuuuuagagacagggucucgcuuuuucgcccaggcuggagugcauuggcacgaucauagcucucugcauccuugaacuccugggcccaagugauccucucagcccugcaaguaguugggguacagauuuucuuguggagauggagucucacuuauguugcccaagcuggucucaaacuccuggacuugaucaaagguuuuguuuugaauuugacuuugaaaaaugaccuagauuuuuauguucuuauauuagauauuuuagacuuugacuuucuaggaugucauuuaaaaauguuuuuaggucucccuuuuucuuuuuucuuuuuuugagacacagucucugucacccaggcuggagugugguggcaggaucuugauucacuucaaccuccgccuccuggguucuagcgauuuuccugccucaccgucucgaauagcugggauuacaggcgcccacuaccaugucuggcuaauuuuuguauuuucaguagagacaggguuucaccauguuggccaggcuggucucaaacuccugacuucaacugaucuacccuccuuggccucccaaagugcugggauuacaggugugagccauggcacuggacccucuuuuucuuuuuuuucagaaguuauuguauuuaucacauaauagaaauaaagggugggaugggagcucuagaaaucuaccauuucagcuucuuccuuaguagacccacauuagcgaugaauauaaaauagauauguguguguguguguguguguguguguguguguguacccugagcuaauggaauuuguggaacauuugguaaagcucauaaauauugcacaacugguacaaucuuaaguaaucaauucuaaguuuuuagggccgggugcggugguggcuuacgccuguaaucccagcacuuugggaggccaaggugggcggaucacgaggucaggagaucgagaccauccuggcuaacauggugaaacuccgucucuacuaaaaauacaaaaaauuagccuagcgcaguggcgggugccuguagucccagcuacuccggaggcugaggcaggagaauggugugaacccgggaggcggagcuugcagugagcugagaucacgugagaucgcgccacugcacuccagccugggcgacagagugaaacuccgucucaaaaaaagaaaaaaagaguuuuuaacaacuuuuguuaauuuuucuuauguuuaauaauaauuauagauaagcuuuucuuuaccuuugguuuucucauauuugaggacugcaauuuaaaugaucuucaggaacuucuuuucuucuuguauuuugugaaaugaaaugcuuuuaaaggcauuucaggcaucagagguagaugaggugguauuuugggcaguggcaguuguuucugaaaucacacauuaguagcuuuuccuauccuuuaucuucuguuccccuggagugaaaaaggugcuguuggaggcaaaauuuguggcuacugaaaauauuccuuaaugcugguagcuucuugacuucgugccuuucuuacccaauuacaucuauucuaaagcugucccacuucuuuuccuuugagcacaugacuacugcuaucuaucuccuauucuuaaccagcauuaauuacacuguguauuagauacuguuuuaaaggcuuuauguuuguugaccgacuuaauccucauaaacacccuugugagguugcugcuguuauuuuauuacggguuuuauagaugaggagacugaggcucagagauguuaaguagcuugucuagguuauacaauuacuaaguggcaaaacuggaaguugauacagacuuccuggcucuaaagcacacuaugucauacagccucucaggaaaaacacagaagggagcagcuauucccuuccuucaccuuuacuuuugacugcaaaagggguaauauuuuauagcacaauuaaaauuauuuugguuaauauuuuaugaaauuucuuucccuuauaaugcauauuacagucugaauuucucucuggugguaaaguuucugacaaagcaucugugcuuaaaacaaagcagcuuuauuuaugaagguauuucuuuacaaaccacagcccugguauccagcagaaagcauggguugucuuuacaugugguuauucuucugggaaagcaucuuagaggaggugagccuugaccugcuuguuaacugagaauaugugcacaggucugggguauaguauguguagauucgugguaaaaagacuugggauugugaggggcugaaagauuacgaaaggauagggguuuuaaaauauuauuacuaaggaguucuguccuuagaaaagauuucuaggaucaagaaccaagagcuggacgaugaugacaacaggcagaaaugaguggcuucucucagcccuugacuucucugccauucccucccccuucgaguguuccccuuuccuuugguuuccaaguugcacgcugauccucuuaguguuuuuaaccucauugcagacagaaguacuuucccaucagguuugccaagacagacuagaauuuuuuuguuagaauuuuaccuuuaaaaacaaaaccaaaaccaaccauuacaaaagaagcaaagguauaaucaaaaguguagaaaaaacuagaaaaaaaguuuuagaacaacacgaguuuaccuaguauagacuuucugccuuaugguaauaccuccugucucucuuagccuuuugaacagcccagcucucauugugcuagccuugagucugaggccccauggaguucccauaguggggaaauucucaauccucccuugcucccaaacaggccucuccuuugcggauagguccugguguguuucuucaccucaggccucuuuaagccugaagaagcgugggcccuacaucugcuuuuaguuuucagucccuugugguaaguuggcuaaggcccuuucgccucuguugguaaggagggguuuuuugggccuccagaaccucccacaggugcugugucuuccuguuggcucauuccgaggaggacucaccagcugacugucaaacugggucuuccucaccuugguucacuguuggccauguggacuucaguaggggcugccauccuucuaagaagcuaugcgauugugucuauuuccuucucuggacagcaggagaccccuuuuugaagacagcacauuuucuuuuuuucuucuuuuuuuucuuuuuuuugacauggugucucauucuguugcccaggcuggaguacaauggugucaucucggcucacugcaaccuccgccuccuggguucaagcgauucuccugccuuagcccccugaguggcugggacuacaggccugcaccaccauacccagcuauuuuuguauuuuuaguagagacaggguuucaccaugugggccaggcucguguugaacuccugaccucaagugauccaccugucucggccucccacagugcugggauuacaggugugagccaccacgcccggccagcacuacacuuucuaaugaguuuuuauugaaaaaaauuuuaguugaaaaugaagcuguuggcucguaagugaaaagcuugaaggcaggcuggaaucaggcauggcuggaauugggcauggcugguuguaggggcucugcucuuuccucuccuccugugauggcugccuccugguguuccacaagguggcaggaugcuccagugcucuguccugacucccagccuccaggguucuaguccagggaagaggaccagcaucuccuucugggagcuccuguauaaauccuguaauccauuuuuucucuucuuucucuuuucuaauaugccauuuuauuuuuuaauaaguuguauauuuuaguucaaaaaauggaaaguauuuuaaaaagauuaugagguaaagaguuucuuccauccugucccuuuuacuauuauaaaaacacccuucauuguccuguuuuaaugguuuuuauucgaauuuuauuuuuccugguaauaagauuugaucucauacuuucuuuuuauuuguauucaccuaauauauaccucuaggcaguuguuguuuuucagccaucuuuuuaauuuguaaccuuucugaauuacuuuguuuuggauugcacuccuauuuguagcauagaauuuugggguuuuuuuccccucugugauccaaucugaauuuaauuuucuuuuaauaggugaauuuagcccuuuaauaugucagauauauuugauauuaguuuauacuauuuuguguuauauuuucuauuuuuauaucuuuuaaauaaucuuucacgaugugaucuguuuucuuugcaucuuuuuuuuuuguugguuuuguccuggugguugguuuuagaauuauaauuucaaauaaugcccuuagucuucuaagaaaguggugguuguucccuacugugagcacugauaaaauuaaugaguuucauaguaauucuaauauggagauauuaaagccagguuaccuugucuguccuacucagucaagaacccuguuucauucugucuucagaggagagaaugaauuacucggcuuggaacucaucagugcuauuauuaccaaugaguucacugucagagggggccuuguaaguuuucccagaggauacuguccaccuuuaacaaggcucuuuuugucuaugaguuucuaaagucgguauagaucaugcaauugguaagcugacauuuguuuguucacaguugaacauuaguucagagucucuguugguggucuguuauuugaugccagagagucaccaguuuuauuuccaagcagacauuaaaagauauuauugguucugaaguucccuuguuuuaaugugggcucaacacuugcugagagagcauuuaguuuuucaaaagcaauaugguaggcaacagagaggcauguuacaugugaaaaggauuucuuuuuuuuaaaauuagaagcuuuaauuuaaccgucuagcuuggcaugcccuguguaaugacugagagaccgagaugacugucuuguugugagucccaccaacaaggacagaagggagguugccaccuugggaggagcacaucuucuguucaugcuccucuccauucaggaggcuucagccccacagcacaaauagccucuguagcggucaagggaaugugguuuuauaauuuuuuagaucugggucaauuauauaaucauagauaacuuaauuuuuuugaugcagugguauuuacuguccaccucuaauaaagcaggugaaucauagacuaccauuggauacaugucuuuggagcagauuuccauccauuuuuacuccaguccuaugguggcuaccgguauuguucuugucgccugcuauucuuaagucugcaguuugccugugacucaccccaggaaaccuguugaaaaugcucgcucuccucuaacuuccugcugaauucagauuuagcaccuuucgggugggaaucuguacuucuuugcaggugacucugaugccggugucccacagacuacaguuugaggaaaucaagacugacaguucugcaagguuuauuacccuuuaauuuuucaaaaaauaccuucagcaacagagaggcauguuacauaugaaaagguuaaaguagaaauuuuccuaaaaucuaugugacagaauucugguaggaugcuaggcaugugugcagaauuucaaauagacuuuuuuuuuuuuuuuuuuuuuuugagauggagucucacucugucacccaggcuagagugugguggugcaaucuuggcucacuguaaccuccgccucccggguucaagcgauucuccugccucagccucccgaguagcuaggauuauaggugcccaccaucacacucggcucauuuuuguauuuuuaguagagacaggguuucaccauguuggccagguaggucuggaacuccugaccucaggugauccgcccuccugagccucccaaagugcugagauuacagguaugagccaccacgucuggcccaaauagacuuuuguuucagagauacagugauuugaauuuaucauaacguucuuuaauuaagaaauccaggaaaauagagauaggagauuuuauaacuuuaaccaguuugaaaaaauauuuaugugaagaugguuuaauauacagauugcagaacgaugaauuuaacauucuuguaaagcuuccaggaaagccucaaggauaagugacaaguccauuuuuaucaaacuuaauggguuucuaaauccuuaucugcuuaucaaacaaaauuuuaauuagaacuguaauugaguaaccagcugccucuuguguucacucuaggaacuugucuaaaaacauuguggagcucauguaaggucauucguuuuugaguugcuaaauaaacuuuauugcagacuucuaaaaauccagguauugaggaagucuacaggaagauaaaaauugauaagaacuuugcaguaguuaguccgauacucucucucucuaguggauuaagguagaaaaauccuucuucagcaccacagaugggagaauauccucccucuuagguuucuuccugaaucagcuuaugccugccuaggcuuguaguagaacagauaaagccuuuggaccuagcuacucuugguuugaauaucuguuaaucuguuaucucuucauuacuuuggacauuguacuuaaugucucaaguucaauuuacucauuuuuaaaaugggaauaaugccgcccacagcaaggagagccguaguucuggaacuuguacucauucauuccuuuauucagcacuacuuuauagguugaguaccuguuuuauacuaggcacuguuccaggcauugaauacagcagaaauaacacugacaaaaguucccauccucauggauccuagugagcagagccauuucacaccaggugaucggggaaaguuucacugagaugaugacuugaauggagaccugaggaaggugagggagucagaucaccauaaaaaauuacuuuuuaacauuauuauuauuuuucuuuacuauuuucugcuuaauccuacuagaaaguaagcucuaugacagugguggguggggggugguauuuguuuuguuagagaauuuuagaugugcucuguuguauuaguuuguucuugcacugcuauaaagaacuaccugagacuggguaauuuauaaagaaaagagguuuaauugguucaggguuccauaggcugcacaggaagcauggcuggggaggccucaggaaacuuacagucguggcagaaggugaaggggaagcaggcaaguccuacauggcuggagcaggaggaagagagagggggaggugccauacacuuucaaacaaccagaucucaugagaacucacucacuaucacaagaacagcaagggggaaguccacucccaugauccagucaccucccaccaggucccugcuccagcacuggggauuacaauuugauacgagauuugggcagggacacaaauuccaaccauaucauauauggaagcacuuuuccugaucacagaaauggggagcuauugaaggagucagagggcaagugcaaugucuucaucuuuagugcucucucuggcagcagugugguacaagggcuugagggguaacgugcaguaggcacuccauaaaugucugcuaagcauuuuuaaaagugaucauucugccauucacuaugagccauaagaguagcugguagaaaugccugugaauguuuaaaagcauuauauagacucuauuucagaauuguguugacuaauaaaaaaugcuaguuuucccuaccccacaccuaucuuucaacugcuuuauauuuauuucuuuauuagauagaaaauuccucaguaaacuuuuauuuagaguaauuccucuuuaugauuuuuuuguucuaaaggucgauucuuaaaagaaaacuuguugaagugcucuaaauggaagucuuuuuuuuuauuucucuccugugucuuuuaugauaguaucugacaacuaucuuuuuuuuguuuuugcagagauuggguuuugcucuguugccaggcuugucucaaacuccuggccucaagcgauccuccugccacagccuccugaguagcugugauuacgggugugagccacugugccuaacaccuuuuuugagaaacuuauauuuuuuuacauauuuauucuugauucauaauauuuauacauauuuaugggguacaugugauauuuucauauguguauacaauguauaauuauaaaaucagguguuuaggauaccugucaccucagacacaacauuucuuuaugucagacauuuaauaucuucuagcuauuuugaaauauaugauaaacuauugauaacuguaguccuacccuacugugcuaucaaacacuagaacuuauuccuucuaucuaacuguaugcuuguacccauuaaccagcuucucauuaccucccuccccaaagcucugguaaccauuauucuaccucuaugagaucaacuuuuuuagcucccacauuugagugagaacaugugauauucgucuuuugguaccuggcuuauuuuaccuaacauaaugaccucaguuccauccauguuacugcaaaggacaggguuucauuuuuuggggggggcugaauaguauuccauuguguguauauuccacauuuucauuaucuguucauccauugauggacacuuaggcugaguccauaacuuggcuguugagaauagugcugcaguaaauguaagaaugcagauaucuuuuugacauacugaguuuguuuccuuugaauguauacccaguagugagauugcuggaucauguaauaguucuauuuuuauuauaaaaaauucuuuuaagagagggugucuugcccugucacccaggcuggaaugcgauggcauaaucauagcucguugcagccuggaacugcuugguucaagagauccuucccaccucagccgccugaguagcugggacuacaagugcacuccaccaugcccagcuaauuuauauuauuuuuuuuagagacaggcuauguugccuaggcuggucucaaacuccuggccucaagcuuuagcuucccaaguaguugggucuauaggugugagccauccugcccagcuaguaggucuauuuuaaguuuuuuaaggaaccuccauacuauuuucuauaagggcugucucaguuuacauucccaccaacaguuauguaagaguucacgccucucuguguccugaccaacacuuuuugucuuugugacaauagccauucuaacaggaaugagguaaauaugucauugugguuuugauuuguauuuuccugaugauuaaugagagcauuuuuuuuuucauauauuggccauucuuucagggccuuugcccauuuuuaaauuugguuauuuguguuuuugguauuggguuguuugaguuuccuauaucaaaauacuucuaaauucagcgugaugauggaacauugguaguugcuuaugagauaaaacagacucuuggauuaaaguaaaaaguaaaaguuucagaaguaauuuaauuuucggagaagccaguaaaauuggaaucauuuguguuuuauuugaaaaaauuaaaauaugguacaaauauaagaauauaauacagauauagaagaaggcugcugaaaccaccaucuaguccaggauauagaguuuuggcagucacucuagaagcucucucugccuccucacugucauagcccucagaggaaucaugauccugacuuugucauuguuaucaccuucuuaauuuccuuugcaguuuugucacccaaguauguauccuuaugguuuaauuuugccaguuuauuuuuuaaaugucuucaaaauuuuuaaaauuuauauuuuuagagacaaaggucuugcuauguugcgcaggugaguugggaacuccugggcucaagugaucccccuucucagcucccugaguagcugggacuacaggugcauaccacugugucugacuuuuuauaaaaauacguuuuaaaccucuuuaucuacagguucccucuccaucucuuuuuauuccuauccucaccuuugguuuuuuuuuuuuuuuuuugaagaaacucaguuguuuuucuuguggaguuuuccaaagucuggauuuugcugauuacauauccauagaguuuaagauauuccucuguauuuucuguaaauugguaguugaauugagaggcuuaauaaaauucagguuuuuuuuuuuucauagaagaggaagagaacuuuguagauucuauuuuuucauugggaggcauauaauuaucucucuuuuugugaauugaguagccauugauacucaguagugaugaacaagucuugcuuuuuaaaguaucauuaugaacccaagggccuaauguauuuuggcuucauugcaguuguuauucuucccagugcucaaaauggcccauuauugggcaaagagagucucuccaaguugaccucugugccauuuugccaugaugcuaguaaucuuuaguagcuuuuuuguguaacaaguuagucuaggaucaucuuaaacauuuucagucccagaccuggaauuagucauuucuccaguaauccuucccuaguuucuuuuaguaggaaaugguauuuuuuuuuuuuuuucugagacggagucuuacucugucgccaggcuggaguacaguggugcgaucucggcucagugcaacccccgccucccagguucaagcgauucuccugccucagccgccugaauagcugggacuacaggcgcgugccaccacacccagcuaauuuuuauauuuuuaguagagaugggguuucaucguguuggccaggaaggucucaaucucuugaccucgugauccacccaccucggccucccaaagugcugggauuacaggcaugagccacuguacccggccaggaaaugguauuucuaaaccacauucugugcaacuagggaggcuauuuauuggauaggucaaacuauauuaagaacucauuaaaaaauacuucugauucaaauucagggcuaaagaguuuuuauuuaacuuuuucagucugacaucuauaucuccuuuuccccaccaugucgacaauccugguucuuauguaaguacucugauuuuaucauucaaauaucagguauuuaauuugcuuuaucccacauuacugaaucuauguuauuaaaauuauauauuauaaaaugccauugcauuuaaaggucuuacguuucuuccccauuuauuucacaguuguaauauaucugcaucaucagagcauauagccauuagguacuauaccuucuuucuuauagccuccauugagagucuuaguucuccaaacaaauauguauuacaugcucaccaccaauucuuauauccaugucuuucuagucauuuugguugucugaaauuuauucuguaguaugguuguucuuacaccuuagugugcaucagaauuaccuggcaggcuuguuaaagcgccgaguacugggccucacuggcagguucucuggcucaguacaugugggauggggccugagaaucuguguuucuaacaaguccccaggugguggugaugcuacuggucuggugaccauacuuuggguauagcucucuguggccuuuauacauggaagauuggcuaagcuuaaaauuccuggcuuacaguuuauuucuuugaguaucuuaaauacauuacucuauugucuguaggguaaaacauugcgguuaaaguuuggcaacucuguuuuucuuucuuuuauaaacaacuugucauuuuggcuggaaauaauuuuacuagauuacuuacugugauggucauuauggguugauuuccccagguaugugauguguuuuuuaaauauacagugucaagugauuuuucuguuucuuugcuuugcccucuuugccaacuuuguaccuugggggcaccuuuuauacacguuuuaggucuucuuugccaaccuuuuguauuuguuacuuucuuucaaucuuucaaaucuccucuuucauuucuuuuugacuuugaaaaaaauuucccccuuucauuuccugcuucuuaucuuuauuaucuguaguauugauucaguugugugccuucuagacuaucguucauucugagaaguuuuccuuuugucucuaauuccugaguucugcccguugauuucugaguuuuucuaaauccaauuuguuuucuuaauaauuuuuuuaacuuguuaggguuuucauguuuuauggagauaucuaacaugauucuguugucuguagagauguuauuauguuuuuucuuuuuuuuucuuaucauaacuuuggacaggauuugaguuggguccuuuucuauuacucauuuuuaugcaaauucauuuucccaaacuuuuagaagaggcauggguucaaaauagcuuuucugacuucacaguucugguaguguuuuuuaacuccaaguauuauuuauaaacaguucauuuuuaaguguacaguuuacacaacuguaaguguaagugguaguuuuacacaauuuuguaaccacuaucacagucgagauguggaagaauacuuuuacccuaaaacuuuccaugugcuuuugcaguugguccccucccuucacaucuggcccuaggcaauuauuaauuuuccaccaguauauuuuaccuuuuacagaauuucaaauacaggauaucuuacaauauauauuaaaauuuuuuggcuugauuucuuucacaaaauaugauuuuuugagguucauuuugcugcauauugucaaaguauuugaaaaugugacagcucauuuucuccuggcucuguucuguaguacuuuugucuuuuuaacaauuacccuguuauccuuuucuccccauuuuagauucuguucauaggaguuuuuccucaggguaagauuuguccuaaaaaagugcuuugcaucacugguuuugugaauucauagggccuagaguucucaagccccuucaggcuuuacuguggacuccuuguagucacuauuaucaaauauacaaacugcacucccaauuucagcuccucaaaauguccuacugugcuuuccagugaguaccucguugcuguuuuguguuguuucuguuuuccgauuguuagaguucuguugcuuuugucugcuucuucucacaugguugcugauagcauuuguaucuuauuguucaucccaccugcuugcauuuugggguucuuaauaucuugagaugcaguuauaguguaguacauguuaucuguggguuuuaguuugguuauuaaagucucuuuuuauggcaggauuuagggagacugaaaaacuaugcuugaaucuaacaaaaaacaacaauuauuucaauaaaauauuauaucaaggaaaauagcaaaaaauuacaaauguguguuacauugauaaaaugauacauuuauuucuacuuuucauaauauugagggagggaguguucugcuuuugugacgagguauagccauuuguguuucuguguuuucuguaucuuuuacauaugucuaccacauuacugucuguugucuuagauuguaaacuaagaaacagugauuguuguguggcauaugcccaugagaauuuguuuaacuguuuuugugaagaaaaaaaauauauaaacuauagauuuucugucauaaauccuucuuucugaauuuuaaccuaauuguaaagcaaaauagguaauaaaguuucacuauuguuuauuuauuacaaggcauuguaauugaacuuuuaaaucaacucauacgaucuccuugcucaggaaggaaaaucauaaaaauagaaaaaagcuugcuuuauuuuggugcuggggaugguuucaagucuuuuuucaguuuuauguagagaccaagaaaguguucugcauagggagccaaagaaaaaaauauugagaaacuuucuaaaguaucuuaacucaguuguuuauaguauagcuuuacuuuacagauaacuuuugauguucuuagaucauuagauauaccuacaucaauauacauaagauaagcuuccaaaggaaauacucuuugcuuugggaauacucuuuccuaucaucuacuaauuuucauuauagcagcagucuuuuauuuguauaggucagugguucuuuaacuuuaaugugcaguagaguccccugaugcugggccgggccccacccaacaccuguuccuguuucagauaaagaccagagagagguauguguacguaucuaagagugagcacaaccaaagcuguauaaaaccuucauggaggaaauuacagaacauuacuguuggauauaauagacaugaauagaagaauauaccagcuuugauaaugugauaccucuauuuaagauguuauuucucucuaaauuaauucauuacauaucaaauuaaaauaccaauaagggcugggcgcaauggcucacgcccauaaucccagcacuuugggaggccgaggugggcagaucgcuugaguccaggaguuugacaccagccugggcaacauggcgaaacccuguaucuacuaaaaauacaaaaaaauuagcugggcgugguaaugccuaucuguaguccuagcuacuuggggcugaugaaggaggauugcuucagccugggaggucgaugaugcugcaaugagcccugguccagccuaggcgacggagugaaacucugucuaaaaauaaauaaauaaauaaauaaauaaauaaauaaauaaaguaaucccaguaaguuucuugugaagaccgaagguaagugaaccuaaaauucacaaagaaaaucaaagggccaggaguagccaagacaaucuugaagagcaagguagggaccuugccacuuuagauauagaugccaagcccuagaaauuaagagacuguggucgugauacagagauagacaaaaagaccaguggaacagcauggagaauccaaaaacauauauagaaaugcaauaugcagugaaaguaacauuauaaaucaucagggacguauggaaugcuaauugcugcuuugaucauuaauuauauggaaaaugaaauuguauuuauaacuucacacuauccacaaagauaaauucuggugaauaaauucagaaagcagaucuuaaauuuauuagaaaauauaagaaauaauaaaauacuuagcugcuguuaaaauguaaaaagcacauguaucuucauguauaaaucuuagaaauaguguaacauugaggauaaaaucaauuuguaugguuaugauaaaguaccacucauacaaaaugaaaagcaugaaaugauacaguuuuuuauaaaacaugaaaacaugcaugguaauauacaucacauucaagauaauguuugcuucuuuuauuaauuuuuuuuuuuaauuugagacgauguuucacucuugcucaggcuggagugcaguggugugaucacagcucauugcagccuugacucccugggcucaagugauccucccaccucagccuuccaaguagcugggacuacaggcaugugcuaccgugccuggcuaauuuuuguauuuuuuguagagagagccauguugcccaggcuggucuuaaacuccugagcucaggcaguccuccugccucggccucccaaagugcugggauuacaggcauuaagccaccgugcccggccagcguuuccuucuggaaaucguagagggaugugauuagugagggauaugugcaggcuacaacuguaacuaaaguuuuauauuuuuaaauaaaaauguuuuaaagcaacaugugacaaaacauuaacaccaaaugaauaucaaacaacaaagaaauaguugaagaaauuguggcaucuauauacuaugaaauauuuuucagccauuaaaaagaaggaguuguagcuaggucauuuuuauggagggacuuucaagaauuauuaagugaagagaacaagacacagaaauauguuuauaaaaucaucucaguuuuauaauguaguaauauauaaugagcauauauuauauaugcuuguguaugaccaaaauaugaacaugaaaaaauauggaaagauucauucuaggcuguuaacaugagagauaacagucaugggagugagaugauaaagaaagaagagaaggaggacagaauagggagucaaaaaacauagaaaaagaaaaugcauuacccagcaugcaugcuaugauuuuguuuauguacuuaggcaaauuuuuauacauauuuuuaggaggacuguagaaucacuuuaaagagugagaguuaaccuaauuuacuauauuugacuggagacugugauagaaacagauuuagcagaaagucccucaaagaaagaguuacucagugcuguauucuguugcuagauuauuuaaacaaauaacguaaucaaaucaaaaugaugcuuuucaguuuuucucucuucauauuuaguaacauaauggacccuaauuucaaugaguuuuucuuuuuaaauaaugauagauauaaaauacucacaaugugcuaggugauauaaaauagcaguuaauaaaaaguacuuggccaggcgcaguggcucacgccuguaaucccagcacuuugggaggccgaggugggcggaucacaaugucaggagaucgagaccauccuggcuaacacggugaaacccccucucuacuaaaaauacaaaaaauuagcugggcgugauggcgggcaccuguagcuucagcuacucgggaggcugaggcaggagaaugaugugaacccaggagguggagcuugcagugagcugagauugcugccacugcacuccagccugggcaacagagcgagacuccaucucaaaaaaaaaaaaaaaaaaagauaauaaaaaaauuaaaaaguacucauuuuaauauuuuaugaaauagagcauuuuggcagagaaacuuuagcucuuucuuucucucucuuucuucaacuugggaaagaauaaggaauaaaucuuuaucuuuuuuuuuuccucuucuggccaagaccuaaauaccagcauuucaugauaauggauaaguuaucuuugaaauuuuccuuuuuucuuucagugugcaggaugacagaauucgagucgaaaggauggauaacauuuauuuugaauacagccaugcuuuccaggcaguuacagaguuuuaugcaaaagauacaguugacaucaaagguaaauauuuucccuguauguccucaaguugaacugauuugaaauuuggauaaagguauuaguaugauucucaauuuaaugaugacuagguaguuauuauaaauaugugggagaagaagagcucacuguuguugugcucaucagaaacacuauuguacugcagucccagcuacugguuagacugagguaggggaggaucgccugagcccaggaguucgaggcagcaaugagcuauuaucaugccauugcaguccagccggggcaacaaagcgagauccugucuguuaaaaaacaaaaagaaccauugcagccucuuuugaaauuaugaccagcuaguaaguugaugguuuugacauauucaucagaguggaaggaguuuugaccaucuuuccuuuuugcuuaucuuuaaagauggcucauuaguaucuuuguauuuuauagacuguuuggaugauaaauauucugaugaagacuagcauuuugaaagguugguugccaaaauuaaaacaccagaaucuagugacaggucgaaauauuuuagguaaucauuauuugucuaauucacauguccacaaucaggcauuaauguuuacuuucauuuguaccucacauuccugccaguccagcuuauguuaggguccauuuuguggauggugaggugaauagacauuuucccucuuggcauaaacuuggcuucacucuaaucuucauccuacuccauauggaggaaauuuaucucugucacaugcuagagaguguucaucaucagcuccccaucacugcuccauuuaagcaucagugucuaguuagcauuuccuugcaucuaggcaucagugucuuguuagcaugucucuuuaauuucaugaugccuuggucaaauaaagugucugagcguguaucccacuucuuuuuauuuuuuucuguaaggucucacucugucacccaggccggaguacaguggugcaaucuuagcccacugcaaccucugucucuuggacucaagcaguccucccacgucagccucccaaguagcugagacuacaggcgugcgccaccacacccagcuaauuuuuguauuuuuuuuguagaggugggguuuugccauguugccuaggcuggucuugaacuccugggcucaaacgauccucccaccucagucugccaaaguugcugggauuacaggcaugagccacugcgcccagccaaguguaucccacuucuaacaccaguguucaguauuaccgagaggucaucuuauguucaacuaaagaccugauaaaucuuaagacuaccaugaccuauccgugguaccagauuuacuuaaaagauaugggccagaaaacacaccuuacaagcagagcauguguugcucuuagugggauaguccucacagcagacuuuguggcagugcccgggagaguguaugaaggaaggagacucacaucaagugagcguaagcgccacccuggcuuagaagcuccaggcccuugaggagccuguauuucuugcugcagucucuacaaaagacacgccaguugacaaaagucaacgcacuaagggaaggccaaaacucuguagucagguauuuauaauucuucucaguccagauguaauuuacugauauuuggucauuuuuaccacaggcagugcuacuucuaacacauugauacaccaucuuugucauguuuucuggggaagaaagcuagaaaguuaaaagaaaaucaauuucucaguggaacggaaagguguuguuagcacuucauuuacacucugguuuuauaaacaccuauaguuaaaauuaauaagauauuuuacugauuuguagagaacaucuuguaauauauguuuuuuuacuucuaaaaguaauuaaugcuuauugcaagaaagucaaacaguguagucguauauaaggaaaaaaguaaagugccugcccucaaacuuguccucugcccuugcagcuuauaugucggagggguuaucauuaacaauuuggcauauauccuuguguaaaacuccacacauacacacauaaacauacacauauaguucucuguauuuguuuaacauaacugggauuuauucguucagcuaauuuuuugaaugccuauuauaugccaggcauugggcauacaauaaggaauaaaacagacaaaaauuccugcucuuuuggaguuuacauucuaauggugagagauguacaauaaaguaaacuaguguguuagaaggugauaagugcuaugaaaaaaauaaggcaggggaguggguugaacuuuuaaauaggaugguaaaggaaggccucacugagaaacagcacuugaacgaagauuugaauagagacugaaggaguuaaggaaaagagccauauagacauaugaaggaacaguauuucaagcagagacaacaguaaguacaaaauaucuuaaguaggagagugcuuggcauguuuaaggaauagcaaguagucugugugcuggaacagaguaacugauggggagaacauuaggugagcucagaaauaaagaggagauggcaggcaguauagggucacuuuaagggcuuugaccucuacucuuaaugaguugggggauguuggaggacuuuugagcaaaauagucuaaugaucugauauacauuuuaaaaagaauuccucuggcugcucuguuaagaauacccuguagggugcaaggaugaagcagugagaccagauggaaagcuguugcaguguuuguggugagacaugaaauugaucagacaacuuuuuucccucacuuagcaacauguuauagauggccuuccauaucagugcagauaauuggaagucauuccauuuaguugguacauaauaaccaggauuuacccaacuuuauuuaaguacuacgcuguuaauguuuauuuagguggucucuaguuuuuuuuuaauacuccaaaagauguuuuaagucaccuucugguacacacauccuugacaugcaguuuggaguauuucuagacaaaggggaugggcauuuuacauuuugaaaaaacaaccuguucuucaaaaaagguucauuccaccaucagaaaaaugcccuuuuuuuccaugcccuggguauuaguaaugauuuacauuuuuccaaaggucaauuuuaggagauauuguccaaauuauuauuuugguaaccauuaaguuuuacuuaaaauuuguguuuaauaaugcuaacaaguuaaugguucuguuuauuacauuuuuuaauuugauuaauuuaaaagaauuuuuauaacaaguuaauauauucuguuuucuagguucucaaauuauuucuggcauuguuaacuuagagaagccugugauuugcucuuuggcugccaucauaaaauaccucaaagaauucaacuuggaaaagaugcucuccaaaccugaguaagugauuccuccaaaauuaaaaaaagggggagcuuauauuaugaacauuucuuaaauugaauuugguaguacuauacuuagagaagcuugccugcuauugauagaauacuagggugcaaggaugagcuguuugguauuguugcugaagaauauuaaaaauauauuggcugggcacgguggcucaugccuguaaucccagcacuuugggaggccgaggcgggcagaucaugaggucaggagaucgagaccauccuggcuaacauggugaaaccccgucucuacuaaaaauacaaaaaauuagccgggcgugguggugggcgccuguagucccagcuacuagggaggcugagacaggagaauggcgugaacccagggagguggagccugcagucagcccagaucccaccacugcacuccagccugggcgacagcgagacuccgucccaaaaaaaaaaaaaaaaauguguguguguguguguguguguguguguguauauauauauauauauauaaagaauucugucaaauaaauuguauucaugauagcuauuugauauauuauaguuuugacuacaaaacugugcuuuauacuaacuggacccagaaauaguauuaaaaagcauucauaaaaauuuaccaccuuucuuauucuugguuucaguucuuauuucauagaccaugaaguuagagauaaaagggccagcugcuaacacagcuuuuuacaagagugauuaacuguggauuuuggaaauuuaaaagcucacaauugacauucuaggaaaauacuaguuugauaaccauuggaauagaaaaaaguaguaggguacuuuccuugucuuuuuauauuccgccuucaccagccccuugucuuugggucugucaagaaucacccuccauuauauugauccagggugcaucagcucugucccauucugcacaagugggaggggagauaggugcuaucucagcaaaaugacagaauagaaauuaacuaggaaacaaggagguggugcugguucaagguugcuggagagagucaaagaaaggcagguuccuugggguucuuuuuguaaugucuuugaugugcguucucccgugugguacuagaacagaguaucauuucucuggaagcaacuuuauccuauuuaaaagcaaucuaaaugcccaucagggauccuugugcuauauucaugcaauguaauguuauauagcagugaaaaugaaugaacuagagcuauuaauauaugaccaaugcuuaaaauuucaugaacaguauauuaagccaaaaauaaaguugcugaaggccacguaguacauaccauuauaugaaguuagaaacaugugaaaucguacucuguacugcuuaagaauauauauguaguuagagaauaagugaagacaugcaggggagugauagaaaauucagaagcaggguuucuuccagggggaagaagggaaaguaguaaagguuggggauggacguggcauaguggaguucuaacugauguuucauuucugaauguggguauuguauuaaucuauacauuuuuuaguguggccaaaauguuuuauuuuaaaaagugucagcccggcauuauacccucauuggauucuacuuuaagcuccaaaaauaaacuuauuaaagagaucaaucuguaugguugguuguguuggggcuuuguaaaaaaaggggugacaagauaccuaccaguuugacuuguucaugauagggacccuguaagugagguacaauuagugauaaauagcuugcccauuaagacuuguguuuguguuccuguaucaccaagcaaagaaguauuaauguugggauaaggaaacuaacuuagaaaucaggcccugauguguuuagaagcaaaugaauuuggaccuggaaagauguguccuccucauauauauauauauauauuuuuuuuuuuuucuuuuuuuuuuuuuagauggagucuuguucuguugcccaggcuggaguauaguggugcgaucucagcucacugcaacuuccgccuccuggguucaagcaauucuccugccuccaccucccaaguagcugggauuacaggugcacgccaccgcgcccagcuaauuuuuuguauuuuuaguagagacaggguuucaccauguuggccaggcuggucuuaaacuccuggccucaagugaucugcccacuuggccucccaaagugcugggauuacaggugugagccaccguguccggccugucuuccucauauuuaauucgaaauaagaauaauaccaaacaauaaaacaagaugucuauauauacugaaauuaaaauagauucuuuucaaauuaccugaaguaaccucuugauaaacugaagcugaacuuuuugcaucucauaauugaugguggaggauggucaggaaacuggcucugcuagugacuuaguguaucaucuaaucuaccuguuggguacuuccauggagccaaagccaaaagacauaaagugcucugcuuuguauauauucccagcauccagcauaagcccagcaccuaguaggcuuuuauuauauauuauuauauauaguauuaauauaggauuaaugaaagaaggaaggaauucuucauucugugaggguauauuucauuggaaauugccaaaaggucauuggaaaccaagauuaauaaagauagugaucaaacugguacucuaguuuugcuuaaaaacgaaaugugguguucaugaguggcauguaauuugaagaucauucuaaaagaguaauucuguagugcuuauauuuugcaaaaauaauguugcuucuuaaggugauuacuuuggaaaaaugaauauucuccuuguagaugaaaaauucaguugcauuauuuuauaaacauacuuuaugcugcugaaguuuuggacuuuuauuuacaaagcuauguuaucaaggggaaaauaaauuucacuugaguugacuuguuuaguaaaugcuuucacaaacguugcugcauauuucauaaaaaucaugauauacguuuauuuaaagguccuugugccauuagaauagaauuuuagauaguuugagaaaauauaccauuucagaaauuauucuuaaggaugauuuaagugaaguuuuguuaagacacacuugagguucuaaaguuauuuugagaguuuaaguuuguuucaaagaaaaauaguguaacaaaauaaauagaaugugagggauauuauuuauuauaacagaauuaaccugaugccuaaauuuaugaaauucagaggaauccacuuuuuguuguuagaaaugaaugcuuuugucauuuuggaugguuuuuauuaagauuggaguggucacaacuucaaaaagauauuggaaauuuuaggaaagagugagaaaauccacccaagauaaacuguaaaaccuuuuuuuuaaaagaaaacuucuuaugauaacagaaugauaacauguggugauuaccuuuacuuacuagugaaagaaauagcuuaauauauaagcuacucucaugacaucuaauggcuagcagccagggaugcugcuaaacauccuaaaaugcacaggauauuucccuaaaaaacacauuauuuggcuccaaauuucaacacuccaaaaccaaacaaauauauuacaggaaaagaaacuacagaccaguaucuuuugauuauaggcacaaaaauccucaaugaaauauaaguacauggaaucaggaauauaaaaacgauuguacuccaugacuauuggauuuauuucggguauacuggcuugguuuaaaaaucuggaagccaaucaauguaaucuaccuuaucaaaaacuacaugauagucucaauagacaggaaaaacucugcauaagauucaacaccccuucaugauaaaaaacgcucaaaaaacuacaacuaacguggaacuuucuugaccugacaaaggacauuuaugaaaaccucacagacauuaaaccugucuguuguuguuaagaugcaguauugcucagaucagucucuaaguucagugcaauuuguaucaaaucccagcuggcuuccuuggagaaauugacaagcugauccuaaaauucauaggauucauaucucuguuucaaaacuuacuacaaagugaguaaucaagacaguguggagggugggauuaaaaaaagacaguguggaauuggcauaagcacagacaugugaucaaugugauagaauucagagucuggaaauaaacuuauggucauuugauuacugacagggguguuaagacaauucaguggagaaagaauagauuuuuuucaaacaaauggugccaagauaacugucugugcaagagaaugaaguuggacccuuacuucaugucauauuugaguuuggaagauaaaauggaccaaagaccugauaugaguuaacacuguuauacucuuagaagaaaacauagguguaaaucuuuguaaccuugaaugaggcaaugauuucuuaacuaugacaucaaaaacacaagugagaaaagcaaaaauagauacauuggacuucaucaaaguaaaagcuuuuauucuucaaagaacaccaucaagaaagugaaaagacaauccacugaauagaagaauuuuuguaaaucauauauccaguaagggacuuguaucuagaauauauauauauauauaaacucuuacaagucaaugguaaaaagauaacucagaaaauggacaaaugauccauacagguuuuucuccaaaggauauaugcaaacaaccaagaagcacgugaaaauaugcucaacaucauuaagcaucagguaaauucaaaucaaugccacaguuagauaacacuucauacucacuaggauggcuauaacuaggaaaaaaaaagguguuggcugggaugcagacaacuugaaauccucauacauugccaauaggacuauaaaaugguacagccauuuuggaaaacagucugguaguaccucaugacauucacugugugauccagcaauuccacuagauguuacuuaagacaaggaaaauaugauguccacauaaaaacuuauacaaauguucauaagagcauuagucacaauagccaaaaaguagaaacaacucuaauguccaucaacugaagaauggauaccuaaaauguguuauaugcauacaauagaagauuuuucaaccauaaaaaggaaugaaguacagauacauguugcaacaugaugaaccuugaaaauauuaugguaguugaaagacaucagucacaaaaagucucguuuugucugauuccauuuauaugaaauguccagaauaggcaaauccauagagagaaaguagauuagugguugccuagggcucuuggguuguuggggggaauggagagugauugcuaaugaguauagaguuucuuuuuggagugauaguaucuagaauuacaugguggugaugguuggccaauuuuaauauacuaaauaccacuuaauugcacacuccaagugggugaauugcauagugugugaauuauaucaauaaaguugauagacacauacacacuuaucuuuuaaaugucaguagugcugagauugaaaaaucuuugucucugucuauuuuaauucuguucuuaaggcaauauccuucugaggcuuauaaccaaugccucauguauuuugagguauuucuacucugguuggagaguguuccaagcccuuugugaacucuggucacuguucacuacuauuuucugguaguuauuuccauggucccacagaggucccuaaacgccuuugaggacugguacuuggccaagaguugaggugacccuucagcagaucucuggagcuguaugugcagcucuguuaucuggcauucugucucacaaauucuaguuucccugcgcccaccaaagaggcagucauguuguuuaccucauuuguuuuuccucucucagggucacgguucugcaccaaguguuguccaauaccugagaaguuuucccccucauguguuuuguccaguuuucuuauuguuuaugauuggaggacauuucucaugcaguuacuuuuuuaugaaugaaagcagaggucagguggcacaauugaacacugcacagaaagaagagaagagggaggcuggagaaaaacauucuaugaaguuuaaaacaugauuaccggccaggugugguggcuuaugccuguaaucucagcacuuugggagggugaggugggcagaucaccugaggucaggaauucgagaccagccuugccaacauggcgaaaccccgucucuacugaaaauacaaaaauuagccgggcaugguggcaggugccuguaauccuagcuacuugagaggcugaggcaggagaauggcaugaaccuaggaggcggagguuccagugagccaagaucaugccacugcacuccagccucggugacagugagacuucaucucaaaaaaaaaaaaaaaaaaaaaaaguugagcacaguggcucaacgccuguaaucccagcgcuuugggaggucaaggccuucggauugccugagaucaggaguccgagaccagccuggguaacacgaugaaaccccaucucuacuaaaauacaaaaaaagcagccacacugguggcgggcaccuguagucccagccacucacucuggaggcugaggcaggagaauugcuugaacccaggagguggagguugcagugagccgacaucguaccacugcacucaagccugggcgacagagcgagacuccaucuccaaaaaacaaaaccaaaaaagaacagaagagcgagauguaugaaguuagaaaaacuguccuaaaaauugcccguguucuaaaacuucaggaaaauuaaucuucacuuaaaaauuagcaaugggaaaagaaccaaauucaaauuucuuacaaaauuauuaugagaaaaaagagaauaaggaguaggaugucauuacagauaauguauacaugccagaaaaucauggucacagauuaaauaaaaaugacaaucuggcugggcgcaguggcucacgccuguaaucccaacacuugugggaggcugaggugggcagaucaccugaggucaggaguucaagaccagccuggccaacauggugaaauuccaucuuuccaaaaauacaaaaaauuagcugggcaugauggcgggugccuguaaucccagcuacucaggaggcugaggcgggagaauugcuugaaacugggaggcggagguugcagugagccgagaucgcgccauugcacuccaaccugggugacugagcgagacuccgucccucacccacccaccccccuaaaaaagaaaaacuacuguuuuaaaaugagcuaaaagacacuaagaaaaugauacuagaugugaaagaacauaacuaagaaguaugaaagauuggaaaugaggugauaggauuuaagacagaaguauaaagaaaaagaucaauuuaggacugaagcguaaacuugaaagaacauaauagcgaauaaauguaauacauauaguuuuagaguagaauuuaaaaagagggaugugcaaaaaauuaacauagcaggccuaaucacaaagcuuuccuuagaaaggccuuccugcaagcuuggcccuugacuggagucugggaccuugaauuucgggagaguuuucaccauuucgugaugagaguggcucacugugccuuaacuguuugugcacacagugugguuuaugcugaucaccuaccuucuuggagcuggaauuuugguacaugguagggagauggugccuaugggaccaguccggcauagaaaccaugggugcugagucucuaaugaguucccugguggacagcauuucacacguguuguuacaauucauugcuggggaaauuuaagugcauccugugugacuccgccuggagaggauucuuggaugcccgguucccccuggacuuugccucaggcaccuuuuccuuugccugauuuugcuuugcauucuuucacuguaguaagucauagcuguuaguauuacucuaugucgaguccuguguauauaccaugagucauugaaccuggcaguggucuuguagacucaacauacaccuuucccauuauuugccuuucuaaugggcuuauuggcaggauuuagaaaugcaaaguuagucauguuguuuaauuacagaucaauuauaagugaaucuacaacccugaaguuuuguaauauaguacaauuuauauuuuauaaaucaaauuaacugccaaaaaguuagacaagugaugaauuuaugaacucugaaagcuguacacacagaaauguuuucagcaauagauuucauguguuauaugguaguuuuugucauuguuuccauuuuaaaaugauauuuaaauaaguucuguacccuuguugccuuugucugucuuuuuuuuaagcaggguuagaguaauauggaguugauuucucuguccagcuuuugacaaagauguuucccucccacuauugagggaaaaaaagcaucuauuguauuuuuggugucugaaauauugauaaaacuauuuucccauguuauauauaagauuucuaugcagguucacaaagcaugaauucuagccagauguuguuggugaguuucauuucaaagcacauagaauuugucuucuucuacaaugguaaauaauuuagaauugcuugaguguuucaggucagugaucggauacuauuggauaccuuaggaugcugguagauauaacccuuaguucaaaaauauauauaauucuaauggaaauaggugcuaacagaaggaaauugcauuucuauugggaaggaagacuccaacuccagaauacguauaaauuuauacuuauaaauacuuacgaaauauaugggaacuccagaagcaugguuaguccuuguaguugcuugauaauuauucuagaugggaaucaaucugauuuaagauugcccagugguugaucuuuuauuaaaaucaauguagauaucaguuuaaaaaaacucuuagugcaucugauuugaacuuuagauuacuuguuuaguaaggacaaaaagaaaaaacaaaaacacacacagcaaaaagaaaagacaaaaacacccauaaccaaccaaauaaaaaaccacacacacaacacauuaauacuuacguuaauaccauugauuaaaauaaccuauaccuuugcucucuaaaggucugggguugugagcuaacuuaaaaaccagcuugguuguucacaguuacugguuuccuuuugauauugcagauauuugguaauuauauguagaugaaggcuguaagccuucuaccccacccccuguauaccagguaguggguuaauucaaacugaauucugccacucauuuagauacuuuuuagcaagcaggcacaaaaacagucauguaaacucuucucuagcucuaugaaauuacaauucugucuuuuugguauuccgacaguaccuuguuucagugguucacuugaggcaugugcaacauuauaauagggacaguucacuuuuaguuggagucagggaacaaacccugagauaauugguagaacaggggaugcuuucagaauccgaagccuaaaacaccaucccuuaggguauggacuguuggauuuauaggauuauuauacccuguucauaugagggaggaggcaacugggcaguauuucuggacagcccacaaacugccauaccaccgugaaaaauuaugucuuacacaucuguuguugacagaagauaaaggcagugagcugagaugcuuuuaggaaaggcugcuagauugugguuucuugauuagucucaugccaacuguuauggccuggauguuugugcccuucaaaauucacauguugaaaccuaaugacuacuguggauauauuaagaaggggccuuuuacuaagugauuagguuaugagggcagaucguuuguaaaugggauuaaugcccuuauauuaauagaaaagacuuaaaggaacuguuugucccuccuccaugugaagacacacagaaggugccaucuauggggacugagcccucacuagacaccaaaucugcuggcaccuugauuuuggacuugacagccuccagaacucugagcaauaaacuucuguuuacaaacugcccauucugagguauucuguuauaacccaaauaaacaaagaugccagcuaagcaccguucuagagucgacgucugauuagggcacuaacauguuaacuagucaccccuaggauggacuuaguuaaaccuaauugucagaacagcggaaguaaggacucauaucuaaacacauagguaacugguuagauaccaacucagagcccaggcuaucagccaaacuuccaacuuagaucuuugaccaugaauucaugugaacucuugucagcuacauagccaaucacugccuaauuguuucuuccuguaaauaauguuuuacauuuuauaacugucuggcuauuucacagacauuucuggagcuuugugauucaaagggaaaaauauaaacccaaccugguuuucccuaggaagauggcagauauuuguagacccucuacugucugcuaagcuguacaggugguacaaaaugauugccuucagggagcuuagaucuauuaaggaggguagaggcacaacauaaauugcuguaauucaagacaaauuaaguuaacugcuaccagagggagagaaagggcugaacacuugcuauccuuucaguuuuggaguugcuucccgcugaaaaucauuaacagauuaucguucuuuggaagcuagaucaaaccugucacagauacauuacacuaccaaaggacagcauugaguuacuaggcaacguuccuaauuugagguaaaguauuucucuuuuccagggcuuuggggccuuagucaaaggagucaucuagaagugaaggaaucucuuuuuggguacugguuuuucgggcucugauauuagguucucuaaaguucugggugagggcuuguuuucuuaacucgggaaacuggauguuaccuaaauuucauuauagcuaugagaagggugguuagguuuauagcacaaacacuuaugccuuucuuuuguuaaauaauuuagugaccugcuguuauuuuccuugccuuuaaaaauaagcucucaagccuguaagggcuguugacagaaacaucuaaggacuggcugauaaaggauauugaauuacugcauuaguacugcauugauuaguacuucuuaacacgaauuggaauuguacauacauuuauuagucaugcuguagcucauucucaaaucuuuuugaaauuuauugaacuucuaauuuuguuuuggauagauacugagacaauaaggagagugugaaugcuuuaacucaguuuaaggaaauaacaguguuuuauacccacuaaauuuggccaugguaauguguguuuuuuuucuuuucucuuuuuuuuuuuuuuggagacggagucacacucugucacccgggcuggagugcaguggcacaaucuuggcucacugcaaccuccgccucccggguucaagcgauucuccugccucagccuccugaguugcugggacuacaggcgugcgccacuacacccaucuaauuuuuguauuuuuaguagagacgggguuucaucauguugguuggccaggauggucuccaucucuugaccucgugauccacccaccuuggccucccaaaguggugggauuacaggcgugagccacugugccuggccgcauguguguuguuaauuacagaguaaauaacacuuguugcauauguuagaaucuuuuuuuuuuuuuuuugccgaggcguagucucacucuguugcccagguuggagugcaguggcgugaucucagcucacugcaaucuccgccucccugguucaagugauucuugugcuucagccucccgaguaccugggacuacagguucgugccaccaugccuggcuaauuuuuauguuuuuuaguagagacgagguuuugccguguuggccaggcugguuucgaacuccucaccucaggugauccgccugccucagccucccaaagugcugggauuacaggugugagccacugcaccuggccuagaaucuugauuaaaaguauuuaucaagaugaucucaugcuaaagaauaaggaggacaguuuuaaguaucuugacauauuuuucuagcugauuacacagcuuuucaugaagauguggcuacugugcuuggcuaaugauaaaagaccauguuugguucuauuccuagagcaaaaccaaaacaaaauguuguuaccauuacuucccuuuccuguucuuguuuuuuuuuuguuagaguaacuaucuuugucuugcaucaaucuacuuaacagcaccagcguuaauggacuacaacagccugaugaauuuucauuuugcuccuuuuguuugauuuucuaucagaaugcuaauuuuugccauaauguagcuggcauguuucuaguuccugaauuaguuuuuuauuucuuuaugcacuuacaucuaggcuaauuauauuugauucuuuuacaggaauuuuaaacagcuaucaaguaaaauggaauuuaugacaauuaauggaacaacauuaaggaaucuggaaauccuacagaaucaggucaggcaaauacaagggcuaguugauuauaaaucguuuugggaaaaacuucugaguaaggcagcagucuguuuuuagagguacaggugaaaauauagugucuuuagcugacugcaguauuaauugauaacuguagcucuuuuuggagaaugaacuguacauaauauuucucuggguuuuuuggggggaaugauggagcugcccuuuuuaaugacugaggggcaugcuuauccugacaauuucuguaacaucauuucuauaucauguaguuuuuuggaaaggcaucaucacugaaaauaugaagcggauuuuuuuugucuacuugguuauauuuuucuauacaccuuuagcuuuuucuugaaauguuugcagucuuauuuaauuauucagguuauagguuucugggauauucaguuugacuguaagaugcauaacauuucaguuugcaaacuuucuuuuuuuuuuuuucuucuuugagacagagucucgcucuguugcccaggcuggguugagugaagugaugcgauauuggcucacugcaaccucugccucccagguucaagcaauucuccugccucagccuccuaaguagcugggauuacaggcaccugccaccacgccuggcuaauuuuuguauuuuuaguagagacaggguuucgccauauuggccaggcuggucucgaacuguugaccucaggugauccaccugccucggccucccaaaauccuaggauuacaggcguaagcaaacgcaccuggccucaguucacaaacuuucauuguuuauuuguccuuuguugaugaauuaggaagauaacggggagauuaaacuuauugcuuucauuuauuaaauuaucacuugggaagaugagacauuauauuauaaaauuaauguuauccuaacaaaguaauagagauaaaaagcaaccccacgucauuugauuaaguacuggagaaucaucugaaccaucugagucaaaggaguuaaaacucuucagaaauauuuauuacuauugcaaauuaaaguaaacacugaauuuauucuccugacuccugaaucugcauauuauuaacuaguuucucucaguuucuuccuguuccagucuguucuaguaugcugaauucagauguauuuuuguucaguaacauuuuuaucuugucaucauccaaaagcugagaaucuguccugccggucugucucgucaacucuguagccaucuccaugauaggaaauaaguaguaggaauaaagagacauuucucggcugaaggagugcugauagccugcagccagcccuggcauuguaagcguucccugcuucugccgcaucuucccuguucaaauccuacuacaacagagucaguucugaaaucaaauuccuaaggcagaaaucaucuggaaucaaaauacccuucaaaauuccuuccuuuauuggaccuugcaccauuuuagaagccgaagcugagauuaacaucuucugcuugucuuuguacuucaacuucacccccaccgccccucgcccaccuuuccaaggagcaauggaaagaggugcaggguaggaguugggugucagcaagaacaaggauauaauaggacacguaucugucccuccucucuugucugagccugcuucuccaggggugucagggaauuggccuccucacgggacccuuuaccccagucaggccagucaagcuguggucucaggagcagugcugcugcugaucugaacugcccuccuuagccuguccagccauccucagaggaaccuuugugaccuuguaccuucucugugcucucuccauugaacuccugaggccugagagcuuaugucacaccuuuucuaguugauuccuggcagguggcauuguauccuaauuacgagucuuuuuccaacuuggcuauaagcacccugagggugggaccauguccuugcuauguucagcacauaggagguacucuggaaguagcuacuuacagaggagaaggaaaaaagaaaggauuaaaaaaacccggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguggcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaaacccaacucaaguggaaacagccauuuuaggucucaagauuuaaaugucucagugggcuuuguacuacugugaaaccuugguuaaaauuaauuaugucuaguuaauugugauuuuuuuuuaaggacccaaauuuuaaguggcaaaagcaaacuuuucuaaggauuuaguaaaacaaacuaaaauaaaauccuuccuggguaaauaccuagagugcagugcaaguucaugucuaucuccagcaccuuguucaguguugucaugagagcauugguuuauaaaaugguaacugugaaauaccaaaggaaaauuaagucaucuuccuauguuguauuucccaagguaggaaaguaugcaauuauauuuuaaagaugcuuagauaaagcaucuuuaucauuucaaaagaauuucugaauaauuuauucuuugguaaccaaaaacuauaaacgaucccuuuucuguguaaaaugucaguacuucauucuguauguauguauucaucugucaaacauuaaaugaacaccuguuaugagccacauugugcuagguauauaugacauuuagaaucgggguauaugaaauaacaauuuggcacaaauaauugucuaguuaauaaaacuuguuuucuggucuuucuuagacugauaugaaaaccaaaggaaguuugcuguggguuuuagaccacacuaaaacuucauuugggagacggaaguuaaagaagugggugacccagccacuccuuaaauuaagguaaaaggaauucuuuuugggguguuuaaucugaaauuauaaaauuuugaaauuaaaggcauuuuaaaaccaagguuaccauuguuuuuaagaacacaguuuuaaauuggagaacauuuuauuuuagaacugagcaauagacuggcucucuaguauuacaaggauuuuuuuccucauucucgugaaugagccugccugcagauuggcagacauagggcguugucccaggaaagugaggauagaugccuuuuguggaggguuuugaaggcuagacugaggaguugauagccagagggaguucauucagugauucugagcauggggcugauaucaucagagcugggcuuguguguaggaggggacuaagugguaguaguggugggaucaaguuagcaaguucauggagaggugcccaggaccugagcuacagcaguaauagcaaggaguccaaaagagggguuaggugugaaaugcuuagaagaguagagugaguaaaguuggagcucccuaagggaagauacuugaauccagugccuaacauacagugauuuccaagguugucugcacaucggaaucaccugggaugcuucacaaaauacucaugccuguguccagcccccauagauugugauuuaauuggucuccagcaugaccagggaguugagauuuaaauuuuacccagaugauucugauaugcagauaaauuuggagauucugaccuagaacagugccuggcacuuaguagaagcccaguuaauguuuauugaaugaaaauuguuauuuauugcacacuuucuauuuacugguguuuaauacucaaaaucaccuucugagauagguucuugaaaugaggaaacagauucagagagcuucacuaacuugcuuaguguuucauagcugguagagauaaauauaagauuuaaaaccagcauugacuccagagaccuuagcaggaacaagccauuauccugaauaguuauaccucuggcuagaccagagugaauauggugugauggugaagagaaccgcuauguguuggcucugucagcugagugagucacucccacuaauccucaguguucucaccuuugacaugguggaacaccucaucacagcauugcuguaaggaauaaaauuuugagcucuuuaucucacaccacacaguaugcuaggagcuuuaugagcauugucucuuuuaaacugcacagcagccucacuaagcagaugcuguuauuagcccuguguuacucugugauuaauaaauagucacuauuuucaauaauggauugcagauguuaauguuggucauaggcuugaagacacuguuauggguuuugcuguuguuuucuucuuuuucuuuugcaaguuuuuuuuuuuacaaugccaacuuuaaaaggucacuaaaguuaacuggacaauaaucuaggcagacaucacuuuacaaaaaagagggaaagcccaaaaugccaccuucuauagaaaacgcacaguacaguuuuauucagagcaaagaaaaaagaaacuugaucauacuaugagaaacucagccauagguuuggaauccguauucacaccacacauucacugaggacaauauucugcucauacgauugauuugcuacugcauuucacugcuguuugucugauauuaacaauuuuaaacagagcagggcagcuaguauuuggaacaauccuuacagugugacggcgucaaggacguuucacuucuguucacaccgcugguucgcuuggcauaccuggguuuccucuucuucaguaaagucauuuuugauauuggaagucuugcgaaucuucucaggacuuuucuccuugauuguauuggcaacagucuuguguguaacaucaagcaaaccuuugaugucuaaguaguuugcaggcagaaguaguacaaaaaguauuccuugaucgacuuucaggaauuguugguccuaaggagggaucuccucuguucguuuucuuuguucgcaucauccucgggaggaggacggccauuuuugugguggguacaccaccaaaugaccuuuuaaaaauauugcugcauuaacuuugguagaggagcugggucguuaucuccaucauccauucucauaucuuccaacauggucuugauagucacagauuguuuggcaauuuccacaucaaauaucuccgcaucaaaacucagcaucuuaauugacggcaugguguuugagcuuaaggagaccacuggccagaggcucaugagagcagggcgacaucagcaaagaagaggaaggcagaggacaaggacacucaagacaugguuuggaugaugauaauuaccaaaucuuuucagauuuagugggucacuccgauuucuuuucuuagccauaaagaccuuaagacaugggaaacugaugagguaaagaagaaauccugaaaauggaaauaucuucuuuaguucagcauucuaaugaaauaagcagaccuuguagagcagacgcagacaagauggcuuucuguggacaacaguguaagggaugcagcauuguggcugcuggaaaggcugccuaaacaucuacuacaauucuuacuguguuuuugcuuacauguuacagcagaaacagacucacuagcagacuuuuccauguaaauuaaaauucuucauuuccaauguuaaauuuccuuuuuuuuuguguacccaggauuaauuugagauaaaucuaguagaccauguugucuguuguuaggcgccgaaucauguaucucuggggauccuaccuucccagaaaggcagagagaaaauaugccaggcauucaacacugauguuuucaaguaugaacuuuucacugaccuaacacugauguuagccaaaaacaaacacacgaaccuuuucuuugcccuuuuauuuuaggucaugguuuuuaaacuuuuauacuccuaaucuauuaaaaucuauuucaaaagaauuccaguuuaauuuuaauggcacuugcaacguauuccaaacaaauaccuggagagaaucugcugauuagucaguggcucagcuauauaauuagucauguaccacaugacaacauuuugguccuuggggauugcauauacagagguguuuucuauguuuagaaauguuuagacacacaaauacuuaccauuguguuacaguagccuacaguauuuaguagaguaacaugcugucuggguuuuagcguaggagcaguauacuguaccauauagccuaggugugcagugggcuguacuaucuaauuuuauguaacuauaugcucuguaauguccacagaaugacaaaauugucuaacgaugcauuuuccagaauguauccccaucauuaagugaggcaugaugguguuguuguuuauacugacauaagugccuuacugaucacaucaguggcucauccagacaaauauucugucucugacauugacugccaaagguuaguuuagggucugguuuucuucuacagugagaucguagaacaaauaauggaugacgaggggauuuagcaaaauaaugcagaucuccccagguucugcaagaucccauuguuugucagucauccaugaauucuccuaaaucccuuaagcuccucuuuguauuuuuaucuuguucuagcucuuaagggcaaacacacaguucauaagucuaggaccaggcauucaaguuucagaagacuuuccacucccgucaccuuuuauucuauaaaauggucucuuuggugcaaaauuuuaauagugacuuuuagaaaguaaaaaugauuuuuacuuuacuuauugacugauucaaagaguucacuuagauuauugaggcuggauuuuacuguacugauaucacauuagcuuuuauaaauagauuauuuuuucuuauguguucucaccuguaguuuuuaucaguucugcuaauuuuaggcaagaagauucuucaguguaguuguuuuuuaaauaaaugcaugucacauuggcaugccauuauucuuaaggccuuuuaaaauuagauuauaucgaauuaauuuuuuuugagguucugucuuuggacuucuuucaguugauauagucuugucaauuuuuuauuuacacacacacacacacacacacacacacacacacacacacacccauauguaugucauugguuuugucaaaaagccugaaaaugcaaauucugcuuguaaauauugguagaggagaaaaaaagaaaaccgugagaugagucuguguuccagacucauugguggguuaugugggaugagucucuaaaauggugaguuaagcaaaauaauuaauuuccaaggcagauuuguuuaucuuagagguauuccacuuucaguagcauacuauauacuuuaaaaauuaaaagaaauuuaguuucuuucaugaguaccucuuucuucuaccuguacuuuacauuuuuuaauuaaaaaaauuuguaaaguuuuaucuuuaauugacaaauaauuguauauauuuguauuaggguucuguagagggagagaacuaauaggauagauguauauaaggaguauugacuuacaugaucacaaggugaagucccacuguaggcugucugcacgcugaggggcaaggaagccagucugaaucccaaaaccucaaaaguagggaagccaacagugcagccuucaguuugucgccaaagggcagagagucccuggcaaaccacuggugaagguccaagaguccaaaaguugaagaacugagagucugauguucaagggcaggaagcauccagcacaggagaaagauggaggccucaagacucagccagucuaguccuuccauguuucucugccugcuuuuaucauagccacacuggcagcugauuagauggugcccaccagauugagugugagucugccucuccuagcccacugacuaaauguuaaucuccuuuggcaauacccucacagauacacccaggaacaauacuuugcauccuuccacccaaucaaguugacauucaguauuaaccaucacaauauucaugggguacaaugugauauuucauuacauauauacauuauagaaugaucaaaucaagcuaauuaauauaucuaucaccucaaacauuuaucauuuuuuuuuguugagaacauuuaaaacccucuuuuagcuauuuugacacacauacaaugcauuaacuauagucaccguacuaugcaauagaucaccagaacuuguucuugucuaaccaaaacuuugcaccaguugaccagcaucucucuuuuccccaucuacccucuccccuagccucugaugaccaccaaucugaucucuacuucuaugaguuugacuuuauuugauuuuacauauaagugagaugaugugguauuucucugucugugccuggcuuauuucacuuugcauuauguccucuagguucauccauauugucaaaugauagaauuuacugcuuuuuuuuuuaaggcugaauaguauuccagagugugugugugugugugugugugugugugugugucacauuuaaaaaaucuauucaucuauugguggacacuuugguuguuuccauaucuugauaauugugaauaauguggcagugaacauagggaguacagauauuucuucaacauacugauuucaauuccuuuggauauauacccagaaauggaauugcuggaucauaugguaauucuauuuuuaguuuuuugaggaacuagcauacuguuuuacaaagugacuguacugauuuauaauaccaccaacaguggacaaggguucccuuuucuccacaucuuuacuuguuaucuuucaucuuuuuuaauaaaaacuaaucugaaaggagugaggugaccuauugugguuuuaauuugcguuucucugauuagagauguugagcauuguuucauuuaucuauuggccauuuguauaucuuuugggaaucgucuauucagaccuuuugcccauuuuuaaauaggguuauuuguuuucuuguuauugaguaguuugaguucccuguauauuugguauauuagccccuuauccaguguuugauuugcagauauuuucuccuagucccuggguugucuguuuacucuguucauuguuuccuuugcugugcagauuuuuaguuugaugcaaucccauucgucuguucuugcuuuuguugucuauaguuugguuccugagcaucccaaggcuuuuucucaagucuuugcacuuguuagucuuuguacuucguggucucucuacguagaauauucuucuguuucucuuuaaucuuuacaggguuaacugcuuguacuugaggucucaacuuaaaacguuguguuaauaucuucggagagguuuuauuugaccuccuaaucuaaauuauguuccuuguaucacucauugauagcauauaggguuuaaucaugauuguuaccuauguuuauuuaauaugcauggggcucuuacauuaucuguacaaggggucuucagaaaguucauguaaaaugcauauuaugaaaaaacuuugcauagauuucaaaaaauuuuggcaccaaaauaaacucauacuaacuuguuagagcaugucucaauaggauguaguuugaggcauuaacagggauaagauaucaguuugaaaagagcuucuaucagaacaacaugaauucugcuaaaaauuaaagcgagaacaaacaccauauuuauggugaagcuuggguggaagaguggugacaucauuaaugcuuuaugaaaaguuucaugagaccucggaauaaacaccacacaucuacaacuaucugauuuucgacaaacccgauacaaacaagcaauggggaaaggauucucuaugugauaaauuuugcugggaaaacuagcuagcuggagacuaaaaguccaagaucaaggaauccuucugaggccuaucagggagaaucuguucugguccucucuccuaccugcugguggugugcuggcacccuuuggcguuccuuggcuuguagauguagcuccuugaucucugccuucaugguuacaugguaugcuugcuguauguaugucccuucacacaguguuuuuuaauaaggacauggucauauuggauuaggggucuacccuuacugcagaaugaccucaucuuaauaauuccaucuacaauaaccuuauuuccaaauaagauaacauuuugagguagagggauaaggacuucagcauaucuuuuuagggguacacaauucaacccaaaacaaauaggcccauuauuuccagauuuucuuccuuuuggcacacauagacugauuauacccaucucuuuacuagaaacaaguguuuugauuauuauuuaaauguuuugcucaucuauucaacgucugaugugagguuguaaauaaccauugaauuuuguaaaauugccaaucuugugcaauuuuguguuuguaguacaguucucugaaaaguuauucucuuaucuuugacaaauauccuggacaguaucuguccaggugaagguauguaugcaaaguguuacauuaauuuuagagaugaaaaagaaacauuuauauauauauuuaaaaauaaaggaaaaugccuaggaagaaagaagcagaggucugaaucugagauucgaagaaagaaaaguagccaagguggaaugggagaagagcugaggucuaagagguaagguguguuacucugggaacaugucuuuguauaggacaagcagaggacuuaaagcucugagggaucaagggaguagaaagaaaaugucagucuagugaacuaaucucuaacugugcuuuauuuuuuaucuguauuuuuuucagcuaucuuuagagauaguuauucuguuuuagagauaagaauaacuaagucucaguuuuuccaaggucauccagccaagcacauaggggaccuuuugaaagcauaguuuuggaguuaaugauacuucagcuugaguucugauucccuuuugucacuuuggagaaguuaugaauuuguauauaccucaguuucuucaccuguaaaaugggaauuaacuaccuaccucauugugguguugugaggaccaaaugagacaguauauguaaaaggauuagugugguuccucauagcaauuuuuuggucaagaagguagccauggucuuuagaauaccaaaaaauuggaagcaguguaauuauuaguagggaaagggaaaauaaauugucugguuauauauuggaauauuauacagcaguuaaaaugaaugacuuaagucuauguguaucaacauggauaaaucucagaaaagcaauguuauaaaagaacacauaaaugauaucacuaauuuaaauuuugucacacacaauauccuguuuagggguucaaacagaagugguguuuucuugucacauaggcagucaagacaauaauaacuucugggaaaugagaaaaggguuagagauacagguaggcugguguuuuacauguauuugcaauauuuaauuuuuaaaaaauuauacagaaaauacacacacaugaauuuuuuauaauguacugcuauuugaccuucacuaccaucauaaucaggugaaaaugagacccaugcacaucugucuagaaagcccauguugaacuugagagcaucuguuuuccagcacaucuugcauuagaaagacagaagacagccaucagaugaccaaggcuuccagggauggcagggggaaggcugggugcuugcacugucaguuucuaggaucugcccaggucauuucuuuuccugaaucugguacuugccuguguuuucuuuugccuguagcuaccgucaggaauguagggagacuuuaggaggauuacuggugaguagguagagucuuuuaugggggccuacucucaaaauaauauaaccaugaacaauugaggaauguuuuuuuguggucccuuuuauuuaugcucuaaacuugacuaguucugggaauugaggaaucucaaccucacguucugauugacuaaguaaaugcuaauguguucguuaacacaaaaggcaaugcauugguuagggaagcuagcuguuaacacaaagaccccaaaaagucuaauggcucuaauguugugaaaguuaauuucuucuuuuuuuuucuuugcauaaacaauccauggccuuuccacauugggggguggggugagacucucaucacauaggcaguuaggaaccccagaggcucuucaguuuuaaacguguagcuuccaacgucaucuugagaacugauauucagcaguggaaggagaaagaacagggaggauauacauuuauggcuuuuaugugaggcaggccuugcauuggcacauacccuucugccuaaaucugauuauaagcagaaugcauuccgauggucacagcuuacugcgggggcuagcaaaugucugcuuguuuuucaaggaauaggaagaaauguuuagugaauaccuagcagucuguugccagagaugguuuuuguuguuucaauuccauuguacauucuucuuagcauuuaaaaaauuauuugaacuuuugaacaggcaauaucuucacauacuuuaaaaguuugaaaaucugaaaaguuacacaguaaaauguuugcuuaucauuccugccccacaucuacucagaucccacuagguaaucaugguuauuacuuuaucauguauacuuccagaaaccuuuuguuuaaaaaagcaaauaugaauuuuauauauauauauaugaaaucucuuccucccuuauuacauagauggagccauaauauacccaguacuuuguacuuggcuguuuucccuuaguaguauaagauaguuauuuuaaauuuuguauuauucagucucagugacaagguggcguucccagcgucagggaauuucuaaucuaaucuggucaagguauaaucuacuaguaaggaggaagagauacaaguaguggaagcuuuuguacuaaaaucaaauacuuaccuguuacucacucuauaacucaauaccacauuuagagcaaaugaguaauaccuuuauaagucaaauuagauuuuuagaaaacugcuuuaggaaauuaggcaugcuaagauaauucuuggcauuuaaaucacauaauuaagggaauagaaaaugguuuguguuaggaaauagaucuuugacuacauuuuugcaugacuuucugauguacuaaguacauuuuaguggucaauguucucuacauuaaauggcuuuuguuuugguaaacccauauguuuggaguauuaaugguuguauuucuaauuuguuacccuggcccaaaugaugaaguaauagaauguugcauauuuccuuccacuuaacauuuaauuuguguuaaugaaaccaaaugucacuuuuaacucuggaacuucuaaaaugaacuacaccgggaagcccucuguauucuuugugguuucccauguuccaugagccagcaaccggguguucacuugcagugacucugguuuacucagccccuggggaugcauuacugcucggaaaugggaagggagaguagcagguggugcguaauugagagcuguguuugauugggacugaccuggugccccuuuccucugccgguuugaaugagaguuuaaaggaggaacugcugcugcuaagaacaaaaugaacccgagugccucuuacuguuugucccgacugucagugcauagggauuaacuaacauccaggaacuuuuagcuggccucugcuuuguucuucaacauucggaccuucagugagcucuagaccugcacaaacgaccugcagcaaauggcagcuuucauuugggcugaggaagaggaauauuggagagaaugaggagaaggaaauaaauaucuuuccuuuuuggcccuuccugcuuuaucuuucuccaucuuuaugccuuuauuaaugaggauuuuccaaauaucggucuucaaaaaugccauaagaagacuucauuuucugugguuuuaaugucauaaaauaucuccuuaugugaaauaacuagauaugcuggaucaagcauaacaaacaucccuuuaggacauugcugaaucuguauuuaaaacauaagggaagaacugagggaacagauggaaaaaggaacuggaaauggaagugaauugacugcugcagcugcccucugggcuccugcagaucuugguaaucaaaaggauugggguucaacugccuugugggagacaggagacagggucuuggguccauuuaaguuagagauaccauaguaacgugagacacucaaaggacuguggucucaguagagaggugacaaauacgucuugaccuguucuugccugaggaaaacguuucuaagaauucuuaaccacaggcccucccucauagauuuucaguuucaauuuauacucuguguggucuggcaauuuccaagcugugaaacuuauuuaaaacagucugaugguacucacauaaaucaccaaguuaaaaaaauacaaaauagaauaaaaaauaugagcauggaaaauaaauacuaucaaaagggcucagauugauuuaaaaaggaaacacagacaauucuuuaagacugaauggacuaaagaacucauucauguaaccaaaaaccauuucugccacaaaaacuauugaaauuaaaaaaagaaugacuuaaauaagaauggaucuuauacuccaaaaagaaagaaagaaaagaaaacaacaacaacaaagcaggauauggguuaaacaagaauagaggaaauaacugaaaugcaagauaauaccugaagaaauuaccuagaaugcagcacaggguggcaaugucaggccuucaguguuucuucucuggauuuuugaaacagcuuucuaacugguauuccugacacuguucuuaugugcauccagacuauuagccuuggaucccagcuccugugaucacauuuucaaaccuucacccuccauuuuccacuaaucuuuuauagacaauagcuaaucuuuuacucaauagcuacccccaggaaauccucccugauccuaaaacugcauuuguucguuaggugcuccuggccuguguucccauuguaccuagaucauaacccaguuauaaucuuauuacauuguuaucauuaaugcuuuuuaaaaaguuuuacuauucaucacuagaguguaaauuguuuguagacuagcaaagcucuguuaacaauuauagcccuaaugucuaccacuuuguacaauuaguacuuuguaagcacucaguaauuguucauugaauguaagaaugaaugguguaugugaaaggugaagcuauauaggucuaaugaugcuuagauccuaggaaagggccuaugguucauguuucugacaggagauuauuuagguaguucauuuagccauuucacaugaccaauguguuaaugucugaauuuaaucuacucguucugugcugucuuaaaagucaaacuuuucaguaaaacgaaaccaaacaaaaaauacaccccuagcaguuuguauuucagcuccccacccccaccagacaacuuuuuuuaaacauuuuauguugguagguacauaguaggucuauauauuaaggguauaugagauauuuguugcaggcauacaauguauaauaaucauaucaggguaaaugggguauccaucaccccaagcauuuaucauuucuuuguguuacagauauucccauuauacucuucuaguuauuuuuaaauguacaauaaauuguuggcuguagucacccuguugcacucucaaauacuagaucuuauucaauauaucuaacuauacaaaauuaucuuaaguuugaauuauagaggcauuuucacaguagcaaccaguagguacugacuccaucacugacaauagcuauaggucacacucuguguuucugagugacagccacacaugguagauacucaugucaccaccuaguuuaucuucaaaugugaaggacuccagugacacucacauuuaguccuuucaucuuugguaguaaagaugaaucuuugucauccccaggaccucuucuuuuuguuuguuugguauauggaaugaaaugacucaggugccuucuuucaguuaauuuaaguuguauaguaagaucaaccguagaauacuaucagucaucuuggaauaauaucuuuaucaucauccaauugaugaugcuucuuccaguuuuguuuccuguugcuaucacuccaucugucauuaauugcacuaagauaauaauucucuauuguguggccugacauacuguuuuauuacaauuauuuggaaggucuuguuacuacugcacauuaaaaaacaauucuaagguaugugaauuguuuaauauuuaaaaauguagucauucuugcuuauuuccauucugaucuucguacaggaguugaagauggaauuauaccuaaccgcagugaugagaaauuuguggugaacagugucacauacccuuucacucucucccugcccauuuagaccuccauaauuauuaauaguuacauugugcuuucucaaugcaaccuacuguccagucucagcacagcgaguacuucagaucauuacuacuugucagguuuagcacucaagaucccaggacuagcuuuucuuguauaauucccacuuguuguucacuuugcacaaaauaccuguuuacauaucuaugcccuaagguuuguccauacauaguuauuucugagcucauauuuuggaugcuauuuaucccucuuccaugcuguucuuuguagugucuacuacacaaaauuuguaacgaugugguaacaguaaacauuuaugagugguugucaugauguagcagguacuguguuaaguaccugacauuuauuauuucauugaauucuuguacuaacaccaagaguuagggcucauugcucuucucauuuuauagguggagaaacuaggacaaggcuaaauaauugguaaauggcagagccuggguuugaaucaaggccaccugacuucugagcccaaguugguaaccucugagguaguccuuaaagaagguuggguuaaaaccaaacugauugauagugaacauacugcuuuugccuguguuggcacuagacuaaaauaaaaaccuuuuccuuuauguuuucccagauuccaaaccaacuuggccuaaccuuucaagucucuaagaaauuuauaguuuuauaucuauuaaaaaaaucuucugguagacuucauaaauaugacuuagauuuuuauuaaacuuuuuugcucguaucuuucuguaucucagaaaaccuuuaauuuuugagacaguagcuauuuguguaggcugucuuauauguucacagauggcauuauuuuaucaguccucaaaccaucuguagcaucaacuuagucuauuccaauuggugucaucuuucauuuaugcaggagugaguuauuaaaguaaaacuuuauauuuguauaacauuuuggguaaauguuagaguaaaacauugguuuauuuuaucacaacaauccuuugcaaagaaaauuuauuuuuuccagcucaucuugauuuacuuuauauguagucuucagaaugaaauugaaucgaauaacuguuuauugagcacaaauuguuauccugaaauguagggauaagaaaugaccccuguguucacugaauuuauagucuuguaggaaagacagugaaguaguaaauucccauugaagaagaaauacaauuaugauuaccauuaugagaagggaaaagacgguaguaugggaaaugauaguaaagggauuaagucuggucuagugaaucuagaaaggccuuucagaggaagagaggguaggaguucgccagacgaaguguagcugaugggugguagggaagaggaaaauaaccuucuaggcaaaguaagcagcaaaugagaaagccuccaugucagagagcuuggaguaacuaagucauugaaagauaugcagucugacuggaacuuagaguaggaggaagagagugacacaugaucucaggggagacccaagagcuaaacaggcaucaguuguuuuuuaggacaauuaaagauucuggauuugaaccuaagauuaauagcaagucacagaugaguuuaaagcagaggugugacaugaacagauuugggcuuuaggaaaaccacucaggcugcaguguggagaaugaguuggaaaaaggaauggaaguggggaggaaaguuaggaggcuguuucaauauaauuuggacuuagacuauaguaguggcuguagagguggagagugguggauggauuacagaguccacccugcugagaauggaagagccagcccguguguguacaaagcucugucuugcucuccugcaucguacuaacaaaugguccuucugcaugcaagaguaugagccagagaaaaauggaacaaaaaugaggccugaaguuaguauagaagcucuguauuaugaaaaggcaugaucucacagguaguuaaggauaauaaagacaaaagcacucacuaaaucgaaaguccucagucugauuguaaucuagccaggauccugaucuaagauuugcuuuucauaucaguguguaugaugucaacagaauuuugagagacaccaaguuuauucaguggcugaugccuccuuucccccaaaacaucaguucauucuuucauccacuuguuuauuuauucauucauucauuuacaaacacuuuaaauccuuacugaggacuuacuacucaccagacauguuuacuuaucuuaguuuuuaauacuacagauggucauuauaccuagugugggccuuugauguuuauagguacuucauggaccacaucucauugaugauacauuuaguccaucagauuuccguuuuaaguugagucaucacuuaagguguagccguugguaaaaucccgcagcacugaucuccuauguaucugaaugucauauccucugcacuuucuauugcuacuccccaaucuuuggucagggucaauauguuuaauuuaauucauucaaacaguuggucaguucagccaucaccaccaccacuaggucgucuuguuggucauuguuuaacuauuauauuagccaagguaaugcaagcuaucagcaaacaaauucuccgucuaaguggcuuaaauacauuagaaguuuauuucuugcuaauauaaguucaauugguaacagauccgggaaugguggauuuucugcuccacugugggcucaggcugauggaguuaccaugaggcucacaagcuugccuagcuggcaaaggggauuaggagaaugugaaagcuuauucaggaaguuuuuaugggccagggcuagagguggcuuacaucauucccacccaugcuucagaacugagguacauggccauaccuaacuacaggggagacugggaaauguagucuuuguguuugcuuggugagccugucuuugucaaacccagcuagugaauuuccuuguaugauaccugcucuuugauucagauaauaauaagaggcauggaaggaccagauauauuguuguaggacuuuuuccuuaguucaguuaaagacagcgagguugggggagggugguccucaucacacagccauguaaaauuaggcccgcagacaauucgaaggaggagaaaaauggaauuuauugggcaaagagcaauaaaaagggaaacaaagacucuccaacaagacagaacgagaaucuugcuaguaugcuucccgccucacagacuguaaucccagguuccacccaggaggaggaggggccaggcuccucccugcugccaaaggcgugaacuucugugucuccaccccagugcacccuccucucaaugcauacgcccauuggaguuuugucagggaguccuucccacaugacuaucucaguaugaaggaggaguuuccuuugugccuaauaaguggcugugucacauuccugggcauuagagugggaaaugucuauauucugaauuccuaacauaucugauuauugcuauuacucuuuucucacagggaaauaaaugcccggcuugaugcuguaucggaaguucuccauucagaaucuaguguguuuggucagauagaaaaucaucuacguaaauugcccgacauagagaggggacucuguagcauuuaucacaaaaaaguaagugugauagaaaucuauuaaagcugacaguguucuucagcuugaggacacuauauauuaaaagaaaacuuuugagagcucuauuauuauuuuauuuuguaaaaucuuacaaauagcaugcgagaguagcugaauccucagaaauuuuaauaguacaaauuagaguuauuccaauuuuuccauuguagaaaauaaaguuuucucaugugccuuaacuacagcaacauagaggcccuucuguuauaauauaggguauucuccuguuucauccugaaaguacagacuauuaucaaaauaggaaauuuauguagacuuguuauuuuagaaaaaaaaaaccuuauuucuuuugaucuuagaacaacuuauuguuucuuaaacuauggaaaaaucugcuaguauaacaucuguggugguaguuaguaugcaaacaagcuuggauauugaaggugaguaaaggauuauuuugauuuuuaucacuuaagcuuuacaguuugagucauagcaaaaaugagucauuuuccacgguuagggaaauaauuuagguuaucuucaaaauaugccuaaaauuaaaaaaauuauuaauauuuuuaaaugauaaaacacuauaaacuaugguguuuuacuuuuugcagaagucauucacauaccuuauacucuuuguuccuuaucaaaacuuuaugacauugagaaguuacuauuuuuauuaccuucuuacuaauaagaaauuauaucuaaugcuauauauguguguguauauauauauguauauauauaaaaugcugcaaccacuugaauuaccuuggcuaauaugaugaugcucagagguuuaguaacuugcuaguaacagaaucuguauuuagacccaggauucuugacuguguuuucauuggcugugucuuuuggaugcuaucauguuugauguaguuaucuugacugccauuuuuuuuuucugguugccacuuuucauaagcaaauuuuauuuuuccuccaaauguaacuccuugccaauuuaauaauuuuacuguguaaccauuuuuaugugccuaaauuuuuauuuuauuuuguuuuauuuuguuuuauuuuauuuuauuuuaauuuuuuauuuuauuuuauguuauguuauguuauguuauguuauguuauguuauguuauuuuauguuauuuuauuuuauuuuauuuuugagacagacuuuuacucucgucacccaggcuggagugcaauggcgugaucucggcucacugcaaccucuaccucccagguuuaaucgauucuucugucucagccuccugaguagcugggguuacaggcacccgccacuaugccuggcuaauuuuuguauuuuuagcagagaugggguuucaccacauuggccaggcugguaucgaacuccugaccucaggugauccacccgccucggccucccaaagugcugggauuacaggcaugagccacugcgcccagccaauaugccuaaauuuuaguugugaccaauuuuucauuaguguuucuauauuuuucauccccuuuuacccccacagaguuuuacuagaaugauaaguacugcuucuaagaauacuugaggugcccaagaggacuuacguaacuguuuuacaugccucagcuaaauuugaaaacaaugcacaagccagaacuggaaauacugauccuggggagaaagauauaugaguugguuauggggccggggagccuauugcaucauuauuggguacaccauguuauuguuuugcuggcaauagcagaagcugugcugauagucgcaaguuuuaugguagaccuuuuugaaguugcaaugugggugccaaaccauuuguuguuuuuauccuuggcucagagccugaaaauugaugcauauuaaccuucuuuaaacaacagaucuccaggcaccuugccuuaacuacuucaaaggauucacugacagaugucagagauuugaaaacagaagcaaagcugaaaaucuuucaguggcuacucaaaugcacaaagucaaaguguccauggcaucaagauggcagcaucaguucauggggcugugauuucuauuccaccuuccugccuuuuuguaaacuuuacuuugauguuuguauugcacaggguuuguguauuuauaaaaguuucaaaacucuaguaaagucagaaucuaauucauuuaaaaaguggccgguaugcagugcaagaaugacuuauuuuggaauuucaaaauauaguuuacuaacggaacuuauaacucacuuggaagccauuccuuguugcuguuuuaguguuuguuuacacaagaauguaccuaaagauuaguuugaagggugaagaguagaaaugaucugguaacaaaccaacuucaggaaagcugaaugcuuuaaaccaauguuuuauagauuaguuggcuggcucuguguacacaccaucaaacauaugucuguucuuuauuauuagauuacucuaaauaagcuucuacuguguacaccacauagugggugauguccuggguacagauugugccaauuaugugaaauucauaaaaugagaaggaacacuggauguugugggaagugguuagcauaggcuguaugguuuuguggaacgugcccuggaauauguaccaauagguguuuuuauggugauaaugauagaggaucucaagugagcugauucugguauaaaauagacauuucuucuucuucuuuuuuuuuuugaaacaagaucucacugugucacccaugcuggaaugcaguggugcgaccacagcucacuacagcuucagccuccagccuucugaguaguugggacaacaggcacgugccaccaugcccagcuauuuuuuuuuuuuuuuuugcauuuuuuuguagagacaagguguugccauguugcccaggcuggucuccagcuccuggguucaagagauccucccaccuuggacucccaguguguugggauuacgggugugagccacugugcuuagccuaaaauaaacauuucuuuugauggcaaaauguuaaauucaaauccuguaaauagugcuagucacaggaacccauaauaacuuugcucaagaacuguuuuguaagaaauucuuaaguaacugccgagguuggugaauacauuuaaaggauaaucgcacuuagcaaauguugaggagaguguuuucagaauuuccuaggugaaaaucuuuuuuuagcuaagcaggaauaagcccacagcugcauguucaguguggcacuuaagcugggguccuucccauccuguguccagugaggcccugccaccauacuugugggucugugcucaagcucucccagugagacagcugcugccagaaguagggcugaacuccuggagagugacuucaggagcagccacuuacccauccucagcuuucuuguagcuucuuuugaguucuuuugcuuaagaaacuugagaacaaccugcugccucuggcuuucaacaugauuguaaagcacuacugguuuucaccuugcuucuguugcugacuuaacuuuacauugugucucagcuuggaaaauuaaucauuuucuugggauuacaauaaucauaagagguuaauauucaaaauuauauugaaaauguuuguguuuguuucuuuacuuuuguuaaaagguaucauuaauugacuaguggccaaaaagcuuccagguuucacauuuauuuaaacaguccagcuuccuguauaggguggggagggggucuuucuggagaaaaguugccucaugauacacuuagaauucaacauuugcucaguuggaccuaacuucuuauuuuuuuugcauaauucacccuuugugguuaguaauuaccuuuuugaauacguucuuagccuuaaucuauuucauauauacuaucuauuaugugccuuauuacuuuaccccuaaauuguuuucucaucucaagacaguucuuuucagccaacauuuugucaguuuuauuuuccugagcugucuucuagagccuucuaacuugauccagucuggacugguuguccccauaucuguuguauaguacuaucuuagauucccuuuacuucccuugaguugaaucuuuuauuuucuauauuccaugucuuccucuucguuuauuucuucauuuugguggaguauauauccucuagaaccuuccugagaaagcacguuggaaguaaaucuuuugaaacauucaugucugaaagugguuuuuuuguuguuguuauuauuguuacuaccuucacauuugauugguaguuuggauugguauaaaauucuagguuuuagaugacuucauuaucuuuacuuccucuucuguugaauuuuucauuucuacuauuaugcuuuaauuuccaagaauuuuuguuuucuuguccuccaaauguuuuuucuuuuuaaaaguagcaucuuguuucaugguuguaguaucuucuguuucauggaagauauuauuaauauuuuuagaaguucccuaacagggcagaauccauauugguacacaagucuuuuuggauucuugauguaaauugugucuccguuuuccuuaaggacaguuuaaaauucagauaccuugagucuuuuaagucaauuacuguuuauuuguuuacuuuauagcuucuaacauauuauugcuguugucuucuuuucuaguguguuuuuuuccuuuuuuuuuuuuuuuuuuuuuuuugagacggaaucuugcucuguugcccaggcaggagugcaguggcacgaucucggcucacugcagucuccgccuuccaggcucaagcgauucuccugccucgccaccugagucacugggaucacaggcgagcgccaccacacccagcuaauuuuuguauuuuuaguagagaugggguuucaccauguugguagggcuggucucgaacuccugaccuugugaucugcccgccucagccucccaaagugcugggauuacaggcgugagucacugcgucuggcugguuuuaugccguuuuaaacaaucucuuaacugucguuucaagauggagagaaauuagaugcauguguuuaacucacuguuuaccagaagcuaugauauaaaaauuauucauguucauguuaaaaaaaaaacuacaguaguaugcagggguaugcaguaaaggguaaaaagucucccucugccacccuuccauaccuacuacccagagguaaccagaguaagucacauguguuaccuccuaaaauuuuuauugauauuuagauuuuuuauuuauauagaauaauguauaucauuuaaagaauacaaagaaaguguuaccauguaaauacauaaaaauauauacauauaugguauaugauauaaacauacuguauauauucaauguauguugaaauuauggaguucuauacugaugcaaacagaucuuaauuuucuuuuagcuguuucguaguacuacacugcaugaguuuuucccaauaagaucccaauugauggacauuuauuucuuauucaucuuuuuaaauuauaagcagcgcuacuaugaauauucagacacacauauuuuucacuauuuguuagucuauuuuuagauaaauuauuuaaaguggugcuuauucaaaggguuaugugcacuuuuuuauuacgaagacaugccaaguuguuuuucaaaaagguuaguccucugcuaagaguauauaaaagugucuuuuuuuucuuuuacauccuguuacaugguuauugugaagcuuuuaaaucuuuggcguuccgauaagugaaaaaugcuauccuauauuucuaauuugcuugucuuuaauuauauaugaagauaaucguauacauacuugcuguucucuuucuaugagcugcauauucaguuuguuuagccauuguucuuuggauuauucaucuuuuucuugucaauuuguaagagccuauuauguuugggagaauuuugccuugugucuguuaugccuuacagauauuauccuucacauuuuuuaacuuguuuaaccuauuuuugcuauaugguuuauguuauuuuaaaaaugaaaaaauacuaaacaaguauuggcuuuguuuuccuugccuaaaauuauuuccuuuauaccuuuaaaauauuacauaguauuuaaccucauuuagaaaauaucagugauauuuuauuucaacuaacuaguuaauagaaaauuuaaacuuuccucaauucugauucuaacuuuuaaaagucacuaauuaaacuucauuuucauguaucuuaugcuauuucauaaaaaauauuucuauuuucaguguucuacccaagaguucuucuugauugucaaaacuuuauaucaccuaaagucagaauuucaagcaauaauaccugcuguuaauucccacauucagucagacuugcuccggaccguuauuuuagaaauuccugaacuccucaguccaguggagcauuacuuaaagauacucaaugaacaagcugccaaguaaguaccagacccugaauucuuccuuuucaccagucaguauaauucagugcauuugccauuuauuuguggauucuuaaucuuuacuagaauaauaauagaaguugcaugaguacauauauaauuagaaaugugauuggacccuaaaaguguuacauuacagcuggaauacuugcuaccuaaaauuuaggcaguuuaccaucuaggacagauauaguacucccccacauaucagaugauggaaagguaaaacacaggcaaagccaagcauuaguaguuuauuaaccccaaaaugagugucagauaucuuguacucauuuccuauauuuccagagaugucuuuauauuuagaaucuguaaaagcaaaguuauccuuuaaaagguaguuauaacauauugcacaaaacauucuauguaaaugaaauaggauuugacauuuacguuugucuuuguuuucugcauaggcaaacaacaaauaauuuaucucuugguuuuaccaugggaaucaugaaguuaaaaagcagaaaugauuuuaggguaauuuugaccauccucagagaaguuaaaaaacaaauccauaagugcuuagugacaauuggaaccacauuuuucugacuuccagugcuuuccucuuuuaucacacuaugaaaaauaagcgauaacugcuguaauuaauaaacuucgaauauguauuugcauguuuugauuuuuuagaguuggggauaaaacugaauuauuuaaagaccuuucugacuucccuuuaauaaaaaagaggaaggaugaaauucaagguguuauugacgagauccgaaugcauuugcaagaaauacgaaaaauacuaaaaaauccuucugcacaauaugugacaguaucaggacaggagguaaugucaagcuuacuuuuauuuucuauuaguuuuacucuaguagaaaagcuauuuuaaaauguaaauagaaaucugaggauaggauauguauuaucuuuucaaauuuucuguuuuauuccuuggaaauauguuguaauaacuuguuuugauaagaguuauuuuaaugauaguguuuuauuagucucuuguuaaaguaaugcaacuuaauguuauauguauauuagcguuaucuguugaaauuauauuauagaaaaucucaauuacuaugaauaacaacuuauagaauucauuuguucuaaauccaggaaagagaaguuagucuuugaucccuaccuugcagaugaugaaaugauacaaagccuguguugauuggcucauacagugauuaaacgguggggcuuccuccuaaaguuaagaguauagcugcuaaaaaaaacaagucuagagugaaaaacuacaguuagugagucuuccauaaaauuaugguacuguuuagaauauguuucuuggggguguguacuucuguuuaaaguuugauaguaaugucugaaugagaaccagaaaaggaagaaguaugccuuuuaaauaugguugugcuuuucaguccuauucugggucuugaggcaugcuacuccuauaucuuauguuuaauaaaauaugaagauucaaacugagggaguuugagaaauucuguuuuauuaaaauaccaaauuaggaaacuuaugguuaacuucuauagaaugagcauuuuauucaggauuuucaaaaaauagauauuuuuccgguggggaagaacuuaauuucaaaucaaauuuuuaaacauuuacauuguuuuguguguuuugccaaaagauuguugaauguauaguuauuugaaauaagaagcucuacauuaauugagaauguucauuaaaguguuuauuagucuuguguuauuucauagauuuacccauuaagucaaccugucuucugaacuaaaauuauuaagauauuauacucagcagacauucacaaugccacauagagcucuauauaacagaaaaaugauuugacaauauuuauacuuauguuuauugucugaacagacaaauaccaaauauuuaauuguaacucuuguuuuugcuaugcagucaugaccuugcaaagugaaaacuggccuaaaggccacuauucuggcuauugguuuaaaaucagaugaucaacacugcuuuaguuacuuuaauaaaagauauguaguagaaaaguggcugccuuuucuacuacauuuuuuuuuuuuuuuuuacaguggagaaaguaaguguaagugccaauucuaccauuuacaugcuauacgaccauggaagaguuaccucuguuguaagacuauuauggagaccaauuaaguuaaaauacaugaaagugcuuuuuaaucauaaagugcuaugcuuauacuacucauauaauaacaauaauaguaauacaguuaccauuuaucaaguacuuguuaaagucuagaauggugguaggugccuacauauauuauuuaauucuuauaacaaugcccaaaagggucauuccaguuuguuggaaagaaaaccaagguuuggaguaguuagauaaguuacccaagguccgaagcacaaauccagcccacuucugccagacucuagucuuucuauuauauuaauaucaguauuucauuccauuuauuaauuccaaauauuaacacaaagauucucaacaccauggauuuuaucugacaaaaucuagauauuuuagagcucauaguauucaaaauaaaauaaaguuuaagucuuggaaagacgguccuggauucauuuggcaguuuuugaguaaaaaugagagaaaauuaucaggaauucauaagagauaguagacugguuauucauuaugaguguggcauugagguuuaaaaaguacagcauggagaucaacuaauuguauuaaaaauuauuaggaagaucaguuaucuuuuaucuuuacuagguuaaguugaugaauuugaggaacaaaguuucuucguuauugauaguaggauggauucuuguugguuuuuaauaaucuucucuaggauuuuaguagaauguuaauacaaaauugcuuucauagaaccuuuugaaaaaaauaauucuauucauuggaacaccaaaggaauucuaaauauucaaaauuguuuuaaucaaauucuguuuuaaaaacgacuacaguggcucacaccuguaaucccaacacuuugggaagccaaggcaggaggaucgcuugagcuccggaguucaagaccugcuugggcaacauagcgagacaccaucccuaaaauauaaaauuagccaggcauaguggaaugugucuaugcucccugcuacucgggagacuaagguagagaaucacuugagccugacaggcugaaguugcugugaccugugaucaugccacuguacuccagccugggcaacagagagaaacccugucucaaaaaaaaaaaaaaaggacuaaugcuauucucaaauuauuuagagguacuuaaaggacuaggaacagacuccaucaaauaugauuaucucugagaagugagggaggcaggguggaaaacccuuauuuuacauuuauuggugcuuuuuuaugccuuucuguucugacauuuuauuucuauacauaugucuuuuguaauaaccuuaaaagacccauuauagcagccccaugugagccacgugaugguauguggaucuuguuauuuuuacuaaaauuagauaaaugugccagucuguaaauccaguguuauuuugacaacauucauuuuucaccucuguucccagcuuuuauauacucauuagaauacuaaagccuuauuguaugauuccuuauugucucuauguaaauauuggcuuagaagaaauuaaugaaagcagaaacuuuauauuuuuauguaauaauguacauacauuauuauguauuauguaaugaacguauguaugaauguuuguguguauguaugaaaguauguauguauguaaugaaagcagaaguuuacauaguuuacugcuucuguugcagucucuaucauauuuuaugaauauauaccaauuaucucuuaaccuugaaugaaauguggaauggaaauggggcaauguuuacauugggggcaguacugauaaguauuauuauuauuacuaagggaaaaagaaaaauauuggaaaaaaucuuuagaaaggguuuuauuaauugacagcaugcagcauauccaaauaccuguuuacugguuuaaaauguggaaaauaaucuguuacaucugaguacuuuuuacuuagauuuaaaauauaguaaaacauccuuaaauuauuaagagaaugaaauugggggauuggaggaauggguuaaguguggugcuggagaaaacagcaguuucuggagugaguaagaguuucggcaagccuagcaacguugccagcccagugauaccacaggcuauauagauugaauaacaauaucuggcauuuaacuaagacagaauugggucccaggagaagaauaugagagauugcuuauaaugaaucaaggcagacuacucacaucaacaccuaauaaacaaagucaggaacuguagaccaggaaaaguugcuaugagagcuuucuaagauuacuggaauguaugcuauuuuucuauguuaguuuucuuuucuuuaguaauaaaauucuuaaaccaaaggccuaccuguucauucuuagaauguuugaaaaaaagaauagcuagagaaaaauguuguaucuuauugucaguauagaagagaagaaaagcuagcagaagacaacucugaggaggaacccaggcugaaacucugaggauugcugagugaggaaaagggacccucaggaucaguccaaggaccagacccugucugaggaugugaccagagggguuuaacuugugccuuccugacucucgcuguuuuccccccugcaguggcacuguauuggcucuguguaugguagcccgcuguagugauugugcuccuagaguagaacuuuugauacuuacagauugaauaguugugguccaaacuguucccaaggugcuccuuguucaaaauguccaccaucccuuagccaguaacuccuguggagcucuguguuagucauuaugcaucuggauguguccuucccaaauaucagugauccaaucagucuguuccugaauuuugcuguuugccuuuagcauagcucuuuccagaauuauuuuauaaaaaggccaacauuucuuuuaguagaacacucuaaaacagcagaauuauuuagcacaguuuaaaagugauuuuaucuuucccauuagugauauuuuuugugguuuuucaaaaguuacuuuuuguagccaaaggaggcuuguuagacucuucacucuuaacuauuuaaguggguguggcagauuugaaacuguaguaauucucuauaaaugagggcaucacuaguucaaaacaguuuucuaaugaugaaauuuuuuagauuagccacuaauucuuaauauaauuaauguaaaagcuacaguguuucuauuaaugggaaaaauaaacucaagaaccauguugauacuguuauuaauaugaacauuauaaauaccugaagguacgugcauauaauaaaacugauaaaugugaaaaaguucucauagcucucucaagaugacaaccacacaguuucuggguuccauucugcucaaaauggguuuuuauaaauuuauuuaaaugaaucauugaauuaguucuuuuguuuuucuuuuuguuuuuuauuaagacagauucuugcucugucguccaggcuggagugcaguggcacaaucucggcucacugcaaccuccaccuccuggauucaagugauucuccugccucagcuucccgaguagcugggauuacaagugccugccaccacgccuggcuaauuuuuguauuauuaguagagaugggguuucaccauguuggccaggcuggucuuaaacuccugaccucagguaaucuguccgccucagccucccaaagugcugggauuacaggugugagccaucgcgcccggccugaauuugguugcaauaauacagaaaugcaagcacacugagaaaagauaauacauaacuaaggcuaaaaaugaauggugugauagaacuucacuugcuuccuggcugauuucagagaaccuuauuugcagagcacaguuggaucuauaaauauauuaugaauguaaauuaaaaugacaggagauauuaucucaccccaguuaaaauggcuuuuauccaaaagacaggcaauaacaaauguugaugaggauguggagaaaagggaacucuuguacacuguuggugggaauguaaauuaauacuaccacuaccacuguggagaacaguuuggaggucccucaaaaaaaaaaaaaaaauagagcuaccauaugauccagcaaucccacugcuagguauauaucccaaagaaagguaauuaguauauuaaggagauaucugcacugcaguguuuauugcagcacuauucacaacagcuaagauuuggaaacaaacuaaguguccaucaacagacaaauggguaaagaagcuguaguauguaaucacaacagaguacuauacagccauaaaaaagaaugagauccuguaauuugcaacaacauggauggauuauggaggucauuauguuaagggaaauaagccaggugcagaaagacaaacuuugcguguugucacuuacuugugggagcuaaaaauuaaaacaguugaacucacggagauacagaauagaaugaugguuaccagaaacugguagugguaguggggguggaggggaugaggggaugguuaauggauacaaaaaaaccagaaagaaugaauaaaaccuaguauugauaacaugguaauuauaaucaauaauaauuuaauuguacauuuuuaaauaaaagaguauaacuggauuauuuguagcacaaaagauaaaugcuugaggagauggauaccccauuuacccugaugugauuauuacgcauuguaugucuguaucaaacuaucucauguaaccaauaaauauauacaacuaccauguacccacaaaaauaaaaaaaagauacuaugguucauauaagugaaaacuugaagaaaacucucauaugggaagaaacacuuucuucucuuuauaguuagggaagucagugcuuuccugugaagagacuuuuacaggauuucaguuccuuggauaaaaacuaucuaaaaauccucucuguucagaauaggggaggaucauaucucagacugguguaacaucuaguaauugaauauuuuaaaauuuuauauacuuagaaauucaaucuuuuaugaguaguagaauucuuaagauaagugaguauuaauaaaugaaagaggugguuaaugaaaaagccaucagaguauacauauaacaauauuagaaacaugaaagcccaaguauuacaaauguuuuaugcaauacaaauuguacuuugucccaaguagugaacccuuaauuaauaauauuugucuguauugacauauauacagucugaaaaacaauacuggacuuaucuugaguguuuaacaauauauaauaaauuguuauaccacaauuuggggaaagcuuuaaaauauauaaugguuacuuaucuaaaucucuguuuauuuguauuuguuuuaguuuaugauagaaauaaagaacucugcuguaucuuguauaccaacugauuggguaaagguuggaagguagguuuaaaauaaauuuuuuucuuacaaugcauuaugaugacaucuguauaucuaugugcuacugggcucaucguagccacauucuugaaauuaaaagcaauucuuuuuacuuauuuuuucugauggaacuuuuuuuuuuuuuggaggggauguagucuugcucugucacccaggcuggaguguagugguaugaucucagcucacugcaaccuccgccucccugauucaagggauucuugugccucagccucccgaguagcugggaccacaggaguacacuacaacccccggcuaauuuuuguauuuuuaguagagacgggguuucacccuguuggccaggcuggucucaaacuccugaccucaggugauucacccacuucagccucccaaagugcugggauuacaggcaugagccacugugcccugcccuuucuuauggaacuuuuaaccaaggagaucauuacuuuuaacucuuuaucauugauuuuaaaacauuuuucaaaaagguaucuuauuuuuacacauuuauuuucuuguuuuguaaauuauugcuuuauuuuuauagcacaggguacacauggaagaaaaguugaggaaccuucaauuguaagauuaauuuaguugcuuuuacuucauggugaaugcuaugccugacauuucuuuuaagaagcugcaauuucauuuucuaccucacugagcuccacauuucuuuauucuuaaugccuuccuuggcacauaauuauuauaauucuuuacaucuuuuuuuuuguaacccagaucaugaauugaugaaaauaaauuaaucaaaaacaaauuuagagaaccacauugggacucugccuuuucuccuugguuagauacuaaucuccaggagaggacucauuuaaagacaagguauuagggaaguauauacagcugugaauaguaucuuuuguggaauauuuauuaguacuguuaucaauaaguugcacaaacaugagaugaaaaugguacauuugccucagaugguagaagagggaccguagcugguaauaguguacagacauucuguuuuaaggaugaagggaaauuuugacauaaugugugaaugauuguuacuuuauuacauauauaauauauauaauacauauauacaaaaaauauaauacaaauauauauauauauauauuuuuuuuuuuucuuuuuuuuaagacagagucucuuuucgucagccaggcuggaguguaguggcgcaaucccggucuacugcaaccuccgccucccggguucaaaugauucuccugccucagccucccaaguagcugggauuacaggcaccugccaccacagacggcuuuuuuuuguauuuuaguagagauggcguuucgccauuuggccaggcuggucucgaacucaagugauccaccugccuuggccucccaguaauuuauuauuuuaacuuaaaaagagaauguuuauuauccauugccacaucaucagauguugaaggcacaggcauggauuucuuucauucuaauaccaucuuuuuuuuuuuaaugcuaccagaagcuguacuuuagauuugaguauuguugauucuaggggauguuuucucuuuuugcaggcauucuuuccuuuaucuguuuuuguccuguaccacagcuaaugaaugaaauaugcauuaugaagagaaauuaccaaaaaccauguuagucuaucuacaacaauaacugaaauaucucccuaaaugaguuuuuccagaagauaaagcuuugauaaauauguuggccuagaagucuagaugauauaauuuuaaagcaacaagcaaggcauaaaucagugacaccaucuuucacauguucaguaauguaaauugaaucaacagauaagauaguuagggaaagguucauugcaguuuaucuguuuggccauaggguuuugacagagaugaguuagaacaucaggagucagauuuugaaugcaaaaggcccaccccuaauccagcaacuuggcaaauuaaagugcaacaguguauuacaagaguuggggagcaaaaaaagaccagacaccuugaccuuuucuucuugaagauuuaucaucauaaugacagcauuaacagcaguggcaaccgccaccaccaccaccaccacaaccacaauacuuacaggcgcucuccuaaguuuuauuuguuugauccugucaacaguaccuaugagguagauauuauuauccccguuucauagaugagaaaagugauauuuagagaaggucuguuucauuugccccaaaucacauagcuaguaaguaaguggcaggacuggagccucgaccuggcuucucugacuggggacccauggcauccccuguugugcucuagcuacugaacagagagcagagaugauacucaagcccagauggggagcaugugguauuucuuccuauccagagccacugugaaucugcacagaucacaguauccugaagaucuuucuuaauugccuccugacuuaaugcauugcuuucuuuguaaugcuuuuuuauuuuucuuuuuucacugaaauacuucaaucauacagaaaagcccauaaaacaaagaauaauacaaccuucaccaauguaucuaccucccagcuuugucuuauuuucuuuuaccauauaugcuucugaucuuuuuuaaagagcauuuucacuuaguauaauuuaaagaaaaaagcuuucugccuaugaaauaaaaguucuaaacucugacuuugcuauauggguauaauuugaaaugcauuuuaaaaggcuuccugagcaaagucauauucuuuggaaucaguagaguucaggaccauaauuaaagaauguucuucuguuuacagcuguuuacuuucaagguucaucagagaauaauaaauaacuaauuuucuaaagugauggcauuucggauuuuuuacuaaccuugauuuccuauuuguguucuuuccccucuucuagcacaaaagcugugagccgcuuucacucuccuuuuauuguagaaaauuacagacaucugaaucagcuccgggagcagcuaguccuugacugcagugcugaauggcuugauuuucuagagugaguuuacaaugaaaaaauauaaucugacuuuuugcuaucagaaacagacuggaaaaaucuuuccaucaaaaagaaaauagagauuacagcucaugacccaccauaaaauaguugaguacauguguucucugauuuuauuucuuuuuuuuuuuuuuuacuuuuuuuuuuuugauacugagucuugcuuugucaccgaggcuggagugcaguggcacgaucucggcucacugcauccuccaccucucagguucaagcaauucuuugugccucagccuccugaguagcugggauuacaggcacccaccacuacacccagcuaauuuuuguauuuuuaguagagacgggauuucgccauguuggccaggcugauguuguacuccugaccucaagugauccgccugccucagccucccaaagugcugggauuacaggcuugaaccacugcacccagcccgaaagaaauucuuaaaaucuacugaaaguuaagaugacccucuauacacccuucaccuagguucaucacauguuagcauuugccacauuugcuuuuuaucucucauguauuuuuuuuccugaaacauuuggaaguaaguuuuaggcauuguaacacuuuaccccuaaauacuuaagccuacgucuuuaaaaauaaggacauucuacuauauaaucuuaacaccauuuauuauuacaucuaaaaaaaauuaacauuaauuuuuuuuuuuuuuuuuugagguggagucucacucugucacccaggcuggagugcaguggcgcaaucuuggcucacugcaagcucugccucccgaguucucccaccucagucauucucccaccucagccuccugaguagcugggacuacaggcgcacaccgccacgcccugcuaauuuuuuuuuuuuguauuuuuaauagagacgggguuucaccguguuagccaagauuaucucaaucuccugaccuugugaugcgcccuccucggccucccaaagugcugggauuacaggcaugagccacugugccggccaaaaaauuaacauuaauuuaugaauauauuugaauuucuugaauuuucccaauguccccccgccaccggcuuuagauuuuaaaaugaaagaccuaaucaacuuuuacauguugcauuugguaauuaugcuucuuuagucuguuugaaccuagaauuaucugccacguuuuuuguuauuuuaccaugguauuuuuugaagaguccuugccauugucucaaagaaugccuuauauucuggauuuauugauagucauguguucauauuggcaguuuuaagucauggcaugcuggccaauguuuaacagccagcucuuuggaaggacagucauguuuguagaguuugcugauuucuguaguguaaacacucccaccagggcugaugucaagcuaccacuggacuggaguugggaagagauguacacaguugauuuucaugaguccauaggaaccagcucuagaccaccacuggucugaguacuuuauauauaaacucaguauuuuucacgugaccccuguaaggcuaaguaucauacccaacuuacaaaugaauaaagugagaugcagaaauaagaaguuaaucuuccaaggguaaggguuggagcccagauucagccccagccauccggcagccagaugucuggccuuugccagccugcccauggugagccugcaggcaucagucuaaauacaucuguuagucucucacuuuaaaaccauaaacaggccaggcgcaguggcucacaccuguaaucccagcaguuugggaggcugaggugggcagaucacuugaggccaagaauucaagaccagccuggccaagauggugaaacccuguuucuacuaaaaauacaaaaauuagccgggugugguggcauguaccuguaaucccacguaacucaguaagcuaaugcacgagaaucacuugaaccggggaggcggagguugcagugagccgagauugcgccucugcacuccagccugggcaacagagcgugacugucucaaauaaauaaauaaaaccuuaaacaguaaaaauucagugacguccuucagggagcuuuauuguauuucaaguaaucaacccgacaaaugaaaaaaacuaaaaacaaaaaagauaugugagaauuuuuacaagcuaguaaguugguaucagucuuuugcccugaggagucuugaauuguaagaccaggaagagauuccaauuuacuuaaaucuuuugagacuagcuugacucagagucuugaauggagggauggaaauuuugucuauucaguuucuuuucuauuucacuuuuaauuuucuauuuuaaggguuuucagggccuuugaguguuucaguuguccuggcuuuuuccuuaguauuaccacugagaaugugaaaacugaacuaaaauuacaccuuucagucuucaaggacucacauucuagaaggguccugggauuuggugagguaauuucauguucauucuauucagaccuuacauaauuucauagaucuggcuucuauucucuugucauuauuccagacuaaagaaaguugaggucucccaggcuaaucauccugguguuauucuugauucuuucuuccuuuuggucccuuuaucuguuaccaaguucuuuuuuuuuuuuuuuuccucgcucugccacccaggcuggagugcagugauacaaucaugacucauugcaaucucuaccuccccagcucaagcaauccuuccaccucagcccccuaguagcugggaccacaggcaugcagugccacaccuggcuaauuuuuaaguguuuuuguagagacaggguuucucuauguuccccagcauaaucuugaacuccugggcuauguccaaccuguuaucaaauuucugauugucuuuuucccccuuugagguguuucuuugauuugucccuucuucuguugucuucuaacagcccauuauuaccucaaaccauucuuacuguauuggccuucugacugggccuucuacuagguugacccaggaguuuuuauuauauuaucccuaggcuguaauugagaguugcgaagagugagcuaacaguaaauauaacaucauagaagcauaugauacucuaauuacuaagugaagaaaaucauguaaaguaaaaguaugauacaguuuuauauguguauauuuacauaaugcacagcauacagacuuuuauauuuuuaaagauuauauaugcuuauuauuguauuacuaauaugcuuauuggccauguguauaucuuuggagaaauaucuauuccuauauacauaugaacauacauacauauauauauguauauguagacucaaaauguuaacugauuauuucuggauggugagguuacuggugauuuuaauuucuuuacuuugcaaaugcaguuggcucuugauaucuguggguucugcauccauggauuuaaccaacugcagauugaaaauauucaaggaaugaaaaggaugguagcaucuauacugaacacauacaggcuuuuuuuuuccccuuguuauuauuucugaaacaguacaguauaacugcuauuuauuuauagcauuuacauuguauuauguguuauaaguaaucuagagauauuuaaagucuaugggaggauguacauagguuauauacaaguacuuuaccauuuuauguaagggauuugagcauguuggauuuuagcaucugcaggggguccuagaaccaauccccuauggauacugagggaugacugagcaugauuucagaaguuccuauaauguacauauauuacuuucagaauaagaaaaguguauuaaaguuuuuauccagaaaaagaauauuggcugaaauuuagcuagagcauuuugcaacuagagcccccacuugagagcagcauugauuguuauguacacuauuuauugagguaccagauggugugacuaugauaucauuaaaaaaaugauuaaccucaaugaaccugacaucagaggauugaauaccagcauuacaaauguauuugucacuuacugagguacuaacuguugugcauuagucacauuacuuuugaucaaaauguugucagaaauuaaggcuguagacacugcuguggauuaaauccucccuugaaacaugucucucuuuuuuuuguucuagaagauggacuguguauauucaguaaucuucucaauugcaaauuauuuaaaaauugaauuauaucauaaaaaauuauagaaauucauuugcaaauauuuucaauuuuuauuaacuucagauaucauugagcaacacuucaugguaaacuucucuagucaucauaacacuauaacagcuuuagaaccaaagugucuucaucugcuuccuauggacccagcaauaucuuuuggccagagguuaaaucauagugccuugacuucauccuuaaguugguugguagcauagugauaaaauugcuuguuguuaugcuauaaacccagucuaccagauuguuaucugcauugaccauuuuucagcuuaccauuuuucuaaguauggauaaucucuuugaaguuuggcaaaguguaucaaauggacaaagaccaagaugucaaacaagccuucuuuaagaguuaugauguuauagguuuaugauaguuuuucauuuuauucaugucuuauuuauaccauugacaucagaaagagcauuguuguucauaucaaaauaauuacuuaucccuucuugcuuuuuuguuguuuuaacugaaaugggacccacuaagagcuguguuaacucauuuccaucuuaagaauuagaucaucagagauagcuacccucaagucaagcugcugaguaguagcaaauuagagucuugaggaccugggcaggaccugagaaggaaggaaagagugagaaaaaaauugaccauuuguuacugcuaaagcuuugauacucauguccagagaggcaagggcagaaauaccaaauauggcugcuuucuggcaaaagagagggugccuagauaggaggaccggaugggucaguaauuagaacaaagacagcauacgccacagugcaagagggcaacaaguggucagaucuaaagucagagccauggcugacgcaguggcucaugccuguaaucccagcacuuucggagacugagacagguggacugcuugaggccaggaauucgagacuagccuggccaacauggggaaaccccgucucuacuaaaaguacaaaaauuugcugggugugguggugcaugccuauaaucccagcuacucuggaggcugaggcaggagaaucgcuggaaucugggaggcggagguugcagugagcugagaucaugccacuacacuccagccucggcgaaagagcgagacuacuacgucgcaaaaaaaaaaaaaaaaaaaaaaaaaaagggaaauaaauaaauaaauaaauaaagucgaagccagagcaggaauaacaaggcaaagucagugggcacccacucggguuuagggugacucuuaacucuaaacacccagggcaguuaggucaaugcaacauguggcaucuucaaaacuagagagcauuuuauuuuguuuuauuuuauuaaauguuuguggguauauaguagguguauauauuuaugggguacgugagauauuuugauacaggcaugcaaugugaaauaagcauaucacggagaaugggguauccaugcccucaagcaguuauccuuagaguuacaaacaauccaauuacacucuuuaagccacuccaaaauacacaauuaagcuauugacuauaguaauccuauugugcuaucaaauaguaggucuuauucauucuuucuauuuuuuuggacccauuagccauccccacuucccuccacauuuuaaaguggugacugagggcugccugucugaugcuaggggccuguccguuuuguguuugugguuuugcacagauucuaacacuguuggugggaaucguauuauuuguuuugaugaacuuuaauucagugagaaauagauaaguuauauucauuauguucuaucuacucaguaaauaaguauacaguauacugugaauauauuuuucgguucacaaaaaacagaaauaaagcuggauaguuaaaauguuguuucuaguaucuggaaaaagucauuuauguacaauaccuuauucuaauaauacuagaaauaucagaaguuacaguuuuaaaaagucauaaugauuauauaggaauaguccaucauucuaguaguguaaucuggauaucuuuuucaagcuaggaagcacuguagaaaucuuuggauuucaguaguaaacagacugucucaacauuucugaaacccacacuacaauagagaaauguuuuuaaagagaggcauuuauuguccguuuguugucuuuuucacguuuuuggaucaucuuuaaaaggucguacagaauaucugagcuacacuauuuuuuaaauguagaaaguaggcaccuucugauccguggucagacgcguuacccauugcgcuacuggccacaugaaaaaaugcucaccaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaccuaguucaaccauuguggaagucaguguggcgauuccucagggaucuagaacuagaaauaccauuugacccagccaucccauuacuggguauauacccaugacccagccaucccauuacuggguauauacccaaaggacuauaaaucaugcugcuauaaagacacaugcacacguauguuuauugcggcauuauucacaauagcaaagacuuggaaccaacccaaauguccaagaaugauagacuggauuaagaaaauguggcacauauacaccauggaauacuaugcagccauaaaaaaugaugaguucauguccuuuguagggacauggaugaaauuggaaaucauccuucucaguaaacuaucacaagaacaaaaaaccaaacaccacauguucuuacucacaggugggaauugaacaaugagaacacauggacacaggaaggggaacaucacacucuggggacuguugugggguggggggaaggggggagggauaacauugggagauauaccuaacgcuagaugacgaguuagugggugcagcacaccagcauggcacauguauacauauguaacuaaccugcacauugugcacauguacccuaaaacuuaaaguauaauaauaauuaauuaauuaauuaaaaaauaaauuaaaaaaaaguaggcaccuuauuucuauuuuauuucuauguaugcacaaaaauaaggcaagaugcuaguaggagucuguaaaauugcacugugaaguagggugauaggaagagcacaguuugagucuaggcucaauugcuuuaggcuaacugcuuuuucucucugaacuucauuuguaaaacuuagguaaugaagaccuaccuuuaugguuguuguaaagaauauguaguggcuucuucguagucuuugauuaguaaauguuuguuuuccuuucagcuuuccuuuuggaccuauuuacaguuaguuuauuacauuuucucauuuuccagucuuugaagaauuugugacuuaucaccaccuacuuaaacauuuuuugugccucuuaaucucucuuggaggcagaguaguuacuauaaagauuuaagcucagcuauauauuuccuguuacuuaaaaagauacuuuauacuuggccauucuuaaaaauuaaguuuuggguccuuuuuguaguuuaauuauguacacuucacacauccacaauugaucacuacauacagauguccacaauuuauacgacacuacacacauugacauaaaauacuaugauaugagauaaugggauaauuuaagaaaaaagaaaaaaguauucauguauguuuucugaauaaguuuuucauuaaaagccauuuaggcuuuuagaucaauaaauauuauaguuuuaaguagccagagacuugaggcaaugaccauuaucuuuuaaaaaacaaaucugaaauuuaguuuuuauaugcauuauuaauaagauaacugaagauaagugaaaaaaguaccuuuuccccuugucuucaauaaauauuuauuacaguguuuauuuuaugccaacauuauaaacuagauguuaggucuacaaugggguuaaugagaugagauagacaaccugcuuucaagaagcuuccaguuuagugugagagaaagguguugaaacuguuauuccggauuuggaggaugcugugaaggagaagcacaagggaagcugauccacaugaauauuucaugauguuauugaagcaaaaugaaaaugacugcuauauuuauguuauaucuuaaguucaaaugucagggucagaugaaaucugugauauauucuuaaugguugauaucuuuacauagaaguuguuuuaaauuuauauacaaaacagaagccucaauaauuuaguuauuauauuaaaaaguaaagcuguuugguguaaucuccaucucucuuaacuguuaggaaugccugcugaucaucuguaugcuuacacuagcugauaaagugauugcuuguuguagagcuauuauagguuuaagauaucaguuugcucaccuuuuuguuguugcugcugcuuccguaggaaauucagugaacauuaucacuccuuguguaaagcagugcaucaccuagcaacuguugacugcauuuucucccuggccaaggucgcuaagcaaggagauuacugcagguaagauauuuuucauuuuccucuuuaucagugcuuuagauaagaugacauuauucaauuaauuauagugucuuuauuauaaaauauuacaguuacucaaauguguuagacucuugggaaagcugaaugucauacauauguagcuugauuugaaaauuaaauucauuucuugcuuccucugucacugaguacaaugaaagcagauguuaaaguuuaugugggugacauuuuuauaaaguuucagcacucuuuucauuuguuagcuuuuacuugaacacuuuuauaauuauaaaaguuugauuaggcaagaaaagacugagaagauagggacugaggggcauuuuagugaucuguuccuuuuguuaagagcccauauucaucccacuauucuuuauugaccucuaaacaucccaacauggaauauuuauucucuuuuucauaaaggauguuagcacaaacaaaucuaacuuuaaaauucagauggcugggcgcauggcucacgccucuaaucccagcacuuugggaggcugaggcaggcagaucacgagguuaaggcaucgagaccauccuggcuaacacagugaaaucccaucucuacuaaaaauacaaaaaaaauuagccgggugugguaucacgugccuguaaucccagcuacucagaaagcugaggugggagaauugcuugaacccaggagguggagguugcagugagccaagaucgugccacugcacuccauccagccugggcaagagagugagacucugucucaaaaaaaaaaauuuuuuuucagacaaaacuuucauacaaguuguaugucuuccaaagcuugauuuuauauauacuuaagaaaaaguaagacuaggcuugguggcucaugccuguaaucccagcauuuugggaggcugaggcaggaacaucucuugaaaccaggauuuugagaccagccugggcaacauauugagacccuaucucuacaaaaauuaaaaaauuagcugggcgugguggugcacaccuguaguuccagcugcuugggacacugaggauugcuugagcucagaaguuugaggcugcagugagccaugauagugcccaugcacuccagccugggugacagagcaagagccugucucaaaaaaaaaaaaaaagagagauagaauuuaaaaaauacaaaauuaaauaaaguuguucaaguucaaauguuuuauucuuuccaggaggcaucuagauuauucccuucacugccauaggugucaucaguaugcuuucuugcuaugcguguucuauccuaguguauccucccagcucugugaguuauccuuugcauccuauucugccaggaagcguuuugucauuauauaauuuugauagcaacagaauaagucgauguaaauuuuagugcagaaaaaaucacuuaaaauuuuguuccaaagugaaaaucuuccugguaaaucauaucagugucaugaauauuauauaaugauuucacuuggcagagcaccuaggauuuuauuuuaaaauuaaugucacaaauacuuucauuuuuuucuuuuacaaugaauuuguaacccaccuagacaaaaaaucuugucuucagaauuacacucuaaaauccaaaaacuauccuuuuuucauaauuuuaagugucucucuccaacagaugauuucaaaguauuuacucagaagacacuguagucacuuuuuuuuuuuuuuuuuccugagacagagucucacucuguggcccaggcuggagugcaauggugcgaucucggcucacugcaaccucugccucccagguucaagggauucuccugccucagcccccugaguagcugagauuacaggcgugugccaccacgccuggcuaauuuucauauuuuugguagagaugggguuuuaccauguuggccaggcuggucuugaacuccuggcuucaagcaauccaccugccuuggccuuccaaagugcuggaauuauagacgugagccauagcgccuguccuguagucacuuucuuugcaaaaugugagagcaucugggauuuuauuagccagauauauuuaagaagaauaauuuaggaaaguaguauuuauugguguuaugaguaaguucagaaaugugguuacacaugaaaguucugagucaaagaacuauaggaggucauugguaggauauuaugcuuuugaaaaaagaccaaugaaucaccaagaaacugaugaaaagauguucaaucuuaguaaucagugagugcaaauuaaaacaaugggauaacgcuguuuaccuguuauguugacaaacauuagaaaguuuaauaauaccaacuuuaagugaggguaugagaaaacaaguuaacuuucauauccugcuuguaggaaaguagauugguauaucuacucuugucuauuaaaauaaaaaauaagcauacucugugacuuaggaaucccacuuuaaaaauuuacucuagcuuugggaaacacuuggacuuguacacguggagauguguauaggauuguucauugcaucaucguuuauaaguaagaauuuggaugcaaucuaaauguuuaacaguggaaaauguguagcagcuuugaaaaucugacaagaagugaucuucaguauacucuacuguaagggccuauugaaccuaauuucaguuucuuaaaggccaucuaaagaacaaagacgaaguuuacuuuuuuuccuuuaaaaaggagaguaaaacuuacucugucuuacacuuaccauguggguuuauuggauuguuuuauaaauguaagaugcauuuugggaucuuuagugaucuuauuuuuucuguaucuuggaacauuuuguuauuucuucauccugaguauuguuuuaacauuguuuaucauuuguuucaacuauaauauaaaagucuaaaaugaaaagaaaaugagagaaugaugaugcagaagugaggggagaaaucacuaucacgucauccuucuguuuucuucuuguauugcccgcauuacaucaucuuccaagaagguauaaaagaagagugcagaugccacaguuggagucugcuucuaauuuucauugaacacaguugaaaauucagaauuuuucguuguucacccguaaaggcaaagagaacaaaauugacagaaggccuuucauaauuauuagcuuaaucagaugaugaaugugaagagaaaaaaaccagugcccugcauauucauggugauggugaaauuucauguaucagcaaaaucugagauucugaaugcucagaaaauauccuaggugaauuuucucaaacucaaaaguugguaugugaauaauauauuuguaagggcaaaaugaacucuguuauucucguccaguuagucauucaauaggaaacauucaucauguaauauuuggugacaagaaccuggacuguccuguuuugcugaaagaugugauaguauucuucuaucuuuuauaauauuuauucacuaaaauuuacuugauacaauuuauagguuacaauuuauagacagacaggagauugaaaggauauagaugauguagaaauaaagguacucauuugauuauucuaauugguguugauaagucaaaaaaugaaaauauuuugcaauuauggagcaaagaugaccaucucuuuaagaaaauuaugagcuuuaaaagauuucaaaaacuucuucaaguauuugcauuuuuguugauacaaaugugaaaagaaucagaaauaaucagcucuagaaccuauuagaaauguauugaaauuuggaauuuaguauuuaugaaugaauauguucuagaugcaugcuugacggcugaugagcaaugacauucagaaugucuuacccauuucagauauauaugccuugaaaaccaggagaauauggaauaaaacuuuugagauuugcuguguuuaaauucuuauuaaaauuugucaugagguugauuuuuuuuacuauccccuuauucucauuucuguaaaauuauuugugaaaugacuuuaaaggaauauauuaaauccagauaguaaauggugaaaucuauuuuuuguguguguacugagaguuaaaauaaacuuugaauuuuuuaaguuacagaaugauagauuacaguaugacuuuuccaaagaaaucacaacgagugugaugcauacauaaacauaaaugcacagaagaagguuggaaaggguagacaccaagcuggucucaguaguaacaucugggaaggagagcugagaguagggcagggcucagaggugcuugaauacacagcuaaagcuguagauaaaacagauauagaggucuuuaaaaagcauaaagaacaucaaggucaaaaaaugauucuuguaucaaaguaaaagauacaaaagaccguagaaagauguuuuaauugaacagcguaugaaaauuuuaggucauuucauuuccaaguccaacacauaguuuauauuaauaauuacaucuagaaauaauuuuaugugauuuacuuuauuguauucauuaaugaaaauaaguagcaauaaucugaacuguuaucuuuacuaaugaaaauauugguuugaucucagacaacaauagaaaaaugaagaauaaagcccagcauggugacaugcaccuauagucccagccuccucaagaagcugaggcaagaggaucacuugagccuaggagcuugaggcuguagugugcuaugauugugucugugaauagucacugcacugcagccugggcagcacacugagacccuaucucuuaaaaaaaaaaaaagaaagaaaagaaaaaaaagaucuuguaaagguaaacuacaagggugaagccauuuauaagacucuucuaaaguaugugcuucagugcacuauuauaauaauaaauguuuucccaauuuugaucuuauaguucaaauuuaacuuuuauacucaagguuuuauucuggacauauguucuuaaaaucuauguuuaaaguuuuguuuucugucguacaaacagaguacugaaauuuuucaugcuaucuuagaguuuuuuuuuuaaggcuauuuccaugccuaguaaauugaaacauauuucuuuuuugcagaccaacuguacaagaagaaagaaaaauuguaauaaaaaauggaaggcacccugugauugauguguugcugggagaacaggaucaauaugucccaaauaauacagauuuaucaguaaguaccuuaugccaaaaaauaagucgaugauaacaucccaaacuuuuacauaccaaagaaacauuuuuauaauuaaaaguuacccaaauuucaacuuuggcuuuaaaugggcuaagccuggacauaguuuuauauuuaccacgaaauguggaauuggugcuauuuccaaugcaagauuaucaauagguuuaguaacuaaaaguuuaguucuaauuaguuauccuagguaacccaauaaaaauauuuuacauuuguaaauacccaauaugcaaauagaguuggaauuauaccauaguuuugcaaauucauguuagcauguaguguuccauccuuuguacugugacuauuuucagauauucuaugcaagaaucagagaugccuuugcagauuccagugaugagaauuuucauuauaggggcuggauuucucuuacauaacacaaaugauccugaauacuuaauuuacuuaacacauacuuacugagugccugugucucagguaaugaaguauuaggaacagagacuaguaagcaagacagaacucuucccugcccucacagagcuuguuguauagcagagaagauaggcuagugcaauacagcuuagugcauggcaugauagaggagaccaggauggccuggggauagguagcagguuggccuaacccaagggcagggaagcauugaggaauguuccccagggaggagauaccaacugaagaaugagucagugcaggccaagguauugaaggggaguauuccagguagaagaaccagcauggcagauauuggaagugaagcauagcaggaggaauucgaggaacugaaagaugaugaguaagguuggagugcagagugugaacaaagaaguguucagagauaaggaagaggccaguucacucauaucaagaaauuugcauuuuuaccccuaaaagauuaagaauacuagcaagagagugauagaagcuggguaaaaauagugaaguuauggcaggguguuugaguuccauugucaaagcuaaauggagcugggcacugaagugguaaggauugaucuuauucaguaauacuccugcauagggaagaguccagugugaacugaacuugacuucauuuuggcauagaugacuggguguuuuaaagggaauacgagggaacagggaaagggaaugagcugggggaggagagagagugaggugugguuauuugaaaccuaucuggguuuacuaauuguuugcuuauaccacauuucaaagagucagcucucugguccuuaagaagacaauucugggugauagauuuacaucacaaaggggcagaaaaaguauuuauaauugcaagcuuucuaagguaacuguucuaagaagggcuucagcaucuggcugccugucaccaaauuuuggcuggaauggcgaauccuggcagcacugaguuuucucaggcagauacuuuuaguggggcuggggucauccuaaggaugcagccuugagcuguuagaaacuaugcuagugggguaacuucuaaguagggaggguggacaaaaucauuuuuacucaaagucucuagguuuuuauaggucaaaguugagaacuaguccagaagagggcucagagaaaaaaccugaugagaauuuggucaaggacaugggguaaaacgguauggugaugggucaaaaaaugaauauguagggaguaguuaugugagagagaagguaucagagaauaaaaugccugacuuucagauaucaaaugugcuguuuuucugguugauggcaagaucuuauguauggcuauggaagguggguagcagaagggagaaggucuuuggagaugaagagaucaaggaacagaguuugggaaaaaguuguccaugugaauguugaaaucuaagauaacagcaagauaugccauagaggaaaacagggauccaggugucugagauugcgagaaauggcgauugggaauccugaaguuuauagauagcuuagauugaggacagacagugguaaagcccuaaagaagagcuucugaacccugaacccugagguacaugguccaugguuggauguggcagaaaggucagcgcccaaaugagagagcugcaggggaauaacaaacagccagccaguuuucauuuuaguguaugaaggaaauguuaagcaaggugguuagaaacagaaguacuaaggaacucuucugaggacagugaaagaauugagauguaggggagcauuuggaauguagaucagagaaagcucagaguaguagcgagcugggacuguaacagaguauucuaccucgggcugugagcagagguggcagagauguguggcauggugcauuuggcuggccaugagagggggaugugaagggaaauacuuugaaugacaucuaguuuaauuuauaauauggauuuucauaucauaacaagacuuguugguaguauauaaugcaugucuuagucuguucaggcugcuguaacaaaauaucauagacugaguagcucauaaacaacagaaauuuauuccucagaguucuagaggcuggaaaguccaagaucaagguaccagcagauucaguuucuggugagggccuguuuccugguuccuagaugacaccucacaugguggaauggguaaagggucucuuacucauguauucacacaguggaagggauaaggggucucucucaggcccucaugaacuugucaucuccugaaggccccaucuucuaauaccauugccuugaggguuaggauuucaacauacaaauuugggagagagacaaauauucauaccauagcaaccuaagacccaaugucuauaaacuuguucauucuuuuuuaggaaauuuuuauaugugguagucaaacaaguuaauaaguaccaaucuuuuuauugucuuuaaaaagaagacuaugucuuugagaggccgaggcaggaggauuaguugaagucaggaggucgagaccaaccuggccaacauggcaaaacccugucucuacuaaacauaaaaauuagcugggcaugguggcgccucccuaugauuccagcuacucaggaggcugaggcaggagaauugcuugaacccaggaggccgcugcacuccagccugagcaacagagugagacugucucaaaaaaaaaaaaaagaagacuaugucaacauaagaauuuuuuuuuucaguucucauaauaccaguaggauauagcuuuucuugagaaaguaauauaaguuaaauauaaacuaagcaacuaaauauuagaacuauaaguuucuuaaaauaauuuccuguuacuguuucccugcccaucuacuugaccucaagaauauuacccuugggauugacuuauuucuuuuuuucuuuccuuuuucauucuuuuucuuucaaaacguauguuacacuuuaauaaagcaagauuugaagaacuaaaauagccuucugucuaauuacaauaauguuuuaaagaaacauugaacucuuacauuuaaaucuuuacaaaguaaauggaguaauuuuuuuuucaagcaggcaccucagaauauuccagaauauucguuucuauuacauaugcuuuuucuaacuugaguaggaguugauauagaacuguugcuauggugaagugcauucuauuuuucaggguaaaaauuuauauauagggauaguguugagaaagaacuuacguaaaauucaauuuaaaauauuuuauggauguuaauuauaaaauauacccugaaaauaauuucaaaguuaaaugacauuguuguuuuugauaaucaugugguuuuaagaacuggugcuuuguacauguaacuauaaguauacuuuucuguauucuguauuacaugaacuuauuauagugcuucugaauaagccaacuuucugcccgcuuuuccucucccaguuuuaagaauacuuuuuaaaauacucuuucuuuuuguccccuuccuugauucacuauauaauccaagcauuuauacauguggucaccgcuggagcucccuccuccacccugcccaccuccauggauucucuacucugcagccacagggcuucuggaacgugccaugccacucucccuuuugaauucauacuucacacuccagccagauuggacuucaugccguucccaagucacugugccucugggacuuggcagaugguuuucccucugcuuagaaugucaucuuuccccaccccacccacucccgccucacacacuccaacauccacccacccaacacccacccgacuccccagcucuggcuuguucaagucuugccuuggaugucagcucuugcacucagccuuccuuugcccagcugggauggguaacccucucacauacccucgccacucuauuucuccacaucucaguacuuauuccaccaaauuauaaucauucuuuuuuuaucugccuuucccaguggacuguaagcaugaagagaacagggacuacaucucugucaccuauguguaaucccaggaucagucacaguucucuggcacauagcuggcaccuaaucagauuuaauaaaucaguaaggauuagcuagaagccuucagcagucuccaagucucacuugaaauuuuugccuuuuauuuucuacacaaaauguuuuuuuucaggauauuauauggggauugccccaauuuacagaauaauuuuacugucaaacuaaaagggaaauuugggaucuuuuaguguaaccacgucuucauacuucugaguaaacuaugguucagaaaggggaaaugaucugccagagguugcucagguugggucgucuugaacuguuucccaaaacauaaacauauuuuaaggcaagccagugcuuuccaaccuuuuucacuuugcaucacacagaaaaugauaguauuuuaauggaacacuggauuaaaaggagaaggaagagguugcucagaggccaaggaggcuggcccagggacuguggccgccccagccccacccaccaccuguggguuaaggggucaguaucuuggcaccccugucaccuugugaggcagcccaggacugcugcuuagggaaaccccagcgaacccacugcaaucucaacucucccaggauuguuuguuaaaccaaaugacucuuuuuuuuuuaguggauggauuuucaacagcaguuaaagucgggguuuucaguucauuuguaggguuuuuguuuuuaguauaaaaaauauaaauuucaacuaauggaggggaggggaaagagugguugacagcuucucaguuuguugggugggaagaaaaugagucaaacgugcacaacaggaagauucccaggaagcacucgaacccuguagcucucuagcccaagcagaauucacagcccagguguuuuauugcuggggcaggguagacauugagaugcuagucacagucccuucuugugagaucaagaugggccuagggugcuucagucauuagcuccgcaugugguauggaaugggugcucacacauuuguuacaugaacaagugcuugaagcugguaaagaugaacagauuucccaauuccuucccuuaucucaguacaaauaaugucuagcuggcccagaaauacuugcuuuggcuguauaaaaguuuaaaagacuaguuacaguaauauucauaagcuguugacaauuugugccuaauuaccaaguggaacaguaauaauacauaccauaaaauaugucugagcuuuaagcuuaauuuaauuccauggcuaaauuauauucucacagauucugcuguaaagguguuuuucacauagcaugaucuuugaaucaugagcccauggauuaaaauucuaggaaacauuaauggcaauugaauauuguuuucuugucaguccuuuccucugguucuccucucuccugcuucugaaacaauggauagagaaggacauuugucugauaaaguguucugaccugcacugcugucucugcccagaauggcccuccccucucuucuuaucucuuaccugucugcauugauuggacucacacuguuccugcaggacccaacaaaacacugccucuuccugagagccuucaccauccucuggccagaaaaaaucccuuucuauucaagcacuuucuuugcucuguuuuuaaagcucucacauacuacuuuuguuacacaaguguagugggaaaguggcucacaaugguaggagauuuaaauuaaaauccugcucugcugucauuucacucucauuuuggauagaccacgauuacuugcugggccuuaguuuccucaucuguaaaaggaggugguuaagcugggucacagccagcccucacacccaggggaauguaaauugggcaggauccagguguuggagggauuuaaguccugacuuuggcaucucaacaugcagcuggugccgcucuccagcuucauuuucccucuuucuguuucuaguucaccuuggguuaaaagugcaaagauuuggcugagagcucgucuggaggaggcuuugacucaagagucucuuaccauaaccugcuguugauugacauuuucgaggaauaaaacacuuugaaacuaccaaacuuuuucagcagucugcagcuguuauaaaaauaguucucccauaauucuucuuuaaagacaguugucaauauuuauaccugucaaggaagauagcacuuuuuuuuuuuuuuuuuuuuuuuuuuuuuuuuacagaaaauuagcuuuucaggucuuagaaauuaacaugugacaguuuuauuuuauuuuuuuucugcuguacaucugcugacuucagggauauuaugacuguccauuauucuaguguacucaaugaugaacacauggagugaaagcaugucuucuccuauuuaguagugacuaugauucccugucauugagcaagcguccccauugagacaugucagaggaugaacuucacuuaacauuccaguucugcgacuuaguugcugggaaagauauuuagcuuuaggccucuguuuccucaccuguauaaugggaauccaguaauauuaguauuacccugugacauuguuguaagaacuaaaugaagugauacauagaaaaucauuagcacagugccuggcacuuguuaucugugauuuucuuaagauaucuugaaguuugucuuuuauuuuuagaucuucucuucccccacagaaguugacauucuauguggaaguugcuuaguuaucacaaguuuugacucacuguuuagauacuggauaaacaauacuaagaucuuauugauugaugcuauucagacagauauugccaauacuaaagggaacacuuaauagaauguacuucuagucucuucauagguuugccaaggcaguccucucuaguuguuauccagcaacauagucccuucagcgcaauacuuccagcuuuuguuugcuaucauuaauuaauucauucaucccccuuuaguuucuugagaacuugcucuguguguggccuccuuaggcuuggugcuagcccagcuuugggcacugucuaggccagucugguauucccaguaggcuccagaguguguggagaggugguuauugccaacuuucagauucuggcuauuugguuagaacauucacucaugcuaacugguccugccgauagauuuuaugugucuuuuauaucugggaacccuugaugugugcugccucaaauacgcacgaucuuucuaaaagagauuagcacauuagaugagugaaauuucuugaccauuuccuuacuuauugugucaucuugggaaccguggaaacaagggggucauauauucuugacagauuuuuauagagaaagcaaaugauuguuuuugaaauguaaacaugguggaaaucucugcuguaaugccuuuuguguauuacauucaucucuuugaucuauuuauugggugccuucuuugugccaagccuuguucuaggcaacggggaugaacuagaagacacaauuccugcucucaugagaacuuacuuucuagaagugagauugguaauaaauaagcaagaaaauucagguaauuucagagaagguugaaaacaaaauaaaaugggcugaugugauagagaaucacagagcagaggggcuucuguagauuggguggucaaggaagguguguccugggaguugauguuugaguguagaccuguagaaaggccuuaaggcaggaaugagcauguuguauucuggcagguggaaggagagcagaaaucaagucuggcuagcaccaagugaacaugguggagggugguagaagaauggaucggaggcagacauggccuuuagacugugaccuuuagacacuuagaagugcucugaggaucuggaugagggcuuuuagcaaaaaacaaguucuguuuuacuuuuuaugacagucacucuggcugcccuauggagaguggauugugggcagaggagaagcaggaagacccagcaggagccacugcagucaccugccugggcaguggcacugggcauggagacaggagguuuuauuuaccuagaggaccuccugauucuucagucuugugucuuuuuuccugcugguguuuacuagagugccugauguacaacuuaucucgugcuggcagucucuuagggcuuacuaagaaagccaccauguugucaccuacaaauauuugaguuuaguggguugaacacauuuaacuucuaaagccuugaaguuaguucuucuuugacauccucaaauccuggggcagggguggugggggcuggaaaaaaucugucucuacaacaguauccccaagucugcccagguucaccaugcaccacuuuucccagguacuucaugcaaacgaauuccacaacuucucaucuuccaagcaaaucuggcacagagcucuggugccaauuuaauuccugcucuuucauuccacccagggccacauauucaagcaauguaccugaauuuaggaugagagaucuuauuuaauucaacucccugauuuuagaggggaggaaacugaagccuagagagguguauuggcuuguccagaguccacacuagaaaccaccuuucuuuugugggccaauucuuuauucauguuuauacuuuuauuuucacacucuguuauuuucuugcuuaucaaggcucucauagaaauugacgccacagugaaaauuuuuguauaauacuugacauaguaugcauucaaugaacaaaugguuguuaguacucucauugcuguagaauccauuuacaaauaaguguuagauuaagauuugaaauauaaagaaagggaggaaauugcuccuuaauuccaaagauagccacuguuaacauuuuggaauguuuccuuugucuuucuuuguaauuuuuuuuaagaaauagccauuuuuuauauaaaaauuuuuauauccugcucuuuuaguuaauauuauaacaugaauauuuuccuauauucuuaaaaagucuuaagauaacuuuuaauggcuucaugguuuucaacaauauggauauaccauaauugccuuaauauuuucucuguuguaucuacucuuugcugucaugaauaauccugccaugguaccucacagaauugauucuuuaaaaaaacaaaacaaaaauugggggcacauaguagguguguauauuuauggauuacaugagauauuuugauacagacaccgaauguguaauaauguuacccucacaugaggguaacugggguauccaucaccucaggcauuuauccuuucuuuauguuacaaacaauccaguuauacucuuaguuauuuuuaaauguacaauaaauuuuguugacuauagugaccauguuguccuaucaaauacuagaucuuauucauuguauguaacuauauguuuguacccaaggaccauucaccuucuucaccccuacuacccuucccagccucugguaaccauccuucugcucuuuaucuccaugaguuuaauuguuuuaauuuucaguucccacaaagaagugagaacaugcaaaguuuaucacuuuguggcuggcuuauuucacuuaacauaauauccuccaguuccauccauguuguugcaaaugacaggaucuuauucuuuuuuuauggcugaauaguacuccauuguguaguguaccacauuuucuuuguccauucaucuguugauggacacuuaguuugcuuccagaucuuggcuauugugaauagugcugcaauaaacaugggagugcagcugucucuucaauauacugauuuccuuucuuuugggcauauauauauauaccuagcagugggauugcuagaucauguguuaguucuauuuuuacuuuucugaggaccuuuaacucuuauccauaacaguuguacuaacuuacguuccuaccaguaguguacaagaguuaccuuuucuccacauccucaccaacauuuguuauugcaugucuuuugaauaugucauuuugacuggggugagaugauaucucauuguaauuucgauuugcauuucucugaugaucaaucauguugcaccuguucauaugccuguuguuuguaugccuucguuugagaaaugucuauuaagaucuuuugcccauuuuuaaauuuuuuuucaguuuuuuuccuguugaguucuuugagcuccuuguauagucugguuagcguuccuuuaucagauggaugguuugcaaauauuuucucccauucuguggguugucucuucacuuuguugauuguuucuuuugcugugcagauuuuuauuuaauaacuugaugugaucccauuuguccauuuuugcuuucguugccuguguuugugggguauuucucaagaaguuauugcccagaccaguguucugaagauuuuccccaauguuuucuucuaguaguuucauaguuugagguuuuagauuuaagucucuaauccauuuugauuugauuuuuuuacaaggugagagguaggaguccaguuucauucuucugcauauggggguauugaagagacugucuuuuccccagcauauguucuuggcaccuuugucaaaaaugagugcacuguaggugugugaauuuguuucuggguucucuauucuguuucauuggucucugugucuguuuuuaugccaguaccaugcuguuuugguuauauagcucuguaguauaacuugaagucagauaaugugauuccaccaguuuuguucuuuuugcuuaagauggcuuuggcuauucagauccuuuuguguuuccauauaaauuuuaggauuauuuuuucuauuucugugaagaacgucauuggucuuuuaauagggauugcauugaaucuacagauugcuuuaguuacuauggacacuuaaacaauauuuauucuuccaguccaugcauguggaauaucuuucccuuuuuguguguccucuuuaauuuuuugcauuaguuuauguagagcccugggaccuugaaugaacauagguuguagucagacaguggucaccaugggccuugggugagacccaguguugugauggcuucaggucugacccagugagcauugaagaauuagguauuuauuguagccuucacagucuagcuuguuuguacuuguucuugggaaggcuuuccaaguauucaaagggacuugaguguucugaucuaaaucuguggucacugcagcuaugucugcauuagggggcaccccaaguccaguaauacuguagcucuuguagacucuuugaguuaccaccuugguggucuugcauaauauucuggaaaauucccuggauuucuaggcagagacucuuguuguccuccuuuacuuucccccaaacaaacggagccugucucugcugagccaccuagagcugagggaggggugacucaagcaccucugugaccaccaccacugggacugcacugggucugaccugaagccagcagaauacugggucuuacccaaggcccgugguaaccacugucugacuaccaucuauguucacucaagguccuagggucuacagucagcagguggcaaauccagccugaagggcuaucauuguuuauaccaccaugccuggcaauagugaaugauacucugggagggaaguaauuaauuugaccuuaaugauauguauaugauuaggcagccuuguucuuuguuagccuucaacaauagggaucuuuuuggucacugucacaggagugaagacagaaugacuuaccuuguaauguuuguuuucugauacauugggccaaaagacccacaggaauccacccgucaucuccagaaagugaaguuuuuauuugaaguuuguucuaguguaacaacuuucaucacauuucauguuucaauagaugccaaagcaaagcacugaguguguugguauuucuguugccugcuucagcagugucuggcucucaaaguuguagccuugcuaccuaaccugagaccaaaauagccaagagcguuaaaacugguauguggguugggaaacaaacauagugaucaggcaagccauuuuagaaggggugguggaaaaaacuucuccauacacuuaagucuucuuaauauuauuuuuuacuuuucaagcaucuaaauuuccccuaaugcacacaauuaaauacugaaauauacauuagaauuuauucauuagaaaauuugagauacucuacacuuuaaauugaacuuguaccguagaacuuuuaaaugauuaggaauguauguuuuauaguuaaaagagauuacuuagaguaauuuuuugucuucacuuucaauaugaugcccccccccccuaccuuuuuuuuuuuuuuuuuuugagauggagucuuacucuauugcccaggcuggaguacagugucucaaucuuggcucaaugcaaccucugccuccaggguucaggcgauucuccugccucagccuccugaguagcuggaacuacaggcaugcgccaccacgagcucauuauuguauuuuuaauagagaugggguuucaccauguugcccuggcuggucucaaacuccucaaguaaucugcccaccuuggccucccaaacugcugggauuacaggcgugggacaccgcacccggccccaauaugaugccuuuugaugacaaaaaaagccuuaacuuuaaugaaguugaagguaucaguccuucuuuuuaugggugaaugcuuuugugccuuaaauaggaaauuauuucaaucccugaggucuuaaacauauucuccuauaauuuuuuauaaacauuuuaaaguuuaauuuucaaauuucagucauuaaucaaucuacucagaauuuauuuauuuacuuaucuuuugagacggaguuucacucuuguugcccaggcuggagugcaauggcgcgaucucggcucacagcaaccuccgccucccagguucaagugauucuccugccucagccucccaaguagcugggauuacuggcaugugccaccacaccuggcuaauuuuguauuuuugguagagacgggguuucuccauguugauaggcugcucucgaacuccugaccucagaugaucugcccgccucggccucccaaagugcugggauuacaugcgugagccacugugccuggcccagaauuuauuuuuauacaugauaugaguuaggaaucuaauuucauaucuuucuauauggauaaucaauuguuuuguaccaguuuucaaaucauccuuuucccaucaguuuauggaauuauuuaucauauauuaaguuuccacauuuuuauggggcuguucugaacucuuauuuuucacuggucaguguuugugugcaagccagaaucacacaagcuuauuugcuauagcauuauaauaacuuuuuacaucuguagggaaaguucuccccuccuauucuccuaauagaauuccuaauuucuauuuagcuuuugcuccucucucuauuuuagagucaacuuacucaguuaauugggggaaaaaaauugagauuuguauuggaauugcauugacccuauagaucaauuuggggaggaguugacaucuuuaugauacauaugugaacauaugaauaugucccuccaugaaaccaguagauacagucaguccucacuugacauuaucaauacguucuuggaaacugcuggcuggguauggaggcuuacaucuguaaucccaggacauugggaggcugaagugagaggaucacuugagcccaggaguucaagaccagccugggauggggagaccucaucucuacaaaaaaauuaccuggaugugauggcacccacccauggucccaacuacucuggagacuguggcaggaagaucucuugagcccagaagguugaggcacagugagucauguuugcaccacugcacucuagcccaggugacagagcaauacccugucucaaaaaaaaaaaaaaaaaaaaaggaaaaggaaauaacugcaacuuuaagugaaaugacauauaaugaaaccaauuuuaccauaggcuaauggauauaaacaaaguuaaauuccuaugucauauuucuggccacagaaaacaucaucaaacuucuaaauaaagacccaacacacuucuaauauuaaacauugaaaaaaguaugaacuauguguuuaagaaagauuaauaaaaacaaauaagauuauuggauacacaauuuuugguaaaucagggagugacagaggucauagugaugguggguuaaaucaaggaauaaauguuuccauagugaaaauugugagaaguaccuccuacuaccaugcagcucaaaaacgaguaauacgugcggcagauuuguuuaucacuuuuguguuacaucaguuuauugucaugcauuuguaugauuaucaccugccuuaugaauuuuuacuugacaaucauuuguauucacucauuuuccaacccacuuauuccauuuuggagucauggguagccagagccuauccuggcagugcagggcaccaggcaggaaccagcccuggacaggaugccaucccaucacagggcacacuaacagauacccaccucagaccggggcuauuacaccaaugaaccuaacuuguacaucuuuggcaugugggaggaaacuggaauacccagagaaaauccacacaggcauagggagaaugugcaaacacaguggccaggcugggaauuuuuuuucccuuaucaauuuuguaaugaaaugacauuauuugaggaccugcuguauuuuuauuuugguuuuaaguccuuucaauaaauuuuaaaaguguucucuauaaaggguuuuuacaucuuuuauuagauuaauuacuaaguacuuuuuguuaguauauaggucauaucuuuuuuacaauagucuucuaauuauuuguugcucuuacagaaaaaugcaacugaguuugcaucuugaucuuaaaucuagccauuuugcuagagauccucucauuaauuauaauacuuuguauagagauuccuuuugguuuuccuuguggacagcuaugugaucugccaaugacaguuuuguuuuguccuuucucauccuaaugccuuuuuauuguuauguuuuucuaucugggaccuccaggaaaauguggauaucgugucuugauugaccuaaggaaaggcuucuaccauuucaccauuaagccuguguuugcugcaggauuuugguagcuagccuugaccugguugaagaaguugucuaagggucauuuuguucucucacucacucaccacuuagugguggauggugucgggaagaaaccuguuucccagcuaaauaaacaugguuuaaauauuagagcugugaagucuaaauuuuuauaugauauuuuuucuauauauacaaagaauugauuuuuguauaucaauuaccucugaaauccugaaguucaaauaaacuaaaaacuucaucauucccuauuaaauucaggagaaaugaaaugcucaaagaacauauacaugauuguauaguuuuaaaagccagcaguuucuguguaguucaauauaaaaaauguuauuccuuuugaaaauauuggaaagggaaagugucagacuuacuuacuuuggguaauauaucuucuucauauauauauauauauauauauauacacaaucuaaauucgaagagagcaauauuucuauucauguaaaugccauacacauuuuacucaucaaggccuucaaauaaguuucacaucugacuuuuacauuaggccuaagccaaauguauuuucauuuguuuuaguucauuucuucuguuucaguuaauuaguuuauagggcauugggacuucauguggcugcuuugggcaucuuuuauuuuuaagaauuuaugauuuauaaaaauuauagcauuuauaguuucaaaggaauuucauauauauuuucuuaauuguuuuaaacuuuacaaaaugcacguaaggcuaggauuucuguuauuuuuaaauuuuacagaugagaaaaugaaauguauuuagccaauggcuaagccagaaauggaaccucagucuucuaacucuaaaugguauuauaauaugcuuuaccacuacaaaucuuauuaaauuauuuuaguuuaccaaguuaauacuuuuaaagaauacacugucaaauuauugauucuuauugugugaaaaagccaaauugaacaauaaguauaaauacucuuaucuuucaagguauuggaaggcauagguuucuacaaaauaaaaaguguauauuuuuucuuuuuuucucauaucuuucuaaacuaccgauuuaaaaacauuucuauuucugcauuuccauuggucccucucaugugcuuguugaauuugguaaucccauuugagacagcuccuuuaacaaugcugucacaguucagggagccuuggcaugacacacguaacccuucugugcgguauucucucuggcauugcauucuuacauuacauucucucuggcauuacauucuuucacuuuccauuuuguacuuuucucuauugcuuuauuuguauguaauguucugaaguccaaauaacaaaaugucauuuggaaguuaugugaauuauuccuaaauuacauaaauguguuuguaaggaguuauugaauuguuugugauggugauccaugaaauaacuaagaaaauuuauuugauuuuuuaugauuucagccaaugaaaaaguauauaaaacaguauaacagacaccuauuuacccaucacacaaaugucguagagauugacguuuuguaauauuuaggaguuuuuuaaguaaauaaaaaauugcagauacagcuaaggucauacguaauuaacugcuauuccuuuuucuccaucuucaucuccuaaccuacaugguaaccauuauccugauguuauuuauuauccuuaugcaugguuuuuauucuuuuguuugacauacauauauauauauauauauauauaaacuaguagcauauaaucauguuuuguguauuuuaaaaaagguacauuaaugucucacugagcuuaucuuaguauucugcauuguaaauaauuguuuuaacaauuguacaaguagaucuauuuauuuuccucacauuagacaauuagauuaucucuauuuuugucaguuaugaauacauacaaacaauauuacagugaacaguuuuauacaugccuuuuugagcacuuguauguuucuuggguagaugcuuaaaagaggaauugcugggucaucuagaccaauauacacaaucuuuaacuuugcuaggcguuuccauauugcucuccauaucuugacagcauacuguguugaaaagacuguccuuugucuacugugcugcagugucaccuuugucauaaaucaaggaacuguauacaugucaaucuguuucugugcuuuccauuccacugguuagauauguaugucauugugccaaaucacacuacuguaauuacuguagcauuauaauacugagucauccaguucaugaacaugguauauuccuucauuuaauuaggucuucuuuaauuucuuucaauaauguuguguaguuuucuguguagagacuugcucauuuuguuagauuuauuccuagguauuugauuucuuuugauacuaugguaaauuguaucauuaacaauguuuuauuuugaauuacagguugggcauuccuaaucugaaaaucuaaaaucugaaaugcuccaaugagcauuucuuuugagcaucauauuguugcucaaaaagcuuuggauuucagagcauuuuagauuuuauuuguaaugcaaauauuucaagauaaaaaaaaaauugaaauuggaaacacuucuguccccaagcguuuuggauaagugauacucaaccuguauuuguugcuaaaauauaggggaaaaguugauuuuugaauacugaaguuguauccaaaauucaauuuuuauagauuuccuuggauuuucugggagcacaaucaugacauauaggaauaaugaguuuuauuauuuacuuucuagcccuuauaccuuuuauuuuuauuucccucuccugcccauuuguuucacaagugaauguugaauuuuaucaaauacuuucucuguguuauuggagauaauuguaugguuucuuuauucuguuaauguggugaauuacauugauuggcuuuugauuauuaaaccaacuuuguauuccucaaaagcucuaaaugguuuguauaaccuuggauugacuuauuaauaguuuauuaagaaguuuugcauguauauuuaugggugaaauuggucuguaauuuuucuuguaauguucuuuucagguuugauaagauauccaaaucugaaauuauuugggaaaaauucuuguuuuguucucuggaagaauuuuuguaauauucgugcuauuucuuucuuaaauguuugcaagaauucaguagggauguucucugcauuuagaguuuuucuuguggaagggcuuuuacaaauguaauaaauauaggauuguuagauuuucuauuucuugugucguuuugugauuuuuaaaaaaggagauagacauauuaaaaaagagauuaaaaagagauuaaagagauuaaaaagagauauaaaauauuugaucaugccaauauuugauuguuuuaugacaggcuuauuuuuuaaucucuguagaauucauuuuauuuuuaucauuauuuuuaucauuguuuuaugacacgcuuauuuuuuacucucuguaaaauucauuuuauuuuuaucauuaguuuuaucauucugcuuauaccaaacuacuuuccagguucuuauuguguuaagcucuuucugucacaagaaacacagguauacucaaguuccuucaaguaauggagauauauuaggugcaauauaaagccauauggagccuuaagagaaaggaauuacacaggaagagcaggaucucuagcacaguuuggcauuagggagacuggaaauguguggcuaauuagaauaugauacagcuuuagggauggaacagguuuucuuuuuaucccccauuaguaacauguuauaaggcuuuacuuugauacccaguuguuugugugaaguuucucacuuccuuuuggcuuuugucuaucuuuucuuccuuucauuacuaauuacccucuuuaccccuggucuaaauaauuuuucaucauaccuuuuauuuucucauaacuacuuacuuaugauccccagugccuuguggccugguucugugauucuuuuuagccucucuucaaguuaccaaguaauugaaccucacugguucucaguuaacucccaaaagauuauuugauuggccuaguuugagaagcuuuuaugcuagcuaggcccauuggcugguucuggcuuuuuuuuuuuuuuuuugagauggagucucacucucacccaugcuggaaugcaguggugcugucuuggcucacugcaaccuccaccugcuggauucaagugauucucaugucucagccucccgagaacuggcaucaucacacccagcuaauuuuuguauaguugggguuuugccauguuggccagccuggucuugaacuccuggccucaagcgauccaccuccuuggccucccaaagugcugagauuacaggugugagccaccgcgccuggccagcuuggcuacucuugaccagggagcuauugccaaaaugugggauucacauagcccagagcauggaugcccugggcuaacuccucugccaagggcuguaguuggacaguuucccuuagcagggguguguaccuggaaaauacuauaauugaucaguacagauaaguccuagaaaauuaaguuguugcaagaguuacaauucugccucguucacaugcuguggugaaugcuaguaaauaauuaaaugcugguaaaccaaugucuagaauuugauguuauaucuuuuaguagucaucuaccuauaacugaaaaauugcugccaaaaauuacaugugcugccaaccccaaauagggccaugggcaaauagauauguaauaccuguuguuuuaagauggacaaauggaaauugauagucuuuaaacauaagcaauagggagaauaugcacauaggcagauuaaaaaaugcuuaaugagaaagccauagcaguuauccacuucuggucuuauuuccuuuuuaauacccaggaauagcuguguguacugcuaagaauucacuuuucugcaguaucacacaguucagguugaagacagaggaccgcuuuccuuuugugauauuuaugcuacaaaguaauguuuugccuaaugcauuuccacuuaugagauaaauuguggauauuaucaaaaacuuuucugguacaauaagugaaauuccuuucuaauuuucaggaggacucagagagaguaaugauaauuaccggaccaaacauggguggaaagagcuccuacauaaaacaaguugcauugauuaccaucauggcucagauuggcuccuauguuccugcagaagaagcgacaauugggauuguggauggcauuuucacaagguaaguacguuaauucagcuugcauauauucuugaaaauaagucaagcccacauuaucgcaugaauuuuccuuuuguguacauauuuagaugcucuuaaagcacucaacauuuaggagcuuaaauaaauuauuucaaggccgggcacgguggcucacaccugugaucccagcacuuugggagaccaaggcaggaggaucacuugagucuaggaguuugagagcagccugggcaacauggcaaaaccccaucuugacaaaaaaugaaaaaauuagccaggaaccugaggugggaggaucaccugagccuggggagguuaaggcaacagugagccgaggucacaccauugcacuccagccugggcaacaaagugagacccugucucaaagaaaaaaaaaaaaacaaaaacaaaaacagaaaaaaaacccacguuauuuuuauuaugacuguuaauacuagaaaagacuuaagaguuaauuuuguccaauagcuuccaaauuauuuuuaauuauugaguuauuuuauuuuauuuauuauuauuauuauuugagauggaguuuugcucucguuuccuaggccagagugcaauggcacuaucucagcucacugcaaccuuugccuccccaguucaagcuauucuccugccucagccuccugaauagcugggauuacaggugccugccaccacgcccagcugauuuuuguauuuuuaguagagacaggguuuugccauguuggccaggcuagucuugacuccugaccccaagugagccgcccgccuuggccucuccaagugcugggauuauaggcgugagccaccacacccagcugaguucuuauuuugaagaaaaucuuuuguagaaaaucaauauuuaagcagauaaaaacagaucugcucugucuucugggguagaaggcuuggagacuuggcuguuaggcucuguagagcacagucugaaaacuuguccauccuccccauuuuaggugcagaccugaaacaaacugcaaaaggcauuggaccaagaucauuuuguugauaucccuuuuuacucuaugaacauuacaugcaacugacuaagucuuacccucaauguguaaaccuaaauuuuaugccguguuaggaauaugagugaaauauccuggcuucacuaaggagaauucguaguuuaaucuguuuaacaccuucugauuuaucaguucuuaaagcaucguguauauuucuuacauguacauuucuaaaaaguaaauacagucucugugcauagucaagcuuuguguauagagugucuugaguuguuguccagcuacguauuuauauaauauuugacuguggaaucacaucagaauauaucacaugcuaauauugauauucuugaguagacacuaaaaugcuuuaaagcuucauuuuucaucugagaaugaacaaaguacccugaauucuguuugaugccaugucaccaaauagguguuauucugauccccauauauguuuaaauuaacucaaaauaagaaauuuaaagagucuuucuuuaguucuuaagacuuaauugauuuucuauuuuauaagaaaaacaaaccagguauuuuauuuugguuacaguauuaaggaaaguagcagagauauuuaguaaagaaaaaaaaaagagaaaaaagaaaaaaauuauuggucaauauaaggggauuugccuggaaggaaaucuuguuacugagccgaauagcaagaauguuuguagauacaaguaaaauaaaagaaggguuuauuuuugucauauaaggagaaggcuggagguggguagcuacuucugguguuucaguggcucugccauuucacuggccuuucccucagaguuguaagauugcugcugcagcuccaggcaucacauuccuauucacaugagguaaaaaggagaagggacugccauagcucccccacacccuuuuuuuaaaaaauuuuuuuaggacauaguagguuuuuaggauccucccagaaaacuuaccuuucacugaccagaacugugucucauggccauaguugcaaggaaaacagaaaauaagaagguaguuuuuguccagcuuuuaaauagaguuaagcacaguaauugggaauacaaucagugguaaucagaaaauaguuucugucacaggguguggaaucaguaauaauaguaacagccaaccuuuaugauauauuuacaauauuaguguaauauucuuaucaagguacaggcacuguuaugugcaccuuauauagaguacuuuauguaaguacauucaaugaguacaugucuaagccuucuaaaccaugcugauuucaagaaauuggaguauuuauccauucauuuucauuuauucauucauccaacauguacuaagugaauaccuaacauauggcaggcacugagaauacaaaggaaccacaguuuuugauuucaugaaagcuauguaguggagaaaaucagcauuaaccaaauaaucacauacagaaaugugaaacugcagcuaugacaagucaaugaaggcuauaugcaagauguuaggacaggcugugauccugauaugaucuggucaggaaggucaggggaaggcuucccuuagcaaguaacuuuugagugccuaucugaaggaugaguguaagaaggaaggaaguauauuucagagagagcaugugcaaaaguccuuuagcauaaaaaacauagacaaugagugaagggugguccuccaggagagcaagauucuaggugaagcauagccaugucauuuuaggaguuuauccuaagagccaugguaaacuauugaagaauuuuaaccaggguuuggcaugauuaugucugcauugguuacacuguaaagaaugucuggagaaaaaaccaaguagaucagaggaacccaaagagcaggcucuuuugguggucuuggugaaaggaucaguaaguagcuuggauuaaguuuguagugcuaguuuaaguggaaaggagucauauuugaaauauauuugggaaauaaaucaccaggacuuggcgauagauagggguauggcagcugagauaaauggaguugucagagaugacauugaguuugugcaucugaauggugaauggugacauuuacuagaagaggauguuuuuucauagauuccgacguuaucuuuguguauaauaaguagaauuauucugagacauucaaagggagcuaucauauaguaggcaguggauauaaaguuuagauuucagacagagagaucaaagguaaagauguaaauuuguugugagacauuuuuguguacgugauuggguguggaugagaucaucuugacagacaguaugguggagaagauuaauguucugagacugaaccuuaaaacugccaagauuucauaguugaguaagaaguuaagguugaaaaccaacaaaggagguguagccagagaggcaggagagaaaaacaggacauuacagugucaugggagcgaggggaaagagugcuucaagaagaaaaguaguggucaacagugcugaaaggucaggugaguugaagccugaaaagucaccuuuggucuuagcaaaauagcugucacuaaugaccuuagcaggagcugcuuucguggagugguggggccacacugcaguuaaaagagggcuaaagagugaguuagaggucaggaaguagaggggguuaguacaggugauacugcaaagguuggccaggaagaagacaggagagauccagugagggacuuguuuuuuguuuuuaaaugguagacuugaacguacuucaaugggauauccagugggauauguuauuuccaagaauuuauuauucuaaaaauaaauaaauuaauuaauuaaucaccuuuggaggauccuagaaugaauccuaaugauacuuaaaaucaaaauaucauuagucacauggagguugaaaacugaaaaauaaagauccaagcagguauccuaucuuuucaaauagguaacggggaaguuucucuuuauagaaauguuccagccaauaaaccaagcaggaaugacaagaauuagaguaucacccuuuuugcaaccccugauguaauaacagauuuaaguaauaaucagaaauggcugcuaaugucaccaaagcagagacaaccagacauuagguaaaaguuugugacaacuuaugaugucuucuggccaaaaaaaaucaaacugaauagucgggcaugguggcucaugcuuguaaucccagcacuuugggaggccaagguggguggaucaccugaggucaggaguucaagaccagccuggccaacaauggccaacguggugaaacccgucucuacuaaaaauauaaaaaauagccaggugugguggcaagcaccuguaaucccagcuacuucagaggcugaggcaggagaauugcuugaacuggggagguggagguuguagugagacaagaucacgccacugcacuccagccugggcaacagaggaagacuccaucuaaaaagaaaaucaaacugaaacuguucagaccucuagaucuagauaccaauuuacaagagaaaaagagaauagaggaacauguuaaacaccaccauagggguacugucagcaaaaucuagacugugggaaacuauaggacaaaugacugguguuuuuuuuuuuuuaacaaauaaauagcaaugacaaaaaaaaaaaaaaaaaaaaggugggggagagagggaagagaaccugcauauuaaaagagaguuaaagaccagucacccaguuccaacauacagaucuuaauucaauccugacucaaacacauaaaccuuuuuuuuuaaagcacuagugaaacauuuaaaaauuuuugagcacugacaggguaucuaaugauacugaagaauuacuuaaaaaaauguuuaagugagauaaacagugcaaugcaaugguuaugauuuaauagaaaaauccuuacuuuagugauacaugcuaaaauguuuacauauuaaaugauuugcuacccaagauauacaucacaauaaucaaggauggauagggaaauuugguaggauagagaugaaaugagauuggccaugaauugaucauuguuugagcuugauaauggcuacauuggaguugcauuaugcauuuuucuuuauuguacaucuuuggauuuuuuuauaaguuuuuuuguuauuguucugggauuuagccauuugagaaagagauaagaucccucguguaggauaggcauuguuucaaacugugcguaugaaaucagugcauugaauugcaauuagcauuuugggguaauacuuccuagauagugcuuuguguuccacaucauggcauaucagggugcaaccaauguccaguugacccaaauaagcuuuuuuuuuuuaaugcaguagaauggaguagaagaaaaaguaucaaaaucauuaauuuauagcauguggcacagagguggaguuaugcaauaagaaggccauuacauuucugugucaucaguaaugacauagaaauuauaauguuauuaggagauguuaacauuggcccaauaaugagauuuaaacucuguugugcuaaaaacauauguauauauaggacaagucacccaguuccccauauauguguguguguguauauauauguauauauauguguguauauauauguguauauauguauauauguguauauauguguguauauauguauauauguguguguauauauauguauauguguguguguguguguguguauauauauauauaauuuuuuuuuuuuuugagacggaguuucgcuccugucgcccaagcuggagugcaaugacacgaucccaggaucccagcucacugcaaccuccgccuccuggauucaagcuauuuuccugccucagccuccugaguagcugggauuacaggugcccaccaccacacccagcuaauuuuuguauuuuuaguagagaggggguuucgccauguuggccaggcugguuucaaacuccugaccucaggugauccgcccgccuugaccucccaaagcacugggauuacaggugugagccacugcgcccggccaaaaacauauuuuuauuaaaaccuuagugcacuguaguuuuaugcuagacguuagggauacaaaccugaauaagauaauuuaccugucuuuaaggccauagggccugugucccugcauauucuuacugaguaugccaagaaagccccugucuuuaaggagcucaagugcaguaagggagauggagaagcaaaucuuuacaauucgguaagaccaugcaaugcuagagaaguguauguguauacguguuuauuugcuugcucauuccuucauucauguuuuuccugucaucuuccagaaaggaaugagacagcuugcagaaaauucaaaauagcuuaagugaauaaauaaggaugagggcuuaaaauggagccaugacugaggcuuaaaacaucaaugcccaauacugcuguggauaagccauaaaucugguucaaagguuuccacaaagcuaaauuuguucaguuaaauaguucacagugcccagaaagccaaaugaauuaauuaguuaagaaggcaacuuaaaacaaauuuuuauuguguuugacagcaaucuuuuaguaauaaaaucagcuagaagaauauauuggguaguaucacacagacuagguuuuauugggucccauugguuacaguuuaggaaacaaauguuugauuauauuauucuuggaucacaggcuccacugagacagaaauugugcuuguucugcacaccuuuuauccccuauuccuaguacuaaguagaugugcaguaaauauuuguuuaaaaacugacaauaaaaacuguaauauaaauaagauguguugacauaacucuguuucuuaguccaaauuucuggaaucugaaggaaacauccccuugugauucaaacaccaucuaaaauaguauauuggagcuuaacuaaguuuugccacaggacucaaaaagucaucaaauuucuauguaaguuucggucuuauaaagaaaacacuuaaguuuagguauguggcaggauaaauuauuaauacacaggaaagagcaaaaguuccagugucauggagauuagucuguccugacaacacucuguguaccagugcaccuuugugaugcugaguaagaggagauuugcacuucacgaagguccagguuaagcuuaguugcucagucuggacucuggucccuaaagugggaagucucaggcaaaucugaguaucagaccaugccggcaauucagcucucuucaccugcuucucucucugcaagaugggauaaucaugauacuuauauuucaggguguugucauguaguuuaaauaaugcauauaaaacaaucuaguaccugacauauaguaguuccuugguaauauuaguuacaauuuuaagucccaucucuaugacacuuugaccauuucauuccacaaugaucuguucacgguaaacuccuaaugcccuauuuauuuggacucaguuauuucagugucuuauuucaguaucuaucuuaguucauaacugguuauccuaugccaucaugcuauuuguucacuauuugagggaaagaacucuacuccauuguguauucccugccccacucaggauggcaguaaguacagcuacuaauauaaauuaaagucauucagaaaugaaauuauuuucacauuuauauuacauuguuuucacuucauccuggaaguuaucauuagucugaaacaaacccagagauacugaucccauauuucaaaauugaccacaacuuuaaagcauuaauuaauuaauaaagaauuacacgugccaguuuaaaaagaaauaugcagauuauagagauuuaaauacugaaauaugggacauuuuccugugcucugccauuugaguagcuguuaguuuaucaaccuucaggucauguuuauagaagcacucugccacagggccugugucccugcauauucuuacugaguaugccaagaaagccccugauugcuuuuuacaugggccacuuauuugucaaaguugugcuugcagcaaacaaccuggagggauaaguuaauucuccccuuaaagaggaagcuugcuucccuuguuguaugcacagcauccaugguacaucacccucacaggacuugggggcuaauguaaaccaacaugaguaauaaaguccuuugucucugacccaguggccuugugucuucugccguuaucugugaaaccagugguauuaggguaaccuguuagcuuuuaagcagaguaaaauccuagacuucacacaguuuuugauaggucaauaggauucucagaucucuugcuaauauuaauuaccugcaaaaugugaguaaaccggcuguguaugggaaagaauaggggcuuuagaucuagaaaacucaagauucuguacaaguucuccagcauccuggccaugugcaaguuacuucauccuucuagaacccugagagaaguacugugccauagucaagagaaucagacauguuauacuugagcacaaaucuugcuuuucccuuuuaacaacuaugugaccuuuuucaaauuacuacuucucagugucucaguucuuuuccuguaaaauggaguugauacugcuaacccucauauauuauugugggaauuaaauaaaguacaugaaaaugccagacacauuguagguaccuaguaaauuuuaguuuuuuuucuuccagauucuaugccauuaguauuuuagauuuaaaagucugucuucauauaugugugaguauagugcucacuuuucuaaacuuagcaucgguuuuugcaccuauaaaacaaaaaguucgauaauaccgacuucacaagguugauuugagaauaaguuuugaaaggaugugaaaucacuaugaagugcuucucuuaguuguucucauugaaagaaguugaccaaaucuaaucucccugacacuuucccucuuggagcacuguggccauaauagaauugagaauccaggaaccuagaggcaccacccacacagaaugggauaauggcagugccuuuccuucuguuccucaggaaguggcuggcauggaagguggucucauggaagaugcacauccuccuccaugcugagacaugccuuuaucucaugacucaggaacagccuuaaggaacuggcccaauugccaaucacugugugaaagaacaaccaccaaauuuguuguuucagcauaguaggauucauucucaauuuauuccaucaaacauacuaguuuuuuagcuacuucgggauauauuuugcagugacuugguccugguggguaguguuauguggaaagauacgcuuguuacaauaugugaaaaagagccaguuacaaagccuggcauucauuucacuuuuguaugaguaauuguauguauaaauauauguggagaaaaccaucuagauagaaggcuuauuccaaaauaccaugggggauauggcuuuauggucauuuuucuuuuacuuauguaaauuuuuaaauuucuaaaauaaaugugugaaaaaaguaaaaccuccucacccucacaaacuaccaguauuggucaaaaugagauguuuuauaggaaucuggugaaaugcuuacauggucacugucugacaacucuuuuuuucuggggcaaauaucucuuuccuacucagggacguggaauuugggguuuuaagcuuuagaccauccugggcacuucaauauaucagaccuuacuuguccacaaaguuuuucccagacuauaaguaacccuaguucuucuuccuuuaggaguugauggcauucugucugggagagaauacaagauucauguauuuaauuuucauaauaaaaacacugcucauauggcacucuuaaucuucagugcacauuaaauuuuuuuuuuccauggagcuuuaaaaaaaauacugaugccugaacccuaccuccagaaaucuuuuuuuguuuuguuuuguuuuguuuuguuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggagugguaaugacucuuaaugagcaugcugccuucaagcaucuguuuaacaaagcacaucuugcaccgcccuuaauccauuuaacccugaguggacacagcacauguuucagagagcacaggguugggggcaaggucauagaucaacagcaucccaaggcagaagaaucuuucuuaguacagagcaaaauggagucuccuaugucuacuucuuucuacacagacacagcaacaaucugauuucucugucuuuuccccacauuucccccuuuucuauuccacaaaaccgccaucgucaucauggcccauucucaaugagcuguuggguacaccucccagacgggguggcggccgggcagaggggcuccucacuucccagaggggcggccgggcagaggcgccccucaccucccggacgggguggcggcugggcggaggcgccccccaccucccucccggacggggcggcuggccgggugggggcugccccccaccucccuccaggacgggggcugccccccaccucccucccagacggggcggcuggccgggcgggggcugccccccaccucccucccagaaaucuuaaguuggacuggggcauggucuggaagucacauuuuaaaagugucccagaugauuucaaagugaagccaagauguggaagcacuuccucaagcccucgcuggagaaaucauguguugaauuauaaaaauaauaggugcuuauuaugaaauguaacagguguacuaggguaugaagugaaacaaaaacaccccauucuccccaggucuaccauguuucuuuagguaacauuucacaagucuacaaguauacaucuuuucuuuucuaaaaugguaucauacuaagcauuacuauuguauaacuugcuuuuguuuccuaauaugugggagacauauuucucuaucaguuuauacagauuagucgugcucuuuuuaaugacugcaguguaucuggaguacagauacuccuugauuucuuuaaccucugagagcuccgucugggacagacugcccuuuaguauaugggacauguucccuauccauuccacugugcucccacaucuuccuguuguuaccacuggaaaggaaucuacauggacuacauuaaauuuuaucccuaggauauaauuauaucccauuaaauuauaucccuaggauauaguuuaauauuacgcccuuguagcuuucauugauuuuuuaugaaauaauucagacguauaauaauccuccaugcaccuucuacccuacuaaagaaauaaaacacuacaauacaaucgaaccucuaauccucccuaaucccauugcccucuacccuauccauaguaacuaacugguuguccuugacuuugguauccaucccaugcauuucucuacauuuuuacucacugauguuuuuugaaacaaugcauggaaguauuugguaugcuuuuaaacuuuacacacaguguaucacacuauauucuucuguaaguggcuuuuuccccccucaguguuauauauuuauaaaauucauauggguacauauacuuugaguucauuaauuuuucccuaauuaugauaguuuauuuuaugaauauauuacuauucccucauuuuucuugauaugaugccaauuuuuugcaaauauaaacagucauauuugugacuugucucauacucaacuccuagugcacacaagggaguuuuucucaaucuaggaguggaguuguuggauuguaaggaacaugugucuuucaugaucuccaaggaggcuguaccagcuuagaaucccaccaccaguguuuaaaaguuuguucucaugcuuaaaauagauuagaauaagaaauguucauuugaugauauuucuauauauucuccaaaauugcucauaagaacauuuucauuuuuauuacuuaauguccuucacaugaagugccaucugguaaauuauuuuuuuguuaaugcuagggacauuuuuucucuccaugugcauacugugccuguuuacaaaaagauuugaagcaauuuauuggccuuuucugacaaacugccaggcuuccugcuaucagccaguggcugcuuccucuuuaauuccuuuuugucuuggcugccaagacagcaagagcuaaacucaaggcucagguguggaaacaaauuuggcuuaguuuuccccuucgcuucuuuuaugggaguauuucucuagugucauucuuagaacagcugcaucagaaucuuggcggugcuaguuaaaaaugcuacuuacuaagcccuuucacacaucuuuuuaauuggaaucuccaaggugguacacaagaauuagcauuuuaaaagcucaugcuaagcuuaaauguaagaaucuacuguauggcuuguaaucuuaguuucauguaauuguuucauuagaauauguuauuguaaaucacuucaaaugcuuuuuguacucaauggaaaaaauauuaaaaucuagcagaaugagauauuugcauaagauuuagcuccaagcuguaucuguaaauagauucuauuaucaauuggccauuuagaacacuagguuuaaaucuguggauuccauaaauauucauugagugcccacuaugugcuauacagugugcaagaagaagaaguaaauggaugaaacgcuauaaacagacaggagguuaggaauuuuuuuuuuuuuuuuugagauggaguuuuacucuuguugcccaggcuggagugcaguggcauaaucuuggcucacugcaaccucuaccuccuggguucaagcgauucuccugccucagccucccaaguaguugggauuacaggcaugugccaccacgcccagcuaauuuuuguauuuuuaguagagacggaguuucaccacauugggcaagcuggucucgaacuccuaaccucagguaauccaccugccucggccuccagaagugcuaggauuacaggugugagccaccgcgcccggccuccagaaucuuuuaucugaauacuauaaccucacaugaaucuuuuccugaauaagaagcagauuuuuuuaaaaaguagaguuuuggcaaacacauacauuuguuucuaauggauauaucugugcauuaugauauguguacucaucgaugaaauauuucuagacccauauuuccaaggaucauuaacauccuugaaugcaucacugagauaagaucuguuuauuaucuugaugaauauaaacuuaaaucucaucuagccuuuuagacucaguaauuaaguuuuagaaaagcaaugaauuauuaagucucauuagaaaacaguuugaaaaaagcaaaacaauuggccucuucucucagcauaauuuauuucuauuaaacguuggugauuaagcguugaugaaaagagauauuuacucgauguggcccauagcuaacaauuuucaugccaugcuacuuacacaaacucccucuucugacacccagcuucagggaauucuguguacucagaguggcacgaguguguuuuucuugaaagagaauuggaagauaauagacauucaaguacuuaguaacuuauuuguuugcccaacuuaguguaauucagaaaauauugagcacugacuguggaguauuuguacucuauacaaaauauauucuuuauggacagaaagaaaacaucuugaaucaguccacaccuucuaauuaguuguaaauaccaguacuaaaauccacaugauaagugagcacuaaaugaguaaguuguuaugauuuuauuggcauuaaaaaugucaucuuaucaauaucucugugcuuucuuuaacugugucuagcaaacacuaguuaucuuauuucaucuuuuucaugggaaauuauuuuaugaauuuaaggcuuguuccuuuaauuagcuuccucaaagucaccugaagguuugguuugauuugguuuuaaaugcaaaucccaggcaaaucuucugauugaagauccccuggagauagauacuguuguaguagguaugaugaaggaggccuuuagacacuauuuuuuuaaaaaagacuuuaauuuuucagagcaguuuuaggcuuacaccaaaacugagaggaagguauagagaguguccaucuacacuuaccacugccccugcacagccucccccauuuucagcaucccccaccagaguacucccuuucuuacaauugaugaaccuacauuggcacaucauuaccacccaaaguccauaguuuacaugagggcucauuggguaauugauaaacaaaguaaauuuauuacaguucuguagacugggaaguccgaggucaaggggcuacaucugguaugggccuucuuacugccucauaaaauggcagaaggcaucacauggcaagggggcuuacuagagaaaaccaaacuggcuuuuacaacagacccacucuagugaaaguaacccacuccuaugauaacccauugauucauuaccccuuaauccauuaauccccaaauggauuaauccauucauaagggcagagcccugaugacccagucaccucuuaaaggccccacuuaauacuguuacauugggaauucaauuucaaugugaguuuuagaggggacaaacauucaaaccacagcauucugccccuggcccccacaaauucuauguccuucucauauacaaauacauucauuccauguuuauagccccaaagucuagagucucaucgaaucagaugugaguaaugcucaaaggacaauucaucuugagguaaauuucuuacagcugugagccugugaaaugaacguguuaccuacuuccaaaauaaauggugggacagguguaagacauucucauuucauaagggagagauaggcaagaagaaagggguaacaggucccaaauaaguccaacacccaaaggaaaaacuaagccuugaggcuccagaguaaucuuccuugguuccaugucuugcuuccuagauacaccagugugaggauuggaucccagggccucaggcagccccaccaccuaggcuuuccugggcucucccaggcuucaguucucacaaguaacagucaagugccugcagcuuucccaggcuggagcugaaugcuggcaguucuacaguucugagaucucagcgagguucuguucucucugcuccacuagacauuaccccacuugggguugucuguccuggcucuggcucugaccccacauuuuugcuuggcauuaauccacgaauggauuaauucauuuaugagggcagagcccucaucacccaaucaccucuuaaaugccccaccucuuaguacuguuacauuggagauuaaguuucaacuugaauuucagaagggucaaaauuugaaccaaaguacuguuuauuuccuuuuccugucuuauugcauuaacuaguacuuccacugcaguguugaaaaggagugguaagaggugacagcuuccuauuuuggcugauccuaguuggaaaagcuucaaguuucucaccauuaaguaugauguuagcuauagguuuuuuugugaauauuccuuaucaaguugaggaaguucuccucuauucuuaauuuacugagaguuuuuaucaugaaugggugucggauuuuaucaaaugcuuucuaugcgucuguugauaugaucaugugauuuuucuucuuuagccaguugaugugauggauuauguuaacuggugaucaaauguucacccagucuugcacacuuaggaugaguccuacuuaguuauggucuguuuuucuuuuuauacauuguuggauucauuuugcuaauauuuuauugaggauuuuugcaucuauguucaugagagauauuggccuguaguuuucuuauaaugccuuuguccgguuuugguauuaagguaaugcuggccuuauagaaugugucaggaaguauucccucugcuucuauugucugaaacagauuauagagaauuggucuaauuucuuccuuaaauguuugauagaauucaccagugaagccauuugugccugguguuuucuauuuuagaagguuaauacuuauugauucaauuucuuuaauagauacaggccuauucagauugucccugucuuuuugugggaguuuugacagauuguaucuuucaaggaaucagucuguuuuaucuaggauaugaaauuuauggccauaacacuuuacaguauuccuuuauuaucuuuuuaaugcccaugagaucuguggugaugucuccucuucuauuuuuaauauuaguaauuuguauccucucucuuuuuuucuuagccaagcuagaaauuauuaauuuucuugaucuuuucaaagaauuagcuuuugguguuguugauuuuucucuauugauuuucuauuuccaauuucacugauuucugcuguaaucucaucauuuauugucuucugccuacuucagauuuaauuuacuuuccuguuucugguuugcccuugaacucuuauuuuuaagaaucucuacaagugacucugaugcacaaauuuaggagccauuguuugcauuuuaauuucuaacauuuuauaggaagaaaaacaggaucagagagagauuuuguuuugcaugagguuauaaugugugcaguuuauaaggaugcagccucugguuauauuggguuccccuguauucaucuuauugauuuaucugauuaauuuuauccaugaugacagauuaaucuuccuuugacaaccuuaauuauguguaguuuuccuagcuauaguuaacauugagugaaaucauuugcucuguuaauuauuuuucuuugcaguucuugggacuuucccacaaaguggacuacuagcuauguuagaggaugaguugcccagucagcacaguguggauuuucuuugaaggaaaauaccuguguccuucguaaguguccuacacaugcuuuauagacagggccagggaacacugucaugugagccuguagaaauuuagaauuuuucuggauuguucucuugauucucaucaguguuuccacggaaauugaaagauugcuacaguggguuuugcuugauuauaugugcaguuuaguauuauaacuuuuauaaauaaacuuuaaauacuguagugugaucuuauugcaaucauuagaaggaaggauuauaugagagaaacuuuuuuuucuauuauaauacacaugcuucucaaguuaaaaugggacuaugcccugauaaacccaucauaagucagaaacaucauaaaucaaaaaugcacuuaauacuccaguaagcucguuauaaaauuuuaaaauaauaagucagggauugucuguaauuuuacuuaugcuaauaaauguuuuucauauugcuagaagaaggcuaguuauuucugccuugucuuaacagaaugauacgauauaauucuuaaauguaucauuugugauuuuuaaaaauaacauuuguuuuucuaauuacacaaguaaugcauguucauuaugcaaaauuuuaaacucaaaauuuuuuaaucacuuguaauuccaccaccuggagaucauuguuguuuagguagauggcuuuccaggcuuuuuuaaagugcacauauguagugguaaaucauuuguaauuucauuccauuucugaguuauuguuuauguuuaauuaaauacaagacagauuuacuaauucacgcuuuuuaugccuuuuaaauaccauauggugccuacauaucuuuuaguaauugguauucucuuacagucuuuccucuacuuggacuuuaguuuuuugggguguuuuucuuccuuauaccauccuucuuaaaaguuagaguacuuuguuaguuaggagauuagcuaucuuuuguaaaauguauguaauauccaaaaaaaaaaaaaacaagcuuugacuuagacauccauuuuggacagaguucaaaguuuuuagcaaccugaagugaaugggaacaucuucaguuucagaaagcacacaaaauaaacuaacucuuaaaaccucuccagguugggcgugguggcugacuccuguaaucccagcacuuugggaggccgaggcggguggaucacgaggucaggagaucgagaccauccuggcuaacacggugaaacccugucucuacuaaaaauacaaaaaaauuagccgggugugguggcggggcgccuauagucccagcuacucgggaggcugaggcaggagaauggcgugaacccgggaggcggagcuugcagugagcugagaucgcgccacugcacuccagccugggcgacaaggcgagacuccuucucaaaaaacaaaaaaacaaaaaaacaaaaaaaacucucccauacaaagcacuuagaggauaaaucuauauuccacuuauaugagaugccuagaauaagcacauucauagagacagaaaauauggggaaaggggagaguuuuccaggauggggaaaggggagaguaaagaguuacucuuaauggauacagaguuucucuuucuguuucugaugaaaaaguucugcaaauggaggccuggcaugguggcucacgccauaaucccagcacuuuaggaggcugaggugggcagauaaccugaggucaggaguuaaagaccaggcuggccaacauggugaaacucugucucuaguaaaaauacaaaacuuauacagggugguggugcaagccugcaauccuagcuacucaggaggcuguggcaggagaaucucuugaaccugggaggcagagguugugguaagcugagauugucccacugcacuccagccucggugacagaguaagacuccauuaaaaaaaaaaaaaaauucuguaaauggaaaguagugauggcuacacaacauuguggauguuaauaccacugagcuguguaccuaagaaaugcuaaaaugguaaauuuuauuauuuuuauauauauauaucauaauuuuuaaaagcacuugaaguauguccaauaauacuguuguaauaggaauaaucauugccucuacuuaacaauuuuaauauuuaagcucuaguuaucauucaauaugaaaaguccucuuuuccuaauugcaguauuucucccuuauacuagcauuuuccuugcaaaaggcccagagauugugauuugaagggacagaagcccacuccauuugccugagagacaucuagaauauuaucucaaaauaguaagaucucauaaaaacaaacuguuuuucaaauuuccaugaaaguguuuuuuauuuuagaaacugacccaaaaaaguacuaauuucuuuuuuccacaaugcuuuauuaagcuuuguugaccuauauaaggguuauaggcgaggaggggaguagggggauuagaaagauuagucagcugccacuccuaaaaauaucagagugauuuuuuuuuuccuuaaucacauaacuguaaccuucugucuacucagggcaaacuaacuuuaagaugaaaccuaaagaauggauuuuucauuuuuuacuacauuugacuguaaauacagacagcuugauaauaauaacauaugcuguggaauucccuaaaucucuaacauauuuuaacaucauugucuaguauaguaugucuuauaaaugauuguugauuuaauaaaaacuauaaacuuuauuuauuuuuuuguuuuuuuguuuugagauggagucucgcucugucgccaggcuggagugcaguggcaccaucucggcucacugcaaccuccaccucccggguucaagugagucuccugccucagccuccugaguagcugggacuacaggagcgugccaccacacccagcuaauuuuuguauuuuuaguagagaugggguuucaccauguuggccaggauggucucgaucacuugaccucaugauccgcccacgucagccucccaaagugcugggauuacaggcgugagccaccucgcacagccaaacuuucuuguuaauguauaucuugucuugcuucuaaaacugauuuuaggcgugagccacugcgcccagccaucuuaggcacuuuacugagauauuuacaacauagcagaauaauaagagaagagaaugguaucaaagacucuggaucagagagaaaauaagaauugaauuaugauauaaagccagguauaagauguuauucaguuguuuucuaguaaucaagcuagaauaaauaaacuauacauuucuuaaaggaaauuaacaggaaauacguuuaucaauaaacaguucccacaauuauaaaugcauacuuccccaguagccuugaugacugguucaugagccaguauuucuucaguguguauucagcauugcuacuuccauugguacuacauccguaccaucaggugcuauggaaaaauagaauuguaauagaaaauguguuggcuccuaaugcaguggccuucaaacuacccuccagggugugagucccacagagccgccucagaauaacaggccuaauaguccuggguucuuaaccagagcaaacaucauucauuguaucuaaucugcagagugaauuuucuuauaaaauauuaaauauuuuauauuaaaauauauuuuaaauauuuaaaaaguucuacaaauggaaagcagugauggcuacacaaccuuguggauguuaauaccacugaacuguguaccuaagaaaugcuaaaaugguaaauuuuauguuauauauauuuaucauaauuuuuaaaagcacuugaaguaagucaaagaauccuccuguaauagaaauaaucauugccucuacuuaacaauuuuaauauuuaaacucuaguuauuacauuuuaaauauaauuaaaauauauuuuuaguuuaaauacuuaauaaaaauaaauacuuaaaauauauauaaauauaaaauaauaauacuuaaaaauaauaaaguaaaaauauuauuugaacaaaggauuuaacagcuaaaaagauauuuugaaaccucugaccuaguacuagagucaagaccauugccuaauaaaaguauguccaagaucuccugaacacuggccugcccuccuuaagaaagaaacccuauaauaccaugaggcauguaggggugacucaaaaaacuccaggccagaaaccagaacaccuaauaaguauuugucucuugucugccacagauuagcccugucaccuugaggaaguggcuugaccucugaaaugucuuaucucaucuauaaaauaggaguauaaaaugauuacuaagaacuuguccagcaccaagacuuuuucaaaauucuuucucuugccucaaagauggcaaagaaugugccaucagacaagcucuucccuucugucaaaagagaagaaccauuggagaaagaaaugaccaaauucuauguagagagcuugagcaagaagaaaaaauguaggggaaggguaaauagcucugucuagagcaauuggcuuuuguuguuuacagcuugucuaugucagaccaucccguaggaaaaguuugguaagaacaaagaccuuugauaaaagaugacugagagacugucugggguuugaugcaaagaucaucagaggcaucuacaaaugaguagucaccagugacaaaaucucaaagcgaggcaggcuggagaaugggcgaucuguuagucuugccagagaggaagguauuagcaaaggcagauugaauaagcggaagguaaaaaaauaaaaagcagcaauagcauuuuuuuuuuacauauacuucauuagcacagguuuggcuuuaccaauauaggaaaggcauuuuuacacuaauuaggucauugugaaaaagaaaaauuggaguuauuuuuuaaaugcaguguuuuuaacuaagaagaaaauaugagaccggguaugguggcucaugccuguaauccuagcacuuugggagccugagguggguggaugacuugaggucaggaguucgagaccagccuagccaacagggugaaacccugucucuacuaaaaauacaaaaacuagcugggcaugguggcacauuccuauagucccagcuacucgggaggcugaggcacgagaauuacuugaacccuggagguagagguuacagugagcugagauugcaccaccguacuccagccugggcaacagagagacugucucaaaaaaaaaagaaagaaaauauuaauacuguggagguuaugugacagucuuuaauaacaacaaccaguuauauuacuauaauaagcuuuccaugaaaacaccaaaaaguacuuuuugauaucuuauuaaaaauuaagauucugucauauuucuuagaauuauauacauuauaauuuuauguuuuuuagaauaaacucagcaauacuguacaaggauaucguaaucuauauggaagcacaaaggaacauauaaauuuaaauccuuuugcuccaugaucagucacuucuuuucauuuuaaacuuuaauuuuggacauucacaaaauuguuaacucuugagugauguggauugaguaaguuguauuacaauuguaaaaacaaaugauucauuucaacuuguauugaacaucuuaugugcaagacacucugcuuaacacuugaggggacuacagagauaaaucagugaggucaguucuaugggaggggaaucagggacagcuacacagaagcagcuuaaggaugauaaggcuuccaguccacagaaagagaggggugaagaugauuccaguauaauggaaccaugagaacacacagaggaauaaaggugugucacaucagcucuuugaauaugccacaaaaaaaaaaaaaaaaaaaaaaagcucugaauuaguuuucccucaguaucugcuggggacugguuucaggaccccccaguaugaaaaucugcagaugaucacaucccugauauaaagugggauauuugcauauaaccugugcacauccuccucgauacuuuaaaucaucuccagguuacuuagaauaccuaguguaauguaaaugcuauguaaagaguuccuauacuguauuauuuuuaacauuuauauuauuuuguauuguuuuuuauuuuuauugaauauuuucgauccacaguugauugaaucugcgguugcagauacggagagcugauuguauacccucuaaaaggaugaauuuuaugcuaugucacuuauaucuuaauaaagcuauuauuuuucaaaaguacaugccguguguuagagauggcaaggauaaauuguugucauggugacaugggauccuguguugugcagaaggagaggagacuggagagagguguaggaucagaccacacagagggucuugaaaaccaugcuaggaauuuugaauuuuauuuuccaggcauuaguaaaacauuguaaguuuuuaagcauaggaaucaaaaugacuccauugauuuuaaaauacggagcuaaaagauaaauuagcuguuaguaaaagugaagguggagaggaaaaacuaggcuauuggaacagcuucgaccaaagaguguaaauuagugaaacuaguuugcaagaauacuagggacaggggucaggcacgguggcucacgccuauuaucucagcacuuugggaggcugaggcaggaggaucacuugagcucacaaguucgagaccagccuaggcaauguggcaaaaccccaucucuaccaaaaauacaaaaauuagccaggcaugguggugcacgccuguggucccagcuacucaggaggcugaggugggaguucgcuugaaccugggagguugaggcugcagugagccaagaucguaccauuguacuccagccugcguaacagagccagaccuugucuaaaaaaauaaaauaaaaaugcuggggacuggauauugcaucuuaaaggggcaaggaaaaugaaagaaaaugcugaauucucauuuucauauuuauagaacaaagauacuguauuauuuuucugaacuguguaaccaacuaucacaaauuuagcagcuugagcaacacacauuuauuauaucaacauuucugugguucaugaccccagacacagcuuagcuaggguugugugaggcugugguuaagguauuggccagggugggauucucaccuugagucaggacuagagaugcauccacuuucagaauuacccagguugcuggcagaauucauuuccuugagguugugagucugagguccucagcuucuugccagcuguaggcuggggacugcucucagcuccuagaggaugcuugcagaucacauggcccucucaacaugacagugaacuucuucaaagccagcuggggagaaagucucuagcacuaguugacuggcaaaacauacaacaucauauaaucgugaaauuaauaucucaucaccuuugccauagucugaugguucaaagcaaguuacaggucccacucacaauaagaggaggaaauuauccaagggggugaacaccagaaaguggagaugguuggggucacuauagagcauguccaccacagguacuuuucagccucuuaaaguacaguagaguguccucuaaagccgagugagcagaguguagacucuggcgucagaccgagccagguuugaauccugacuccaugacugacuauccuuuugagcacuaaaccucagucuccucauuuguacauagggauaaagaucuacgucucaugauguggugucaggacaaaaugagauaaugccgguaaaacacuucagugagugcccaagacaggaaaauugcucacauauguuaucacauuugagucucagcuaccaugagaaguaauugaaaaguuuuccauuaaaugauuuaccuauauuaaaucaguuuuugcucuugaguaaacuuaaucuaauggacuuuuugcuauaucauugugagcauggauuaauacauucaugaaaaaucacuagacuugaguagaggauuuuuuuuuuaaucaaccucuucuuuuuacagacaaggaagcuacaaccacauagaaaaguuauccgacuugccuaagaucucacaguacuuaguggcuaagccaggacuagagugauggccuauuuaugcaaguuacugcuguuucuaccauguuuagcugugugacauaaauuuuuaauuacgacauuuauacauuuuuucacucaaucuuguagacuagaagcuccuuuuucaaugagacagcuaauuuuuuaaugccaagaaauagauacauagaaaaguucaaggccuuagcccuaaaauaagaauuugcaaacuucuagugacaguacucaaucucucugaaugucucuauuguuuaagacgugaucugauguuuuaacuuuaaauuaaacuaaauuggcugggugcgguggcucaaacuuguaaucccaacacuuugagaggcugaggcaggcggaucacuugaggcgaggaguuugagaccagcauggccaacauaccgaaaccccaucucuacuaaaaauacaaaauauuagccaggugugguggcgugcaccuauagucccagcugcuugggaggcugaggcgugagaaucacuugaacccuggaggugaagguuacagugagcugaaauugugccacugcaauccaaccuggacaacagagugagacucugucucaauaaaauaaaauaaauuugcuacuuauauguguaugugucuucacacuguauaucugggcacgcucuauauuuuuugaaccgauucuuaaggguaucccaaugauaguaaugaaaauaagcagcaugaaauuuuauagccauccuagaacaauauuuccuguguauuuuaauccacuggaauugggaaagaaggauugauuauguuguuuucauuuaauguccauuuaucaaucuccaucuuugugucagauguuugcuaggugcuugggggaugagaaagggucaccacaugaccauaauccuccuacccagagauaacuacucuaaacauguugauagccuucuauauauauuuuuugcacauguaguuuuuaauauaaaaagugacacaauaaaauacuuucaaaaauuauaauuacagaagcaguggcugucaugguaggaggaaacuaaagcaaaucagagggcacaaaacugaaaacuaggaggauucccauuuccucccaacccccugcuacccuccccagcccuacucacuagaggcaaccacugaguggucccugauuuucuucugguaguuaacauuauauucauauaaaauauuuuaacucugguuuuagauuuauuagcuuuagacaguaucuguuaaccuuuugcuauaaaauaugaagaaauuuuuuaucaauucaagcuugagccguucuucuucucagcuuccaguuucuaaaacuguuuuuaccuugaaaaggucucugacauuuauuauuacugguguauuaucucuugugcuuuuucauaggcuaguuuaaaaauggaaugcauuauugugaucacauguuacauguguauucucuuuagagcuaaauauauauguauaucauucuaagguacuaaacuuuguuguuugacaaaccugacaaaacaagcaauggggaaaggaaaggggaaucuucuaggcaucccagucuaaaacucuucauuucuauccagcuuuuuucacuucuuccauuucgacugcuacucuuccuuguaucucauguuauuaucuuccuugaauauucuuuuuuuuuucuuugcucuguugcccaggcuggagggcaguggcauaaucucagcucacugcaaacuccgccucccagguucaagcaauucucgugccucaaccucccgaguagcugggauuauaggcacuugccaccacacccggcuaauuuuuggguuuuuguuguuguuguuuuuauuauacuuuaaguucuaggguacaugugcacaacguacagguuuguuacauagguauacauaugccauguugguuugcugcacccaucaacucgucauuuacguuagguauuucaccuaauacuaucccucccccagcccccuaccccuaacaggccccggugugugauguuccccgcccugugccaauguguucucauuguucaacacccaccuaugagugagaacaugcaguauuuggcugcauaguauuccaugguguaugugugccacauuuuuuuuuaaauuuuaagaaaugcucuuuuuuuuuaauauacuuuaaguucuaggguacaugugcacaacgugcagguuuguuacauauguauacaugugccauguuggugugcugcacccauuaucuugucauuuacauuagguauauauccuaaugcuaucccuccccacuccccccaccccacgacagaccccggugugugauguuccccuuccuguguccaaguguucucauuguucaguucccaccuaugagugagaacaugcaguguuugauuuucuguccuugcaauaguuugugagaaugaugguuuccagcuucauccauguuccuacaaaguacaugaacucauccuuuuuuauggcugcauaguauuccaugguguauaugugccauauuuucuuaauccagucuaucauugauggacauuuggguugguuccaagccuuugcuauugugaauagugccacaaugaacguacgugugcaugugucuuuauagcagcaugauuuauaauccuuuggguauauacccaguaaugggauggcugggucaaaugguaucucuaguucuagauccuugaggaaucgccacacugucuuccacaaugguugaacuaguuuacacucccaccaacaguguaaaagcguuucuguuucuucacauccucuccagcaucuguuguuuccugucuucuuaaugaucauuguucuaacuggaaugagaugguaugucauugugguuuugauuugcauuucucuggugaccagugaugaugagcauuuuuucauaugucuguuggcugcaugaauguuuucuuuugagaagugucuguucauauccuuugcccacuuuuugaugggguuguuuguuuuuuucuuguaaauuuguuuaaguucuuuguagauucuggauauuagcccuuugucagauggguagauugcaaaauuuuucucccauucuguagguugccuguucacucugaugacaguuucuuuugcuaugcagaaacuuuuuaguuuaauuagaucccauuugucaauuuuggcuuuuguugccauugcuuuugguguuuuagucaugaaguccuugcccaugccuauguccugaaugguauugccuagguuuucuucuaggguuuuuaugguuuuaggucuuacauguaaguauuuaauccaucuugaguuaauuuuuguauaagguguaaggaagggauccaguuucagcuuucuacauauggcuagccaguuuucccagcaccauuuauuaaguagggaauccuuuccccauugcuuguuuugucagguuugucaaagaucagaugguuguagaugugugauguuauuucugaggccucuguucuauuccauuggucuauauaucuguuuugguaccaguaccaugcuguuuugguuacuguagccuuguaauaaaguuugaagucagguagcaugaugccuccagcuuuguucuuuuugcuuaggauugucuuggcaaugcaggcucuuuuuugguuccauaugaaguuuaaaguacuuuuuuccaauucugugaagaaaaucagugguagcuugaugugggagauagcacugaaucuauaaauuaccuugggcaguauggccauuuucacaauauugauucuuccuauccaugagcauggaauguucuuccauuuguuuguguccucuuuuauuucguugagcagcgguuuguaguucuccuugaagaggucuuucacaucccuuguaaguuguauuccuagguauuuuauucucuuuguaguaauugugaaugggaguacacucaugauuuggcuauuugucuauuauugguguauaggaaugcuugugauuuuugcacauugauuuuguauccugagacuuugcugaaguugcuuaucagcuuaaggagauuuugggcugagacgaugggguuuucuaaauaugcaaucaugucaucugcaaacagggacaauuugacuuccucuuuuccuaacugaauacccuuuauuucuuucucuugccugauugcccuagccagaacuucccauacuauguugaguaggaggggugagagagagcauccuugucaugugccgguuuucaaaaggaaugcuuccaguuuuucccauucaguaugauauuggcuguggguuugucauaaauagcucuuauuauuuugagauacauuccaucaauaucuaguuuauugagaguuuuuagcuugaggggcuauugaauuuuguugaaggccuuuucuacaucuauugagauaaucaugugguuuuugucauugguucuguuuauguuucggauuacacuuacugauuuguguauguugaagcagccuugcaucccauagaugaagcugacuugaucgugguggauaagcuuuuugaugugcugcuggauuugguuugccaguauuuuauugaggauuuucgcauugauguucaucagggauauuggucuaaaauucucuuuuuuuguugugucucugccagguuuugguaucaggaugaggcuggccucauaaaaugaguuagggaggauucccucuuucucuguugauuggaauaguuucagaaggaaugguaccagcuccucuuuguaccucugguagaauucggcugugaauccgucucguccuggacuuuuuuugguuggugggcuauuaauuauugccucaauuucagaaccuguuacugguuuauucagaguuucaacuucuuccugguuuagucuuggcauggaguauauguccuggaauuuauccauuucuucuagauuuucuaguguauuugcauagagguguuuauaauauucucugaugguaguuuguauuucugugggaucggugguaauguccccuuuaucauuuuuuauugcgucuaucugauucuucucucuuuuguucguuauuagucuugcuagcagucuaucaauuuuguugaucuuuucaaaaaacuagcuccuggauucauugacuuuuugaaggauuuuuucuaucuccuucaguucugcucugaucuuaguuauuucuugccuucugcuugcuuuugaauuuguuugcucuugcuucucuaguucuuuuaauugugauguuaaggugucgauuuuagaucuuuccugcuuucucuugugggcauuuagugcuauaaauuucccucuacacacugcuuuaaaugugucccagagauucugguauguugugucuuuguucucauagguuucaaagaacacuuuuauuucugccuucauuucauuauguacccaguagucauucaggagcagguuguucaguuuccauguaguugugcaguuuugagugaguuucuuaauccugaguucuaauucgauuguaguauggucugagagacaguuuguugugauuucuguucuuuuauauuugcuguggaguguuuuacuuccaguuauguggucaauuuuagaauaauugugauguggugcugagaagaauguauuuucuguugauuugggguguggaguuccguagaugucuuuuagguccguuugguccagagcugaguucagguccuggauauccuuguuaaccuucugucucauugaucugucuaauauugauagugggauguuaaaaucucccauuauuauugugugggagucuuagucucuuuguaggugucuaaggacuugcuuuaugaaucuggaugcuccuguauugggugcauauauauuuaggauaguuaagucuuccuguugaauugaucccuuuaccacuguguaaugcccuucuuugucucuuuugaucuuuguugcuguaaagucuguuuuaucagagacuaggauugcaaccccugcuuuuuuuuugcuuuccauuuguuugguagaucugccuccuucccuuuauuuugagccuauguguguuuuugcacgugagaugggucuccugaauacagcacacugauggguguugacucuuucuccaauuugccagucugugucuuuuaauuguggcauuuagcccauuuacauuuaagguuaauauuguuaugugugaauuugauccugucauuuugcuguuagcugguuauuuugccuguuaacugaugcaguuucuucauagcgucaauggucuuuacaauuuggcauguuuuugcaguggcugguacugauuguuccuuuccauguuuagugcuuccuuuaggagcucuuguaaggcagaccugguggugacaaaaucucucagcauuugguugucugugaaggauuuuacuucucccccacauaugaagcuuaguuuggcuggauaugagauucuggguugaaaauucuuuucuuuaagaguguugaauauuggcccccacucucuucuggcuugugugguuucugccaagagauccacuguuagucugaugggcuucccuuuguggguaaccggaccuuucucucugacugcccuuaacauuuuuucuuucauuucaaccuuggugaaucugacaauuaugugucuuggaguugcucuucucgaggaguaucuuugugguguucucuguauuuccugaauuugaauguuggccugccuugcuagguuagggaacuucuccuagauaauauccugaagaguguuuucuaacuuaguuccauucuccccgucacuuuccaguacaccaaucaaauguauauuuggucuuuucacauagucccauauuucauggaggcuuuguugauuucuuuucacucuuuuuucucuaaucuugucuucucacuuuauuucauuaauuugaucuucggucgcugauauccuuucuuccacuuggucaaaucggcuauugaagauugugcaugcaucaugaaguucucaugccgugguuuucagcuccaucaggucauuuaaggucuucucgacacuguuuauucuaguuagccauucaucuaaccuuuuuucaagguuuucagcuuccaugugauggguuagaacaugcuccuuuugcuuggagaaguuuguuauuaccgaccuucugaagccuacuucugucaacucaucaaacucauucucugcccaguuuuguuccauugcugcugaggagcugcaauccuuuggaggagaagaggcgcucugguuuucggaaguuucugcuuuucugcugugguuucucccugucuuugugguuuuaucuaccuuuguucuuugauguuggugaccuacagguggcauuuugguguggauguccuuuuuguugauguugaugcuauuucuuucuguuuguuaauuuuccuucuaacaggccccuuaacugcaggucuguugggguuugcuggagguccacuccagacccucuuugccugggcaucaccagcagaggcugcagaacaguaaauauugcugccugauccuucaucuggaaguuucaucccagaggggcacccgccuguuugaggugucugucggucccuacugggaggugucucccagucaggcuacacgggguuuugggacccgcuugaggagguagucugucccuucucggaggucgaaugccaugcugagagaaccgcugcugucuucauaguugucagacagggacguuuaagucugcagaugcugucugcugccuuucauucugcuaugcccugcccccagagguggaaucuagagaggcaguaggccuugcugaacuguggugggcucugcccaguuugagcuuccaggccacuuuguuuacacugugagcuacucaagccucagcaauggcagaugccccucccccugucaagccacaacgucgcagguugaucucagacugcugcgcuagcagugagcaaggcuccgugggcgugagaccuggugagccaggcaugggaggguaucuccuggucugccgguugcaaagaccaugggaaaagugcaguauuuggucaggaguguacuguuucuucagguacagucucucauggcuucccucggcuaggaaaaggaaaucccccguccccuugcacuucccaggugaggcaacgcccugcccuguuucagcucaccguccauaggcugcacccacuguccaaccagucccaaugagauaaagcagguaccucaguuggaaaugcagaaaucacauaucuucugcauccaucucggugggagcuacagacuggagcuguuccuauuuagccaucuuggaagcgacccuuaauuuuuggauuuuuuucugagacagauucucgcucucuugcccagucuggagugcaguggugcaaccucagcucacuguaaccucugccucccgggcucaagcgauuuuccugccuuagccuccugaguagcugggauuacaggcaugcaccacuacccuugcauaauuucuguauuuuuaguagauaugugguuuugccauguuggccaggcuggucucaaacuccugaccucaagugaucugccugccucagccucccagagugcugagauuauaggccacugcaccuggcugaauauuuuuuuuuuuuuugagccugucucugaguacuuuuuucauguagggcucuugguggcaaauuuuuuuaguuuuagaaagccucaaauagcuuuaucuucauauuugcuuugaaaguuuagaugaauauaaauauccagauuuuaaauuuaaagaaauugcucccguuaucuuccaguauuacauucaauguagauaaagucaguaagagucugauucucaucccuugcuuaaugaugaauuuuuucuuucucugaggcauuuagaauuuuuuaauccuuauuauaaaauuuucagcagaauguuuagauguaaaucuuuucuuacuaaucuuacucagcauuucaugaaaccuucccauaugaaggugcaugucuuauuucagcguaggggcauuuucuuaaguuauuuuaugucauuaccuuuguuguuuguaucuuuugcacuuccuauuugagcagcuuucaacuguuaggacauggucuccguguuuuaaaucuauuuguuuguacuuuacauuucuuggucuuucucauugcuguucucagagauuucuuugaauuuaucuuccagguuuaaaaacuuggucuagggcagggcacaguggcucacgcuuguaauccaagugcuuugggaggcugaggcugguggaucacuugagcccagguguugugaccagccugggcaacaugguggaaccccaucucuacuaaagauacaaaaaauaaaaaauuagccaggcaugccuguagucccagcuucccagcaggcugaggugggaggaucaucugagcacaggaagguugaggcugcagugagcuguguucaugccacuguacugcagccugggcgacagaguuagaaccuuucucaaauaaacaauaauaaaauaaaagcuugguccuauacagcaucgaauuuuaauuucacccauacaguaaauuuuucagugaucauauuuuuaauuuucaagauuucuuguucuccaguuguuuauuucuucauagacuuuucuuguuuuaagucugucauauucuuaaucuuccugaggauaccaaaucgagauuuugcuuguuuuaauucuuuccaguucuauuaguccauuuucacacugcugauaaagacauacccgagacugggcaauuuacaaaagaaagaaguuuauuggacuuacaguuccacauggcugggaaggccucacaaucauggcagaaggcaagggagagcaagucacaucuuauguggauggcagcagguaaagauauugugcagggaaaugcgcguuuuuaaaacuaucagaucucaugagacccauucacugucaugagaacagcacaggaaagacaugcccccauaauccagucauuucccacugggucccucccacaacacgugggaauuaugggagcuagaagaugagauuuguguggggacacagagucaaaccauguuauuccaccccuggccccucccaaaucucguaucuucacauucagaaccaaucaugccuucccaacaguccccugggguguuaauuuauuucagcauuaacuuaaaaguccacaguccaaagucucauccaggacaaggcaagucccuucugccuaugagccuguaaaaucaaaagcuaguuaguuacuuccuaaauacaauggggguacaggcauugggcaaauacagccauuccaaaugggagaaauuggccaaaacaaaggggcuacaggcccuaugcaagucugaaauucagcggggaagucaaaucuuaaagcuccaaaaugguaucuuuugacuccaugccucacauccaggucacacugaugcaagagguggguucccauggucuugggcaccuccuccccugugcuuugcaggguacagccucccucccagcuucuuucacaggcugacauugagugucuguggcauuuccaggcauauggugcaagcucuagguggaucuaccauucuggggucuggaggacuguggccuucuucucacaguuccacuagauggugccccaguagggacucugugugggggcugugaccccacauuucccuucuguacugcccuagcagagguucuccaugagagcucugcccuguagcaaauuucugccuggacauccaguuauuuccauacaucucugcaaucuaagcggagguucccaaaccucaguucuugacuuuuguguaccugcaggcucaauaccacauggaagcugccaaggcuuggggcuugcauccucugaagccacaaccugagcuguaccuuggccccuuuuagucauggcuagagcugcugggacacagggcaccaagucccuaugcuacacacagcgggggucuacaggccuggcccaugaaaccacuuuuuccuccuuggccucccgggguguguugggaggggcugccaugaagaccucugacaugccuggagacauuuuccccauugucuuggggauuaacauucagcuccucguuuuuaaugcaaauuucugcaccuggcuugaauuucuccucagaaaaugggauuuucuuuucuaucacacugucaggcugcaaauuuuccaaacuuuuauacucuguuuccauuauaaaacugagugccuuuaacagcacccaagucaccucuugaauuauuuucugcuuagaaauuucuucucccagaucauccucugccuaaaucaccucucucuaguucaaaguuccacaaaucucuaggguggggcaaaaugcugccaguuuauuugcuaaaacaaagcaagagucaccuuugcuccaguuuccaacaaguuccucauuuccaucugagaccaccucagccuggaccuuauuguucauaucacuaucagcauuuuugucaaagccauucaacaugucuguaggaaguuccagacuuucucacauuuuccugucuucugagcccuccaaacuguugcaaccucugucuguuucccaguuccaaaguugccuccacuuuuucaaguaucuuuccagcaacaccccacuccugguaccaauuuacuguauuaguccauuuucacacugcugauaaugacauacccgaggcugggcaguuuacaaaagaaagagguuuacuggacuuacagcuccacauggcuggggaggccucacaaucauggcagaaggcaaggaggagcaagucacaucuuauggggauggcagcaggcaaagacagagauugugcugggaaacucccguuuuuaaaaccaucagauuucaugagacucauucacuaucaugagaacagcacaggaaagaccugcccccauaauucagucaucucucaccaggucccucccacaacaugugggaauuacgggagcuacaagaaaagauguggcuggggacacagagccaaaucauaucaccagugaauuguauuuuuauccacuuccucuaugguacuuguucuguugguuuucucagucuucucuuucauacugucauuuuuccuuauguguccucaaauuuuucuuuaauguguuugcuacucauauaucugacuggaacauuacucgaguuauuauaauagcaaggaugaauuuccaguagcucaauagguccuuuuucuagcagacuccuccacugaaguuaaaaaauuucuggugaccucauuuuuuaacauucacuauguuauuaauauaaccauuuuccgaugccaaaaauucuaacauacuaauuuuauugguugcauaguuuuucaucauaguacuguuuacucuuucucuuauuauuggauauuugauuuuuuccagcuuuucauuaaauaacaucaagaacacauuuguacauguauuucuucauguaucucugaugguuuucauaguguuaauuccuagagugaaauuuauaggucaugaaagauuucuaauagacauugcuaaauugucuuuuggaagauuguaacaagucucugucucauaaaaauacccuuuccccgcagcacucuugauaauggcagaucauguucuuuuuaaucucugcuaacuuagcaauauacauauuacaauauauauauagaaugugaauauuuuccuguuugaauuuacauauuuggguguuuucaugaguuucuuuugugaauugacucuuuauguucuuugccuguuuuucuguucaccauuuuguuucgcuuugucagacuuuauuuugggaauguuaagugcucauuauaauuacuguaaguuuuuucucaguuugugguuugccuuuaacuuuuuuauuaugugucuuuugcuaaauauauguuuugaugacauauauguaaagccacccacucaccuguccagagauuaaauuucaucuauauagcuugguauguuuaugauuucuaguuuuacauuaaacuuuuaaauccauguacauuuauguuggaauauggcuuauauagggacacaucuuuguuuuuucugaaauaacuaauuagcuagcaucuuuuucauugacugguaguucauccuuucccuauuaauuugaaaucucaccucugucauauacaaaauguuuuuuauaaauauguguguguaucugccuagaaauaacuuguccaggcacaucuuacaauucuugacauuucuaacaagaccacucuguuacuuuacuguuuuagaaagcacuuaaguauaaugcuuaaucuacuguauuaaaacuguauacaacagccaggcaugguggcucaugccuguaaucucagcauuuugggaggcuaaggcaggaggaucauuugaacccaggaguucaacaacagcccaggcaacauagugagaccuugacucuacaaaaaauuuaaaaauuagcuuggugugguggcaugcgccaguggucccagauauucaggagucugaggugggcacucgcuugagccugggagguugaggcugcagugagcuguuaucacugccacugcacuccagccugggugacagaucaagagccugucucaaaaacaaaaaacaaaacaaaaaacuguauccagugcuuguguauuauccuaauuucuaaaaaucaaugaccccccaaaauauuucccucaucagaauguucuguuaucagccaaagauuucuuucugucagcucacauccugccacaauaaaggcaaacagugguagacagggugaaccauugugauucugaagcauucuaagugguuucagggauaugaaaguuucaucauccuguuuugugguaggggaaaaggaaauauuguuaaaguaaacauugaaauuugagguaaauaccaguauucgaacuuugaaaaaguagccagaauguuccuaagguggcaacauuucagaaauuauacaauuucucaaugccgcuaguuauuggaacaguucuaaggcucugcccauguguugacaucacauuccaucucccuuguucuuauagggcuucagccacacagcugguuaaggugcaauuugaccaugacuuucuuaagaaaugaaagguacauuauggugcuguaggucaaaugugaaguauguguccuauuuugugaacuauuguagcaaaacuaaaucaaugaagggauuuugcugagaaaguaguuaccagcauucacaaagcuggcuacugggugaaaaaccugaauucugaguuuugcaauuaacugcauaacacugaguauuaccuaauaaugauuccuuuguuuuuuucaguuccuuuugcauuauauagguguuuucccaaauguguucugaaagacauuauugcugcaaggugcucuggaagacauuucagggaccaugguuaaaucaguuaaagaaaagcuguguacuagauccuucucuaagaaaugcacuggcugggcacgguggcucaugccuguaaucccagcacuuagggaggccaaggcaggcagaucacuugagguuuagaguucaagaucagccuagccaaaauggugaaacccugccucuacuaaaaauacaaaaaauguuagccaggugugguggcaugcaccuguagucccaguuacuugggaggcugaggcuauagaaucacuugagcccaggaggcagagguuguagugagccgagagcaugccacugcacuccagccugggcaaugggaaugaaacccuguccaaaaaaaaaaaagcacaauauguagucucauacuaaaggcuuuaagaagucuuacagaaaagaaauuuaaaucuuuuggaucuauuucuugacaucuguaggaacuguuucauaaaaucuacuuuaggaaccuguauuagcugcuguccaagguaucaaacgucuauaauucuaguuccaguaaaaaguuguauauaaauaacuuacuuuauauguaguacuuuaauuuguaauaucaguauggaaucuucuuaaggaaacacugaaaaaaaccuuuaauuguacaagaucuuuguacaguaucauggacuuuuaaacacagaaacacagagaaguauuguuuuguccugugaauaccaaaacuuugauuuggauuuauuagugagaaaaaagcaggaucaaacguuucccuacuuuuuaggaguucugugcaauaccucaaauucuauccagaauguuccuacaaaguacaguaugauguuagacacucuuuacauccaacauguuuucuuuuguuuaauuuaauuugagcuauuauuggcucaaaauauauagauucuuagugaucuuuuauauuuauuguucauaaaauaauguucggcuuccuaauaagaaagugaagaggaaaaucaagguguuuucaucuugcuuguaggaugggugcugcagacaauauauauaaaggacagaguacauuuauggaagaacugacugacacagcagaaauaaucagaaaagcaacaucacaguccuugguuaucuuggaugaacuaggaagagggacgagcacucaugauggaauugccauugccuaugcuacacuugaguauuucaucagagauguaaguauccgguaaacuguauuuaaaaagaaauuaauuuguaaauuauuauuuuuaaaugacagucauaauugugccauauuuaugggguacaaugugauguuuugaaacauauaaacaauauggagugauuaaauuaaccuaauuaacacauuccucaccucauuuaaauaucauuuuuuguggugagacauuugaaauuucucuuaguuauuuugaaauauauauuauuacugcuguagucauaauaccguuaugcaaucccugcauacccuuuuguacauggaugauacauauuauacacauuauuuuccugaucucagucuccaaauacucaaaauuaucuuuuuuauaauugacugcaguccugcaagugaucauuagaaugcuacacacugaauucagacagauugacccuaaauaauguuuguaguuuuuugauauauguuccuuuuuuugcugacucaacauaaaucugguuguacgaaaaaggccuuccuggcaauauuuucacucagaauuauaucuuauuauccuuggugaacccuaaaucaagaacagguaccauccaucuacagccaaauuccucgagggaaaaacaaggaaauagugccauuuccacuuugugaaauccuuuuuuucaccaacauccugaaggaucucacugugagaucuuugaucucaucucuuuguguuucuaucugauucaguaacaucauuccuucaauacaugucuccuuuuuuucagggugcauuucuaagcuucaguguaaaauuuuguuugugucaaacuuucuaucccugucauuuccaucuaacucucuccuuuaguuuacuuucucuaucuuguucauuuuggucucugcuuuucaaaucuccccuucauggcaccucuccuuaggucuuucccuucucuggucuuucuuucuguuuucccccccauuuucuugcuccuuugucauugugucuucccucauuuucauuucuuucucucuuccuuaaauagccaauaaaaucauauuuuuaauauuucuuuucaaaaagcaacacaaaaauaaaauguauuuuucuuuaaccuuuuguugccauugguguuuugggguuuaguuuuguuuuuaaagcuuaauuuccauuuaauuuuuuuccagaagauaguuuuucuucagucuuuagagacucagcuccaugaacaggcuuugauggagaucauggggcagcauccucagaucuaaauuggagcagaguuguuugguccucuaggcuucaugagaaugauuccugacuaccuugcugugagcggcagaacuugugcaguaauacaguuucauacacuguuugggaagcacagagacaucaacgacacucaauuuggaaaugucccugacagcuguaccuucuacuauauuucaaaugacaaacuucuaaauagccuuguccuuaggugugcauccaacacaguuugugcagcaaauagguuguaccuagcuauggcccuuuuuggcacaaccguuguuguuguuccuccuccuccucuucuuucucuuccuccuccuccucuuuuuuuuuuuuuuuuuuuuuuucuuuuuugaaauggguucacucugucacucaggcugcagugcaguggcaugaucauggcucacugcagccucgaccuaccugggcccaggugauccuuccacuucggccucccgaguagcugggacuacaggcacacaccaaccauacccagcuaauuuuuguauucuuuuaggaauggaguuucaccguguugcucaggcuagucuugaacuuucaggcuccagugauccaccugccuuggcuucccaaaguucugggauuauaggcaugaguuaccaugcccagccucccuucuuuucuuuguuauuuuggcagugaagacccaagagugacucagguuuuguuuaaacauuuauuuagauuacauagguaauuauaacauuuuguuuuuuuuaaggaauuuuuuguuuugcuuuaaaaaauuuauuugcaaaaagauguaacucagaaacuuuaaucauuauagaaacuacguaggaaaugaugaguucauguccuuuauagggacauggaugaagcuggaaacgaucauucucagcaaacuaucgcaaggacaaaaaaccaaacaccgcauguucucacucauaggugggaguugaacaaugagaacacaugggcacaggaaggggaacaucacaaacuggggccuguugugggguggggggaggggggagggauagcauuaggagauauaccuaauguuaaaugacgaguuaaugggugcaacacaccaacauggcacauguauacaaauguaacugaccugcacauugugcacauguacccuaaaacuuaaaguauaauaauaauaaaaaaaagaaacuacauaggaaagcaauugacuuuuguacauuaaccuuggauccugcaaccuugcuguaaucacuuacuaauuccagucuguguguauguuugccaauucuuuugaauuuccuacauaggcagucaugucagauacaaacagacaguuucacuucuuucuuccccaucuauuuuuuuuuucuugucuuauugcaguaacuaggacuuucaguacaguguugaaaaagcaguaagaaaggauaucguugccuuguuucugaucuuagugggaaagcuuugaguuucucaccguuaaguaugauguuagcuagagguuguuuguggauauuccuuaccaaauugaggaaguucuccucuauuccuaguuuacugagaguuuuuauugaauggguguuagauuuugucaaaugcuuucugugcaucuauugauauggucaugugauuuuucuucuuuagccuguugaugugauggauuacguuaacugguguucaaauguugaaugagucuuacacacuugggaugaguccuacuugguuauggucuguuuuucuuuuuauacauuguuggauucauuuugcuaauauuuuauugaggauuuuugcaucuauguuuaugagagauacugguuuauaguuuucuuauaaugucuuugguuuuaguauuaagguaaugcuggccucauagaaugaguuagaaaguauuuacuccacuccuguccucugaaaaagacuauagagaauugguaaaauaucuuccuuaaacauuugguggaguucaccagugaagccaucugggccuaugauuuugguuuuagaaggccauugacucaaguucuucaauagauauagaccuauucagaauuucuguuuuuuuucuugugugaguuuuggcucauugugucuuuuaaggaauuguuuuucaagaaauuuucaccaagguuaccagauuuguggacauagaguuggucauaguauuccuuuauuauccuuuuauuuguccacggcauccguaguguuguccuuuucauuucugauauuagccauuugugucuuuucucuuuuguucuuaguuagcuugacuagaagcuuaucaguuuucuuuucaaagaaccagcuuuugguucuauugauuauuuuccccauugcuuucuuguuuuaauuucauugauuucugcucuaauuuuuauuaucucuuuucuuuugcuuauuuuugcucuucucuuucugguguccuaagauagaagcuuagauuguuuauuuuaaauuguucuuuuuuucuaauguguucagugcuauaaauuuucuuuuuuuauucuuucuuuucuuuccauuuuuucuuuuuugagacagggucuugcucuguuacccaggcuggacugcaguggcaugaacauagcccacugcaaccucgacucccugggcucaagugauccuucugccucagccucccauguagcugggacuacaggcacaugccacaacacccagcuaauuucacuuuuauuuuuuauagagauuggggucucacuauguugcccaggcuggucucguauucuuggacuccagugauccucuugccuuggccucccaaagugcugggauuacaggugugagccaccgcuccuggccuauaaauuuucuucuaugcacugcuuuuggugcgguuccacaaauuuugauaaggugugcuuccuguuuuuacuuaguuccaaauauuuuaaauuucucuuuauuucuuuuuugacccauauguuuuuuaagaauguguuguuuagucuccauguauuuggggauuuuccaguuaccuuuuuguuaugauuccuaguuuaauuccauugugguaugagaucaaauauuguaugauuuuuauuauauuaaauuugucaacauguguuuuauggcccaaaauguggucuuucuuggugaauguuccauguuagcuugagaugaauguguauucagcuguugguugaaguaucuauagauauaaaugaugucuaguugauugaugguguuguugaguucagcuguguccuuacugauuuucugccugcuggaucugucuguuucagauggaggaauuuugauaucucuaacuauaguaguauguucaucuguuucucuuuguaguucuaucagcuuuugccucauguaguuugacauucucuuguuaaaugcauacauguuaaggauauuaugucuucuuggacauaagacauaauauccuuuaucauuuuaucauuaucccuuuaucauuauauaauauccuucuuuaucccugacaaauuuacuugaucugaagucugcucugucucaaauuaauauagcuacucuaacuuccuuuagaaauuaauauagcugcuucagcuuucuuuaauguuaacaugauguaucuuccuccauauauauauauauauuuuagauagagucucacucugucacccaggcuggagugcagugguacaaucucagcucacugcaaccucugccucccagauucaagugauucuugugccucagccucccgaguagcugggauuacaagugugugccaccacgccuggcuaauuuuuguauucuuuuuaaauuaaagaugggguuucaccauguuggccaggcuggucuugaacuccuggccucaagugauccaucugccucggccucccaaagcgcugggauugcaagugugagccaccucaccuagccccuccauauauuuuuaauauguaguuauuuuuauauuuaaggugaguuucuuguagacaacauacaguuaggucuuauuuuuugauccacucugauaaucugucuuuuaacuggugcauuuagaucaucagcauucaaagugauuauugauagaguuggauuaauauuuaccauuuuuuacuuuuuucuauuuguuguucuuguucauuguuccuacaugugucuuccacuguuuuucugucuuaugugguuuuaacugaguauuuuauauuauuucauuuucucucuuuuuuuuuuuuuuuguuuuuuguuuuuugguuucuugggguguuuuuugaggugggaucuuacuguguugccuaggcuggccucaaacucccgggcugaagugaccuucccaccucagccucccagguagcugggaguacaggugcauggcacugugcccagcuauuuucucuccuuucuuagcguaucaguuauauuucuuguuuuacuuuuucuagugguuguccuggaguuugcaauauacguuugcaacuaauccaagucuacuuucaaauaacacuauauugcuuuaugaguaaugcacguauuuuuuaauaacaaaauaauccugauuacuuucuucuauccuuugcaccaucacugucauuuauuucacuuauacuuaaguguacauaagcauauauauauauauaaacauacauaaucgcauacacuguugcuauuauuauugugaacaaaauguuaugcuagauccacuaaaaauaagaaaaauaaaaguuuuucgccuucacugguuccuucuucaaugcugcacuuuucuuuauguagauacaaguuucugaccccugucauuuuccuuccuucuaaagaacuuuccuuaaacauuucaggauagaucugcuggcuacaaauccucaauuuuuguuugucugagaaugucuuuauuucuccuucaguuuugaaggauuauuuugcaagguacagaauucuagguuggagagguuuguuguuuuuuuuuuuuuuuccucucaaaacuuuagauauuuuacuccacucuuuucuugcuuuugugguuucugagaagucagauguaauuuuuaucuuugagcuuguguggauaagguguuucuucccucuggcuuacuucaguauuuuuuuuuucuuuaucuuugguuuucuguaguuugaauaugauuugucuaggugugguuuuggggacauuuaucccguuugguguucccuaagcuucccagaucugugguuuugugucugacauuacuuuggggaaauucucagucauuauuguuuuaaguauuucuucuguuucuuucucucuuuauuuucucucugguauucucauuagcugcauguuauaucuuuuguaguugucucaaacuuuuuggauauucugagguuuuuuucuagucuuuuucuguuugcauuuccauuuuggagauuucuauuaagauguccucaagcucagagauucuucccucagcuguguccagucuaccaguaagcucaucaaacacauucuucauuuccaucacaguguuuuugaucucucguuuccuuuugguuuuuucuuagaauaugcaucucugugcuuacauugcccaucuguuauugcaugcugucuguguuaaccauagagcccuuagcauacuaaucaguugcuuccaauucccagucugauaauuccaacauuccugccauagcuaugucugguucugaugcuugcucugucucuucauauuuguggguuuuuacuuuuaguaugucuugcgacuuuuucuugacagcuggcuaugauguauuggguaaaaggaacugcuguaaguuagguuuuaguaaugugcugguaagggucuaggggaggaguccuaugauuaagucucagucuuaccucccucccaccccucaggugggauaggaaggcuagagugggcuggaguuggguauuuccuuucucucauauggaaggcuagaggagacuggaguugagucuuucccuucccccagguaggugaggcuuugauaaaaccccagcagguuaggcuccacuuaaguaguuucuucugagggcagaccuuguuaagaacagagugcccuggugcauuucaaaauaguucuuucuuucuuccccuugccugaagcauaaggggaauuuacuccaguguuuauugugagaaccaaguggaacuccugggaguaaaacucacaaaagugugcccccuucccccaugacucgguuccccugcacuuuuugacucucagacuuguugacacugagccuccagcaauugaucaguuccaguuccaguuuuccuacccugauacugguuccuucagagguuucugccuccauuucagcucaggaaaguugugauucuuuguaucugcuugucugucucuaacuugggggacagugguuugccugugacuucauuuuucuuacagaucuaaagaguugauuuuucaguugguucuacuuuuuccuugugauggagagguaaccuccaaccuucuuauaugcuaaacuggaaaccagaaacuucccugaccuuuuuauggaugaaaaucuuuauuuucaugguuccuucugaucucuggauagggaagagagaucagaaaggagcaauaagggaggucauguguugcugcugcaggccgagaacagccuugaggagcacagugucggaucccagacccuuaggucuuccggcuaaaagugccuaucagcuuggagaaggagcaccauggagauaggugguccuaagaucccucggggcagauuuuaagcacagcuuuuuaaagaaauccugccuuaauacguuuauuuguuauuguuaucagaaagaaggcacacauucagacuuuuaauaaggugaauggcaggugaaucaaaacuggaguucuuugauuuaauuaccuccuucugccaauauuuaggcuaagauugguguuaacuuuccuccagauagagguuuccagaauauauaaaauaugccuuaaaauaaugcuuauuaaagaauccaugagacugggugcaguggcugaugccuguaaucccagcacuuugggaggccaaagcaggaggaccccuugagcccagguucaagaccagccuggguaacauagugagaccccucucuacaaaaaauaaaaacaaaaaauuagccaggcauaguggugcacaccuguaguccuagcuacuugggaaguugaggugggaggaucccuugagcccaggaguuugagguuauaguaaacuaugauugugccauugcaaucuagccuggaugauagauugagacccugucucuaaaaaaaaaaaauuuguuaauucauacugacacuaacaaaaauaaacuuuaaaaugguggaggugaguggggaaaagugaaaccucugcuuuacagaauaccaacgaauaaauguaggaagaauuuuuuaaucaacauuuaauaacgacuauaauaauaacugauucagacagcaaugaucaauagauuauaaaaccuuuggaugaaagauuguuggagaaaaggauauucauauaucucaaagugucaugccacagguuauuuauuaauuacaaagggaaaagguauagugaagaaaucuaguggguacccucuucaaccagauaaucaaauuuggcauccccaguuauguaaaacugauaucacgucccaccugaugugaugcacugggaaggacccaucaccuacauauacauggaauauuccugguaucgacgaaaagagucaaacucuguaaaauauuugaagagauuuauucugagucaaauaugagugaccauggcccgugacacagcccucaggagguccugagaacaugcgcccaagguggucaggguacaguuugguuuuauauauuuuagggaggcaugagacauaaaucaaauacauuuaagaaauacauugguuuggccgggugcaguggcucacaccuguaaucccagcacucugggaggccaagguggguggaucacgaggucaggagauugugaccauccuggcuaacacggugaaaccccgucucuacuaaaaaauagaaaaaauuagccaggcgugguggcgggcaccuguagucccagcuacucaggaggcuaagguaggagaauggcguaaacccgggaggcggagcuugcagugagccaagaucgugccacugggcaacagagugacacuccgucucaaaaaaaaaaaaaagaaaagaaauacauugguuugguucagaaaggugggacaacuccaagcaggggcuuccaggcuacagguaaauuuaaacauuuucugguugacaauugguugaguuuaugugaagaccugggauuaauggaaaggaauguucagguuaagauaaaggauugugggaccaaguuuuauugugcagaggaaucucucagcagacuucacagagagagaagagguuguaaaauguuucuuaucagaccuaaaagggugccuggcucuuaguugauuaucucguggaucuggaaaggaaggaaaacaaagggugaaggggauacucuauagaauguggauuuuucucacaagagacuuugcagggcaauuuaaggcguggcaaggaaauauacuccuugggguuaaauauuuuuuccuugucucauaauguugugccggagucauauugaaaagcaagucacaauauacagggucaaauaaaacccaucugaugagaauccaugauauguagggcaugacucccuggaccccuuagguaggaauuuggguaagauaaaaaaaucagaguuuaguccucacuggcaaugauguuuggaggaaauagcaaaguccaaauugaaagacauuaugcaaaacagcauaagugcccccuccacccacacucuauuccuguacgaaaggauacuugauacuucaaaaauguccaugucauaaaagacaaaaaaggaaagagacaaaaagaaacauuguugggagaauuagggagauuuaggaacuguauauguuauauaauaauaauauauuuauugaguguaauaauuguauucuaguuauauaggaggauguuuuguucuuagaagauagaaucuuaaaucuuuagugaugaagugucaugaugucugcaacuaauucucagaugguucaggaaaaaaugucugugucuguggaggaggaagaagaagggaaauaugguaaaauauuaacaauugauuaucuagguaaacaguauauaauaauuggucguuguacuuuucuugugacuuuuaggaagauuuaaaauuuuucaaaagaaaguggaagacagauuuuaauuacaauaaaauuuaaaaaugaaauaacauuuauucugucuuauugcuuuaggugaaauccuuaacccuguuugucacccauuauccgccaguuugugaacuagaaaaaaauuacucacaccagguggggaauuaccacaugggauucuuggucagugaggaugaaagcaaacuggauccagguaugaaauauuccugcaguugguacaaauauugguuuucauguuugauaacucaaaguuuguuggaacaugaacuuacugcuuauuaauaaugaaagcugugaaugugagcuauaaauaacauuugucaggauucauuuuugcuaagcuuuaggucaaguagaauuuagauuuauccuugcuaucucugaguccuucucuggucuuccuugucucauuugucguggcaacccuuuucucuuuuuuuacaggaauaggguguggguggagggggcacuuagguuuuccucuuagugccuuguacucuuacaugauucaucucaguacagaugacagucaccugcagaguauaauuagucaucuuuuaaaaacgcccaauauuuuccccaaaauaucauuuaacuuacuaagggccauauacuguacuggacauagguuuuuauuuuaauauuauaaggaaacugaaucucagacagguaaagugguuugaccaugucaaccacuuagaugggggcuaaaaugagccuagaauucacuucuucugcuucuggguucucuucuguuccccucugcuagagcugcuauggaggaaaucuacaauauuuuuccuagucuuuccaguuacuggugucacagaaaugagacauuuuaugaaaaagaacaccguuagccaauagcaauacauuuaagugccauaaguaauacaguagacuuuagcauuuuuuuuucuguucaguaguaauuguuuuaagccaccagccuguaguccuguggugguuugcgcaauugguaugcugcaauggaaaauccaucaugcaagauaccccagaguccagauuuuauuuuggaaaaguaauagggauggaccugaaaaagaaaucaggcagcuggcccaaauaaaacaaagcacugggccuaagauaaauguaauguuaggcaguuccugcuuuucaccaccaugcaaucuugaaaaacacaucauaaauucucuuauggaaguaguuuuguaucuauuaaucugcauccagguugacaagaggagacuuaagcuaaaacccuugggacaaagagaauagaguucaccaacagggaagaagaggagucagugccgcuaauacgcauuugaugugaacugaaaacuaacccagagcauuguaccuuucccuuaaauguucugugcauuuuauuuuauugauuuuaauuuuuguguuuuguugagauggggugucacugucauccaggcuggagugcaguggcacgaucauagcucacugcagacacaaccucccaggcccaggugauccucccaugucagccuccccgguagcugggacuacaggugcacaccaccaugccuggcugauuuuuguauguucuguagagacaggcucucacuauguugcccaggcuggucucaaacuguugaauucaagugauccuccugccuuggccucccaaagugcugggauuacagggaugagcuaccuugccuagcugauuuuaauuuuuaucaaugaacauaauuuuuaaaauucaauggugcuaaaaggcuccugcugacaagcuuccaucccuucaguucacguccuuccccauccuagucccaaggcaacuacuuucaacacuuccccuuucuguuguauuucuaaguaauauccguauuuucaugucucuugcuucaucaaguugacacauuauugauggaccucucauuguguuaauugagaaucuucaauuuucccuuccucuguccuuccaguauagucauuucacauguauuguaugucauucauacuuguuguuuucauuauuauugccaugcuaaauauugcuuacugaugagccaaguuuggagacaaguacauuucuuucuuuuacaacguuuucuauuuucucaaaaauaagaauugacuguccucauuuuuuccauuuuguuuuguuuuguuuuugagucuauagcugaaucuuccuguacccucagauagcuucguaaaaugccucucuagauguuuuuccacacaacugaaccuacugguucccauuuguccacuggggcccuuccuccuggagcccuuuguccuccugcucaucugaacuggcugcugucugggccugcggcacagcugucauccuaagccugccuugcuggcauccuaggaguucccuuaccccucuucuaagcaugugauugcaaggaacaaaacacucggucucacacuggcucagacaaaaggaugcaguauauauaaucccauguuccaugacuuccagaggaagagugggcuucagcuccuccuuuuuguaauucccaggcucugucuuccugccuggccagcuuuauuaucaggcuagugacaaugacugcagcucuuccuggcaucauguccagaauguccaaaggaagaagagacaagcauuuccuguucacucuuucuuagaacaagggaacuuuuucucagaugccuuccaguaucucaugauugccucauugcauuuucagaauugaguaacaggcuccuucuuaaaccacuccuuagcagaggauggcaggggugacuuugaugggccuagaugaaucaggaucaacuucuggagcuggcuuugaagacccaguccccugaguuaaaugauuagggaguuaauuccuuauaaaaucaagguuuucuuagggguggaauaaauguugaauuaggcuacuacuaauaucaacuaaaggagguaaaaguuuugagauuuuucaugaaugaaaauguuucacaugcuuguuggccauguauauguugucuuuugaaaaguaucuguucauguccuuugccuauuuuuuaauggguuugguuuuuucuuauaaauguaaguuccuuauagaugguggauauuagaccuuugucagaugcauaguuugcaaacauuuucucccauucuguacguugccuguuuacccuguucauaguuucuuuugcugugcaaaagcuuuauaguuuaauuagguccccugugucaguuuuugcuucuguugcaauugcuuuuggccucuuagucaugaaaucuuugcccguuccuauguacagaaugauaaaagcaaaacaucacugaccauuagagaaaugcaaaucaaaaccacagugagauaccuucucacaccagucagaauagguauuauuaaaaagucaaaaaauaacaggugcuggugagguuguggagaaaaaggaaugcuuauaugcugggugagaguguaaauuaguucaacuguuguguaaggcaguguggugauuccucaaagaccugaagacagaauuaccauucaacccagcaauccuguuacuggguauauacccagagaaauauaaauuguugugucauaaagacgcaugcacacguauguucauugcagcacuauucacaguagcaagacauggaaucuaccuaaaugcuuaucaacgguagacugguuaaagaaaaugugguacaaauacacuguggaauacuauccagccauaaaaaacaauaagaucauguccuuugccggaauauggaugaagcuggaggccauuuuccuuagcaaacuaaugcaggaacagaaaaccaaguguugcauguuucacuuauaagugggaguuaaaugaugagaacacauggagacauagcggggaacaacauacacuggggccuacuagaugggggagggugggaggagggagaggaucaggaagaauaacuaauggauacaaggcuuaauaccugggcgauuaaauaaucaguacagcaaaccuccgugacacaaguuuaccucuauagcaaaccugcacauguaccccugaacuuaaaaguuuaaaaaaaaaaacaacaacucuauagcuuccauguucgaauuuauaguucagccaggauuagaauuuuagauugaaaaccauuucacucagaauuuugaagcagugcuccacugccugcugccuuccaauauuguuccuggcuauaucugugcuucauccauuaccucuuccccaacuucuccucuucuguaugagguagaggccauugcguaggucaucaguaaaaugccccacaggucuuuuggauggcuucuauaauacucuauuuccuaugaugugauagguaaaacaauggacaaacaguuaagaaaccuguguuuuagucuauuccaaucuguaugaucuugaacaagucaccuaacuucacucaccccuaaauuuuuaugaaucuguucuaaaagcaacuucagaaauuauuugucaguacacaucucuuuaauaacugcuuagagaaguuuggcuuaaauauaaaucuugcuauguuuccccauaauaagcagaaacaugaauuauuacuuccacugacucaaagcagugccagguaaacauuuuaauaauguccauuuaagaaauggccauagcuuguaaguaguuacauccucaucaagaacuuuugcugugagccuguaaagaaauagaguuuuucucauaaaacaaguuuuauucucucccauguggcuuuuucugacuccauauuuccauccuaccagcacccccaaccccucucgcacacagagguuaaaggaguacauaauuacagaaagagaucccccaggcgauuauagaagagugguugcguucuuuaccuugaagauaugagaacuaccauaauuuaaaguggagaccagcauauaaugauacacucagcaacuguuuguauguuaacaagguauucagagcagugaaauauuuuauguaaguuagcuauauuuuguagcuauauuauacauuauauauauaauuauauaagaacauuguuacaacuaucucuugugcacucuuuauauauguauacauauauacauauauauacauauauacauauauauauacauauauacauauauauacacacacacacacacacacacuauauaaaaaaauuaaaagucauuaauaggcugggcaugguggcucacgccuguaaucucagcacuuugggaggccaaagugggcagaucaccugaggucgggaguucaagaccagccugaccaacauggagaaacccugucucuacuaaaaauacaaaaaguagccgggcaugguggugcauaccuguaaucccagcuacucaggaggcugaggcaggagaaucacuuaaacccgggagguggagguugugguaagucgagaucaugccauuguacuccagcuugggcaacaagagcgaaacuccgucucaaaaaaaaaaaaaaaaaaaauucauuaacaaauuuuuggauagggggauuuuguggcauuuaucaggcucccagaaaauacugauggcuggauggauggauagauggacagacagacagaugaaugaaucuuguuuagaaaggucagcaugggaucuagauuauauuggagagcuggagacagggagaucaguuaggacuaacacaguugaagugauaaacuauuuuucugucuuaaaguuaagaaauggcuuuuuuugauugccuauugccuuucacuucacucuuagucuugugaacuuugaagaguuacaaaaaauuauccagguuugcaggcacuggcuucuagcugcaucuucccuaaucuguucccaccuacuuccgcaccuguguuucucaacuuucauuugggggcaaaagguacugucagugccuugcaacggaaguuuaggucuguguuucugagugaguuggcauucuuuccaccucccacuucagcacccacccuuggaaagcucuuaucugucugcugccgaauucuuagaggagggccaggaaaaauccauuguccuuuuucucugucauguucagucuuuggcuuuuuaaauuuucacugauaaaagaagaaaagcauacacaucuaucaaaugaaauaaugauugagaaaaagcuuuuaauaaacucauaaguauacugggauuguagaaaucuuuguaacucuuguccaccuuggacauuucugcagcacagugcacauuuugcagcacaauuauauugaauuucauaauaaaaguuacauaauauccugagcugcuuuagcuuaaacuacaugcagugguuuaugauaauuauuguacuucauuauaucccaguucuuuuaaaguuuuaaguucauguguauguauauauaugacaggcuggguccucuaggaggcagauucugagauuugcauucaggagguucauucggagugcugggcuguguuauggucaaaaggcuucagccagcccugcagagaacucugaggcuagagugguccuucagaguuaccucaacuuggggugagggggauagaccucuauaccuuuauuaguuaucucuauuaguuugggguaauuugcaaacagugugcaacagauuaccccccaaaacauagcggcuuagaacaacaaacauuuauuaccucauaauuucugugagucaggaguccaggugcaacuuagcugaacaccucuaaggcugaaaacuguagcccuguaagagacccucuaguucgguuccucacagggcuacagucagucacuaaucagggcagcagccaugucaaggcuucccagcccacacauggcucuugccaagccucccaauaucugcuuccaagcccacucauguggcuguuggcaugccuuaggcucucaccaacuguuggugggagacaucaguuucuuuccaugugagcaucuccacagacagcccacaacauggcggcuggcuucccucagagcaggcaggcaacaaaaugagaguacccaagucagaagccacaaccuuucuguaaccuaaucucugaagugacaucucaucacuuuugccguauucuguuuguuagaagugagucacugguuaggaaugauacagagagggaaugacacaagcacgugaacaccagcaggcagaggucuuugguggccaucuuagaggcugccuacaacaaccagucacuggcuguaggcugccccaaagcgggauguggucuugggugaagccccucccuucagcugcaacaauuuccaaagaaggcaaacagucgaggguugcaggccagcaaucuuucugacagcugagggaauaaacucuuuaguccuaagugggaucugggugguacugaacagaauccgguauguauagcucuuaguuaaccugaauauuuaauaaaccagaccaucuuaauccuguuauuuaaacuggccaacauguaauauuuucuuuucuguuuuuaagggagaaauuauaggccugguauggugguucaugccuguaaucccagcacuuugggaggccaagguggguggaccacuugugcccagaaguucgagagcagccugggcaacauggccaaaaccccaucucuacaaaaaaaaaauuagcuaggugugguaguaugcaccuguaguuucagcuacucgggaggcugagaugggauaaucaccuugaaccuggaagauugagacugccagugagcugagauugcgccacugcacuccagcauggaugacagagucagacccugucucagaaacauaaaaaggagaaauuauauuguaucaaccacguacuaagaucauucucauccuggcgcaguggcucacgccuguaaucccaacacuuugagaggccaaggagggaggauuguuuaaagccaggaguucgagaccagccugagcaacauagcaagaccugaucucuacaaaaaauauuaaaaaauuagcugagugugguggcaugaaccuguaguccuagcuacuuaggaggcuaggcaggaggauugcuugagcccaggaguuugauguuacaguaagguaugauugugccacugcacuccagccuagguaauagaacaagacccuaucucuaaaaaaguaaauaaauaaaaacauucucuuuuuaauauagacguucaguucaaauuugcaaugaaucauuguuaaaaacuauuuuaagugaacuaaaagauagauccuauaugcacacagcaguuucaaaacaguauuuacccuuuucuagacauaucaaauugauaaauggaucuaacaggcaaguaggaacagugauuucagauuguacgauuuaauaaaguuaugagaacuuacauguccuuuuuaauccucuaauuuauuucagcuuucaggcacaguuuugaucuccuuucuuuauuucacaggcgcagcagaacaagucccugauuuugucaccuuccuuuaccaaauaacuagaggaauugcagcaaggaguuauggauuaaauguggcuaaacuagcagauguuccuggagaaauuuugaagaaagcagcucacaagucaaaagagcuggaaggauuaauaaauacgaaaaggucagagugauuaugcugcauuuuuucauuuguaaugaaaccuucuaaguuguccaagaaagagaggagcguccuaaaaaugaacaucaggucuacuuuuaagcaccucuucaaauauucugaaccauuuaauuaugaugaagugaaaacagcucuugcaaagcucaggugaauucaguccaucuucauuagaucauuauuaaguugcuaaauugguuuuucggucauuuuuauaaagaauuaaguuaacuccuuaauaugugccacauucauuacuuuaaagauucaguaugccaaagguuacugaagauauugagaaccuacagaagauuucuuuuauucauagauuuuauucagauaugcaacgauuacauccagaaauucuaucagagcauuaaugaaaauaauaguauuacauaacaggcaaucacagucaguauccacaugucacuuauuuuguagauugugacaaauuuuucauucuaaacaggcugcugucacuuuaaaugcuuaugggaauacuuuccaccuuuacgcuugcuauccagcuaguauguagucaguacauaaauuaaucuuaauguaaaccugagauacacuuugaaagaaagauauuccuagaaaaauaucauauuaguaaauuauacccuuuuguuucccaaauauaaaauucuaaaacaacauaagcuccccauccaccuacugccccaccccugccguacuuggggagccuggugugcuggguacauuaguacccugguugauaaucauaugaccaugaugaacagauuguugaucgaauagaaaaucuuggcuggcuacugguggucccuguguuauacuccaauaauauucuuuaauauuugguuauaauucugggaauuauuaccaaauuucaauauugaaauaguaaugccuaucauacuagcuaaagaaacaguugcuaacuuguuuaccaaaguacaguagugcaguuaacuucucuuucucuaccuccuucuccugugcuuccgccuugcacuccuccacuucgguauacuguaguucaccaaguccagagugcuggacucuacaaauggcacacagccuccucuagugacacucuuuucuggcucauuuccaaauugcaaugccaaaacagaagcaaaguggcauaaucaguuucagccuauuucuguuacaagccagauuaauauaaaauuuuuccugagggaaaaguaucuaugagaauuuaaaaauaaacuuagcccucuuccucugcaaaguccagagacaaauuaaacucuuuaguugccauauuauuauuguucuuuuucucugaaaaaaaccuagaauaaaacuuuacuacaaaggauauauauacaagauaguaauaaaauaugucaauuucuaaauuugcuguagaaauauaugcaagauagcaauaaaauauggcaauuucuauauuuucauauauucuuguuucugcuauauagccuauaaagcaagagcaaaaaaacucucagauuacucauaaauauuuuaacucuuccaacuaguaagugacauuuugaacucuaugaaguuaucuugacaagaugagagaauuauuagaagacauugcauugggauggaaucugaucauuuaucaagauacuguauuuguuauuuuaccuuuuuucuaaaagugcuuaucacaucaauuccuuuggccagaucaaagaaaucaaacugcaucuugggccuuacuguggauuuguuauaauaguugcuauuuguuggaugguuacuguguguagaaaccauucugagcagucauuugcagcagccuacacacugugccagcuacucuucucaucacuuuacauacauuaucucauuucauccuuauggcagccuuauccucaugguauaguuggggaaagugagaccagcaaggacaggacacugacccagagucacacagcuacuugaugguggagcaguaauuggaacucagguacucuagcuccauacccuaaauagucaauuggguugcuauucugcagaaaaaaaaaaaaaguaagucuguguuaugcuggcguuuuacucuuuaauuagcuucauuguuuucgguugguguuacuuuucauccugggaacacuucauaggaguuucuuuucuccagguacaaauaagcacacaccaccagccucuagcagaguuugaaggaggaggaggucagguucuccccucuggggcuggcagggguaaggauuuuaggagaaggcacaaagguaauaguggcaauugguaaccugggucccuugauuauaguagcagcucugaaagcuccuuucacuggaagggugacacugacacagcuuccuaacuauagagccugcccgguauucaaguguuauagacuuuucauagcuucugaugagacguauugucucccagcaauuucauuuauuaaauaaguaguauuugauuuuuccccagaaagagacucaaguauuuugcaaaguuauggacgaugcauaaugcacaagaccugcagaaguggacagaggaguucaacauggaagaaacacagacuucucuucuucauuaaaaugaagacuacauuugugaacaaaaaauggagaauuaaaaauaccaacuguacaaaauaacucuccaguaacagccuaucuuugugugacaugugagcauaaaauuaugaccaugguauauuccuauuggaaacagagagguuuuucugaagacagucuuuuucaaguuucugucuuccuaacuuuucuacguauaaacacucuugaauagacuuccacuuuguaauuagaaaauuuuauggacaguaaguccaguaaagccuuaaguggcagaauauaauucccaagcuuuuggagggugauauaaaaauuuacuugauauuuuuauuuguuucaguucagauaauuggcaacugggugaaucuggcaggaaucuauccauugaacuaaaauaauuuuauuaugcaaccaguuuauccaccaagaacauaagaauuuuuuauaaguagaaagaauuggccaggcaugguggcucaugccuguaaucccagcacuuugggaggccaagguaggcagaucaccugaggucaggaguucaagaccagccuggccaacauggcaaaaccccaucuuuacuaaaaauauaaaguacaucucuacuaaaaauacgaaaaaauuagcugggcaugguggcgcacaccuguagucccagcuacuccggaggcugaggcaggagaaucucuugaaccugggaggcggagguugcaaugagccgagaucacgucacugcacuccagcuugggcaacagagcaagacuccaucucaaaaaaaaaaaaagaaaaaagaaaagaaauagaauuaucaagcuuuuaaaaacuagagcacagaaggaauaaggucaugaaauuuaaaagguuaaauauugucauaggauuaagcaguuuaaagauuguuggaugaaauuauuugucauucauucaaguaauaaauauuuaaugaauacuugcuauagaugaugguau

SEQ ID NO: 17359 - RNA, 13734 nt, Homo sapiens
gcugcuggccccccuggguccagaggagccuugccgcccucaccugcgcagagccuggagccgacgcgucacccccagcggaagcgccucgcugcccgggcgucuggcgaggugugcgcuccgggucccagcuccagcgcuucgcggcagucgcccgccucuuuccgcaagcagggcggggacugggcggcaucuaccgagaucugcgauucgaggcgccgaggagccgaagaccacagcucagcucagacggcgcccuagggccgcacagagggucgggcagugccggagagagguuugaaagcgccgccgccaacucgacagcgcgucccaggucagugugaggcgccgucccugccggcugcacuugggaaacuuuggcuugcaguggcggcugccgggaggaggacaucgagggcgcagcguggaacccagcggcccgcacggccucagugcucccugcccggugcgcgcaagccccugaagcccgcaccucccgcucacccugacauugcagugccccgagcaggaugagagacccagggccagccgagggccgccgggcugcaggggccucccgagagacucugccccgccaccccggggcgcgcuccacgcgagcucacccucgcgccuccugccuuucccacugguucucgguuccaguuuugcggccgcuggggcuuggacuccgcggggaugcggguuccgccuccuucucagccucgccgagcggcgggaaccggcgagggcugcccggccgcggggugucgaggaggaugcggggcggggggccugaugggcgaaggucggcgcagcagcgggagcggcgcgcgcugggccgcaagagcgcgcgggucggaggggcugacuugggcgcgucuccggaggggcugacuugggcgcgucuccgcaggugccucggcagcugggcagcaggaggugccggcugggcgcugggggcgggcuggggacugcggagcccuuugcagcuuccaggagcuccugcuuccaggagccacacaggggcgggcagccgguucccgcccuucucaggugcgcacagccuuggcaccaggauaccggacccccuuagcagagagccgggugcagaggugcgccugcuccgggaugggggcaguggcugcgccccucagacgcaccauuucccaagggagggccgcguccggccggcgggcgagcggcgcagggaccgcuccgcagcggcugugggcagaacccguuuucauggauggugaucgccuuagcccgccagcugccugcccuggcucagagaugaggcgacgaaacgcgcaccccgcccccaucggugcccuggagcugucgccccagucaccuuccuuugcccuucuccgacagcgccuugagcucgcuuccuccugcucucaggaaaaacugaggaaacgcgccugguuccaggggucggcggggaccguggagacgcugccagcauccucaacagcuuggaaaucccaucaccuugguucccugagacuuggaggacuagguuggccucucucucucucucucucucucucucuguguguguguguguguguguguguguguguguguguuuuggggggaggugaaucaguaacagagguuggggcauagaugccccaaaggccugggggacagccgaaguaacuaggagaacacggcagcccuuugcggguaugugugggaaacacagcaaaccuuaccagcuacgcgucuccuuggacaguuucuaaauauuucuugcaagucaauaccagggaagaaucuuuuucuggccagucauuccauuuuccaggacgaccucagaugcaucuuuuauucugucucugccccuuuccuugggugggaggagguacacauuugcuuguggcaagcaggcuugccuuauuccaguguagcuggccucccuccuggccuucggcugcccacuagggcucuggguuuuuucaaacccgucuaggaaaggcagggcagcaaaccuccagcuccuggcccauucuacuaauucaaggcuguccucuucucugggaccugugagcucccuggacccgucucuaggcuguggcagccaucuaucucugccuuucacuccugcaggggagccgagcaucgcaccacuuggaaguaaugucggagacagcucugugugaaucugaggcagggguccauagcaaacaggaaguggccuggaaugaggaaugaagaguuugccucagauuuucuccaagugugcauuagaagcaccucccauggaauaugugggaguggagccuagaauuuucuuuuuaacaggcacuccauguguuucuuaugcccacaaaagaagaacccauugguauagggaacuuagcaucccaucgucagaccccaucaguccugaggauuccuguaugcagugccuguauuuggugaugcauguuuguaaauggacauuuauugaauucguaaguagcaaguauguucggaucuuuuaaaauccucacaaucaucuacuguaaaguagauauuauccccauuucaggggugaggaaacuaaggcucagaagaaugaccucccagagguugauaacuuggagagauccggagcccaggucccugauacgcacccugcugccucaucugagcagucuuuaauccccuuuggggcagcacauaggcagggacuggggcaagggcgacgggcugaauuuugaguucaaacccauuuguuaaguucuuccccaccauggccagaugaugaacuuuaugagaggaagcguggauccuauuuggagguagagugaaaggcucaaaagaaaauaacuuuuccuucuuuucuuuucuuuucuuuuuuuuuuuuuuugagacggagucuugcuuuugucacccgggcuggagugcaguggugcaaucucggcucacugcaaccuccgccucccgaguucaagugauucuccugccucagccuccugaguagcugggauuacaggcacccgccacaaugcccggcuaauuuuuguauuuguaguagagauggaguuucaccaugcuguccaggcuggucucaaacucuugaccucaguugauccgcucccccucggccucccaaagugcugggauuacaggcaugagccaccaugcccggccacuuuucugccuuaaugaaaggaaaacuggggguggcauggggacaaaaagccacaggaaaggccuggccuaucgucuccaagauggcuuugcaagcaccucagcucaugcagcacugccaugugagauaacacacaaaucaggcccucaaaacaguccuacuccgugcgaagcucauccaagaagcaaggugauauugagauaaaggacacaaacauguaauugaccucuggcaaacaggugaguaagaugauuggcuuugggagagugcccucaccuuuccuuucucagccuccugaucugcaccaagugagugccgaggcccuuccaaccccagcaguccucgcauggcagacucagcccugcaggcagacacacacgggguugcugugcauagaaucuccagacacuuuacaaacucauaaucagugagauaugacuaacugagcaaacauugggggauuucuuaauaaggaauuuaaaaacuagacuccaaaugggaaagaugcauguaacaaauuauugguguuuauguaacucugaauagcuuugauuuccuucaguaggaacugacagcuggcugacagaaaacuuauccagggagagaagagacaaaagugaagugugaaauuuugaauaauguuuucagguaaguuucuauuuccauuuagagugggugucuggaagggugaaugcaguuaugguuugaauuucuuucauguaucgacagauauuuuuaauagggcucaucuuuccaagaugcaaugugucuuacuuccuuuuccuggcuuccaguccccucguagcagggcaaggagcuggggacuucaacguuuggccugcacaugcucacugaaucccuguuuucagcaagcugccucuaaguuuggagccuuucugaucaauuuagaaaauaaaucuucauuuucuugccuaggaaagugguugucugauuccuggggugggauagaauauguagggguccagucguucuguucacagacuuucaaucaucuucuuguucuaagcccugauacucauugccauuuucuauggcacuugggaccucuaaguccuaaaugucacagguccuguggguaagcagccucccugggucuauguccugcagccuccucugcuaugcuaaggccauuugccacuccaccauccccccauuuccagagcuuguuugaaauugcucaucuaaugguaucucuccuccaauuuucuuuguucuuaaaaauacacauauuuaaaauauuuuuuaaaaauaacucagugcuuauuauuuugguggcaucuugggcauagagggaggaacuaaaggagcaucguaaauaugccaugaugaggugcaagugauauuaaagacacugcaauuuuugaaugaaaagcaguuuauccagcuguuuaauaauuaauaucuuguaauaaugucgaaaugauaguauuuggaaauuguaagggaaguauacuuaaaggauaugcucuuuccauguuuugcuuauuagauuccacugauguuuaccaaaugagaagaagcauagcaucuuagaaauaugagauccuuaaaaaacaacauuuccaguauuuuaucuguuauuuuaaauaggcuauggauuggagagaugauaaacauuucacaaagcuaauucugagauaaacacuuuaaaaaagaagaaugcagugagugugaagacaaaacaagaaaguauuucucuagacagugucugauuucauuaccacauccccauggaaugcacguucuaugauugucauuccacgcaugaggaacucaagacuccuagaggcugagagacuugaucagggcacauagccaauaagugugagagucacgauugacaccugucggaugccugaacuuucugcaguugaacuauuaucuguaucgaagguacaacugaauuuggggauugcuuauagucuagacauaacaaagggauugacuggauguuaguaugcuaucagcacucaguguccaaucaggaugcuccaaggaggaaagaacguucuaggcaagagaaguggucuucgucaaaaguagaguucaauucuaugaaaaggaaauaugucagacauaaauaucaguguuuuugauguacaaauggagaaggugagauaaaagaaccccuggaaaaggaugaagggcuaaagagaaggggauucuuccauucaggcacugauuacagaaagaaccugaacauguauuguacauuuggagaauaaaguaucuaacaccuuuuuucucugacaaguuuaaugucuaggcaauuucaaaaguucucuacuaaacguuaaaaagugagcaaacaggcugggcgcaguggcgcacgccuguaaucccagcacuuugggaggcugaggcaggcagaucaccugagguugggaauucgggaucagccugaccaacgugaagaaaccccaucucuacuaaaaauacaaaauuagcugggugugguggcacacaccuguaaucccagcuacuccagaggcugaggcaggagaaucacuugaacccaggaggcggagguuacagugagccgagauugugccauugcacuccagccugggcaacaacagcgaaacaccaucucaaaaaaaaaaaaaaaaaaaagaagugagcaaacaaaguggcuuuaaaagucuuuauaaugaggaaaaagucaaccucauggggcugguuuugcuggacacucccccaguccucagaggagagggucugccuauguccacauugcagguggauuaggcagcgaguugguuccacugcucaacuucucugagacccuggagcccacagcacccucuuuuuccacaagacugugauggggccacuguccuccuuaggcacggccgucgccagcauaguaccggcuccucuucuucucccagaaccuccugacaccaaccuuggugaaagaaaagcugugacaguaagugcucagguuuaguguuguggagaaaggccuuuacuggaggaugauagcugaaaaguagaaagucuuggcugggcauggcggcucacaccuguaaucccaacacuuugggaggcugaggugggaggaucguuugaggccaggagaucaagaccagccuggacaauauagcaagaaccugugccaaaaaauaaaauaaaauauuuaaaaaaauguuuuaaguaaaauaccuuccccuaaagauucugcuaagacuuuaaaaacuaaaaacaagauugaccuaaacacuagaaacucuaagagaguauaauauugaaaucugguaucuggcaacuuguucucauuugaauaucuguuucucaaaugcuacuuuuggucaaacaauuuuuuuaaaugacugauacuguauagcaauugaauugcaauuacuaaguaguuucuauauuugauauuacauuccagcucauuucucuacauuucuaugaucuauuaagcccauuuauauaugaaaaaugcuuuuaaaaugauccuuuugugaucacugucucaugugagcucuuuucagaugcuuugcauucagaauagaccucugaguugggacccaagcugucaacugaucccaaauuccuaaguuccugacuugcagguaugucuggcuccaagauagccuuuauagaguaugucacaggggacauaaaaucaaagcauucacucucauugcauuuauguauguauauauugaguaguucuuugcuuugcaucaugaaugauacugcaguggagaugaacacuauguccuuuugaauacugccuuucaggagcuuaguuguugaaacuccagugaaagucaaggcacaaaugucauagauaaugucaugagaacugaaugacucuuuuaaaaggaagaccuaauaggacucuuuguaaauuuuaauaaugaaguauaucucacauauaugcuaugcucuuuucugcacacacauucuauuuuacaauaaguaaauaaaagugauauauagaagaguacaugaaaugcguacuguuuaaagaagaagaauagaauggacacccaccuaugcaccacccagacugggaaauagaacaucaccugaaccuucgggccucucucugucccucccaaacggcauuguucuccuaaucucuaccaaggaguagcugucucuugauguuuguauuaaucauucccuuugcuuuuaaaaaaauuuuucagguucccccuuauauuugaucccuaaguaaaauaauuauuuauuuuuuaaaaacuuaguagcagguacaaaauuagaugaauaaagaaaggacaauauugccaguguaugacaaaagcuuuucauuuuucaucuuuuucaauuuuucaucuuuucauuuuuccgauuaauauguuuccuccaaguugcuuuuuucaguuuguucuagucucuaucuuuaauguaagaggcauuuuuguuuguuuuuaaauuuuugguguggcugcucaugguuaaaggguugggauuaaaagcugaugagaagccuuaaacacacaaaugaggcuugcguuuucagccucauuucggguacugauuacagaaagaaccuaaacauguggguacauuuggagaauaaaguaucugacaccuuuuuucccugacaaguuuaauguuuagacaauuucaaaaguucucuacuaaauguuaaaaagugagugaacaggcugggcgcgguggcaccaaauguaaguacgaccuggguggcaugucagauucuugagagaacacuauagcaauuuaucccugagggcugagggcguggcugccggccuccucgaagccaagcuggggaagcaggcugugggacccuucagccguggucaguaagcaaucacuuauuccccuguuuucuuguucucaaacaugccuggugucuccaaguccagagaugcucuguuucaucauuuccugagaauaaaccucuagacaucccagagagcgggagggguagucuucuaucuccuagugacugccuaguggaguuggaggagugaccuaagguagcacuucucaaaccuuaaugugcauacaaaucaccuggggaucuuguuaaaauauaggcugugauucaguagcucugggguggagcugacauucugcauauaaaagaguuuucuggugguggugaugccaggguaggaucacaccucaaguagcaaggaccuaggaaucuaacugcuuaucugacagcuuuucaccuacuccuccuuauuuuagcuguauucuucacacacacacacacacacacacacacacacacacacacacacacacacacgcugagucaguuacuacuggcucaucugcuuucuggcuuccaaaauauuguugcugccaucuucuccucuucccucugucuuuaauuuugucuuugacaaaauucuuugguuuuaaggauuuucaggaagaagcaaaauuagauguguguguucugccauauuaacccuaacuaucugcuaaaauauuuuccugaaguuugguuguaaccaaguaaauaaagucuguuuccuuauaaauaaccgcuauuuuaggccucuaggucuuugcaaaaggaguauuaucuauuucucccuccuccuuugucugccugccagauucuuacaaagucuucaagacccaacucaaauaguuggcuucugugaagccccuuuugguccccaggauguuaaagcuucugugcucuccugacucuguaaccagcugcuuauacaguaucucucccaaaagacugugagcuccucagagauagggcuuguaucuuuguagcucagugcccagcacaugucaggagcuuguagauguuuaacaaugaaauuucugccugcaugcuuacuuuucucuuuuuucuucccuuucuuucugcucucuucaucucuucuuucuuuugguuauuagauuuguuaucuauucuauuaucaaauagaaaucuauuucccauaaucuuaauuuuaaaaguaaauagguagaauaaacaauaguuuucaguuuccaaaaacuacugaaucaaugaaacagauguaaauauuauauauacauucaucugauucucccccucccaacucuaaggacuguuaaaagacaaaaauuuucuuaguccucgaugaagacauaauucuuaccaccuaauggaauuaucuguugaaggaaucuaaaucuaaaauauuuaaauaaauuaaacauaaauauuuuuuaguuucaauaacaaaaauuaaaauguuuacaaagucuggauggcuccuuucagguuucuugccuaugaaacuccuuuuucagagcagauauacuguugucaaaauuuaacccuauaguucuugcuaaccucguuauguggucaguauaugauuuaaauaauagaaucaagagaaaugcguaaucacaugcucaccauuccaaucucagugugaauuucagauauuaugucaguuauuuuaacacguuguagcccaaacaauauuucguccuucaaaagaaacauaaaaaugucccucaaauugaaagucuagauaucacuugcauuacuuaauugaagagcauguuuaaguaauguaauacuaaaguuuuuacauuaagcuaccaauauuuuaauugauucaguugcaaugacaacagaauuuuggcuuuuuggcuuaaguuuacuuuuuaaaauuuacauuuuaauuaauuuuuuuuagagacagguucucacucugucacccaggcugagugcagguaggaugaucauaucucacuguaaccucaaacuccugggcucaagugauccuccugccucagucuccugaguagcuggaacuacaggucacaccaccaugcccagcuaauuuuaaaacuuauuuuugguagagauggagucucacuacacauugcccaggcuggucucaaauuccuggccucaaguaauccuccugcuucaaccucccaaagugcugggauuacagaugugagccacuguacuuguccuaaauuugcuuuuuaauauuauuaauuuaaaaauuauuuuucacagguaaauuauuuuuuaauuaaugugggacuuaggaaaguacuauuuuggugcuauaaauauucaaugaagauuuugaaaauaaauuuuaauuuguaauuuccuaaaggucauuauuauucaaaaauuuacuuuauuuugcaauucacuauuuuguucugcauuuauuaauagcaugaucccauuuauguccccuacauauuuucaaaauuaauucugacaaaaugaauauaaguugggaugcugauucuggcuaaucuuuuggucuuugccaucuuugauaaccagguauugaguucuaaccuccgaagauggaugaagguauggaaauuucaagugaaggaaauuccuugaucaaagcaguccaucagagccggcuucgccucacaagacuuuugcuagaaggcggugccuacauuaaugagagcaacgaccguggggaaaccccuuuaaugaucgcuuguaagaccaaacaugucgaucaccagagugucaguaaagccaaaauggugaaauaccuguuagagaacaaugccgaucccaacauacaggacaaaucugggaaaacggcucugaugcaugcuugcuuagaaaaagcuggcccugaaguuguuuccuugcuccucaagaguggggcugaccucagcuugcaagaccauucuaguuacucagcucuuguuuaugcuauaaauucagaagauacagagacccugaaaguucuucuuagugcuugcaaggcaaaagggaaagaggucaucaucaucacaacagcaaaguugcccugugggaagcauacuacuaaacaauacuuaaauaugccuccuguggauauagaugggugucauuccccagcuaccugcaccacuccuucagaaauagacaucaaaacugccucaucgccacuuucacauucuucugaaacggaacugacgcuuuuuggcuuuaaagaucuugagcuugcuggaagcaaugaugauaccugggacccagguuccccugugaggaaaccugcauuggccccuaaggggcccaagcucccccacgcuccacccugggucaagagucccccauuauuaaugcaccagaacagaguggcuucauugcaagaggagcuccaggauauuacaccagaggaagaacuauccuauaaaaccaaugggcuggcacuuuccaagcgguucaucacuaggcaccaaagcauugauguaaaagacacugcacauuugcuaagagccuuugaucaggccagcucaaggaagaugucauaugaugaaauaaauugucaaucuuaucuuucagaaggaaaucagcaaugcauugaagucccuguugaccaggacccagauucuaaccagacaauauuugcuuccaccuuaagaaguauaguucaaaaaagaaacuugggggcaaaucacuacagcucugauucccagcucucagcuggccuuaccccuccaacuucagaagacggcaaagcacuuauaggaaagaaaaagauccucucaccaucuccuucccaauugucagaguccaaagaauuguuggagaauauccccccagguccccugagcaggagaaaucaugcaguuuuagaaaggcgagguucaggagcuuucccuuuagaucacaguguuacccaaaccagacaaggguuucucccacccuuaaauguaaauucucacccucccaucucagauaucaaugucaacaacaagauuugcagccuucuuucuuguggucaaaaagugcuuaugccaacaguuccgauuuucccuaaagaauucaaaaguaagaaaauguuguuaaggagacaaucauugcaaacugaacaaauuaagcaauuaguaaacuucuaggagauggguauaaaacacaucuucuucaaauguuuauaucagagaaacaaagaacuagagaagaaaucuuaaauguucauucuuuuaaaucucgugauugguuaguccauaauggcuagauggauuaaaauguaaugugauuuguacuaggcgucaugagcauaaaaaauaauacauaguuucuguuaagggaauucucucaaacaaaaggaaagcgauuuuucucaaugcuucuaauauuuaacaaucuccauguaguccaaauuugucauuaaaaaaaaaucaaagaaagaaggccacguauguugggguaauuuuuaaaaauuuucagauuggcuaaauauuuuauuaggaaacaguuuucaagucaauaauuuuuuuaacauuucauguuaauaaaugagauugaaauuuuuuaugaucucuaaaccauaaaagaaaacaccgacagcuguaaaauguucuaagauaaaaaaacucgagcuacaaagaaagaaugaacuaauucuuuacaaauguugacugaagauagauaaaacucuaauuaaaaauuuaaaagguuaaacacuguauuagaaugggcaacuaaaauauucguggugucaguuuaauuagugucaaacuggcaagucagaguuuuacaaccuacuaguaaucuaugccgggucuuguuguuugugcacuguguuuugcuuugcuuuguuuugguuuuuaaacagacuuaccuguaaaguuaucuuacggaauuauucuuucuccauaucuuuuaaggaauuauucuuucuccauaucaucuuuuaauuccuguuauuaguuuuggaagcuuauccauaaguuuccaaagacaagaugauauaaaaguuaaaaagcauuccucuuuacuuauaucaaauuauucuugucuuucaaaaagaaccaaaaaaaaaaaauucaucauggauaaaaacuaagcgcuugccuucuuuuaaaaagaaaaacugaugauuagauuagguuagcuaaaauuaauagaggcaguagaaacuuaaucacaaaauguacuaaauauuuggcaauauuaaacaaugccuuuuuauuucugauauguaguuauuagacauuuauauauuaaggauaacuuccuuagugugacauuccaaucauuuaguauuuuaggaccugugaauaacuuccaacaaaauuaaugaauaccauauuaguauuauaaaauauuauaaaguaauaauuauaucaucuauauaacuucaaaguaugauguuuauacaaagaauccuuauuucagucuagcagcuuaacaacaaaggauaaaucagacuauacaaaaccuaaguguauuaauuugaugauugucacguacaacuuucuuugccuuccaaguagaggugauccuaacaauuggcaugaugcuuuucuugguaauuugauauaagcaaguuguaauguacauaguaauuauuuaauuacuguggcuuuuauuuuaaaaaguaauuagagguuuuuccauuucaugucuugaacaacauuaauauuaauuacacuagaaauauuuuuugauucagaacuuagaauuguaccugauauuuauagguauuuaaaugcuuucugcaaguuaaauaucgagaaaaguacuugacuucaaguuguaaggauacaauuuggaaggguauguaaauagauuaguucauaaacaaaaugguaucaauaaagauuuuaaauaucau

SEQ ID NO: 17360 - RNA, 3060 nt, Homo sapiens
ccgggauaguaaaggucggcccgcgcaagauggcggcccccuuggaacucaguugcuggggaggcggcuggggacucccaucgguucacagcgagucccugguggugauggugaggccgccucgcgggccagggcgcaggaggaaggggcggggcuggaggcgccaggcugacuugccccaguuucccgcugcgcugcgggguccaggagggccgagccgcugcacgcugcauugcccugggcucccucccaccgacgagucccaaccuggccgauacccccgccgaaggccggcggcgacaucaaggcuucuccgcuuggcuccgaguuuuguccgccucacaaagcugucugggcgguggagugaaaccccgaagcaaggggcgcgcccucccuacucugcauccccaggaccuuuuggggagcaaaguccucgaaagccggguggcuggcgcccgcgucccuacuugagaucacggggagggaugcggccucaguaucagucgccuucugccuuugggggauggggcugugaaguaaagcugcucugcagcuuugcauuacgcacuuggucuaaaauguuugauugcaaacucuguuucaggcuuaugccaaauuuucuggugcacccuugaaagucaaugugauagauaacaccuggagagguucaagagguauaguguaaaccuuuacacuccccuuucugcacucuuuuuuuucuucuuccauuuaaagcugugagguauauagcuauaauauugaggauuuaguuucuuaccgugaccuuggcucuguguuguuuaugguuugaucauucugaguaauaccucaaagugcaagcgaaaucacuggaaauuaugagaaacgaaaauguucuuuagaaccgcucuuugugaaacagcaaaaaaaccaagacaagcuuacucauuuuuuccccucuaaaugugcaacugcuauaguuuuuaggauauuggaaucucucagaggaaaucacacuguguccuuguauguaaacuguuuuuugauuauaggcgauguaccaauuuugacaacugaagacgacaugguuucucagccagcaaaaauacuaaacuuuuuaagaaaacaggugggugguucacuuugaagaaguagauugguagauuguugaucccugcauguugggcuuuauuuuauuuauuuauuuuuuuuugccaacucauuagacaauuggagauaccugggacaagauguaaaaauagauuugagaaucacugcucuaaagcaugaguucugugauuugaaagucauaugaagagguagucaguuuauauuuuaauaaacuuugcuugaauuuuauugaaauuuguauguaaguagauuuaauuagccauuuucacuauuaaacuuauugauaggauuguguauuuugucacauaguugguacacauuuugugcugggcaugacaccugagcucucaccaacuagcaacuauauuauuuuuaaaaagcucuuaauagcaguuuuauggaauaauguaucuaaauguuuuaacaguagagaauuauguauccaaaauguuuaaacauguaaagauuuauaugaauggauaaguuauuuguuuugccaauacuguacuuaaaaaaauugugucaauaacauuuugaacuuuuauaaauuggaagguuuuuucuuuugucuuggggagaaacacagccaauuggaacuguuuccuucuuguuaaaaauaauaguugcuuuguuuguacuacaugccaugcacugaacuaggucauuaacaagcaugaaaauaauaguaguuaauauuguaacauuuauugaccauauuguguaugugaugcugugcuaagaacuuuaugugcauuaagcaauagguuucacuggauuuguauuucucuuucucccauuuuaauaccacguuugcuauuuguaaggaaaaauaugaauccugauuugauuaguuuuacugucuuugggcugcucuuugacuucugaguuucuuugguuuauuuuuuuuuaauagaaauauaaugcugauuaugaacucucagcaaaacaaggggcagauacauuggcuuauauugcucuccucgaagagaagcuucucccugcaguggugaguguucuuaaauauuacaguauuuuaguagccuaguugcaaauguacauagucuguuuagaaaaaaaccaaugagaaaagucuuaagagaaaauuuuacuuauauguuaaucuuaauuccuucauauuacugugaaacuggauucuguuaggcauucaacuaguaugugaaacaacaaaguaaaauaaaaugucauguuggaaauucuuugugggagauggaucuuuuugcuccauguauagaauuggguguaauucauucauucaacaaauguuuauugaacaccugcuaugugucaggccuuguucuggguguuuggaagauagcagucaacaaaacucacacauuuaaaauaaucuuguuuuauccugagucauucuaacuggaaaauuuguaugaagacacuucauauaaagauauuuaugaaaaacucucauguugauugagugaucuuucauuuaauaaaagaacauccuuguaguguuuuuucucuucuuuugcagcuucacacauucuggguugagagugacaauuacuuuacugugacaaagccaugguuugcuucacaaauuccuuuuccuuugaguuugauccugccuggaagaaugucuaagggagcacugaauaggauucuccugaccagaggacagccuccccucuaccaccuccgagaaguggaagcacagguauaguauggauuauucuucaagcaagggcccuagagagaaaggacaagauaaaaugcagacuugaguuuaccuagagaugccuuccucaaaaguaguuuuagaguaucuuuucuacuuuugagauauaauuucauccuuauuagauauacagagaugccaaggagugccuaaaucuucuaucaaacagauugggaacaucucaguuuuucuuuggagauacgugaguauucccuuaaaaaucauuuugguau

SEQ ID NO: 17361 - RNA, 6726 nt, Homo sapiens
auucauaagcagucaggagauuugagauuuuuauugagaaaauagcuauuuugacauuauauccaguuucucauuuaucagaauaaauucuuuacaauauugaucaccaucaccacuuuaguguauuuguacauagucucugaguaaaauauauucacacucggcaaggcuagaauauugaaauuauggccaacauugcuuacuuuaagauuguuuacuuuauaaagaagcuagaguaguugugcaacuagaacagauguuuuuaaaauguuugccauucaaagauaggcuuggugggacaaaacuaauaugcauacuacauacauauauuucuugucuucuuuacugucaaucuuucagaacaguaacaugacauuacaaacaccucaaauucccacuucaaaaugaacagaaaaauggaaaaacauuauuucccauuucauaaaauuaaaaaucaagucagaagagaaguaaaacucauuuuuaugcauuuaacuuaaaagcuugaauacacgacuccuccuagagagaaggaagccagaacuucagaaguagccagugguccaaagaauaaauggccccaugaccuucucuaugguucaugacuuacugagggcugaugcaaacucuggcaaguuauuuuucaugauuuccaaggaucugggauauguaaacgaaaugauuaaaagacauuucucugaauuugcaagaagacgacugaagaaucagaacaaagauccaacggccuuucacguggcuacauguucaccauuacaccacaacucaaaacccacaggcgagcuuucucucaaauacacauucaaaaugguguuccaaauaauccaauuguauacauugcaaagacacacaaaaugccuccuuacacacgauuaguaaucugguuuuagacucugaagugauaccaaacauauuuagcuaacccucucaaaauugcaggccuagugagguuuaaauguuuuaggauauagaaucugcuuagaauuuagugaaaacuaugaaccguagacugucuucgguaaugaacaaaacuggaaaauauuaaacuuccuuugcuuugucacugagcaacuauaagcuuucuaugauguauguaucauacuagcuuguaugugacuuuagugucauaaacacccauugccuuuuuggcacuuuuaaaguacagccagaaaagguuuggaaaauuguucuggaaauacaaguugguucccucugucucauggaugcuuaggaacuggguagucugcugaaaccaccaguucagcagacccuuguacagcuguucccggccaacugggauccuaaggaaacaggcuggaagagccaggggccucccucacaaaugccuaaauaaccaacauaucuaugccgacagccaucccucucucaaugccaugguccaagggagucuugaccugucucuucccauuuuacuaccacuggcuagaggggcacccaacaacaagaaaccuuuguaaugaguaugaacuagcaaaaacacuguagggcagcauuuccuuagguguaucucucagaacauaaaucccacaagauaccuacuuuuaaaaaaaucuggccggggacaguggcucauaccuauaauuccagcacugugggagggugaggcgggcagaaucaccugaggucaggaguucaaaaucagccuggucaacauggugaaaccccaucucuacuaaaaauacaaaaauuagcugggcgugguggcaggugccuguaaucccaguaaauugggaggcugaggcaggagaaucgcuugaaccugggaggcggagguuguagugagccgagaucgugccacugcacuccagccugggugacaagaccaagacuccgucucaagaaaacaaaaacaagaaauccauauuaaaauaaauuagggaaaugauguauaaaauagaggugcuucuuggagauuuaaaaugcacauuagcguaucaaaggucugaaaggccaacaguaacucaacuuugucuaacccacuauuucccaaacuuacuuggccacagaacccucuauucuccuaacaauauauucugacaaaacacuccuucaggaacugcuucacccagaaccaaacaggugaguuuuaaaaaauauuauagcauaauuucaaaugauuaauaaggauacaaagagacuuauuuuccugucuuuuguuauuuugucuacuuauuuuguucugaauaaucuucuaucacauuuccccuucuauucacaaaccuucaacucgaguuacccuuucugauaccuuuguucaagaauguuaauucuuaucagaaauccauggcacacuagucuggaaaaaaauaauuuugugucuuuuuaaauuccuagaguaccucuccacuucaaucacaauuuaaguccagggcagguauccugggcuccuagcaaacacuacaccccaacaagaguuugggagccaaauuauuuugcaaacccuuaagaacacaaacuaaaacuaauuuauccuuauaucucugcaaaaauuagcauuuugaacauccaacgaaacuucaaguuugaggauaaugggcuuacugaccugaccuuugauuucacguaacuaacaacaaauuucuuuaaaaucugguuaagaaauaugaaaauauugaaaaguaaacauaaauuccacaaagcugaauggcagcaaaaaauauuucuuaacaucaagaacauauacaaaagaugaucauuaccacccaaauuaucucuguugcucaggauuucaguuauaaaaauagccaaaucaagacaaagacaauuacagcuuaaaacgaaaagcuacaccuucuucauuaaaggugagcaucuugucacacugugcauauggagagagaacaaguacaaggcacgggagaacuaccaugucaagggacagagcuuuuucaaaauauuuuauccucagaaguaaaccccacuaccauagaaagaaaaaaauauaauuagauauuuuaaaucacagcauuuuugacuuccuagggaaaaggaguuuuugguuuuaggguuuuuuuuuucuuuucugguaaggcaaaauagaucuuuagauaucauuuguuacaaacaugaguuuuucuuaagaaugaaauaaaaauucuauuuaacuucuaucauauauuuauucaacuaaguugaauacuauguuuagaaaauuaaaguuuuaaaucaugguuuauauauagauaaugauacauuuaaucuaugaauuuacuuuaaaaccacuuuuauuuugaaauacuuaagacucacaagaaguuauaaaaauaguucagagagaucccagguacccacugcuuagcuuccuuucuuuacauguaagcauuuauaucuagguuuuaaaaggguugaaguuuuugacaguugaugaaaaacugucaaaaaauuguaacaagccugguaaaugcauauuuuuggaggagguucuaaggaaacacuaccaaguucaaguaccacuuuuaucacaugcagcugccuuaaccaacagguuuucuaagauacuaucccccuuaccuguuucugccucuuucaaugguguuuuuccauuuuuacagacuucugaaaauuuuagcuuugauugaaauaagcuuccccauuccuucauguuaauauaucuagcaauauugaauagaaauuauaaauggaaauaaaaaugcuugcuuuuauaaaaucuccagucucgcagcacccccaauauaauacaaacaaacuuaaguugaaauuugguuuguuaaugcccaccuuguguggucaaaacacaguuuugaaggaaugaccaccuucaauguucuuuacagcuucuuuaguguuacuuaaaaaaaaaaaaaaaaucaaucugauggaugauugaugguaguuuguucauggaagaucuucaucuuaugggaauuaucuaguuuuucuaaucauauacuaccaacaaaaauaaacacaagcauguucccuuuaaucauauuauccuccaccauuacuuccaaaaggcauuggcucacaguauucuguuuaagauuguggaccauuuaucccaaugaacucacucaaacuuuaucuaaaacauaucaugacaggcugguccaacagucuguucagucugaaaaaauguucugugcucuguucagauugacaaaauguucuuuuuggccgggcgcaguggcucacgccuguaaucccagcacuuugggaggccgaggcaggugaaucacuugaggucaggaguucaagaccagccugagcaacauggugaaaccccgucucgacuaaaaaaaaaacaaaauuagcugggcaugguggcacaugccuguaaucccagcuacuugggaggcugagacaggagacuugcuugaacccaggagguagagguugcagugagccgagacugcgcuacugcacuccagccugggcaacaagagugaaacucugucucaaaaaaaaaaaaaaguucuuuucuaagagcuuccuguauguguggcugcucccuaaaguacuuugugcucaguuacagcuuccugucaucucauuuacuuauacauaaauagcucaacuaaguaacccaacauauaaacucucacuaaacucacauguugcaucuuagaaaaggugaucuggaagcauuauggacuauagugagaauguaaggcuaacagcaguucaaaguagggaugacacaaaaacaaauaaaucauauugacagucauucccucuacuaaaaaagaauaauacuuguuauucuaaaaugaccucuuuugauuaaaauuucaguucauaaaacauuacaguaugcuucuuuaucaaagucuacauaucagaagaacaugagcuccacguuccuguaaaacuuuaaacacauuuuucuuccuaauagacauuagcaguuuuguugaaaagaaaaauugacauaaccuagcauuaucuuuugacuuugcccauggagaaacuuggaguuaaauuuacuacuuaauuuuagaaucugucaguguugauaugguucuauaaauuuuuaauuuuuuuaauuuaaauuuuuaaaauuuuuaauucuuuaaaauuuaaaauuuuuaaauuguccuguuuuacauguaauauacuuguaauauacauguaauguacuuguacguuauaacuguaauauauuucaaauacuuuuuggagggucugauauaaaucugauauaaauuaaaaaugacuggccuugaccacagcauaagcagaugucugaugaaugugcuaaccacccuucuccaauauacauccauccuagaggacaauaaagucucacagucaugauuuccaauauaacauauuuagguuucagacugcuggaauaauagauuucagauugcuggaaucuaauaaucugccuuugaagaugacugacacacacaaacacacacacacacacccuguuguagaaguaaugugcaacucaugagguacuuucccucauccaaacagaugaccaagauuuugaagacuaccuuauuucucacuuaguuaaaacuuucaagaaaaaauauuuagaaugacuuaaagacucuuguauaaauaacuaccuaaauacagaacaaauugggaggaugugggucaaacacagcugagcuccacucagcucaaauuagaugagucuuuugacuacaaagcucauuuucuuaacauauggguuccugcacgacuugauaagauuugcugagcaccacaguaaucuuuuaagacacuaaucaaaaacaugguucuacauuuuaaaaaccucagaaguaguuuuaggacaacagaagcaccucaaccacuaaaauaagcaaguuucuauuauaaguaaaauuaccacacagcaaaucccuuaacaguucagcaaccaauaaauagaaaauauucauuaaaagcugcuauuucugauuguuccuuuguauucuucgacuauaagugaaacauaugaaaaauaauugguugucagaaagcuuuugacuacaugauaugcaucuuaugaaagaauaugcaucuuaugaaagaauaugagccaagcauagaaaacuuggaccagaugcacaguauuucuacuacccuggccaugggcuccuccugaguagugucuaacaagugggcaauuucaguaagaauuuuacagccuagcauaguaacgauaaccaguacauucacuucuucuggaauuaauacaagaaagacaacugaagauguacuacaaagacauaggucuaaaacugccacauuugcccaaguaaacuaaaagaacucuuccuaaccuauaucgaacacaucagcaaagaccaauguuauacugaaaugaguauuaucagauguuauuauauguaaccaccuuuaauauuuaucuaugugcuacuaaacccccaaaagauuagacuuaugagagcauaauuaaaaagcacauuccuccucacuuuuuaaaguuaaauauggucucuucuacugaagcaauuuaucuuuuucugguuccuaaaauaggcaucaaauuucuaaacagaaguaaaaagccucagccaaaaagccacauauuagguauucagccuggucuaagaaaacuaaguuaauaaauugaauaaauuaaaucaaauaaauuaggagugcacauucagaacagaauuguagccuuuggucagcaacaugugaaccaaaggcaaaaaucugccaugauuaaggcaguucuuuguauacaguacgaug

SEQ ID NO: 17362 - RNA, 3847 nt, Homo sapiens
uggauaugaagaauuugcugagauuuuaaagcaggggguggcauacugagcugguuaguaaagccagucugggaggaugcggcacaguggguuaagagugggggaaaaugagguaccugugauaccagcugaccaguuaggaaguuaauggcagugacuaggagggaaguggugaaaagcugggugagguggcgaucgugguaacagagagagcacagauacaagaguuauuaugaagaugcuggugacuagagugggcuugagugacugcugagucccgacaagaucaggaaggcaauccugaugagagaaggugguaaauuuaacuuuagcuuuuuugaguuuguggaauagugagucauuccagccugggaugugucauuguauuggguauccugacuuugguuuuuaaacuuuauuugauauacaucccucuuuuugacauggaaggcaauauugaugucuguauuuuaauuucacauuaauccuuuaccugguaaaaauguauuuacuuauucuauuaauuaguauuauuuuauuaugauaauauauaauuaauauuguuauuugcuauagguuaucagaccaggaugaagagggaaagaucaagcaggaguauaucauaucugaccccuccuuuuccauggugacaguccaaagggaagauagugggauaaccugggaaaccaauucaaguagaucuucuacuccuugggcuucagaagaaagucagacuucugguguguguagucgggaagggucaacugugaauucuccuccuggaaauguuuccuuuauuguggaugaagugaaaaagguucggaaaaggacucauaagucaaagcaugguucaccaucauuacgccggaaaggcaacagaaaaagaaauucuuuugaaucccaagauguuccaacaaacaaaaaaggcaguccuuuaacuucagcaagccagguacuaaccacggagaaagagaagucauauacuggcauuuaugauaaagcaagaaaaaagaagaccacuucaaauacaccuccgauuacuggggcaauauacaaagaacacaagccauuaguguuaagaccagucuacauaggaacaguacaauauaaaauuaagauguuuaauucgguuaaagaagaauuaauuccucuacaauuuuauggaacauugccaaaggguuauguaauuaaagaaauacauuauaggaaagggaaagaugcauccauuagucuagagccagauuuggacaauagugguucuaauacaguguccaaaacacgcaaauuaguagcccaaagcauagaggauaaaguaaaagagguuuuuccacccuggagaggcgcacucuccaaaggaucagagucccuaaccuuaauguucagucaugaagaucaaaagaaaauuuaugcugauucuccccuaaaugccacaucugcauuggagcacacaguucccucuuauucaaguaguggcagagcagaacaaggaauacagcucaggcauucacagucagugccacaacagccagaagaugaagcaaaaccacaugaaguggaaccuccaucugugacacccgacacaccugcaacuauguuccugagaacaacaaaggaagaaugugagcuugcuucaccaggaacugcagcuucagagaaugacucuucagucucaccaucauuugcuaaugagguaaagaaggaagauguguauucugcucaccauuccauuucucuggaggcagcgucaccaggucuggcagcaucuacccaggaugguuuggacccagaccaagaacagccggaccugacuucaauagaaagggcagaaccagucuccgcaaaacugaccccuacccaucccagugucaaaggagagaaggaggaaaacaugcuugagccauccauuucucuuucugaaccucuaauguuagaagaaccagagaaagaagaaauagaaacuucccuacccauagcuauuaccccugaaccugaagauucuaauuuaguagaagaagagaucguagaacuugauuacccagaaagcccauugguuuccgagaagcccuucccaccacauauguccccugaaguggagcacaaagaagaagagcuuauucuaccauuauuggcagcaucaucuccugaacauguugcuuugucugaggaagaaagagaggaaauugcaucuguuucuacugguucugcuuuuguaucagaguauucaguaccacaggauuugaaccaugaauuacaggagcaagaaggugagccaguucccccauccaauguagaagcuauagcugaacaugcaguuuugucagaagaagagaaugaggaauuugaggcuuauuccccagcugcagccccuacaucugagagcucucucucaccauccacaacugagaagacuucagagaaccagucuccacuguuuucaacaguuacaccagaauacaugguccuaucaggagacgaggccucagaaaguggguguuacacaccagacuccacaucugcuucugaauauucaguuccaucacuggcaacaaaagagucacugaagaaaacaauugaccguaaguccccguuaauauugaaagguguuucugaguacaugauuccaucagaagagaaggaagacacuggaucguuuacuccagcuguggccccugcuucugagcccucucucucaccauccacaaccgaaaagacuucugaaugccagucaccacugccuucuacugccacaucagaacacguggucccaucagaaggagaggaccuaggaagugaacguuucacaccggauucaaaguugaucuccaaauaugcagccccacucaaugcaacacaggaaucucaaaagaaaauaaucaaugaggcaucccaauucaaaccaaaagguauuucugagcacacaguucugucaguagacggcaaggaggucauuggaccaucuuccccagauuugguuguugcaucugaacacucuuucccaccacacacaaccgagaugacuucugaaugccaggccccaccacuuucagccaccccaucugaauauguuguucuaucagacgaagaggcagucgaguuggaacgauacacacccucuucuacaucugcuucugaauuuucaguaccaccauaugcaacaccggaggcacaggaggaagaaauuguccauagaucucuaaaucuaaaaggugcauccucacccaugaauuuaucagaagaagaucaagaagacauuggaccuuuuucuccagauucugcauuugugucagaauucucauuuccaccguaugcaacccaggaagcagagaaaagagaauuugagugcgauucuccaauauguuuaacaucaccaucugagcacacuauuuugucagaugaagacacugaagaagcggaacuguucucuccagacucagcaucacaaguuucaaucccucccuuuagaaucucagaaacagagaaaaaugaacuugagccugauucacuauuaacugcagugucugcuucagguuauuccugcuuuucagaagcagaugaggaagacauuggauccacagcugcuacaccuguaucugagcaguucaguucaucacagaagcaaaaagcugaaacuuucccuuugaugucuccgcuugaagacuuaagucugccgccuucaacagauaaaucagagaaagcagaaauuaagccagagauuccaacaaccucaacaucuguaucugaauaucucauuuuggcacagaagcagaaaacucaagcauauuuagagccugagucugaagacuugauuccuucacauuuaaccagugaaguggagaagggagaaagg

SEQ ID NO: 17363 - RNA, 2466 nt, Homo sapiens
ccuguauguaauuaauuggccucugagucaugccuuuuaucacuucuuuucuaaaacauuuauuaagcacguacuuugucgcaggccccauuuuggaauacaaacuauagagagaagcucgcaguucauugcagaacacaguuacuuugcagugcacaaguuauaugacaaaggagaacacuagcacagggcaguccagagggaagagagcuuggcucuuucccagaggaggugacaucugccugaggcuugguggaggagcaggagcuggcuaguugaagaagagguaaaagacaguugcagagagugugcugugcaaaggcucagaagagugaagaaaauauugggacauacagaaaguuagaauggaucgauacagcccgaagcauaggauguuagggaaggacguggcaaaugauggggauggagaaguagccaaaggccagagcaggaaggacuuuguaagucauuuuaaaagauuuccauuucacacugaacguaacggagaaauauugaggauuuuuuuuuuuuugcaaagaaaugauguaaucagaaauauauuuuauauagcuauuauguaccuacaaaaauuaaaaauuauaacaaauaggccgggcacaguggcucacgccuguaauugcagcacuuugggaggccgaggugggcagaucacuugaggucaggaguugaggccagccuggccaacauggugaaacccugccucuacugaaaaauacaaaaauuagcugggcaugguagugggccccuguaaucccagcuacucgggaggucgaagcaggaggaucgcuugagcccgggaggcagagguugcagugagccaagaucaugccaccgcacuccagccugggcggcacagugagacuucaucucaaaagaaaaaaaaauuauaaaaaauaauaugguuuauaaaucaggcagcuauguaaaucacaaucccuguugagaggcugcauuauggcaguagcggugggaauggauucagagucuauaggugguagaaccgguaggacuucuugacuaauuuagauggcaaggaaaagaggaaugcaggaugcuucuagaucucguggacaaccagaugaauaaucucauuuccccagagagugaauucagaagggcagaaacucaguuuugugaguucuguuuugcauuuuacaugccuaucgaauauccaaguggaacugugggucuagauggagcucgagagauaacuaugagcuggagauaaauauuugggaguugccacuuuauguagugguaauugagagcauaagaaauggagagaaugcagggugaaaaugucaucuuggggcagaugcaggacaagagcuugugaaaggaauggccaagaggaauagguggacaaccagaggagugggagcucacaggagccuugaguggaguuucagaaacccagauuucacacagaaacaucaacaaaucaacuucgcgucucgaggugaugguauuuaaacuguguucuauugagacccuucauuaauauuugguuuugaaauauauuuuaacauaaguuaaaaauagcaaacucaaauaugguguuucuaacauuuuaaaacugaaauccagcaaacaucagugccacguuaacuguuuuuuugugcaggugccagaauaaggccauuucugguaaauugaagagcuuccugguauuucaaggugagcuguugaaagaacugguaccauuucucagugugaaucagggcuuucucaaugcucugucacugaaacaaaauacagaaauagggucuacauaagauaacuucugucuucuguaaaccuagucucaaauguuuguuuaugaaaauaauuuuauuuugaaugacuuaacugcuuaagugugacaucccaugccuucuguuaauauauggggcuuugauguugucguuuuuaaggguuggggagguguagcuaagaagaaguuaaccaacaccacuuucuuucuguagcuuauuugccucucuucaaagucaaguuuuagaggcuuauguguauuguguguuucuuuuuacauguauuauuuugauacugauuauaucacgaggaccacguaacuuuguguuugcauugcuauagaaaguuuagagaguuaauauuucuguuaucuuaaaugguccucuuuuuuucauauuuacucauaaacuuaacugcuuacaaauuaucucugauagaagugcucucaaauuauacucuuuguauuugguuuuagacuacuguaugauauuugauuuuuauuucuaguuuaaguuacaauuaaaauuagucugaauuugaguagaauaugacuuacacuacuuggucaacaaauugagcauguucgacgguccaggaagaaaaaaggagcgaucaguacucaacauuggcuccaaauaacccacagaauuugcaaaucacuugcaaauugucuaauaaaguuuaacuuuuaaa

SEQ ID NO: 17364 - RNA, 467 nt, Homo sapiens
uuuuuuuuuuuuaaacaagcucaggcaaauuuuauuaaaggaaaauuuugcaucguuuacuuuucaccaguuuguucuggcgugcuucuaacgaugucagagucaccuggaucaaugauagccagugugcacacucuguaguauuuuccacaugcugugcccaguucaauauuauugccacuguagugauggacaccaguuuuggccaacauugcauaguacucuauuucggauuuccucaaagcugagcaguuguuagcaagaaugaccaauuuagcuuugccuuggcuucagagucugcuuguaccccagcacguacuuuccacuuuucauaaugaguuggagccuagaguugaucgacuccagugacuuuuucaucuucuuugcggccaccauguuccugccuuaggugcgagauggcccuccaccaagagcagccgcuaagauggccaggacgcgagaaaaaa

SEQ ID NO: 17365 - RNA, 2367 nt, Homo sapiens
auaaaaauaaaguuuuaccuauuucauccaggaauauaugcuuuguaucuuauacguaauauuccagagaaaaagaaaguuaccuauaccucuuuuuugaagaauagauauucuuaauauccacaccauucaaagacaauguaaaaacaaaacaaacaaaaccccaaaaaacaaacccccaaaacccaaaaccccaauauuguaggucagucuccuaccugagucuguaugaaaaaauaaaaauauuacaaaauaaaaucaagcaguuaauuaaaaauaacagacucaaugauaaagaacucuucaaguccaucagaaaaacuacucaguguaaaaguggauaaauagguucaugugcaauucccaggaaauaaaaugcaaauggaguaacaaucacauaaaauauucucaaguucauuauggccaugagaaugaaaauuaauuacaauacaaauaauauucauuuguaucauauugaugacaauuaaacauuuuuagaaagcuaaacguuugugagaaugugaagaaagaagauuauccacugcuaaaaguaugcuggaaaaaaauuuaggauaucugguaaaaguguacaugcucuaaaaccaagaaauucuguaaucagguauguguccgagauuuuccaggcuauguguauaucaauguucucauuuuacaaauaaaguaaucaaagccuagcucuuuuuacuauuaauauauauaaaacuacuuagaacuuuuaauauauauuaaaaguuaacuauuuuaacuuaaaaguauuuauuuuaacuuaaaauaaauuuuuuuauauuaaaaguuaacuacuuuaacuauuuauauauauaaaacuacuuagaaguuuuaauauauauaaaacuacuuauauccugguauauauuaaggauuauauaauaauauauaguuaucuaugaucauccucauccucaucaucaauagucaguuguaggugaaauucuauuaauuaauacugacaaauaacacauuuuaggugcucaucauuggcucuccggaggaguauucuaacagcugaauuaaaaaccugccaauauuugaccagacgaucaaguuuggaggacgucccuuccucucccacccagagccacgcucuugcgugcuuccacagugacagugugaccuuuugaaauuuggagaucauacucucauccuugaaaacgccccaccgccuucccuggggcggccggccuccagguucgcguucuaccugguagaaucccuugacaguuucaguaccuggccgccagggcuuuggguguuaaugccuuccuuggacgggaggcacuggggagaagagagggaaggcgcugaaacccaccugagaaggcgggcugggggaaggcaccccgggaaagagguuuucucgggugccagcacccggagagagcuacucuggggccaggcaagcaucccgccuaggcucccuagugcauauuagugaguaacacgacuggcgcgcgaggugguccauuuuauuuuugguagcuagacgccaauaggacgcaccacuucagcuccaaacgggaacugguggccccaagauguuuucuuuucuuuuucauuuuuuugagacagggucucgcucugucgcccaggcuggaaugcaguggagagaucucaacucaucgcuacccccuccuucuggguucgagugauccucccaccucagccucaguagcugggaccacagacacgcgccaccacgccggcuaauuuuuauauuuuuugcagagaaagggucucgcuauguugccuaggcuggucucgaacuccuggccucaagugauccacccgccucggccucccaaagugcuggaauuacuggcgugagccaccgcgcccggucugcccccaagacuuucauugaaaagauggaauggucgcuucugugcggauccuccaaaccaucguugggagaggccuccuuaaagucuaggagaaaaguuguuugggaccgauaugaaaguaaggcaaagccggauggaagagaguagccgaaacaagcaagaaaaggaaaagcgaucgugauggguuuaggaaaggugaucuggcgugcuaaauggcauuuccggagaaaucugaaaacuauugcuuuacugaaguauagcaaagagcuguccgggcucuggaaacuccuuaacggaucaaaacggaugcaauggguauccuucuccaaagacacaccucaaacgggccgggagccgggcaguuagccacccgcugccuccccuuccgcaguccggcucgcagccgcucagcuaccucuaaagcccggagcaggaaaguccgcgcaggccuggauggcccgggugguaaucuagcaggccugcacac

SEQ ID NO: 17366 - RNA, 8818 nt, Homo sapiens
cgucgaaggugugggugggaacgccgcccgucagaaggccaggaggagggcgcgagcacggccagcgcaagcagggaggccaggguggcgggaagggugggcugaggcgcuggagaccgagccgagggcgcagcugggugggaagggaagaggggcggccgggagacgggggaccgcgggcgaucgaaaucaggcggaggggaggccucgcgggcuggggcuuggggugagcccgagcgaguggaggagagaggcgaggacgaaacgagacggggcgaaggccggggcgggacggggcagggcgccgggguccgggugcgcgccggaagggccucggggcggcccccggggcggugcugggggcggagcgggccggggcgcggcugcauuaagugaagcucauagagacugugugcucuagcgccuugcggcggagggaggcgaugcuggugccccgccacacgucgcugcuguccggggagcugcagagcuggggcgaaccggagacguugcuggggccggggagggaggcgggcaccaugccggggaaggcgggcugguagaggugcgacugcagccccgcgccguuggaacccgccaggcuguuggacaggcccauggaguugggcggcggaccggccgccaggcugcacugggacagcgacugcgccauggccugcugccugcccagcgccggcggcagaggcagcugugacacgccaggcauggcggccgccgcccagcgggugucguuggcguggaaagagcacaggcugucgcccauggcggcggcagcggcggcggcagccgacgggaacugaggcaggccuggcgugggcagcagugugccgggcgcacggaacacguuggucgucuuuuugcgcuucuuccacuuggcgcgucgguucuggaaccagaccuggagcgggcggggcgggagacagacagggagcuauuagccggcccggcggcuggggaguuggggcuugagccccagaaacccgccucggauacagccgcucugcccugggaggaacaagugccguaggcccgacaagcccccauacccagccggagacuguggcuccccaccaacuccuggcaacuggcgcccccugcacccaccaagcgcggaguccugcgcuccuaagagcucgugccccgaagaguuuacgcacugugcaaacacaccaaaugugugcagucuucaccacgccccugcacauucugugcacugcacagauucacaggucugcagucaggcaugugucaaaguucgacccacagguguacaaaugaagauaaacguguacccauguagcuuaauagcaugccuuauaacacugaugugcuauagaauuuucagaaacgcuggaaauuuggaaauugaugacaggcuguggaugacauaguuucaaaaucgaaagacaaaggaaaaccccuaacgcuacgguugacagagcggagagguuaauacagugaucugcgugggaaagugaacgccacugagcuacaguguuguuugggucaccaccaugacuuccgauuccucccauauugcuucgugcuacugccacaacucuccgugccucauucccaaaccacucuauggacaccuuugucugggcuguacgaguggcuggaaccugcugccccaagagccuucaacccuauucuuuuuuuuuuuuuuuuuuuuuuuuugagacggagucuugcucuguagcccagguuggagugcaguggcacgaucucggcucacugcaaccuccgcuucccgggucccggcugaagcaauucuccugccucagccucccgaguagcuaggauuacagaaacgcgccaccaugcccagauaauuuuuguacuuuuaguggagacgggguuucaccauguuggccaggcuggucuugaacuccugaccucgugauccacccgccucggccucccaaagugcuaggauuacagacgugagccaccgcgccaagccaaagucuauuccuuucaggaacuuaccaagggucccaaguaacaaggccuccaguucccucaagucgcccccauuucauuuauaaacuaaaagcaaauuuucggaccaauaugaauuaaaggaggucacauuucacuacgagauauaugaaucaaauuuaauuuugcucagacaaacccaaacguccuuuuucagggaaaugaguuugauaaaauacacuccaaaugaaaacagccuuccuauuuuuuuuuuuuuuaacaguggcccgggaguuacagacccugucaggcaaauuugccuaggcaugucaaacccucuaucacagaagaagaguucugccugaaagauaucacauaagcugccaauccaagauaacucccaucucccccuauuugaaugugaucuuuuuaaaugacaauaauaauaauaauaauuugccagcaagccugccuggaagacuugcaguuuaaaaucuggucaucuggcguuuacugugccuaaauauaaaugauguaggacaagcccagguacugaguuuccucuuagaauuuggccaacgcaauuugaccacgauauccguggaaaaaaacguugugcauccguuaaucuaaccuauuuaguguuuacucugcaagcuaaaguaucagggguauggacauaccugcccucggucucggugagccagcaauguucagcgguguguucaugcccaggcaagcguagacgcacucuacgcuuaccagugugaacgguguugcagucuagaauacucccccagcuuggggccggcccucgccuuucuaccgugccugcgccgucgccuaccacuuucuuccugugguuucuaccccauuuugcagauugcugcguaucccagugucggcgauggauaaacaggucucgucucuucccaguugcagcccgugagcugguggcacaacggauuaaugaggcaacagggcucuagauggugagugggaucaaugagacccaauugagcuguuagcggucuuaggcggagagcaucucucaggaggaaaggaaggcacagcgagaagaccuaaggccgaaagucgcugugcagcacccacccaaggcuggacucgggggagguagacgggacggugucugugacuaaacgguucccacaccuuacacgccgcaccgggauuauguuuugaaaggugucuuauaaaaucaagaccgguuccuaacaaccugcaagugccagugaaucccgaaauguuuguuugaggagagggagugugagggaaggagcagaaaaaagaaagagggggaggauugcccaguagaauuucaauagaaaaugugacuaccagaaugguuucugaaucuaggaucugcucaggcacaggcggaaaagaacagcuguuaaagaacuaaauauuauagaaauaaucggaaaaucgugcucaauuauguuugaggguuaguagucaaaugauggcuacaaauuuuuuuauguuucauggcuuacugggauugggaaaaaaaaucugcguggggucugagcaccuccguuccaagcuacgaugcauauguuuuuuaaaugugaauguuuccacuugaaaacuagagcaugacggauuaaaaugcaggcaaaaccuaagggagauuuuuagaaugcacagaugacaacuccaggaaauauauuaaccccagccacgggccaacuuuguacucaguuugaaaugcagcucuucuuggaaaaugcuuaauacaacagugagaaucuaauggagguuggaaucuaaaaauccacuuucaugauaucugcuguuacaguaauauagacauacuguaaauguauuuuaaaauauauagcccguuuaauuccccagcuauaaaugacugagaaauagaaaaaagagggagagaaagagagaauauuacuuuuuccccccuugaagcaaaugcuuuaugaagaucucauuggaauccagcaaaugauuaaugugaagauuuuggaggaaaucuggggagcuguauuaaagccuagaucucagguucauuucgaucagccagccgugaacucugggccgaauucauuacaguuuaauagugcugggagaggaagaaaaugcaauuucucauuccauuagaaaacuagaaaauacucucaguuugucccccuauuaagauguggcaggugacagggccauucugggggacacggucaauggaauuacagcacacuauuuuuguucauauaaaauauugaaaggcaagccugacugugcagaaguuauuuuacugauuugguuuuuauguaaauaaaauauugaaaguuaauuaauccaugcuagagacuaaugauuaugcuuauuauauugcauuugaucacauaauuugcaugauucucacauugcugcuuaauaagccauuccagguuauaaauaauucugaaauugguuucuaauaauggcaugcuauaaaaggaaugguuuuauuacacuggccagaaaagaggagcuauaucagacauggaauuggccuccaugugaguagagaugcuuuaauaaauacuuaaaagugugauauauaccaaauaaagauaaaaaauaaguauauuggauaauuuagucuagaaucaaaaagcaucuuuaaaaauauacaauugcaaugaauuaaauguuuagauaauuuuuaaucagcgcaguggcccacauacugaaaagaauguguggcagucuguuaacuauaaagaaaacuaugaaguauugaucauauaagaacauaagccaauuacuauuuaauuugaauuuggucaaggagcaaugguacagugaauugugaaguaaauacauuuuccauaaauuauuuuugcauuacauuacauaauguuaaucauuuugaaaaguuaauuaagaagguuauguugaucugauuacuuuuuaaacuauggaacauuauuuuuaaaaauauugaaauugccauucuauuaaauugugucuaucagcaggcucaagcuauuaucuuugcuugaacauuaugcuggaacaauuagaguacuuugucucuuucuucuugugcauucuuuuguguacuuuuugaaaauaacuauuucuguuacauagcuuauauuuuauuucauuuacaacuuuuucuguuaaaagaauaacugucauuaaccuuuggaagaccuaauaaaguuuaauagaccucguuuucuuuuuucauaaaaucaguuguucaauuauauuuuauuugugauucuaaguucuauuuuaauuuaaacuaauugccaguauaucuagguuaagacacagcauuuuacccuuuaaauacagaauuaauagauaaucuuucucuuaaaggacaaaaccccaaaauuuaugaauuucuaaccugcaaaauugaaccuacaagcaagcacugucaucaguguugauggaaguauugaaauuguauauuuauguaaagguuuaaacucaacuucagauauuuuuuaaaaggugaaaaauaaaaauuuugaagagcauuacuaacacauguuuacaguuacacaauuaguacucuuuuggugugucguuuuaaaagaccauggucuaggccuuucacuaggaaaaccacccagacuuauauuguauaaaaaugcuaaucauuauguuaaucaacauuacuuuauuaauuugaccauuuuaaauccccaauaauauucauuugcuauuagagcagaagcaugcgcuaucuuuucaguuuagacuaucuuuaaaaugccgaauggagacagaaacauucaacgcugugauuacggacguucucauugcuuacuucuuagaucaaauguaaaguaacuaagaucuuaaaguuaauuuuauaaaaguagguagcacugguuuaacaaauugaccagguugaugacacccaggauaucguacagaaaauaccaccguccaagacggcaaaggaagauuuuucagcacccuggauagcucaagagugaguaccggcgcuuggaauuucaccuccaggcaccuguccauaaaauauuugauaugucuucauucuuucuuuuaaaaaacaaaaaaaaaaaacaaacaaaaaucugggauucacuaggcuuauacuuuuauucaccaauuuucagaauaauuauaggugugauuuucuagguuauauauaauuuacagcuuggagagugguuggaggagaauaaggggucagcaaugauuuccucuacugccugucaaccuuucccguucugaaugccccuucuucagacaugauauccacaacagaaagccuucauuuccccucccccaccguagcuuccuuagaggacuccaaaacaaaacggggcucaccggcuuugggaaucucgucagcugcccccagcgcacugguagacuacgaaaguucaaaccccuugcaaacaucaaagcuaggaauauuucgccugagugcagagggagggugauacuuaagguaauaaagccacgccgugaaaccuggguguagcacuuuuuuaaaaggcgcucauucgccuuauuugcucuuuucucuuguuuucuguauaauuguugcauuccuccuuuuauccaaacgcuuaacacaaacucauuaggggguaauauuugucaauaaugcgagcaggaguugaggugugcgcucggcugggccgcccgggggggcgcugagguugccuucucaggcggaggaggcgaacccuguagcccgacaacgccgggcuucgauuuugaggagcuucuuccgggaugucgcuauacuggccggagacgggccuugcguguccauugggggauggcgauggggaccaguuuccggguagagaaggagauaacucgauacaggaacgcacaggcagccugaaagcagcccaggaucucgacaggggaagggaagacccugcucccuuugcccaaauccucccgcccuguccuugccuucugucccagaucccaagccccucguaccugcacucgggacucggucagcccgauacgcagugccagcuccucacgcauaaagaugucgggguagugagucuuggcgaagcuccucuccaacucguugagcugugcgggggugaagcgcguccgguggcgcuucugcuucuguuggcccugcugcuggccggcuuggcugggguucgggccgcccuggggcccgggcugcuuguccgggucuuuggcgcucaccgccagcgaggccggaguagagcccacuguggugauguccuccccgggcagcagaguggcucccuccacugggucagaguugggcgccaggucccccggauggcccccggggucggagccccccacgcccagccuacacuucaccgccucccgguggcccagaagcucggcggcaucuuucauaccugaggaggcaaggggaucgcggucacuacuuucuuggcgaugccaggaggggcugucuuccccgcgcagccuuccuucaacccguccucggcccccuccgcacccgcgcuuguccuaaggaagaaacucccaggguauucagcuggguuccccagaauuuggacagccggguuggaauaauaucucccggccccuugcccucgccgcagccggcucccguaguaaacagcacaagcuuucgucucucccacaauaaaacacucccagucccggcaauaaaacaugccucugaaucccuuccauaaaccguaccccaggcgccccaggaaaucgagagcaaaucuuuggacacaggggugcggggggcagaaagaaaauuaaacaauuccucgguugcugcggcaccugcgcuucggcagccugacgaacuguaccuccggcccucagccgauucccucuuacuuucggaagaugaauaagccuccaagcuuucaccccccgaaaucaacccaaaucagcuccgccucccccucaaaucagagaaaguguuuggaaaauggagucacauccaucaccgaagauucccaauccggaaacccagagcucagcaacccagauagcauuaaggaaacucgagugaacucuauggacaaccgugaaucaaacuuuagagauuucaacuuuucuuuccagagaaauaaaaggcgcauuccucacagccauuggcaacgcugagucccuugcagaagagggggggaugacugugagguugaauuuggcuucucuccuucucaaccagcacacuuagcaaauccgccuugauggcagcagcuucuccuuuaugccagauuuuuuacaaauuacaccacacuuagaaaaggaggagagaagaagaugguggggagagagaaacggggggagggaaggagaaagaaaucccaaaucaaaacaaacaggagagggaaaaaagagagagaaacaccuccuaacaaauuaucacgggguauaucgccuuucgaaaaaaaaaaaaaggcgggggaggggggaagagaaaaauaagaaaaacaaaaaguaacaacauuccccaacuccuuucuuggaucuacauauuccauagauuuuuuuuuaaaggcgauguuaaaucaaauuaaacuuuaaugcagcacaauuacuuuuaaagaaauuaguccauuuaggucgcauuaagguaaaauaaggaacaaauugacaauuuccugccccggcuucuccuggcugcccgggcgagaggcgcgcacucaccuagccuggcguccaggaggucggcaugagacagcaucgcgcaccgcuccagggcgaaagcuguucccccccaaauuuuagcggcuuuaaguuauuuaaaauagauauaagcuauaagcuauacgauauagauauauauagaucaccuaaaugaaagaaaauucgguuugugguuaaaaag

SEQ ID NO: 17367 - RNA, 4941 nt, Homo sapiens
aagccucuuucuaugugauaccauagcaucuccugacacauugaucucaggguacuuagccccuuuucugggaucugcuuuuaucauugcaaagucaaagcucuguucaaugucauacaaacacaaauucucauaccaaaacuacugacauuuacacugagaagaagcaauaguggguaaaacugcuaacaccuuagcaugacucaaugaacuagcaccaaacuguauuaauagccauagucauuauauuauuugcugccacauguuugcacuuaaaaaaaguuucaggccaagcccaauggcucaugccuguaaucccagugauaugggaggucaaggcaggagguucgcuuggggccuggaguuuugagucugcauugagccaggacugccacugcacuccaguuuggguuacagagugagaucuugucucacauuaaaaacaaaaaacaaaaaacaaaaaaacagaaccaguuucacuugagaauuaccucuuugaagcaguaagaguuauuaauuguauuaaaucuugaccuucgaaguacaugucucuguaauauucuggaugaugaaugugaugaaaugggaguacacguacacuugaacugcauaccaaaaucugcugguugucuuguggaaagcacuuaugcacuugaauugagcugaaccagcuguuuuuauccauggaccauuauuuucacuggaaagaaugacugucaaacuaugauuguucaaacuuggguauuagccuugcagcuuuugagguguguggaaaucugaguauucugcacauuaaacuaaggccaucaucauucauugagcugaguauuaggauccgcauuuccuggugguguauuaagccagaaggccagcucaaaggcuucauuuguaacuuucauuuuuaggucacccuggcuuaugaacauuaguacauugcuuuuugggaaaaggacaccuaaauaggaagcuuuuaucaaaaaacuuaaaagcacauuuuucucauccuccauucacacugagaacaacuaggaguaguacgucagguccucucucuguggguccggggaagcccauugaugagcagcuuuuggcuuggcuugcucauuucaggucagucgaucaagcagccuuaaaauauccacugguguucaaggagucauuugauccucacucccuuccuguucuucucucuggaaagcucagaacuaccuguccuacuuuucuucaauucagaggcucucuucccagaaagcugcagucuacuuacuggauuucaugaacagacacuucucaaaagacgacacacaagcagccaauaaacauaaaaaaaaaaauguccaggcugggugcgguggcucacgccuguaauccuagcacuuugggaggccaaggcaggcggauugccugagcucaggaauucgagaccagccugggcaacacagggaaaccccaucucuacuaaaauacaaaaaauuagccgggcauggcagugugcaccuguagucccagcuacuugggaggcugaggcagaauugcucaagccugggaggugaggguugcagugagcugaggucaugccacugcacuccagccugggcaacagagcaagacugucucaaaaaaaaaaaaaaaaaaaaaaaaaaacuaaacaaaacaaaaguccagcaucacuaaucagacaugcaaaucaaaaccacaaugagauaccaucucaaacuagucagaauggcuauuaaaaagucagaaaauaacagauguuggcaagguuguggagaaaagaaugcuuauacacuguuggugagaaauaaauuagaucagcuagccccuguggaaagcaguucggagauuucucaaagaacuaaaaauagaaauugcuauucaacccagccgucccauuacuggguauauacccaaaggaaaauaaaucauucuacugaagagacaccuguacuugcauguuuaugacagcacaauucaugguagcaaagacauggaaucaacccaggugcccaucauugguggacuggaugaagaaaauguggugcauauacaccauggaauacuaugcagccauaaaaaagaaugaaaucaugucauuugcagcaacauggcuagagcuggaggccauuauccuaaagugaaguaauaauagaaacaaaaccagauacuacauguucuuucuuagaagugguagcuaaacauuggguacacacaguggcagaaacuggaacaguagacacuggagacuucaaaaggagggaagggggcaaggguugaaaaacuacuuauuggguacuauguuuacuacuugagccauggaucauuagaagcucaaaccucagcaucagcaauauacccuuuuaacaaaccugcacauguacccccaaaucuuaaacauacugggcuccucugcuggucacuccccuucccagucuuccuaggcaucaucuauucuuuauccugcccuuauuuauccugccuccacaguacauuucagccaugcagaccccacaaaauucacuacuuguggcugcuuguuugucacccacacacccaucagugcuuagagucucuucucuggaaguagggcuguuuucacauguccauuuacagucuacugcuuucuagauuucucuccuuuaacucucuacacugcuacaauuaaagugaacuacauauugcucuucccuuuuuauaaaaauucuauuuccccucccuuuguuaauuuugcucagaaugcuuuguucuuccagaaagucuuuuccuauuccauuucuguagccccccuuuuaucuagaaaaaagucucucugaacgucuguagcacuuaacauaaacuuccuugagauacacuucauuuuuuacuaacauguggaccuaucuacaucucuccccuauuggacuggaacuccccguggccgcgaugucuucacuaaugccuguguucccauaacgcgccauguagacacccaggaauaaccuagugaaugaauggaagauuucucgguuuuugugcaaguucuggauccagcaaacugaagaugaaaaguuacuuccaaaggcucaguuuaucccccuucucaagagacucugguuagugaucagccccaucagucagcuccugaaggaaccagaagccuaccccagguggggguaagcugcuuucuuccagggaggagugguuaacuaauugguaaaaaguuacucagcuggagaaucccccaggaguuccaugaccuaguucccauucccagaggggaaguggagcuucccuggaaagauggcgcaccugugcaaaauacuccucagagauccucccagcccauucaaugcacagguccaaggggcggcauggguuggccacgucagcacacuuaaucaucaugcguuugaucaggauuugguuuucagggaaguucuucccagcaggguugcauucacagucgcugccuucaaucuggaaaacagauggucagaucaggcuugguucaagaugacggugaagcccacaaggguuaauucgccaggcauucgauggugaucaccgagcacacagguaggacugggacucggcgaaggcagcuuuuccuuuuuuaaauuccauauauaauauacugacacauucuuuaaaaaaagaauauacugauacagucuuaaaagacacucagcaauacacacacacacagaguuugaaaguugaaagucccugucaccaccugucuaccccucacauccauuuucuucccuagagguaacugcuacagcaguuuuguuuuuauuuugagcaauuugauauguaaucuuagaggaaauuucucccaguuuuuuuaaaaaaauguguaaaagcagagcuuuuagcuacuuuaaugcauuucagguagggcaguggcacauacauguaacccuucaauuauuucuugauuucuacuacuuaugccuaccaucucccucccuccuaugaccugucccacccccaacucacccaacucucucgcacuuugguucuccuaaggcauguguccacucauguuuucuuggcuguucuucugacuggcugguaagugagccagguaggcgugggguccuuggaguaggaaguagucaggagcagguguguucagccauguuuagaaagacugguccacaccuaguggugaugucaguguccugagccauguggccaggacacgaguugguacacacaucacaggccauuuacauagaaccugaaagauuguuauucuccacuuuuaaagacaccaucaaauugauuguguaaaaacaauuaggucuccagagcucugccaagccaaaaggcugcaugacauuugggggguuuaagacuggaccuauuuauuagacuaucaaugggcagaauauguucuggagguuuuugauuacuuaucaaaguaauacuguuuacuauaaauacugcaguuaauaguaaguugcagugcagaggugggggcuuacaugaguggaugaccuuccuaguucuaugaaucucuauacuuuuccuucucuaaauccccagauccuugcuccuguaagucuucuguggaaggagagggcucugguguugugcuguggaaucccugggggaaggagcuuaaauaggugagguagacacugucacuccauccagacuggucaugggauggguccuacacaguucaucuccuuacugagcaaguuacucaugaugaucauucacauccauccaguuugccaaccucugccgcucaacaggaaugagcggaaagcuuuucuaccuuuaugggguuaugaacagcuucauggcuucagagaacaguggaucuuauuaggugugaaccuucuguuucauguuccuaaaagccaaauugguaaggaccuuaaggcagguccaagguacaugaguagguuuuaaaaaaggaaaacacaauaaaugcuucugcuuucc

SEQ ID NO: 17368 - RNA, 4718 nt, Homo sapiens
uuuguuauauucagggaguauguacauaaguauuugauguuuuauccucuaugucuuucuuuuguuugugaugcuucucaaaacuuuuuuuuuuuaaggaacaaguauucuguuaauauauucaaaauaaaaguaaugucuuaguuuguugguuuaccacuuuuuaaaguucagauuuguuaaguuuucucgauagaggcaaaucuauagauuuugaaaucuauuauuucaaaacaaggccacagugagauguuggugguggcaauaugaauaugcaaacauguaugucuuucuaggaaggugcucaugauuuauugaaagaguuguagcuucuacccuaaaacucagcugcuuccuagggggcugcuaagaaccaccugcugaugaccaggaucucgauuuugggauugguuagggacuccuaauccuccuguucacacuuaccaaggaauagcucuucauggaugaaugaaugaagaguugaccguaugucuggccuauuguugaagcagaaauugccacgcuaucauaaaguacuacuuaugcauuuugguggauccuccuucauuauaaagucugggccaggcaugguggcucacaccuguaaucccagacuuugggaggccaagguggaagaucacuugaggccuggaauuugggaccagccuggacaacauagcaagaccccauucuguaaaggaaaaaaggaaaaaaaauauaaaaauagaaucaaguuuuucuguuuguuuuguuuuguuuugcuacccagcuccuaaugcucaguuacuguuuguuaagaguuaacuucacaucuggaucuggucagccccuggccaagugcaaaagccaauagugaaccaaacaauaucacggcaagggaggcagacaucaccaaagacugcauuuugucagaccauaaauaaaacugccaccccaaacuccacagacgaaaccagaauuguucaauuccaucuugcucuucaucuacuaaaacacgucuuuccucugauuuccauacccuguuaauauacacauuuucagucacuuaguuucaaaaccucaaucauuuugcauuccuuuggaaucauuccuuagcauccagucagucccucagccuuggugauuuuuuuguuccuaucacucuccuuugcugaugucucuucuuucuucuuggcgcccaucaucacccaccacuacucugauucaagcucucacaccaucuuacaccuggacugcugcaagggugauuucugugcuguuucuuuccuucuugcaauuuaguuugcuugcuuccuccucugaauuccucuaucaaauaccauacaguguuauugugagaaaaaaaaaguagcucauagcaggcugaauucugugagguaugcaagcccagagagacaugaguaugggacuucaugcccccuuccaugccugggggcaauuguuuaaagucauuuuaaaggcugggcgugguggcucacgccuguaaucccagcacuuuggguggccaaggccgguggauugccugaggucaggaguucaagaucagccuggccaacauggcaaaacccugucucuauuaaaaauacaaaaauuagcugggugugguggcgggugccuguaaucccagcuacucaggaggcugaggcaggagaaucgcuugaaccagggagcuggagguuguggugagccgagaucgcgccauugcacuccagccugggcaagaagaguaaaacuccgucucuaaauaaauaaauaaauaaauagucauuuuauuccugacagcugcuucacccauuaucuucacguuccugaaauuugugauacaaagagcaacguauagccaaucaauagcuuauguuauuuuaauguaauucuuaguaaacaacuuaugaacuaacugccucuuccuuuaaaagccuacuuauaacugcugcuaauugggguguauauucagggcaacuugagucuaugcuucuggguugaaauccucaagcuuaguccaaauaaacucucugcuuauauuaauucugccucagcuuuuuccuuuuucuuuuuugagauagggucucacuccguugcccuggcaugaucacgacucacugaaggcuugacuuccaggcucaggugauucuccugccucagccuccugcauaacuggaacuacaggugugugccaucacacauggcuaauuuuucuuuuuucuuuuuuuuuuuuuuguaguuuuuuauggagaugggguuucaccauguugcccaggcuggucucaaacuccugggcucaagugauccuccugccucaaccucccaaagugcuggaauuacaggcaugagccacggugccuggucagcuucuuccuuuuaggucagcaauuaguacucuccuuuuguuagcaguggcaaauuugaaugggauugcagcaaccucaauucuugccuccucagaggaaagaauucgacugaggggcauaaggcagagggagagaucgaggcaaguuuuagagcaggagugaaaguuuauuaaaaaguuuuagaguaggaaaggaaauauguaaaguacacuuggaagaagggcaagcagacaacuugagagauucaagugcaugauuugaccuuugacuugggauuuuauacauugacaugcuuucagggggucgcaucccuucucccaugauucuucccuugggguuggcuguccacaugcacaguggccugucaacauuugggaggggcugcaggcacgguguguuuacugcaauugugcacaggcucacuugaggcguuuuucccuuaccaauugaguguuccuaaaagaaggucguauaccaauuaacugccauuuugccucagagugcacaugcuugagcccacucacccaacuccugagaucuuauugggaugcugcugaucaccagcuucaggguuuuucuaucucuugggagacucccuuggcugcaaccgauuauuauuuuagagagacaguguaacaacugccugagcaucaccugaugaucaccugacauucuugguguggguuggggggcccucuccugccugcucaugucugacuaacuaccuacuauaagacuuugagucuuuagcaaauacuaccuuaguugcuauuuauguuucuauuguuuccuugauuaaaaaaaaaaagucagcaucugggguucccagauuuugcuuuuauuucccacaauaguagacaaaacaaguaaccucaaaggguccaaaacagcagugcaggaaguuauagcuguugaaagccugcugauuuucuguuggccuaaaagaaagaagcagaggcaaagauuaauauagauaguuuauuugggccaguaaauuuauucgaggacugcagcuugggacacgcuuccgaguugccuuggggagugcuccaaaaaacaaaagagaagcucaagguuuuuuuuguuuuguuuuugagauggagucuugcucugucccccagacuggagcgcaguagugcgaucucggcucacugcaagcugcgccuucuggauucacaccauucuccugccucaaccucucuaguagcugggacuacagaugccugccaccaugcccagcuaauuuuuuguauuuuuaguagagacaggguuucaccguguuagccaggaugguuucaaucuacugaccuugugaucugcccgccuuggccucccaaagugcugggauuacaggcgugagccaccgcacccggccaagaagcucaaguuuuuaaagaaaaagaugaaucaggaaagggagugauuauaaaaguuguucuuucagaauucucgugguuuacggaacuaacauugguuagugaugggcaauacauuguagaacuauacaauguguggcauuuuuuauggcuacuucguaucagucuggagcccacaaagcauauuugguucaagagauaauuauguagcucaaggaagagagagacaugaaugcuguuacuuuuuuuuuuuuuuuuuuugacaguuucacucuguugcccaggcuggaguacaguggugccagcuuggcucacuacacccuccgccucccugguucaagcgauucuccugucucagucucccagguagcugggauuauaggcgcucaccaccacacccggcuaauuuuuguaugauuaguagagaugggauuucucuauguuggccaggcuggucucgagcuccuggccucaagugaucugccugccuuggccucccaaagugcugggauuacaggcgugagccaccgagccagcccuguuauauuuuaaaugccucucugggccugauaauuuaaaggggcucaccucccucagauuaaaaaguuuucuuucucacuuccaugaguagaauucuaaacuaguauuuucuuccuagagacuuugagagucuaaaaauugagagguuucagggaguuggaauuugaacuuuauccagcauucaguaggugcucgacaaagauuugacacuaaauagaucuguuugggucuugacaaguggcgacaucaacaaaaaguaucugccuacugcauacagagauuaucauuugaucuguguaguuucuaagccagguucaguaaaaacaauugguuugagaaagcuuuucauuuuccuaagaugucuguauucgaagcauguuggaguguuggaguuuuuauuuuaucaggucacauguuagauauuuuugugagaauuuaauacgaacaaagacca

SEQ ID NO: 17369 - RNA, 4674 nt, Homo sapiens
agccagucacacagcaaucuguauuugaauauaauggagcaaaaaaaaaaugcucuuuuauuaaucugauauacacuaaauaucuuugcagcuguuacaugaauguuaguuaucuggcauauaaauguauacacaauuccaaguuugauagauuuaugcuguacacgagccaucccacauggagcaugcccuuucacaaggauacgcauggcugucucgggauauuugucaaaacacauuuggucaaacauuuuggcaauuggaaaucagacacagaggagcauacaggaaagaugaguucacaacaggaccagcuguacuuaagaugaaaacuccaaaaccugaaacagaauuuacacaugcagcacacguauauacaguacaauagggguaacuggaacauucauagcaggagaucuuacacagcauuaaaaacaggaagaauaaaaaaggaaaacaaagccaaacaauccaaacaccaaaaccgacaggaccauugccaagaucucauuaaaauagacaguggauaguacguuuagcauauguucaaaauggaaguucaccugaaagagaaaacucuucuaucauguuauuuaguguaucuagauaguaacaaaagacauaugaucuguucaauauguuccuggaucaggaugaggauacauaacugcauggaugcuaagaaaguguauauuaaaaaagacauuucuuuuuucuucugacugacauaggacauagauucaguaaagcaaauauauaacaauagcagcggagaugaaguuaggccaauuugucaaguucuaucuagguaggccuggugaauaucaaggcaagaaaggaguuuccuucuuggaugacuacgugggcgcaagaggggagacacuuugcaacuucaaacuaguuucauuuuguuugcauagcaugaaauagccaauuuuacuguacauucuuucugaaggaaugacacccauagauaacaguggauucucuguacuggguccuauucugagucaauacaaaugcagaaagaaacccuuugugaaucacaugagguugagcuugcuaagucuuuccccuuccuuggacuuaggggcaaugcugacccauaaauccaugauacucaaugugauguggccugugucuaugcagugggaggccaagcauucuuuagggcuuuagauggugguaugcuggcaaauguuuaacaacugucuuagggguuaggaggagucugauuugcauggcuuuguugcuuuccauggcuuuguugcuuuccaugguauaaauaccaccacuauagcugaucucaaacuacaaaaauacugucacuugggaagguguguguaguaguauaccuguauacaguauuucuaccauacagacauaauaggcauacauuaccucaugggcacagauaaugguaaaauguaguaaaauaaguagaaagugaugagcuuugacuauauguugccuuugcuuuuagcuauaauuuaucuaaucuuauuuaauuuuuuaguaauagcuauguuucucaacugacucucaaaaguucugaaaguuuaacaaucaguucggaugaaccgguucaaagcuauuccagcucaucacuagcuuuagaugacuccagccccugugagcaggcugccuagucacuccccaggcaccacaaagcuguuuuggacuuugcaccccugcugcugggguagauuacccgcuugaguugaaacccgucugagucugaacaaaggguugaaaacugcuuucugcuccuaguccugggcacucuuggaucuaaggggagcaugaaugcaauaaaguaggcagagaguggacaaucucagcaauuucagcauucagaccugacuggaaggcaccuagccuucagcaccaaguggggaaucuucugcagacauggagaguaccaucuaccuccacuagccaaugaaucucaagaacccagguaggaacauccuggucuuucaggagucaaacgcugagcucucagacuucugcucuggagaugggcugcucugauuccauaccagcugugcccauccuaucagggcacaggcacugaaaagcaauuggaaauccagcccugcacagggagcugugccaaagccagcagccuugcguucacacucccccugcacccauuccuguucuucaccuucuccuccucugugccuccacaacaggcauggaugggccuuucaucccaagugccccaggaaagcuuggccuugcuuuuguacacugcuagaauuaagagguugucgaccagaggaggaaaagaaaaaaaacaaaagggaaauaaaggaaaugagugggcacugcccugaggagguaagaagagaacuggugggcaaaaauggcaauggggcucucagaggaggguagagggucacugacaacuacccucuuucugcucugccccccugcaggcccuagaaccccaaacauccuuugcaacuucaagacacuugcaacaacacgcaccaguuuuaaacugaaacccaaaauaccccugcuacuggcugucagaaccuguuuucuggauggcuuaucugcugaggguagcgaggagggaagcugcuuuaggaugucugcaaagauaauugacucacccacaaaucuucaaaaucagaaaggaaacacccugggaggcacagaccaggggaguggcagcagcugcaggcuuugcugacuuagcucugaagagaaaaccccaacacuauucgcuggggaacagacccccuagcuccugucucugguuucacaccaugaaaagaacaccucagaagaaagcgggacuuuaggccagguguaguggcucaugccuguaaucccagcacuuugggaggccaagguggguagaucacuugaaguuaggaguuggagaccagccuggccaaaauggugaaaccucgucucuacuaaaaauacaaaaaauuagccggacauaguggcaugcaccuguaaucccagcuaccugggaggcugaggcaggagaauugcuugaaccugggaggcggaaguugcauugagccgagauugcaccacugcacuccggccuaaguaauagagcgagacuccgucccccgcccccccgcccaaaaaaaaaaaaaaaaugcucuagagagauggggcuaucucugcuccugauucuuuuccuugaauaauaucuuagugcaauauccugcugagauuauuuaagggaacaacuuaugugugguuucauuuuucucauuuuccaaguacuaguuaauagucucuccaacaaaaaccagguaaucaaggagcuuucuccucucaucaaagguuaucucaaugacugaauaguuccugcacugccugcugaaggcuauuauuuguuuuaaauguggaaaaauaacacuuuguauuuaugggggggggcgcggaggguucacauguaaugggggucagugugagagugucuucucucauucuguuuuccuugcccucauuuaaguccuccauaggcuuaauuauugcacacagcagugucucaauacguaucacaugggaggugcucaauaaguauuuacuggauaaucauaugaaaugacaagagaucagugaaggcucggcucagcucuuccccugcccaaccaugcuagccuuaaguaagagcugaaacagacccauaaacuguauucuuguaacucaaaauccugggauuacuaaacugcauuuagauauuguuuaagaaagacugaagggagcccuggcaauggcucugugacugguuggugagagacgggcgacaagaggaauggucaacauuuagagcaaaagaacaucacacggagaacuguuacgccauaccugaaacaaugaagggacacacaauacauccagaauauacuaacagguuuuuuuuuuuuuuugucuacauuacagauaacaagagaagcuuuacuuaaaauacauacuuugcugagcauaaacaaaaacugugagaaacauauaguccacuucagaguuucagaaguuguugcaauacugguguuuuuaggcuuaguaaccagacuaaguuuggcacgaugugaggauuaaagaaaaccuaacauacagccgauaugccccuuaacaccaauaucccaguugucuuucugugauaccaggugaaggccaaauucagacauuccuggcuccagagccuuuagugcaugaacagaucagguauauuacugaagaaauagguaaaggccauuuugacaucaaacagaaaaaaaauuggagaauaucauauucuaucuauuuugauuggcagagggaaucagaaaguauuccccuggacugcuuuggaaaugaccccagcauuuagaaagucucugcuguguccuaaucucuuugcuggaaccuuaucagugguaucuuggacucucccuucugucacuacauuucuuuucccaccuccccuuugaucucuuaagguaucuugaaagacaacuaagcaguuuuuggugaaaaccugaacucugauuuggugagauuugucuauuugccaauauagguaaaaucacugaaaaacuguuucugaagccuauguauaauacuuaaggccauguuucaagaaaauaauggaauaaacagucaggagagcuguaggguaauauugcaauuauagucuucuaaccuaagcgcguu

SEQ ID NO: 17370 - RNA, 4674 nt, Homo sapiens
aacgcgcuuagguuagaagacuauaauugcaauauuacccuacagcucuccugacuguuuauuccauuauuuucuugaaacauggccuuaaguauuauacauaggcuucagaaacaguuuuucagugauuuuaccuauauuggcaaauagacaaaucucaccaaaucagaguucagguuuucaccaaaaacugcuuaguugucuuucaagauaccuuaagagaucaaaggggaggugggaaaagaaauguagugacagaagggagaguccaagauaccacugauaagguuccagcaaagagauuaggacacagcagagacuuucuaaaugcuggggucauuuccaaagcaguccaggggaauacuuucugauucccucugccaaucaaaauagauagaauaugauauucuccaauuuuuuuucuguuugaugucaaaauggccuuuaccuauuucuucaguaauauaccugaucuguucaugcacuaaaggcucuggagccaggaaugucugaauuuggccuucaccugguaucacagaaagacaacugggauauugguguuaaggggcauaucggcuguauguuagguuuucuuuaauccucacaucgugccaaacuuagucugguuacuaagccuaaaaacaccaguauugcaacaacuucugaaacucugaaguggacuauauguuucucacaguuuuuguuuaugcucagcaaaguauguauuuuaaguaaagcuucucuuguuaucuguaauguagacaaaaaaaaaaaaaaaccuguuaguauauucuggauguauugugugucccuucauuguuucagguauggcguaacaguucuccgugugauguucuuuugcucuaaauguugaccauuccucuugucgcccgucucucaccaaccagucacagagccauugccagggcucccuucagucuuucuuaaacaauaucuaaaugcaguuuaguaaucccaggauuuugaguuacaagaauacaguuuaugggucuguuucagcucuuacuuaaggcuagcaugguugggcaggggaagagcugagccgagccuucacugaucucuugucauuucauaugauuauccaguaaauacuuauugagcaccucccaugugauacguauugagacacugcugugugcaauaauuaagccuauggaggacuuaaaugagggcaaggaaaacagaaugagagaagacacucucacacugacccccauuacaugugaacccuccgcgcccccccccauaaauacaaaguguuauuuuuccacauuuaaaacaaauaauagccuucagcaggcagugcaggaacuauucagucauugagauaaccuuugaugagaggagaaagcuccuugauuaccugguuuuuguuggagagacuauuaacuaguacuuggaaaaugagaaaaaugaaaccacacauaaguuguucccuuaaauaaucucagcaggauauugcacuaagauauuauucaaggaaaagaaucaggagcagagauagccccaucucucuagagcauuuuuuuuuuuuuuuugggcgggggggcgggggacggagucucgcucuauuacuuaggccggagugcaguggugcaaucucggcucaaugcaacuuccgccucccagguucaagcaauucuccugccucagccucccagguagcugggauuacaggugcaugccacuauguccggcuaauuuuuuguauuuuuaguagagacgagguuucaccauuuuggccaggcuggucuccaacuccuaacuucaagugaucuacccaccuuggccucccaaagugcugggauuacaggcaugagccacuacaccuggccuaaagucccgcuuucuucugagguguucuuuucauggugugaaaccagagacaggagcuagggggucuguuccccagcgaauaguguugggguuuucucuucagagcuaagucagcaaagccugcagcugcugccacuccccuggucugugccucccaggguguuuccuuucugauuuugaagauuugugggugagucaauuaucuuugcagacauccuaaagcagcuucccuccucgcuacccucagcagauaagccauccagaaaacagguucugacagccaguagcagggguauuuuggguuucaguuuaaaacuggugcguguuguugcaagugucuugaaguugcaaaggauguuugggguucuagggccugcaggggggcagagcagaaagaggguaguugucagugacccucuacccuccucugagagccccauugccauuuuugcccaccaguucucuucuuaccuccucagggcagugcccacucauuuccuuuauuucccuuuuguuuuuuuucuuuuccuccucuggucgacaaccucuuaauucuagcaguguacaaaagcaaggccaagcuuuccuggggcacuugggaugaaaggcccauccaugccuguuguggaggcacagaggaggagaaggugaagaacaggaaugggugcagggggagugugaacgcaaggcugcuggcuuuggcacagcucccugugcagggcuggauuuccaauugcuuuucagugccugugcccugauaggaugggcacagcugguauggaaucagagcagcccaucuccagagcagaagucugagagcucagcguuugacuccugaaagaccaggauguuccuaccuggguucuugagauucauuggcuaguggagguagaugguacucuccaugucugcagaagauuccccacuuggugcugaaggcuaggugccuuccagucaggucugaaugcugaaauugcugagauuguccacucucugccuacuuuauugcauucaugcuccccuuagauccaagagugcccaggacuaggagcagaaagcaguuuucaacccuuuguucagacucagacggguuucaacucaagcggguaaucuaccccagcagcaggggugcaaaguccaaaacagcuuuguggugccuggggagugacuaggcagccugcucacaggggcuggagucaucuaaagcuagugaugagcuggaauagcuuugaaccgguucauccgaacugauuguuaaacuuucagaacuuuugagagucaguugagaaacauagcuauuacuaaaaaauuaaauaagauuagauaaauuauagcuaaaagcaaaggcaacauauagucaaagcucaucacuuucuacuuauuuuacuacauuuuaccauuaucugugcccaugagguaauguaugccuauuaugucuguaugguagaaauacuguauacagguauacuacuacacacaccuucccaagugacaguauuuuuguaguuugagaucagcuauaguggugguauuuauaccauggaaagcaacaaagccauggaaagcaacaaagccaugcaaaucagacuccuccuaaccccuaagacaguuguuaaacauuugccagcauaccaccaucuaaagcccuaaagaaugcuuggccucccacugcauagacacaggccacaucacauugaguaucauggauuuaugggucagcauugccccuaaguccaaggaaggggaaagacuuagcaagcucaaccucaugugauucacaaaggguuucuuucugcauuuguauugacucagaauaggacccaguacagagaauccacuguuaucuaugggugucauuccuucagaaagaauguacaguaaaauuggcuauuucaugcuaugcaaacaaaaugaaacuaguuugaaguugcaaagugucuccccucuugcgcccacguagucauccaagaaggaaacuccuuucuugccuugauauucaccaggccuaccuagauagaacuugacaaauuggccuaacuucaucuccgcugcuauuguuauauauuugcuuuacugaaucuauguccuaugucagucagaagaaaaaagaaaugucuuuuuuaauauacacuuucuuagcauccaugcaguuauguauccucauccugauccaggaacauauugaacagaucauaugucuuuuguuacuaucuagauacacuaaauaacaugauagaagaguuuucucuuucaggugaacuuccauuuugaacauaugcuaaacguacuauccacugucuauuuuaaugagaucuuggcaaugguccugucgguuuugguguuuggauuguuuggcuuuguuuuccuuuuuuauucuuccuguuuuuaaugcuguguaagaucuccugcuaugaauguuccaguuaccccuauuguacuguauauacgugugcugcauguguaaauucuguuucagguuuuggaguuuucaucuuaaguacagcugguccuguugugaacucaucuuuccuguaugcuccucugugucugauuuccaauugccaaaauguuugaccaaauguguuuugacaaauaucccgagacagccaugcguauccuugugaaagggcaugcuccaugugggauggcucguguacagcauaaaucuaucaaacuuggaauuguguauacauuuauaugccagauaacuaacauucauguaacagcugcaaagauauuuaguguauaucagauuaauaaaagagcauuuuuuuuuugcuccauuauauucaaauacagauugcugugugacuggcu

SEQ ID NO: 17371 - RNA, 586 nt, Homo sapiens
cagucguucggacaccgcugaagcccaacccggauuccuuacacccgggacagcugccgcccuaagucccaagucacggcgcgcaucuggccucccaaacuggaucucagguuuauacacccuuucccugguccucggcugcccccgacgagcccccgggcaacaaggacagugccccuauauccccgccucaucccuagucgcugcagcaacacucagccucgcaccccggcacguuccgcgccucccgccagccccaccccaccgccucagcggauugccucgcugcaggugagucuggccaggggucccuuggcaccagggguugcucaccuuacugaggaccccgcagcgcuccacaggcggcccagacuccgucucuggauccuccuccgagcccgacgaguuccagcucugauuauccgacauggaggcucgacaaccgagcaggagaccggcccccgcucccucagcugcgccggaggaggcgcccaguccucggggugaagggucgggggauggcgaagcgaagagugcccgcuccggugugggggggagcaggaggagggacgaaguccgcccgccg

SEQ ID NO: 17372 - RNA, 25377 nt, Homo sapiens
gaacgauccucucuuauuggucgaaggcucguccagcuccgagcgugcguaaggugagggcuccuuccgcuccgcgacugcguuaacuggagccaggcugagcgucggcgccgggguucgguggccucuagugagaucuggaggugaggcgggcggugaccgagaagaggggcaggggcggcggggagcggggcggagaugggugggagcgggguuugggcuguguugguggcaauucuggagcuucccucggcccugggaaguggcuaccggcagcuccugcggaccuggagggggcugcgguugcgcuuugucgguguggcagcucggacccgcggggacugcaaggaauguccuugaggcccggcaggccgagcggcggccggcaucagugccggaguaacccggggucccggggugggcuugagaggcgggcggcggucuggccucuucgugacugcggucaucaucgguggacccgcggggcguagcugcguucaucgucccuguucagucagaguaggcagugcuggcugcacggucacgaaaaucggggcggaaagggugucaggcagggugaccucggaggccccuggauucgagaaaugcuaggggucuauggggcugucgggccggcagcucgcagggcagacgggagaagcgccugcaucccgggauccgggcauucacgcccaggaacugcuguucguuagcaccuuucuuuuaggugacgggaaagaucucuguaaauacugcugacuaacuuagaaccaugaaagaaccguggauugguguagaugugucugguuauuuacaggagaacggcuugagaggaugcggagcccaacguggggauucgcacaaugacucaaaagauucuucucccucuuuuuuuuuuuuuuuuuuugguaagggguguagucuccuuggugcugauauucuuuuaggaaaaauguaccuuggagauacaaauauagaacaguuaauuucugcaguaggaggaggucgauguacuccauucuuaaguagucguuugaaauauuucaggauuugaggauauuccuucuuagacaugguccugcagagucguaggaagcauuuguuucugggcuauacuaaaugugcaugauuucggcgucccacaagguagagaauguacuuuuuguuuacuuaugaauuuauuuuccucuccaugcagugaaaggcauuuugcaauuuagagauaaucuagcaaagaccuggacaguacuuuggggauaggcuggauuuugcaggccugcuuuguuguaguguucuuccagaacuuaugauaaacuugguggccaaaacaaaugggaauuaguaacaugaagguuaaacaaaauugcacauagguuacagcauuaacaugaaaauugucggguaugugggauaaccauuucaagauaagagugugaguaugcgugcaugcacacacucuuuguauuccuuuauggucuaguuucuagacuauagauagccacauuauggaauuacauggucuacuuagguugacccaugugaaauugccaguauuuaaaauucaacuaaccuacaaaaauagcaguuucauaugauuccauuuaacacuuaucuuugucagagaacuuuggagcucuagcuucauaagugaaugaagagaauagauaugacuuaaaaaacaacauguaauagaaugugagcuaauuggguauagaauccagauuuccugauugccagugcaagauucguuuuuuuuuuuuuuuuuuuccuucuuucuggaauaccagcuugagcagcagaaugcuagaucuuguugggauugaaaaugacugccauauaagacgcaguucuuggcuucaaagagacaaaauguacacauuuauuaauuugagaacacugugagauaguauauaaucaaauacuggaauguguaaugcaggcggagugcugaguaggaggaaguaagaugccaaaacauccuuuucugcaguuggccaugguagguggcuucuguagcagauuggauugacauuuaagaauuauccauucuuuuaaagaaucuguaaaaguuugcagcauacuuuuuagucugaauaaguaaggcauaccuugccuauuuguuucuuuaaguaaaauuaauuuuuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaauuaauuuuuauugcagcauugcauaaauacugucaacuuaauuugcaggagcuauccuguagccugcuugugacauuugcaacugcugaugaagguggacgauugaauucuauggcauguaaaugcuuugcguaaucacagggcaacggggaggauguuccugagaaaugagauuguuuauaauuaugguuacuuuugacacacccucauaagauugcucaguuuguuuccaaauagguggaguucucuguguuuaggggcggcugacagaaucauguguaauuuuuuuccuugaauauugcaaagaugacuuuacaccuaggaaaaaaagucccagaauuacaaugccaccauaaaaucuuuugagggaaaacauaaugugucuaauguauaauuauggguuuaugauguuaaaccaauuuguucacaaguuaguguuccuucuggguugcagcuaagauuuuaacucaaaugaauuaacuuuuuaaaacaaugaaucugauugacauaaugaggaauaaucugagcugaagaguuuuuuuuucagggaaagaggguuagaaauaauuuugaccuaauuuugaaacauguaguuaauuuacuuucuggaacuuugaugcuaauugauccuuuagaacaguugguagaguuguguuuuaaauguaggaaagaaauuaugugauagaauaccaugaugaaaaucuagccuuuuagugagugagucuuuuguuuauaauuaaguagaguucaaaucuaagauuugauuaaagauuuccaauacuuaaaaguccaaguaccugcuaauuuaauagaaaguauuuuguugcuguuguucauuuuccaggauaguuccaaguugacugucucuaaucugaagaucugaaauccgaaaugcuccaaaaucugaaauuucuugagcaccaaccugacacucaaagaaaaugcucauugcagcauuuggaguuuggauuuuggauuagggaugcuaagcuaauaaauguaaugcagauauuacaaaauucaaaaacauccaaaaucugaaacgcuucuggucccaagcauuuuggauaaaggauacucagccuguauguaaaauguuucuccuucccguaccccauuaauaaguucccugaaugcucugcauuuagccuuaaacuagagggcauggguuacauccauaucuaggugccuuaaaaaaaagucgucuuuaggucuguuucaagaugugucauaaaauacaugcuacuauagcuuaagaauuuaagccagcauuuguugagcaaugcuguauaugagugcaaggugcuggaggguaaauugaugaauaagacucaggguggaagguugaaaaagcaugaguaaacacaggcagguacaugccacauuuauauuccuuuagguacugccagcuuuuuaaaacugugacccacaguaggaaauacacguuaauuuaaaagccagacacacacuuauauagguauaguuucuugaaacauaguuuuaagaaauaauaccuacccauacuaccuggcuuacccaacagcuauuuuuuauaauauuguuuucuauuuuauuuuauuuaaaaauguuuguucuuaacgacaaaauugaugucaugauguaauugaugcaguuguuguggaucaacaguuugaaaacuguuuagcuaguggugugguaugucugaaauguagagaacauggagugaugcagugagagaugacacuugguauuugcuuugguuccuuaaagcugcucuuuuuuuuuuuuuuuggucuuuccccuaacccuuuauaaauagauuaaugcuuucuuucacuuacuugauugccuuuuuauagucugucuucaacagaugaaucacuuuuauuuauuacuaaaugugagauucauuugaauucuugcuagaguggcaguuaaugagcuuuuuaaaucuuuuugguugauuuuugcagguuacuaauaugccuuaucacaggcauugauuuuagugaaagaaguaagacuugcagguuuauuuguggagaccaaugguaauagaagauuuguuuucaaaaucagaaugucauaauuauuauuuagcaaacaggaaauuuagucaugguagucaguaaaucaaaaucuucuauauguucuuuugggaauuuuuuugaaugcuauauacagauacuucagccagucauccucuucuaguacuguuccagcuuuugauuaguugugaaaguuuggagcuuuucacaucuaaugcuuuuccauuggucuucuagcacuauuguugaugaaucugcuagaagaaaagcagccaccacagcaaaauucuuaacccuguuuuauuaauguagaaacaucuaucagaaaagacuuuuuuucuguugacagcaauguuaggaagguuuauuaaacauccuuuugcuagugacauuaugccauauguucuauggaaugaaaaaguacaagaggucccugcccuugaggaucuuaucaacuaacaugauuuauagcaggacacucaauaaguggauucuuggguguuuaccuuuuguguaaucagaauguagaugaugaagaagauacuuaacaugcauuuuauaucuagguaauuagaaaaugugaauagcuguuucucacuuguguuuucugcuugauugcucuucuacuugcaaggcuuagguaauaaggucgagauacuuaucugguuugaucuuaaauguuugaauucauauaauuuuuaagaaauggcugcuuuaaaguugguugccaguaaguaauaaaggauuuauuguuugagugaagaagaaauaacauaguucucuuaauuuuauaauuauuuuccagaauuauaaggaacaguaucaaauagucauauguaugggacacugugcauacaaagcaggguuuauagcacacuuuuccuuaaaaucuuuuccuaaaaauacaaugagcuguauacuaaguguucacccuugauauuccuuccaggauccaaggauucuguagcuacaauguugucaagacuuuuucgaaugcauggccucuuuguggccucccaucccugggaagucauaguggggacagugacacugaccaucugcaugauguccaugaacauguuuacugguaacaauaagaucugugguuggaauuaugaauguccaaaguuugaagagguuagugaaguuaauuugauacugacuaaaguaaauuacauuuucaauuuuugaagagcccuuaagccccuauagggagcacauaauuuuuaaaaguuagaguaaaauauuuauuuuaguauuuuggaacuuaccucaaauuucugcuuacauggaaugcacuggaaaugcucuuauuuugcuuugucuuuacaaaugaauguaauugacuuuauuugagaaauacaucuuuuauaagugacuaauagucaaaaaugauugugggccggguauagugacucaugccuguaaucccagcacuuugggaggccaaagcaggagaauuguuugagccuaggaguucaagaccagccugggcaaccuggacaacauaguaagacccagucuuuaaaaaaaaauuaaaggccgggcacgguggcucaugucuguaaucccagcacuuugggaggccaaggcggguggaucacgaggucgggagaucgagaccauccuggcuaacauggugaaacccgugucucuacuaaaaaauacaaaaaaauuagccaggcaugguggcgggcuccuguagucccagcuacucggaaggcugaggcaggagaauggcgugaacccaggaggcagagcuugcagcgagccgagaucgcgccacugcacuccagccugugugacagagcgagauuccaucucaaaaaaaauuaaaaaauuagcugggugugguagcauguaccuguaguccugcuacucgggaggccauggcaggaggaucccuugaaccuggagguugaggcugcagugaacugugauugcaccacuguacucuagccuggguaacagcauguuacccugucucaaaaaaaaaaaaauuguggugauguauuggcuuaccacagugguuugauuaaaaguuggauuuaauuuuugauuuguagguuugauauuuuuauuggacuuguauugugcuuacauuuauguucucaugacuauauaaaugaauuacacaugcaaaauaaaaauucuuaguuuugauuacuuauuuuaaaagucaaagcuaauggaauuuccuuuucuuucucuccuauuaggauguuuugagcagugacauuauaauucugacaauaacacgaugcauagccauccuguauauuuacuuccaguuccagaauuuacgucaacuuggaucaaaauauauuuuggguaauaguuuuacauauuuaacuucuggugucaucagauuuuugauuugcuguggaaauaaaccuguucauucaaaucauguauuuggaaauauguguauugcugaaagugugcugcaugcauugaauaguuuccuuauuauuggcaauuagacauucugaaauuugagaccuuaauaauuuggaguaaacuaguauuaucucagaaugcugugugacacuguuauuauuuguguaguaaaggauaaaguuuuuuuaguauugaacuuuugucauuuuagguauugcuggccuuuucacaauuuucucaaguuuuguauucaguacaguugucauucacuucuuagacaaagaauugacaggcuugaaguaaguauuuaaaaccuaaauauacuuucugucaaaauacauuuuaaaaaacuuuucuuccccaugcuguaaagguacauuuucaaaaguuaagaaaauaaggggaaauuuuuuuguauaauuuuacuauuagcuaauuuuaauaacuauuaacauuuuggcauauauccuuuucuacuguuuuuauacuuaaagaaaauaucugauaucauauauauuguuuuauaauuucuuuaugcuuaauaauaguuuaucaacaucuuuccaugucccuuuuuuuuuuuuuugagauggaguuucgcucuugucacccaggcuggaguguaauggcacgauccuggcucacugcaaccuccacuucccggguucaagcaguucuccugccucagccuccugaguagcugggauuacaggcaccugccaccaugcccauuuaauuuguguauuuuugguagagacuguguuucgccauguuggucaggcuggugucaaacuccugaccucaagugauccgccugccuuggccucccaaagugcugggauuauaggcgugagccacugugcccggccuccauguccuuaauguuaaacuaaauuguuuguaauggcuauauguauucucuucugucuaaacgucuuguaguuuauuaaucaucuaauguuggacuguuagguuauguaauuuuuuuuauuaauaacaacacugugaugaaugucuuuguaacgaaauuuuuguucauauuuguaaucauuuucuuaagauacauuccuagaagugagacagugguuuugcuuuuuuuagagcuuugcuuuuuuuuuuuuaagagcuuuuuagugcuauuauugccaauuuaguuuacagaaaguuuguuuaguuuauccuuccacagguagugaucaaugaaaauuuuuauauauuccacuuuuuuucccuaaugguaauccaaggagauauuuuuuacuaaggaugauacuuugauacaaaauuaucaaaagguguuuaaauguaaauauacuuacauuuuaacauuaaaaauauuuuuaacaaauauuuugagcaacuacuauguuuagcuuugaggaugccaaagaaauauaggguauacuuuuuugucugcagaaagguacacauacuacaggaucauacaguauggagggggaaagguuuuguucuaaaaagaauuuuuuuaaaaucauacuuuuucccguuaaauuuaucugaucauuuuguucuuuuccagugaagcuuugcccuuuuuccuacuuuugauugaccuuuccagagcaagcacauuagcaaaguuugcccucaguuccaacucacagguaaguauuauuuauaagauaggaaugugaauaguauuccuuuuuucaguuuacauuaauaggaaggauuaauagcguuucuucauagcacaagauuuaagaauugcccaaaguuuuaaguuuaauucucaagucccaagacuggucuccauaagugccccaggaacaguccccuguaucuaacaacucaauuaugauucuguagcuacuggaauuuggaauugcccccauuuuucuuuuugaaaguuuucagaacuuaugguaauaauaauuuuuggguaaauaagaguauuuuccuagugaaacacaucagagagcagaacaagaucuaauggaagagaaacccaggguagauugauugauugauugauuugagauguagucucacucugucacccaggcuggagugcaguggcgagaucuuggcucaccacaaccuucgccuccugguuucgagggauucuucugccucagccaccugaguagcugggauuacacaugugcaccaccauccccggcuaauuuuuguguuuucaguagagacggaguuuugccauguuggccagacuggucuuuaauuucugaccucaagugauccacccgccucagccucccaaaguggugggauuauaggugugagccacugcaccuggccagauuuauuuuuaaaccccuuaaauuaacacuggcauuauuuccuauuuuaaguuucaucuuaauguucauuagucacuuugaagaaccuaaccauuuuaacaauauuauaucagaguaucuugaguauaaaauagcacacaauucugcccugauuauuuguugaugaaagugugugaucauuugaacauauuaacaaggaaauaaguuugguuuuauuaauacuaauaugaucucauaaaauuugcaacuaagcuucugucaugguagguaaaaauauagaauguuguaggauuuaauuaugugugauuuaaaugacagaguuaaugcacuaccucaaaggaauauuccuaacaaauaucuuauucaguggaaagggaaucagggcacuauauguucuuuuuuaaaaauuuggcugggcgcaguggcucacaccuguaauuccagcacuucgggaggccgaggugggcagaucaccugaggucaggagcuccagaccagccuggccaaccuggugaaacccagucucuacuaaaaauacaaaaauuagcugggcaugguggcgggugccuguaaucccagcuacucgggaggcugaggcaggagaauugcuugaacccaggaggcagagguugcagugaaccaagaucacaccauugcacauugcacuccagccugggaaacaaagugagacuacaucucaaaaaaaaauuuuuuaaaauccuuuauauuacaaucauacuuuguaucuugaauaccuguuaguuuuaucauauuguauauuuuacucuuugaauaguaauuugauauuaauauaagccauaggaugcucuaacauuuaaaaaaguuguucugucccuugccuucauugauauguuugaucuguuuuaggaugaaguaagggaaaauauugcucguggaauggcaauuuuagguccuacguuuacccucgaugcucuuguugaaugucuugugauuggaguugguaccaugucagguuuguaagcaauuuuugccauauuuuaaaauagguaugucgcuaaagaggaaaaagaacaucuuggauuuguauuauuuauuguuaaauucugacuuuuaaauuacucuuaaaauuuuuuauuauauuaguguguggguauaucuggccuguuugcuuugguggaaacuuagcagcagguuacugauuuauuuuucacuccugccauccucucuuuguguuccacuuugugauauuuuuauucauuugauuucuuuuguuuguuuuuuuaaccaacauugcauuccaagguuggucuggaaaacacuuuccagccccugcuguuacuuagacucaauuggugacuugguucuuuguguuuuaauuaucauguagggagaaaagagucaggaauuggacagaucugaguaagauucaccuaauaaggugauuggaaauauuuaauccgauaguaagcaguacaucucagcaaguacccagcauuagcuucaacacauguuucuucauucuuaauuggauaguagagaauuagauauuaauaucaaacauaggacuucauuauguagaauaaaaauuacagacuggcauggaaauuugccagaaggaauauauuacgcugugugaaggucuccuaaucauuaggauuauauuuuauggcuuucuuauaaagaccauacuugguuaacuacuguguauuuccugguaccuuagagcccucaaugagaugccucauucuuucagaaguaaauuaucuaacuuuuaaggggguaaauuauugucauuaguuuaggccucuucaguagauaguauauuaaaaauguaauauugcuucuaacuuucugagagcaaauuauuauuuauuuauuuuauucaacaaagauuuuauuuagcaaauaaaauauuuuuuaauuuuaaaaauuuacuuacuuuaaaauuuacuuuugggaguacaauuuuaugaguuuugacaaugacauagucuuguaaccaccacuacacucaagaaaaaauguugaucaggugaaaauguacuuguuugauuuuauucaagcaaaagaauauaugagaaggggauucgccaggaaguaauaguugggccaugaaaccaugggauuauucauugaaauaauaaugauguggaaagcagcugggcgaugaguuuugucaugauauggucagagaaguagacaaaggaagugauuagauuugugguuggagaagacagugagacauuuacagcuauacagaaaugguauaauuagagauuuggguuacgguaaaaaaggacagauuuaacacauauuaacuuggaaguaacccuuugaaaaagccaguacaaaaagaagaaagucuuagcuucuuggaugucuguggauuggugcuguuucuuuguguguagagagacuuaucuggggacacaguaaggaagaaugccuggagagcauauggcaacaacaugagugaauauugugcagagagaaauaguagauagucaagucaugaaagcauuggucaaguaugguuuuaauggccucaaguuugaaaagauuauauucagcuacuauuuaaaauguaguuugauuuauaaugcuuuuguuauugugauuuuguagucucuugaauuuccacauuugaggguaaucguggaauuaaaaaaauacaauauaugcuuguucuagucagucaaaugauaucuuaaaauuuagguaauaaaauacaacuuugaguuuuugugagcaguuuuuauaggacaauuuaaauuuauguuucaaagcauugggaauuaaaaaaauacaauauaugcuuguucuagucagucaaauuauaucuuaaaauguagguaauaaaauaaaacuuugaguuuuugugagcaguuuuuauaggacaauucaaauuuguguuucaaagcauuguuauguuugagcgacaucagaaauauguuuuauauuauacucaaguuuauuuguaaagugagggagaaggauuugguggucaucuaaggucucuucuagccucuauaauucuguuuucuauuugagaucaccaaaugauaccuuaaacaguuguaguacaauauguuuguuaauuuuuagucuuaaguuggcauuuuguauuauaucauuuuccaaacagaucaaugaaauaaccaaaauuauaagaacuucaguaggcaucauagagguuauauugaaauuagaguuuguugguacacaaaaaauauuauuuugaccuuauaucaggacuggcauaacuggcaggauauucuacuuauauaaaaaauccuugguuaauuggcaaauugcuuuucuccuaacaagugggauuagaucaauagugucacugggguuuugcucuguuagaguagccuguccucuccuuauuuaauaauaaggcacuacugcuugacaaaaaggaauuggaaacacauauguuuuaucaauuguguauuaaacacuaccauucugccuggcauugugauauggggacaugagagaaggcaagagcuuugcucuugagggacuuagaguucuguuguuauuccugcuguuuccuaaggcuuggcaucaccucuaaguugcuaauucuauuuccaguaaguggcaaggagcuuaauguacuaauauuuucauguuuuguccaccugcaggaagacaaauauauccuugugauauaugcagcauaaaaaauaacguagacuuuacuaguuguaucuuuaauuuuucucuaaccagggguacgucagcuugaaauuaugugcugcuuuggcugcaugucaguucuugccaacuacuucguguucaugacuuucuucccagcuuguguguccuugguauuagagguaagaccaauucuuacauauggcacuaguagaagaguaagauuucugcuuacacaguuuaccuaaacagaaucaauaccuucuaaugucacacugacuuaauuuguagcuuucucgggaaagccgcgagggucguccaauuuggcagcucagccauuuugcccgaguuuuagaagaagaagaaaauaagccgaauccuguaacucagagggucaagaugauuaugguaaugacaugguuuucuucuucuuuuaguauccucaguuccaaucucauuauuuuuaagauuucuuuuuuucuacaauuuuggcccauucaaugauauugcacccccuucuuccuuuuuuucuuaauguguucauuucuuugaggcuccuggucuuuauuagccccucucuccuaaacagacuuuuuaaguucccccaccuuaucucucguugaaagccuguucuuugggguguuuucaguaguucaguggggucacuacuuuaguuaguugcauagcaagcuuggggcuuuuuuuuuuucaugguaaggggaagcuaugagagauaaugucuggcuguccaguugcuagggauaagaaauuuaaguucuauugauaugcagaggauacauuacuuuaaaaauuuuauuucagucucuaggcuugguucuuguucaugcucacagucgcuggauagcugauccuucuccucaaaacaguacagcagauacuucuaagguuucauuaggacuggaugaaaauguguccaagagaauugaaccaaguguuucccucuggcaguuuuaucucucuaaguaaguuaauugaaaucuacuuugugauauauuaaucauaacacucuaugcuaauguaaguuuagauuguguccuuuacauuucugaauaagauuuuaauuugcuuucuuuuauuuagaaugaucagcauggauauugaacaaguuauuacccuaaguuuagcucuccuucuggcugucaaguacaucuucuuugaacaaacagagacagaaucuacacucucauuaaaaaacccuaucacaucuccuguagugacacaaaagaaagucccagacaauuguuguagacgugaaccuaugcuggucagaaauaaccagaaaugugauucaguagaggaagagacagggauaaaccgagaaagaaaagguaacuuguuauucucuucgcuuucaauccuucauugcuuugucaaaaaguagucuguuuucaaaauuaugugccguguugugagauuucuuuugauuucuugaacaguugagguuauaaaacccuuaguggcugaaacagauaccccaaacagagcuacauuugugguugguaacuccuccuuacucgauacuucaucaguacuggugacacaggaaccugaaauugaacuucccagggaaccucggccuaaugaagaaugucuacagauacuugggaaugcagaggugaggaugauaacauaaacuccaauguggcauuuuucauuacaaaggagcuuuuucaaggaagaaaaaucuaguaucugcugaacacuacagcuaaguucugggcacgguguaacaugacuaacagauacuaucuucuuucuuuauuucacacaaccuugagagguagguacaauuaucuauuuuucagaugagaacauugaggcuccaauauguuuaauuucccaaaguaguaccucuaggaaaugauaaagcugauagcaggguccaagauuuucugacuccagagucaaaacucuuucuaguuuauuacuguuuaucauagagaugagugacuacuguauucucauagguguguugaggccuagaaagaguuuaacacagagacaaguuucaaagauagaagaaaguuuguuuuuguuuuguuuuguaagcuugauacccaugaggaaguuugcuuuucuuucugacauuugaacaggaccuucugccuacaugaccauaugaaucuacucaugcuuucaugcaaauaaucauguuccauccaugucugcuuaauaugguucuuucuuuuaaauauauguuaauacguuuauugguaaaaugcaauuuuuugccagcuuuauugagguauacuugacaaaauuuuauuuuauuauuauuauuauuauuauuauuauuauuguuuuggagacagagugucacucugucacccaggcuggaguacaguggcaccaucuuggcucacagcaaccuccaccucccagguucaagcgauucuuguguaucagccucccgaguagcugggauuacaggcaugcgccaccaugucuggcuaauuuuuguguuuuuagcagagaugggauuucacuauguuggccaggcuggucucaaacuccuggccucaaguggucugccugccuuggccucccaaagugcugggauuacagguaugagccacugcaugcccggccugcauucuucaaucauaugcuuuuuagcuaaacuuagucauuguucuuuaaauacaguucccaacucuggguuccuauucuugucaucugacaugucucccccucuccagguguucacaccuuuagggcaaaugcuagcaucucuaugaaaccuaccucaauuccgccaaacagaaguaaccuuucuuuucugaagcauccauuauauagagacugugcauuuuuaauggcagucguaccuuguugcuuauaucacauuuacaugaauaucuccauuauuagacaucgggcucuuagauggcuaaguccaugucuugagagggccuuggauuucauaggugcucaguaaacuuacuaagagaaugaaugaauuugcauugauaauacauaaaccagcuaauguuuaucuuacuauucuuuugaaaaauuaggcuaauauuaguguuugcaaagaagauccuugaauaaacccacaaaauggaauuacugguaccaguuuuguggaggguggugauugugaguguguguguguguauguguauguauguauaucaccaccacaagcagagucaagagacagcuaauaaaccaagagaaaauauuggcaauuuauauuuaaggcuaaagggcuaaucucuaauauauaaagagcuccuacaaauugaugagacuaaauuuuuaucuaauuuuuaaaaagagcagauaaucagucuauugucaggaaaaaaguacauauggcucuuaaaaaugugaaaaggugauuaacuucauccuaagagaaaugcaaauuaaaauuguacuugagauauuuucacucaucagauuggcaauaaucccaaaguuuaauaacauacucuauugagguuguagggaaaggucuuuucuuguuuuuuuggguuuuuuuuugguuugguuuuuuuuuuuuugagaaggaguuuugcuauuguugcccaggcuggagugcaauggcaugaucuuggcucaccgcaaccucugccuccuggguucaauugauucuccugccucagccucccaaguagcugggauuacaggcaugcgccaccauuccuggcuaauuuuguauuuuuaguagagacgggguuucuccauguuugucaggcuggucucaaacuccggaccucaggugauccgcccgccuuggccucccaaagugcugggauuauaggcgugagccacugcccccaggcuggaaaggucuuuucuuacauugguggugagaaggcaauuggaccguguuuauucaaauuaauaaauuuguaaaaauuauaaaaauuuauaagauuguaaauguucauacccuuuggcccaacacuugugugaauauauacccauaugugugcguguauauauauauauaugcauauuuauaaucaugccuaaaaacaucucuggauggauacacagugaaacagugguaccuauuuauguguagguagcaaagaacugggcagaugguagacagggaugggaugaagacuuuuuguuauaucucuuuuaauauuuaguuuuuaaaccaugugaauauauugccuguucaggauaucaaaaauagcaaguuuacuagaguuuaaacaauagcuguuauaucugacacacacuugaaaccuugcuaaauucacauuuauuuuucuuuuuaugguguauuagugcaagccugucuuuguauuguaaaaucuaaugauacgguauuuauauuauuuuuguuuggcauuuuuugcauuaaaugaauuauuuugcagagguaucuuuuaauuaaaaacuacagugauuuaauuuaaaaauuacauuauuuuagcuuagcauuguuuguauuaaaugguuuauaacaugaaauacaguccuucaagucuucuguuucaucucucucucugaccacaauuucauuuuuuuucuccauuucuuuagaaaggugcaaaauuccuuagugaugcugagaucauccaguuagucaaugcuaagcauaucccagccuacaaguuggaaacucugauggaaacucaugagcgugguguaucuauucgccgacaguuacuuuccaagaagcuuucagaaccuucuucucuccaguaccuaccuuacagggauuauaauuacuccuugguauguuauuuucucgauuaagagagauuugcuuuguauguuuuuaaucuuuuuucuugauuaguuucauauauguacauaguuuuauaaaacauuuuccuuuuaaaucauuuuauccuaauuuuuuauucugcuuaugauguaggucauagaaauuaaaaauauauuuccugcuuuuauagucauuacucaaagauuuuaguauuuuaaacacuuuuuaaaggugaauuaaacauuuuguuuaaaaagaauacauacuaaaggauuaaguuugaagauaguuauacugacaagcugagauaaaauuuugugcauuuacuauauagauuuucauuuggugccugacuuuaccuuuuaggugaugggagcuuguugugagaauguuauuggauauaugcccaucccuguuggaguggcaggaccccuuugcuuagaugaaaaagaauuucagguuccaauggcaacaacagaagguugucuuguggccagcaccaauagaggcugcagagcaauagguguaaguuggcauuuauauauuugccaguuuaaaaauacaucauaaguaaggcaaugagaagaguuuuaaggacaauuagugauaccuuuugggucaagcaugagcauuuuuggguaacaugugcuugcuucucuaacauauacuguguagcuugguggaggugccagcagccgaguccuugcagaugggaugacucguggcccaguugugcgucuuccacgugcuugugacucugcagaagugaaagccuggcucgaaacaucugaaggguucgcagugauaaaggaggcauuugacagcacuagcaggugugugaguggauuuguauguacaguuauaucuauuuguuuauuuuagaaccagugucauuuucugugauuaccaaacauaauuguuaacauauuaccugcuaaagagcacauaacagaauaucaacuuuaaagccauucauuuaaaaugaguaauauuuaugcuugguuggggggaaaaaaagaauguugauucaaaugaauagcuccacagagguaaauuaguaagaaaaaaaaaaaagugugagcuaguaauuuugauuagauguuacuuugccuaggagagaacugucuuagaaaaaaagauuuuucaaauaggagagaaauauuaguauaauaagacuuacuucaaauaaagaaaauuaauaaaguagcauaaucaacacaaaugauaaccauaguauaguucaagcuaacacauuuguuuuuaugugaacuguguaaguuuauuaagaaauaauugugacugggcgcaguggcucacgccuguaaucccaacacuuuggggaggccaacgcgggcagaucacuugaggccaggaguucgagaccagccuggccagcauggcgaaacccugucucuacucaaaauacaaaaauuggcugggcaugguggcccgcgccuguaaucccagcuacucgggaggcugaggcuggagaauuucuugaacccgggagguggauguugcagugagccaagaucaagccacugcacuccagccugggccacagagugagacuccgucucaaaaaaaaacaaaaaacaaagaaauaauaauaauaaaagaauaaaacacagucuuugcaucuuuuauuuauagauuugcacgucuacagaaacuucauacaaguauagcuggacgcaaccuuuauauccguuuccaguccaggucaggggaugccauggggaugaacaugauuucaaagguaaguguaggcagaguaucugaaaguacuuuuauuaaaaugaaaguacuuuuauaaaaaacaaaucaggcauuuguugauugguauuccuuacauuugauagauuuaauuuagacuuggcauuacacauauccugaguuuacuuaggacugggaacaaucuuaguauugacauuucaaaacuuuauccagucaagagaccaccuuugaagcugaccucuucaagauuugucuuuaagaacaccaauauaauuucaguacuuugggaggccaaggcaagaagauugcuuggggucuggaguuuaagaccagccugggcaacacagugagaugcuaucucuacaaacaauaaaaaaaaauaguugugcauaguggcacacaccugugguccucgcuacacgguaggcuggggcaggaaguuagcuugagccuaggagcuugaggccagcuucggcaauguagcaagacccugacuccauucauccauccgucuguccguccguccgucugucuguuuucaauuuaggauauuuucugcuuaugugggguuuacagccuaauaaaccuaucaaaagucaaggagcaucuguauaagcuuuaaaauugccaauaaacaguauggcaguucaacaacuuaaacaugaaauuaccauaugauccagcaguugcacuuccgggcauauacccaaaagaacugaaagcaguucucagagagauauuuguacagcuauguuuguagcagcauuuuucauaauagccaugaauuggaaucaaccuuaguguucguuguuggaugaauggacaacaaauuagauguauuuguauguguguguauguauaugucuauauaaaauggaauauuauucagcauuaaaaaggaaggaaauuauagcacaugauacagcauggauaaacauugaugacauuaugcuaaaugaaauaaaccagucacaaaaagacaaauacuguaucauuccacuugaaugaggugucuagaauagucaaauucauagagacagaaaguagaauggugguuaucauggguuuggggaaggggaaaaugggugguuguuauuuaguaaguacagaguuuuuguuuugugagaugaaaagaguucugggagcaaagacauggaaccaacccaaaugcccaucaaugauagaccggauaaagaaaauguggcacauauacagcaugcaauacugugcagccauaaaaaaggaaugagaucauguccuuuguagggacauggaugagccuggaaauaucauucucagcaaacuaacacaggaacagaaaaccaaacaccacaccuuuucacuuguaagugggaauugaacaaugagaacacauggacacagggaggggaacaacacacaccgaggcaugucgggggguugggggcaaggggaagagcauuagggcaaauaccuaaugcauguggagcuuaaaaccuagaugacagguugauaggugcagcagaccaccauggcacauguauaccuauguaacaaaccugcauguucuguacauauaucccagaacuuaaaaaagaguucuggggauuuguugcauggcagugugaauauacuuaccacuguacaccuaaaaauggguaggaugguaaauuuuauguguuucaccacaauaaaauuauguuuuuaauugccaauaaauauguuuuggauuauugagguaugaguuguuaauugaauuaaugccauuuaauuggaagucauugggaagcuuauuuguauuuuauguaauauaaagcucaacgacauaagagucgaaucacaagaucaacucuuaugacccacuucucuuuacagacuucauuacuugggguuuuagguaacagcugaauaacuagaagauggaauuuauuacucauuccccagugacauauaaauaugaguauuuuuauugaauauuuuuaacauuaucaucuuuuaucuacaucuuuuucaacaaugacuacaaagaacuugguuuucauaccgagaaagaaacacauuaggaauuuauaccugaccaagaaaguaauugugaugguuaacaaaacagcuguuacuuuugugcucaguuucuuugaaguauaguuauuauacuuagaaauauaucauagauacaaauucuucucauaaggaugaaggaugaauauuucaugcaguuuaauauguguguguuuuggguucuuguuaacaggguacagagaaagcacuuucaaaacuucacgaguauuucccugaaaugcagauucuagccguuagugguaacuauuguacugacaagaaaccugcugcuauaaauuggauagagggaagaggaaaaucuguuguuugugaagcugucauuccagccaagguugucagagaagugagugacuggauggauaauuuaucuuuuuuauuuuguaaucuuuaauuguauuuaaaaaugggggaaaggaguauuaacauuuuaaauaaaguuaaauauaugggacaguguuuuccaucaaagaugacuguuguaccuugcccaucugucuguguguaucauccauaggaacaaacuuuacugauuuuuuuuaauuuuuuuuauuuuuuaauggaggacagggcuuaaauggggccacaucuaaacuuuguuuucuggagguucagaaagauagauuuggguaacauuccccugaaccuucuggaggaacaucuaaauguacacagcucuguuuuguagguauuaaagacuaccacagaggcuaugauugaggucaacauuaacaagaauuuagugggcucugccauggcugggagcauaggaggcuacaacgcccaugcagcaaacauugucaccgccaucuacauugccuguggacaggugagcucuccagccuccacuucucuuguguuacgucuuucuaagugaaagaaguauauuguauauuuuuucuuuucuuguuuccaggaugcagcacagaauguugguaguucaaacuguauuacuuuaauggaagcaaguggucccacaaaugaagauuuauauaucagcugcaccaugccaucuauagagauaggaacgguggguggugggaccaaccuacuaccucagcaagccuguuugcagguaugauguaucaggcauagaguccacaagccuaguucugacucucuggguuucucuuucuaucugagacuauguaucacucaccucuauuuuaauuggucuuuuccaaacucuuuugucauaucagccuaauccauuguguccaaauaagcauguuuaagcuuaugcuuagauaagaaaguagaugaagagagcaaaugaauguucaucuacugaguuaaggguacugccagucaggcugugaauauuauguuagcuaugguauuaugcacugucagguguggcugucaagucuuggaaaguuagugcuuccaguggagucuaguucuauucugaugccauuacaguugcccuguuuuuaguugauuuaguaagaaauuggucaugauuuuaagggugaaucuuguugugucucucccuggcuacagaugcuagguguucaaggagcaugcaaagauaauccuggggaaaaugcccggcagcuugcccgaauugugugugggaccguaauggcuggggaauugucacuuauggcagcauuggcagcaggacaucuugucaaaagucacaugauucacaacagguaagacucaaagauauauuuaacauguucccccuauacuucaaaaaauaugcaguguaaaaacuuacuauucaucuacuguaguuccaaguuaaaauucuacacuccugauauuuauauauugcuacuuugucauuuucuaccauaggucgaagaucaauuuacaagaccuccaaggagcuugcaccaagaagacagccugaauagcccgacaguucugaacuggaacaugggcauuggguucuaaaggacuaacauaaaaucugugaauuaaaaaagcucaaugcauugucuuguggaggaugaauagaugugaucacugagacagccacuugguuuuuggcucuuucagagaggucucagguucuuuccaugcagacuccucagaucugaacacaguuuagugcuuuacaugcugugcucuuugaagagauuucaacaagaauauuguauguuaaagcaucagagaugguaaucuacagcucaccucugaaggcaaauauaagcugggaaaaaaguuuugaugaaauucuugaaguucauggugaucagugcaauugaccuucucccucacuccugccaguugaaaauggauuuuuaaauuauacuguagcugaugaaacuccugauuuuguaguuaauuuauuaagucugggauguagaacuucaagaaguaagagcuaaguucuaaguucauguuuguaaauuaauacuucauuuggugcuggucuauuuugauuuugggggguaaucagcauuauucuucagaaggggaccuguuuucuucaagggaagaaacacucuuauucccaaacuacagaauaauguguuaaacaugcuaaauaguucuaucaggaaaacaaaucacuguauuuaucuccgcaggcuauuuguucagagaggccuuuuguuuaaauauaaauguuuaaauauaaauguuugucuggauuggcuauaacaugucuuucagcauuaggcuuuuaagaaacacaggguuuuguauucuuuacuaaagauaucagagcucuuaauguugcuuagaugagggugacugucaaguacaagcaagacugggaccuuagaaaucauuguagaaacacaguuuugaaagaaaaauaccaugucucuaagccaacuuuaauugcuuaaaagacauuuuuauuuaguugaaaaaucuaguuuuuuuuguaaacuguaucaaaucuguauauguuguaauaaaacuuaugcuaguuuauuggaaguguucaagaaauaaaaaucaacuuguguacugauaaaauacucuagccugggccagagaagauaauguucuuuaauguuguccaggaaacccuggcuugcuugccgagccuaaugaaagggaaagucagcuuucagagccagugaaggagccacgugaauggcccuagaacugugccuaguuccuguggccaggagguuggugacugaaacauucacacagggcucuuugauggacccacgaacgcucuuagcuuucucagggggucagcagaguuauugaaucuuaauuuuuuuuaauguacaaguuuuguauaaauaauaaagaacuccuuauuuuguauuacaucuaaugcuucaaguguugcucuuggaaagcugaugaugucucuuguagaagauggacucugaaaaacauuccaggaaaccauggcagcauggagagccucuuagugauugugucugcauuguuauuguggaagauuuaccuuuucuguuguacguaaagcuuaaauugcuuuuguugugacuuuuuagccagugacuuuuucugagcuuuucauggaaguggcagugaaaaauauguugaguguucauuuuagugacuguaauuaauaucuugcuggauuaauguuuuguacaauuacuaaauuguauacauuuuguuauagaauacuuuuuucuaguuucaguaaauaaugaaaaggaaguuaauaccaauaaguguaagcaguaaccuuuuuucuuuggauuaacccuagcccugaggucuggaagcuuguaaagucuggucauaguaguaaccuguaauucaugcuaggacucacaugaccauuuauucucaaauucuacaacauugauugauagcaguauucuauuacauuaaaaugagcucucuuagaggguuugauuaguucagauuuaucaucucaacuagacaucuuuuggauagugagagugggagggcuaguuaaggagaagaggggcagccacaaccaaacagccauugcaagcauuuaagcugugugagcugaauuggagaggggaauuuguacagcuugguauagcugaggauggccucuuuagaaauuacugugagucaguaauuuacagaaaauuauugacuacacuuuugcuguaauuagagguaaaa

SEQ ID NO: 17373 - RNA, 3212 nt, Homo sapiens
uuacuuuauucauuaucguauauuuuaacaauguuuauuauucauuuaucccucuauagaaccaccacccacaccgaggagauuauuuggagugggucccaaccuagggccuggacucugaaaucuaacuccccacuucccucauuuugugacuuaggugggggcaugguucagucagaacuggugucuccuauuggaucgugcagaaggaggaccuaggcacacacauaugguggccacacccaggaggguugauuggcaggcuggaagacaaaagucucccaauaaaggcacuuuuaccucaaagagggggugggaguuggucugcugggaauguuguuguugggguggggaggaguuauuucaauggaggaguuauuugcagauugcagagagaaaugagggaaguucgccuacaccgggccaucugcggggucugcaggugaggaaaagagagaaagcauuggcugaaucuauaugcccauuuuuuaaaacaagauccaaaguccaugaacauuuuacacacaagaauaccgaagcuuaugguaccuauugguacaaaagcccuaaguaccaauacgagaccagaguuggcauucgugccuuuaagagaucccuuuccuuuuucccucugcccucucagcaacccccuuacccccaaccaacacacacacacacacuuaccagugggggcugcuguaugucuuggcugccgaacggggaaggugacauaggcaucauagccaaagaggcacguagcgauuaggcccaguaccugggggacaggauaggagugaggggguuuagauuagcuggucagguuacucagucucuuaucuucuuguauccaccaccuccagcaccugccccacgcaggaugggacucaagcaccggguugguaagccagggaaaggccaagagagugcauccuaccccacucucccuccuccuauaccucucaacacagggaggccacacuguggcccuacccguagggggcacaauucaagucauacuuuuuuuuuuuuugagacacaguaucacucugucacccaucugucacuggggcuggagugaguggcaugaucuuggcucacugcaaccuuugucuucuggguucaagugauucuccugccucagccuccugaguagcugggacuauaggcgcccaccaccaugcccggcugauuuuuguauuuuuaguggagaugggguuucgccauguuggccaggcuggucuugaacuccugaccucaagugaucugccugccucggccucagccucccaaagugcugggaauacaggcaugagccacugcgcccggccccaauuucuacuacauuugggacaaaguucuugcagaugguagucuagugcguugacaaaggggccgccuguuuguaccucucaccaagguccuugugucugacaagggacuucccuucacagcaaaugaagaccuugggaggcaaaaccaaguccugggccagacuuuccuccaugucugaggacaagugugacuugcugugggucacacgauuucugccagaagcaaaggcagaaauggucccuggcuccucaaacccuucgcucugugcuucagagcugcucccauggccuuuaccccugcgacgauuuuggagugguuuccucucucaacaaggacaacaauggaggugaucagguagaggauugccgcuaugaggguucggaagaaauccugugagguguagggaggagaagagggaagucagcaaccacaguuccccgacaauccuaacugcccagaccccucccuggucuugccauuguggaccccuucucacacuccagggccaguugaugaaugguaucuuggugugcaggucacacauguagacaacaaagaaaauagcagcaaggaucaucucaaucaccgacagggaggaguagccugguguggaggcacugaagcagaucaggaucaccaggcauaauaucuggaagggugacaugggaaaggggaccucaaucagcaaccagggcugagaagauugguuuaaauugggggucccauacuaagaugccuacgagggcuggggaaaugacauacaauaauagcuaaacacuuuuuaugugcucacuguguuccaaauucaaucaucacgacaaucuaaugcucuggguacuauuauuacucuuucuaauuuauagacgagaaaacugaggcacagagagguuuaauggcuuggccagggucacccaacaaguaaggaguagaguugggugccucaguuuccucuuuucccuucuagguuacgggcagccugaggggaguggcgcugccagguguuuugugagccccgcugacgccagcuuuguggccuugaccggggcggaacacgcgguucccccagcaaccccuuugggaagcggugagagugacaccagagaggcaggacuccguuaaaggcgccgcaccccuuuuacaagugacucaaaggcggcgcccacuuugagaaggguggaaaccccgaaaagcuaaggacaucccgcccggccucugaagggcgaggaagaacuggcgaagggcggggcgcucuacaccgcgggacuagcgcggggcgggggggccccaccccaacaggcccugccccugggcgcgcugccagcccgcccuccugugcccaggccgcgccacgcccugccacaggaggcccccacuucccagcacccugggaccccuucgaugcguccacugaugaguucacgcaggcuguccccacguagcccuccguaugcguuauaggcuccuugcuucaccccggggaccaccagaucucaacaaccuucgucaaaccccaccgacucgcccugcgccccggguuucgggccuccaccgugaacccacccaccugcaccccacugccgagcgccccggccaagugccugccucacccggaccauccaguuccgcaugguccagccaccccaucccgcuuuugcccacgcgccugccccagaacgcucacaaucucagcaaacaggaggauucccuuucgagugcgcgagaaguuggugcaggcggcccagcagccaggagccgagaggcgcucagaauccgccauggcaugggcuggagucccuggugccucggaggaucugcucacuugcucgugguuucgaggacgcuguacacccagcugucuugcccgccgucuggccgggaag

SEQ ID NO: 17374 - RNA, 3212 nt, Homo sapiens
cuucccggccagacggcgggcaagacagcuggguguacagcguccucgaaaccacgagcaagugagcagauccuccgaggcaccagggacuccagcccaugccauggcggauucugagcgccucucggcuccuggcugcugggccgccugcaccaacuucucgcgcacucgaaagggaauccuccuguuugcugagauugugagcguucuggggcaggcgcgugggcaaaagcgggaugggguggcuggaccaugcggaacuggaugguccgggugaggcaggcacuuggccggggcgcucggcaguggggugcagguggguggguucacgguggaggcccgaaacccggggcgcagggcgagucggugggguuugacgaagguuguugagaucuggugguccccggggugaagcaaggagccuauaacgcauacggagggcuacguggggacagccugcgugaacucaucaguggacgcaucgaaggggucccagggugcugggaagugggggccuccuguggcagggcguggcgcggccugggcacaggagggcgggcuggcagcgcgcccaggggcagggccuguugggguggggcccccccgccccgcgcuagucccgcgguguagagcgccccgcccuucgccaguucuuccucgcccuucagaggccgggcgggauguccuuagcuuuucgggguuuccacccuucucaaagugggcgccgccuuugagucacuuguaaaaggggugcggcgccuuuaacggaguccugccucucuggugucacucucaccgcuucccaaagggguugcugggggaaccgcguguuccgccccggucaaggccacaaagcuggcgucagcggggcucacaaaacaccuggcagcgccacuccccucaggcugcccguaaccuagaagggaaaagaggaaacugaggcacccaacucuacuccuuacuuguugggugacccuggccaagccauuaaaccucucugugccucaguuuucucgucuauaaauuagaaagaguaauaauaguacccagagcauuagauugucgugaugauugaauuuggaacacagugagcacauaaaaaguguuuagcuauuauuguaugucauuuccccagcccucguaggcaucuuaguaugggacccccaauuuaaaccaaucuucucagcccugguugcugauugagguccccuuucccaugucacccuuccagauauuaugccuggugauccugaucugcuucagugccuccacaccaggcuacuccucccugucggugauugagaugauccuugcugcuauuuucuuuguugucuacaugugugaccugcacaccaagauaccauucaucaacuggcccuggagugugagaagggguccacaauggcaagaccagggaggggucugggcaguuaggauugucggggaacugugguugcugacuucccucuucuccucccuacaccucacaggauuucuuccgaacccucauagcggcaauccucuaccugaucaccuccauuguuguccuuguugagagaggaaaccacuccaaaaucgucgcagggguaaaggccaugggagcagcucugaagcacagagcgaaggguuugaggagccagggaccauuucugccuuugcuucuggcagaaaucgugugacccacagcaagucacacuuguccucagacauggaggaaagucuggcccaggacuugguuuugccucccaaggucuucauuugcugugaagggaagucccuugucagacacaaggaccuuggugagagguacaaacaggcggccccuuugucaacgcacuagacuaccaucugcaagaacuuugucccaaauguaguagaaauuggggccgggcgcaguggcucaugccuguauucccagcacuuugggaggcugaggccgaggcaggcagaucacuugaggucaggaguucaagaccagccuggccaacauggcgaaaccccaucuccacuaaaaauacaaaaaucagccgggcaugguggugggcgccuauagucccagcuacucaggaggcugaggcaggagaaucacuugaacccagaagacaaagguugcagugagccaagaucaugccacucacuccagccccagugacagaugggugacagagugauacugugucucaaaaaaaaaaaaaguaugacuugaauugugcccccuacggguagggccacaguguggccucccuguguugagagguauaggaggagggagagugggguaggaugcacucucuuggccuuucccuggcuuaccaacccggugcuugagucccauccugcguggggcaggugcuggaggugguggauacaagaagauaagagacugaguaaccugaccagcuaaucuaaacccccucacuccuauccugucccccagguacugggccuaaucgcuacgugccucuuuggcuaugaugccuaugucaccuuccccguucggcagccaagacauacagcagcccccacugguaaguguguguguguguguugguuggggguaaggggguugcugagagggcagagggaaaaaggaaagggaucucuuaaaggcacgaaugccaacucuggucucguauugguacuuagggcuuuuguaccaauagguaccauaagcuucgguauucuuguguguaaaauguucauggacuuuggaucuuguuuuaaaaaaugggcauauagauucagccaaugcuuucucucuuuuccucaccugcagaccccgcagauggcccgguguaggcgaacuucccucauuucucucugcaaucugcaaauaacuccuccauugaaauaacuccuccccaccccaacaacaacauucccagcagaccaacucccacccccucuuugagguaaaagugccuuuauugggagacuuuugucuuccagccugccaaucaacccuccuggguguggccaccauaugugugugccuagguccuccuucugcacgauccaauaggagacaccaguucugacugaaccaugcccccaccuaagucacaaaaugagggaaguggggaguuagauuucagaguccaggcccuagguugggacccacuccaaauaaucuccucgguguggguggugguucuauagagggauaaaugaauaauaaacauuguuaaaauauacgauaaugaauaaaguaa

SEQ ID NO: 17375 - RNA, 486 nt, Homo sapiens
gagguguggcugcccgaggcgguagagcggagaaagccuauuuucuuuucguuuagauacauugccuuuugccuaggcuggcgucgagacuugaggccguugcagacuuuggcgcggcucgcgccuccugcuucaagagcccagcggugagagcuggccugcggcacgcggccuaaugccaggugaguacugcuccgagcugugagacaucgcgcgccugugacccugucacagcgcuggguaccgcugaccuuucaggcugcgacggacacagccagccacggaagaggacaacagggccuccggacuccccucgguguucgcucaguauggaaguuuuucucuaucauucggcgaagucgacucaucuuuguuccggucacucuguguaaugugugcaugauugugaaggauacugaggaaugaaaacuuaguguacagaaaaauggaacuacuggggcuuugcagcuguuagaaaagaagaag

SEQ ID NO: 17376 - RNA, 8210 nt, Homo sapiens
acccccaagaagaaaguguggaaagguuugugggaaauuguuuaaaaaaaaaaaaaaaaagacguuuaggauaaccagguacuuucaaguuccucauuaguuugugagaaguccugaugguuacauuucacugaaacuugaaaaauuaagcagaauacaggagcaaauagcaugaggcguucucuuucuggacuguuuaucuggaaaaacuaaaaaugcuagagaacucaaaauaacaacuuuuaaugucugagcugacuagaauguaauagaauuuuccagaagucaaaaaggaaguaggaguaguaaucugggaaaauaagucagcacuauaggcuagaguuauucuggaagaaucuguaauugucucuaaccuagugcuugagagccauauccucauggaaagaauuaacuaggaaaaguccuuuccacaaaagcagagggcaaggaaacuugcuugucuggcuguaugguaagggaacaagauuucugagaauuuguaaucauaggcuucugauacaggucuuuagccuaaguucauagaaccagugugcccugaaaaacuccagaccaagaagaacuuaguucuuuaguguaaagugcucauggcuugguaguaucccaaggaaccuggaaaaaagggcuucuccaaagauaucaucaacccaggccucagaugccacacauggccaggucugguggcucacgccuguaaucccagcacuuugggaagcugaggugggcagaucacgaagucuggaguucgagaccagccuggccaauauggugaccccguuucuacuaaaaauacaaaaacuagcugggaaugguggcgagugccuauaaucccagcuacucaggaggaugaggcaggagaauugcuugaaucccagaggcgaaguugcagugagcugagaucgugccauuacacuccaacccaggcaacagagugagacgccaucucaaaaaaaaaaaaaaaaaaaaaaaaaagaaacccccacacauaaaagaauauuaacucauaauaaaauuaaaucagaaaaccaugagaaaaagcacaaugagcaaaaaggcaauagaaacaauagguagucauaccagcaaaggcuucaguuauuggaauuaugagauguagaauauaaaauacuaucuuugaagaaauaagagaggcgauagaaaguacaguugacccuugaacaacauggguuuaaaguauguaugcagguacacuuacacauggauuauuguccugccuuugccaucccucagacagcaagccaaaccccuccuuuucuuacuccucaggcuauucagugcaaagaugacgaggauaaagaccuuuaugauguucuacuuuuacuuaauaaauaguaaauauauuuucucuuacgauuuucuugguaacuuuuuuuucuaguuuauuguaaaaauacaauauaaaauacauguaacguguuaauugacuguuuauuuguugguaagucuuccuguuaacaguauucuauaguaguuaaguuucaggggagucaaaauuuaggcauguauuuuuuacugcauggggguuuagcacgccuagcccccacauuauucaagggccacuuguguuaguaaggaacaagaaacgaucaaaaauaggugcgaugggcaugaucucacauauguggaacuuuuaaaagucuaacuuguagaagaguagaaugauggcuaccagaggcugaggauuggaaagcuggggaaaggagagauguugaugaagugggguacggaguuucagcuggacaggagaaauagguucucaugaucuguuacacagcacagugacuauaguuaauaauuuauauuuuaaaucucaguacaaagaaauaaguuuuuugacaugauagauguuaauuugccugauuuuuaucauuccacgauguauacauguauugaaacaucacauaccccauaaauauauacaauuauuuguuaauuaaaaaugaaauaaaacauaagaaaggauaauggaauaucaugcuaugugugagagaggaaauggucaaaaaaugauggugaggggguauauaaggacacaggaaccagcuugaagagacucugcuggccaaaucuggauuaauuugaauaccaaguauagaccauugggaaaaaauaguuucuaaguucauacuuauaauaauacauagguaaauagggaagaagagggaggggucuuccucauaguggaaugccaagugcugacuguuagaaguuggggaguagggcuggagucggaaaauagugcagacgacucucccaaacacauagaacaaaaaaguugccguauacauauggcauaacaaauuuaaaaugaagcagaaguaaacuauugcuuagaaauacaugcauaugugauauaacacuaaagaaaauaaugaggauaacauaugauagugguugcuucagaaggcaucuaaauauugguaauacucucuuuaguaguuuuagguuucaugaaugcucauuuuuagcuuguacauaaauauguauauacucauauauaaacguauauuuauauauaaacauguauauauugagacaaugucuugcucuguugagcaggcuggcauacaauggcaagaucuuagcugacuguagccuugaacuccugggcuccagcaauccucccgccucagucucccaaguagcuaggacuacaggugugcacuaccauacucagcuaauuuuuauuauuuuuuacagagacggagucuugcuauauugcccaggcuagucucaaauuccuggccucaaguaauccucccacuuuggcuucccaaagugcugggugggauuacagguguaagccaccacauccagccuguauaauuuuaaauagaaaauguuucacaguauaaaacguaagcauacaaaggaauuaugaagaauuauagacuauaauucuuaguuuugaauuugggccaugaaucacugcauuacauggucccucacauaaauauggcauaguuuuguuuuaguaaaauauuggagauugguaacagacauaguaaaauauuggagauuguugguuuuuagcaaauaagagaugcuguuuucaaucuuaccaaaaacacuuuacugguuuuuugggaaagaaauuguaaacaguaagugcauaaaauauugcuggaaaaauacacaauauaaaacauuuuguggguugucaggauuuaaagucguuuaauuuucauuagcuuaccuuuuauauuuguaaagguuuuaucauuuaauuuuuuuaauauaaaaguuuguaacuaagaggauuucaaucaccuacaagacauuuugaaaaguuuaaaaguauaaucuucguaacaugugccucaacauaucuuaauguuaaaacaauaggugauacagagcagguuuuuaacauugaucaacacagaagcagaugcuuuguugguagagcucuuuacucugauuuuuauacuguauuuagugccauuguuaauauucucucccacuuuaucuuguaugagacccugagcuuguugaugauaauuuugcuguuuauaguaccuugauaccuuuccagaauuaaucucugaggugccauauucaauuuguuuacagauaccuuagauagaacuuuaggagacaaaaggcaucuugugacuguagaaguggaagcaaggccaauugaaacaucaucuguuaugccugugauugaguuugaguaugcugaaaguaucaaugaaggccuuuugaaggucucccaagaggccauugaaaauggaauucacagcgcaugucuccaagguaagacacucaaaugagaguaagcauuaguaucccacucaaccauuuaaucacuccuuauauuacagauuauuucagucuuuuuccuaacuuuguuaguguuuucucccuauuccuuugcacuucucaguuacuucucacuucacaucuagcagaguaugauacaauuuuuuucccuugucuaggaccauugcuuggauccccaauucaggauguagcaauuacuuuacauucccugacaauucauccuggcaccuccacaacuaugauuucugccugugucucaagaugcgugcaaaagguauagaacuauccuaauccuuauggcuuuaaggugacucuucugaguauaguaccacugaucuugcagacagcuguguuuacagagccuuaucuugugucuuugccuccucagccuuguggucaacaagaguucuuaucauggagaaucucugauuucuuaaucaccagguuuuuauuucaaagaggaucuuagaaauuacuauguaacauggauugcuauuggaauauacucugauaaagaggcaagcuuccuuaagugacauuucugcuuuccccaucccugacagacagcuauuagaggcaagcaugguagguuugaguagaagccagauuugagguuagcuuggcccaaaauggacuguaaucuaaagaacacugaagauccaauauugguuccaguuuuggagauuguuauucaaauaagauugcuuuagugcuugcuucagcagcacauauacuaaaauuggaacgauacagagaagauuagcauggcccugcacaaggaugacaugcaaauucuuauagaguuccauauauuucucuacuuauauuaaauuauaaagauugcuuuaaucaaggaccauugaaaccaguuaagucccacugaauaacagauucaggcuaagcaccuucucuucucaaagcaucaagcaaugggucuucuuggugugguuaucuggggaguuuguccuuaagugucguggacccuccgcuuccugccucaugaaccuaccagaacuggauuaacucccaggagugugguaugcugaaugcugauuccaugcauucuucucagcauugaacuacccuaauuucuuaggugauugcuuuugcauuauuuauacuugguuuuauagccauuuuuuaauacuuggacuguguuugagacccaauuuucuguaguuuuauuugaauccgaaauuacaaaguuaauuuaaguauuccaaaccccuaaccuaagaaagccaaacuugauaucucuucgacaugaguuuaaauuuauacuucuuaaaaagcuuuuugauuaaaaacaaagcuuugaaaaaaguuuaaauauuguucaccuaagaguauguuggaaauguuaccugcaaaguaguuaugacgauauuguugagaaaauucacccucaaguaauuuuuaaauuguuuuuuuuuuuuuuuuaagagacaaggucucacuauguugcccaggcuggucuugaacuccugggcucaagcagucugccaaccucggccucccaaacccaaagugcuaggauuacagguguaagccaccaugcccauccccaaguaauuuuuaaaguuucucuggaaauugguuuuaauauugaaacuaagguaaucugaaaaauaaugcaguuucuaaauugaccccaagcccucaauauauuggccuguccuucaaaauguaauaugccuucuaaaaauaaagucugcauuuccauguucauuugccuuuuuaauaagauuaugccagagaacaagaauuaacuuuaugggggcuuacauuuagucauuaguguuaauucguuacuucaaacaaaacacuccuaauggaaguacugcuacccuuguuaagcuucuucuaauggggaaucuccuucucucugcuuguaagugcuucauguauuuauugagucaucuguguugugcuuauaguucaccaggcacugagaaggacacaaauaggauuauauuuuacucuaccuaaaggagcuugugauuucauaagggaauuaaauauagccaaaguauuagauaaaaugggugaaugccaugaaaguaguaggaagcagggaauuggggaggauucuuggaaagauuuauauuugagcugagaugauuuuggaggacgugagcauggugggggacauuccagacacagauaagaguccuuuuaacuguaguaccagaugaaggcaggggaguuguguguugaaaaaguaaaaugguuucagacuguagagaaaacuuuaaaaacuacauuaaagaguuugaacuuuguucugagaaugguggagcauaauuuaaagguuucgaagagagaaguaucaaaguacagaagggauuugaauagggaagagauaguagaggacaggaaauggacuaaguuugaccuaggaugccagcaauaggaaugggaaaaacaaaaaaaaucuuacagcuuacuuggggaaaaggaagucaaaggugaacugaagacuacugaugucaucaucagaaaaagggaugugcauagaaguguuuggagaagaaaaugaugagcucagugugggacauguuggagagcugccggauauucagacacuaucccaaagcaggccaauggaguacaggacuggagcacucaaacuaugggcugcauaggauuuaacguuuuugaggaagccauguugaagucguuuuugaagcucuccagauagguaauauugacaggaaaagauugugaaaagaggacuaagaacaguucugugagcaugguaugcccuaguuagauaugcagaauucaaucuuuuuuaggauuuuuuucucuuaauuuuuacauccuuuucaauuccauuauuuuauucugaaagacauuuucaguuuccacauucuuuaugcauguucuucuuggccuuugaaaucuaagauucuaaauaagaaaagauuuuacauaauguuucuacuaccuuauugcacuaaauuuuuccuuuuuuuuaagcucuccccuuuauugcugucucuggcauguggcauggcauggacuguaauuauagacaucaggaacagaaacaugagguuuaaauaugaacaaaugaaucuuugaaaggggaggacuuucugugacucugaccacauguucacaggcauuuuuuauaaacauccccuugcaucauaccauacaaaagaucuauaaauucuguuaucaugcuuauuauacaagcaaauauuauaguuguugccaucuuauaaaacguuaucuuuaaagagagaguuaaagcaagcuuaugucuuuuuguaugagcucuaggcuguauuuauuuuaaguuuuuauuuaugaaagauaaguuaacauucuuuaauuucuuuaggcucugaagaaagcugauaagcaaguuuuggagccucugaugaaucuugagguuacaguagcuagagauuaucucagcccuguccuggcagaucuggcacaaagaagaggaaacauucaggaaauucagacucgccaggacaacaaaguuguuauuggauuuguucccuuagcagaaauuaugguagguacuuuguaacugaaaaguacauauucuucuuaauucaggggauauuauaugccaaugaauagacaaucaguaaccugaaagaaacauuaaggcuuugauuuagagaauacauguuaaguuucguuucaaccagcaggaaugguuaggacuuugaauuuaaauuguuggcgaaauccagggauuauagcacuacaaggggguauuuacagucccaaaaugugguaccagccuauaugaccauuuuuucccugccaagcauuuaucuuacuuccaccauugucaguuuuaaggcaaguuaucauucuucucccgucagccucuucugcuccaggacaggcaccuggguugccggcaaagccaucuaacaaauacaucugcagcacacuugcacuacucugcuuucuguccucaauguuuuuauauccaacuuacccugaaaaaaguuaaaucaucuguuuggaggaagugauauggcuaagccacaaaaguggcaacaucacuuuucccuaauagucaaaagauaaucagcaggaagagaaacuugaggcuuaaauuugauaauauaaaugacuuaaauuauuuugauuaggguuauucaacugugcuucgaacgcuaacaucaggcucagcuacuuuugccuuagaacuaucuacuuaucaagccaugaauccucaagaucaaaauacacugcucaaccggagaagugguuugaccuaaauguuuuaguuuuuggagagaaauucaggagcaccuagcuacuucauuuucaguaagaacaauuuuuauugcuuuauuuauuggacgaauaaaguacuguuucaguacauucagagaacuagauaa

SEQ ID NO: 17377 - RNA, 8210 nt, Homo sapiens
uuaucuaguucucugaauguacugaaacaguacuuuauucguccaauaaauaaagcaauaaaaauuguucuuacugaaaaugaaguagcuaggugcuccugaauuucucuccaaaaacuaaaacauuuaggucaaaccacuucuccgguugagcaguguauuuugaucuugaggauucauggcuugauaaguagauaguucuaaggcaaaaguagcugagccugauguuagcguucgaagcacaguugaauaacccuaaucaaaauaauuuaagucauuuauauuaucaaauuuaagccucaaguuucucuuccugcugauuaucuuuugacuauuagggaaaagugauguugccacuuuuguggcuuagccauaucacuuccuccaaacagaugauuuaacuuuuuucaggguaaguuggauauaaaaacauugaggacagaaagcagaguagugcaagugugcugcagauguauuuguuagauggcuuugccggcaacccaggugccuguccuggagcagaagaggcugacgggagaagaaugauaacuugccuuaaaacugacaaugguggaaguaagauaaaugcuuggcagggaaaaaauggucauauaggcugguaccacauuuugggacuguaaauacccccuuguagugcuauaaucccuggauuucgccaacaauuuaaauucaaaguccuaaccauuccugcugguugaaacgaaacuuaacauguauucucuaaaucaaagccuuaauguuucuuucagguuacugauugucuauucauuggcauauaauauccccugaauuaagaagaauauguacuuuucaguuacaaaguaccuaccauaauuucugcuaagggaacaaauccaauaacaacuuuguuguccuggcgagucugaauuuccugaauguuuccucuucuuugugccagaucugccaggacagggcugagauaaucucuagcuacuguaaccucaagauucaucagaggcuccaaaacuugcuuaucagcuuucuucagagccuaaagaaauuaaagaauguuaacuuaucuuucauaaauaaaaacuuaaaauaaauacagccuagagcucauacaaaaagacauaagcuugcuuuaacucucucuuuaaagauaacguuuuauaagauggcaacaacuauaauauuugcuuguauaauaagcaugauaacagaauuuauagaucuuuuguaugguaugaugcaaggggauguuuauaaaaaaugccugugaacauguggucagagucacagaaaguccuccccuuucaaagauucauuuguucauauuuaaaccucauguuucuguuccugaugucuauaauuacaguccaugccaugccacaugccagagacagcaauaaaggggagagcuuaaaaaaaaggaaaaauuuagugcaauaagguaguagaaacauuauguaaaaucuuuucuuauuuagaaucuuagauuucaaaggccaagaagaacaugcauaaagaauguggaaacugaaaaugucuuucagaauaaaauaauggaauugaaaaggauguaaaaauuaagagaaaaaaauccuaaaaaagauugaauucugcauaucuaacuagggcauaccaugcucacagaacuguucuuaguccucuuuucacaaucuuuuccugucaauauuaccuaucuggagagcuucaaaaacgacuucaacauggcuuccucaaaaacguuaaauccuaugcagcccauaguuugagugcuccaguccuguacuccauuggccugcuuugggauagugucugaauauccggcagcucuccaacaugucccacacugagcucaucauuuucuucuccaaacacuucuaugcacaucccuuuuucugaugaugacaucaguagucuucaguucaccuuugacuuccuuuuccccaaguaagcuguaagauuuuuuuuguuuuucccauuccuauugcuggcauccuaggucaaacuuaguccauuuccuguccucuacuaucucuucccuauucaaaucccuucuguacuuugauacuucucucuucgaaaccuuuaaauuaugcuccaccauucucagaacaaaguucaaacucuuuaauguaguuuuuaaaguuuucucuacagucugaaaccauuuuacuuuuucaacacacaacuccccugccuucaucugguacuacaguuaaaaggacucuuaucugugucuggaaugucccccaccaugcucacguccuccaaaaucaucucagcucaaauauaaaucuuuccaagaauccuccccaauucccugcuuccuacuacuuucauggcauucacccauuuuaucuaauacuuuggcuauauuuaauucccuuaugaaaucacaagcuccuuuagguagaguaaaauauaauccuauuuguguccuucucagugccuggugaacuauaagcacaacacagaugacucaauaaauacaugaagcacuuacaagcagagagaaggagauuccccauuagaagaagcuuaacaaggguagcaguacuuccauuaggaguguuuuguuugaaguaacgaauuaacacuaaugacuaaauguaagcccccauaaaguuaauucuuguucucuggcauaaucuuauuaaaaaggcaaaugaacauggaaaugcagacuuuauuuuuagaaggcauauuacauuuugaaggacaggccaauauauugagggcuuggggucaauuuagaaacugcauuauuuuucagauuaccuuaguuucaauauuaaaaccaauuuccagagaaacuuuaaaaauuacuuggggaugggcaugguggcuuacaccuguaauccuagcacuuuggguuugggaggccgagguuggcagacugcuugagcccaggaguucaagaccagccugggcaacauagugagaccuugucucuuaaaaaaaaaaaaaaaacaauuuaaaaauuacuugagggugaauuuucucaacaauaucgucauaacuacuuugcagguaacauuuccaacauacucuuaggugaacaauauuuaaacuuuuuucaaagcuuuguuuuuaaucaaaaagcuuuuuaagaaguauaaauuuaaacucaugucgaagagauaucaaguuuggcuuucuuagguuagggguuuggaauacuuaaauuaacuuuguaauuucggauucaaauaaaacuacagaaaauugggucucaaacacaguccaaguauuaaaaaauggcuauaaaaccaaguauaaauaaugcaaaagcaaucaccuaagaaauuaggguaguucaaugcugagaagaaugcauggaaucagcauucagcauaccacacuccugggaguuaauccaguucugguagguucaugaggcaggaagcggaggguccacgacacuuaaggacaaacuccccagauaaccacaccaagaagacccauugcuugaugcuuugagaagagaaggugcuuagccugaaucuguuauucagugggacuuaacugguuucaaugguccuugauuaaagcaaucuuuauaauuuaauauaaguagagaaauauauggaacucuauaagaauuugcaugucauccuugugcagggccaugcuaaucuucucuguaucguuccaauuuuaguauaugugcugcugaagcaagcacuaaagcaaucuuauuugaauaacaaucuccaaaacuggaaccaauauuggaucuucaguguucuuuagauuacaguccauuuugggccaagcuaaccucaaaucuggcuucuacucaaaccuaccaugcuugccucuaauagcugucugucagggauggggaaagcagaaaugucacuuaaggaagcuugccucuuuaucagaguauauuccaauagcaauccauguuacauaguaauuucuaagauccucuuugaaauaaaaaccuggugauuaagaaaucagagauucuccaugauaagaacucuuguugaccacaaggcugaggaggcaaagacacaagauaaggcucuguaaacacagcugucugcaagaucagugguacuauacucagaagagucaccuuaaagccauaaggauuaggauaguucuauaccuuuugcacgcaucuugagacacaggcagaaaucauaguuguggaggugccaggaugaauugucagggaauguaaaguaauugcuacauccugaauuggggauccaagcaaugguccuagacaagggaaaaaaauuguaucauacucugcuagaugugaagugagaaguaacugagaagugcaaaggaauagggagaaaacacuaacaaaguuaggaaaaagacugaaauaaucuguaauauaaggagugauuaaaugguugagugggauacuaaugcuuacucucauuugagugucuuaccuuggagacaugcgcugugaauuccauuuucaauggccucuugggagaccuucaaaaggccuucauugauacuuucagcauacucaaacucaaucacaggcauaacagaugauguuucaauuggccuugcuuccacuucuacagucacaagaugccuuuugucuccuaaaguucuaucuaagguaucuguaaacaaauugaauauggcaccucagagauuaauucuggaaagguaucaagguacuauaaacagcaaaauuaucaucaacaagcucagggucucauacaagauaaagugggagagaauauuaacaauggcacuaaauacaguauaaaaaucagaguaaagagcucuaccaacaaagcaucugcuucuguguugaucaauguuaaaaaccugcucuguaucaccuauuguuuuaacauuaagauauguugaggcacauguuacgaagauuauacuuuuaaacuuuucaaaaugucuuguaggugauugaaauccucuuaguuacaaacuuuuauauuaaaaaaauuaaaugauaaaaccuuuacaaauauaaaagguaagcuaaugaaaauuaaacgacuuuaaauccugacaacccacaaaauguuuuauauuguguauuuuuccagcaauauuuuaugcacuuacuguuuacaauuucuuucccaaaaaaccaguaaaguguuuuugguaagauugaaaacagcaucucuuauuugcuaaaaaccaacaaucuccaauauuuuacuaugucuguuaccaaucuccaauauuuuacuaaaacaaaacuaugccauauuuaugugagggaccauguaaugcagugauucauggcccaaauucaaaacuaagaauuauagucuauaauucuucauaauuccuuuguaugcuuacguuuuauacugugaaacauuuucuauuuaaaauuauacaggcuggaugugguggcuuacaccuguaaucccacccagcacuuugggaagccaaagugggaggauuacuugaggccaggaauuugagacuagccugggcaauauagcaagacuccgucucuguaaaaaauaauaaaaauuagcugaguaugguagugcacaccuguaguccuagcuacuugggagacugaggcgggaggauugcuggagcccaggaguucaaggcuacagucagcuaagaucuugccauuguaugccagccugcucaacagagcaagacauugucucaauauauacauguuuauauauaaauauacguuuauauaugaguauauacauauuuauguacaagcuaaaaaugagcauucaugaaaccuaaaacuacuaaagagaguauuaccaauauuuagaugccuucugaagcaaccacuaucauauguuauccucauuauuuucuuuaguguuauaucacauaugcauguauuucuaagcaauaguuuacuucugcuucauuuuaaauuuguuaugccauauguauacggcaacuuuuuuguucuauguguuugggagagucgucugcacuauuuuccgacuccagcccuacuccccaacuucuaacagucagcacuuggcauuccacuaugaggaagaccccucccucuucuucccuauuuaccuauguauuauuauaaguaugaacuuagaaacuauuuuuucccaauggucuauacuugguauucaaauuaauccagauuuggccagcagagucucuucaagcugguuccuguguccuuauauacccccucaccaucauuuuuugaccauuuccucucucacacauagcaugauauuccauuauccuuucuuauguuuuauuucauuuuuaauuaacaaauaauuguauauauuuaugggguaugugauguuucaauacauguauacaucguggaaugauaaaaaucaggcaaauuaacaucuaucaugucaaaaaacuuauuucuuuguacugagauuuaaaauauaaauuauuaacuauagucacugugcuguguaacagaucaugagaaccuauuucuccuguccagcugaaacuccguaccccacuucaucaacaucucuccuuuccccagcuuuccaauccucagccucugguagccaucauucuacucuucuacaaguuagacuuuuaaaaguuccacauaugugagaucaugcccaucgcaccuauuuuugaucguuucuuguuccuuacuaacacaaguggcccuugaauaaugugggggcuaggcgugcuaaacccccaugcaguaaaaaauacaugccuaaauuuugacuccccugaaacuuaacuacuauagaauacuguuaacaggaagacuuaccaacaaauaaacagucaauuaacacguuacauguauuuuauauuguauuuuuacaauaaacuagaaaaaaaaguuaccaagaaaaucguaagagaaaauauauuuacuauuuauuaaguaaaaguagaacaucauaaaggucuuuauccucgucaucuuugcacugaauagccugaggaguaagaaaaggagggguuuggcuugcugucugagggauggcaaaggcaggacaauaauccauguguaaguguaccugcauacauacuuuaaacccauguuguucaagggucaacuguacuuucuaucgccucucuuauuucuucaaagauaguauuuuauauucuacaucucauaauuccaauaacugaagccuuugcugguaugacuaccuauuguuucuauugccuuuuugcucauugugcuuuuucucaugguuuucugauuuaauuuuauuaugaguuaauauucuuuuauguguggggguuucuuuuuuuuuuuuuuuuuuuuuuuuuugagauggcgucucacucuguugccuggguuggaguguaauggcacgaucucagcucacugcaacuucgccucugggauucaagcaauucuccugccucauccuccugaguagcugggauuauaggcacucgccaccauucccagcuaguuuuuguauuuuuaguagaaacggggucaccauauuggccaggcuggucucgaacuccagacuucgugaucugcccaccucagcuucccaaagugcugggauuacaggcgugagccaccagaccuggccauguguggcaucugaggccuggguugaugauaucuuuggagaagcccuuuuuuccagguuccuugggauacuaccaagccaugagcacuuuacacuaaagaacuaaguucuucuuggucuggaguuuuucagggcacacugguucuaugaacuuaggcuaaagaccuguaucagaagccuaugauuacaaauucucagaaaucuuguucccuuaccauacagccagacaagcaaguuuccuugcccucugcuuuuguggaaaggacuuuuccuaguuaauucuuuccaugaggauauggcucucaagcacuagguuagagacaauuacagauucuuccagaauaacucuagccuauagugcugacuuauuuucccagauuacuacuccuacuuccuuuuugacuucuggaaaauucuauuacauucuagucagcucagacauuaaaaguuguuauuuugaguucucuagcauuuuuaguuuuuccagauaaacaguccagaaagagaacgccucaugcuauuugcuccuguauucugcuuaauuuuucaaguuucagugaaauguaaccaucaggacuucucacaaacuaaugaggaacuugaaaguaccugguuauccuaaacgucuuuuuuuuuuuuuuuuuaaacaauuucccacaaaccuuuccacacuuucuucuugggggu

SEQ ID NO: 17378 - RNA, 6178 nt, Homo sapiens
cagauuaauagaagacauuguuucuguuuagcuuuucacuccugggauuuaugauguaauuggagacaugagacacuuagaggaaacaguucacaaugcaaggcaugaugugaucacaggaucgcaggaucagcgugcuggcucccgaaagcguuucugacccuaacagcaccugagaaccacugagggugcuuugaaaacagaccacugccugggcccuuucccuagaccaguuaaacagaauuucugaaacuugaauuaauuggugaaccccucugugccuccauuuccucaucugcaaaauuagggcaauacuuuaccucaaaucuauugcugugaaaauaaaaagagugaaugcacguaaaugcuuguaauagugccugccacacaauaaacacucaauaaaugugagcucucauuggugaauaaauauucaaacaugaauaccuaguagacucugcugaagcuuuucagaauguugaugccuauucacuuggaaaacucuaagaacgacuuucucugcuguccuuguugugugaaggcuauggcaguuuuagagugcuugaaacuagcgcuccuuguugggcagcauaggaggacuagguccuucaguuauuuacuuaaguuggugcacacaauuuagagacauuuuaaaggaauauugcagucaacagcuccacaaauaaugcugcagaaacacaaagaugagcuggcugggccaguggaggaaaggcaaauggguucucugguagauucaggaggaaaagugaucccagagcaugaagguuuaggauauuaaagauaacgggccuuugcuaagugcuaggccuucuccaaugggcuauacaugcaugauuuuauuuaauucuuacaccaaauggaugguggcuauuauccauucccacauuacagauaagggaugaaggcccagagggguuaaguaacuugccugaaggugguagagaaaugauuuaaauccaggcugucuccagaucugcucucuuaaccacagcaucacagccucuggacccacauggaagacccuguggcugaaucugcaggugggucaccucagauucauccuucauccuuuccucuuuaacuauuuuucuucuguuuugaucaccuccucuugaagagugagggauucccauccuagggaugcaggcauggcugaaugaaacaugauaccugacacuggacagaugguaugaacggugguuuauugguacauaugucugcucaaagccccgggaggaggacaccucaugccgugcaaggccacauggcugcugcgcuuggaaacggagggaacaagcagagagaggcaagcuuuguagcaucaggagaguggugugcccccugguuugugagggagaauguauuuaccuuguuugaauaauuccuuggucuggcagggaacugaagccacugcucagggguaagcaggaacugugucuggcugcugcuuuuuuuuuuuuuuuuuuugagauggagucuugcucuuaucacccaggcuggagugcaauggcacgaucucagcucacugcaaccucugccucccggguucaagugauucuccugccucagccucccaaguagcugggacuacaggugcccaccaguacgccuggcuaauuuuuguauuuuugguagagaugggguuuugccauguuggcuaggcugaucucgaacuccugaccuugugaucugccugccucagccucccaaagugcuggauuacaggugugagccaccacgccuggucucugucucucucucuuuuuuuuuuuuagagaugaugucacccaggcuggagugcagugguacaaucauagcucauagcucacugcagccuugaacuccugggcucaagugauccuaccaucucaaccuccugaguagcugggacuacaggugcaagccaccgugcccagcccuauuugaccucugauaaagaguguuguuuggcuagaaaaccuuauccucagaagcagagugaggaggggaacuugcaucuaggccauuuggggccugccauacuuugccagaugucaagacagcacguaauauuggguguugacuuuaggucuuauaucacaccuucuucuuuugucuucauccuuucccccacuuccugugcuuuccuuuugucuccucucauucuuaggcaauggguuuaaggucaaagacacaggccugggcucagauucuugcccuaucacugaccagcugugcaguuauaggugagguucucaagaucucuuggcuucugccuucuuauuccuagaaaucagaaaauauaagucucuuuaaaaugcaucuguuuugagaucuaaaugaaagccugaaaagccuuuuaucacagugaaaagugcucaauaaaugucagccaugcucauuuaaauggccuaacucugguagugacauuuggggccaaaggauagcucuugauggcugggucugaaagcccguuucaggaugagguagugucagcucuguuaagguaacaggauugggccugagcuguuagaaacuuggccucaauaagacucuagcugagguaucuuuucuuucucaagaaucucaagggcuuaggccagcacagccugugcacucaugcuuuuaaaaaaaccaaaaacccaaaaccaaacagaaaaaugcagcaacaauagcugcuugggcccacaugucacucuauuaucucccaccguuggccugugccaguacaaucaauuguuccacggucccauuugguaacuuggaaacuguuugcgcugaggaucuaugauaagcacuuuggcuggaacuaacgucccuuuggaggugaggagggagaaaaggaaagcaagaugaccuggcuggggacaggcaauucucuaaaugcuggccuaaagggacugaguucuugaaagcaggugacuagaaagagaauauuguucuacuuccuucuuuuuucuuuauucucugggcucacauuucuaagaucuuuaauuuucaaaacuuaaacaagaaaguguauuaaucuuaaaugucucccauuaaucaucaaguccagcccagcgacgagagauagaugacucacuuccacaggugauuucuugguaauggugggucaagguuugccccuccauuuccccuacugucucacuaauggagaaagcguccccuuaggaaguaccugucuuggagcaauuugucaagggaaaauugcaggugggaauagccacugacaagaaaauauuucucuuagggaaacaaggugaguagcauagcauggugauuauaagcauaggcccuaccuuugagaguuguuguaggauuaaauuacagaauuaaauaaagcacauaauucagugugugacauaguaaguaggucugcgauaaauagugaauauuuacuacaccccuuuacaugccagacacuguacugaggacuuuugccaucauuugagccacaucauauuucauugacugagcuauuauuucccucugguuuacagacggggaaaccaagaugcuacgugacuugcucaagaucacacagguaguaagagacagaaccaggauuuguacccauguaaucugacucugaagugcauguuccaaucacuacacaugcugcucucggugaacagugacucuuacuaugaaacaggaggcaaaaugagcuugcugccaugaggauagagcccaggauguuguccuguguguuguagagugauguauccucuucuaccucaacgaccacuagguuccuguaggcaaauuaggagugauugagccaugaggaauaaauccagccacuccacugcuuuugcugacugauacucaaguucuuuuguagaaacuugaaauuccacaauaucaguagggaagaauaagagguuacuuuuaguuccccaggcagugugccaaagguugagaugcucuuuaaaaaauuuuaaagaguugcccuuucugaccgugacaaaucucaucccauaaaugucagauaaguugcucugccacacagcagguggucuguccccaacucccuguuagugcugggcccuggcaaagucaggagguugugcgguggguucuacagagggcccuguccagacauggaugcccuggggcuugggagagggcuuccagaauguggggcaggagguagugcugaaggacagcuucaaauucugggaauacuuggaagagugaaaaggcaagucuauuuucauaugguugaagacagcccuacccucuaagaccauuugcagaugugagucuagcaguuucuaugaaaugucuuuguccccaacuggcagaaucuagaaaaaccucgugggguuggaaugacccaauuugcugacuccaaagccaggcuuuggucaucaugcaggcaauucugucuucaugcgguugcaugcaggugaggcuggagcagacagcauguucuggaacaccuuaaugaugucaggacgcuuuucauugcucaucuaucacguaacagcucagauuugcaaugugcuaccugcguucucccuuuagcacagacaaugcguucuuucaacagugugcggcuccaugggaaaggcucugcugaaagugaaguggugggguccacagcugccccucugggaaggagugguaugggggcagguggggaccagaugccuggccacagccgagcuggggaugagcacauggaacaaccgcuucugguuacacuuacucguuucucugugcugaaaggugucauauaaaugcuaagaacagagagagauggggccuauuuauuugcauuuugucuaaugugagcagaugcagauagaaaagaggcuuagccacagccguucaccugccccgcuaggccuuccaucuucaguucauuucaaugccucccgcgucaguuccgcuccagugcugcagcagacauggcauggggugcaaaaggggcacaugcccucugucuucaguggguuugcaaaacuugugaaagagacagguuuaaccacaggaaccaucugaggacaauacaacccagcauauggcucagugguaagucauggggaacaauugaaaugcuggaggagguuguggaagagaggaccacgcguggaugggcaggaaggcuucuuaggggaaaugaacuggacuugcccugugaagcuggccagcagguaggugggcaaagauggugagcaucgauugucuacgcccuuugccagacccucacaucugcuauucuacugacauacuccccuccucucuuucagugguugggucucccuuaucaauuaggacuuggcuuaaaagacuuccacgaggcuuuccucaacuguucuaaguagcagugcucugcacugcauuauucucuaucacaguauucuguuuuuuccucccucaauguaauacaauguauaauuagauguuugcuuguuucagucuuccccauugcauuucagccaccacacagucaggggccauaugucugcuucauucacuuuuauauucacagacaugcacaaugccuggagccuaagaggugcucaguaaauacuugcugaaugaaugagugaccuuugaggaaagccucauuagcaaauauauuucuuggccaguugaauccaagcucuuguuuuauauuccagaaagaaaaccugcagauuccauugaucuggcauggagcuggaugucuuucaggaugaagaguuuucauuaaaacacagccacaacaaagcaagaaaaaagagcaauugauguaagcaugccagucagguucacauguuaagaaacagaauaaggccgggcgcgguggcucacgccuguaaucccagcacuuugggaggccgaggcgggcagaucacgaggucaggagaucgagaccaucccggcuaaaacggugaaaccccgucucuacuaaaaauacaaaaaauuagccgggcgugguggugggcgccuguagucccagcuacuugggaggcugaggcaggagaauggcgugaacccgggaggcggagcuugcagugagccgagauugcgccacugcacuccagccugggcgacagagcgagacuccgucucaaaaaaaaaaaaaaacaaaaaaaaaaaaacagaauaaaaagaaauaaaaauugauaaacaauuguaaaucauaccaaggcccugcauaaauaugacuugcuauuaugca

SEQ ID NO: 17379 - RNA, 3639 nt, Homo sapiens
gacaagacaggcaauaaaaaaacagcuaaaauguagacuacgucaaauggcaauaaaugcuauggaaaaaaugaaagcagagaaggcagauagggagagccaagguggaagugggaauggacagggaaggcuuugcugagaugacgauauucaaaugaggaccugaaggaagggagggaguaugcuaugaggcuacuggggaugaucuuucaggaagaggugcagcaagugcagaggcccuguggcaggagccuggcaugcagagaaacaguauaaagcccaguguggcugugcuguggugaacaagcaggagaguaggaggaagaggucagaggcagcaggacaccagguuguacaggccucauaggaccugccaucaucgguuuguaggacuucuucucugcagcuggcccuucucuuagcacauauauccauagcucaccauccuagaggcuuagcuccucuucugagccauuguugucuucucuggccaccaccauugcugaagcccucgcuggcaaccagagcacucauuaucuccuaggucuuccuguacugcuacaaugguugauuuaugugucaguuucauugggcuaagggaugcccagauaacugguaaaacauauuucugagugugucugugagaguguuucuggaagagauuagcuuuugaaucaguagacuaaguacagaagaucugccaucaccaguuuggacaggcacccucuaauccacugguggccugaauagaauagaaaggcagaggaagggaaaauucucuccucucuucuugagcuggggcaucugucuuuacugcccccagacaucagaguuccugguucuuuggucuuuggacuccaggacuuaaacuagcagcuuuccuggcucucuagcuuauagacaguauaucaugacacuuucucugcuuguguaaucacgugagccaauucccguaauagaucuccuuguauagaucuacauauuuucuauugguucuguuucucuggaggacccuaauaaaaccacuaugucaaauugcauaauuuccuguguauguaugucuucacuuuccaucaagauucuugcucaguugggguaaagccauguguagccuuuuuccuuauuuccuacaacaguuggcacaguguuaggcacucagcaaacacaaggaaaaugccugcugcauagaaacuucaacucuacaguuaaggcuucaagaacuuuauuaguucuuucuccuuuugucugagucugagggagaauacuguuagagauagucuaaucuugucuacuaaucaauauucuucuuuuaaguacaaugaucuaauacaagaaauguuucgaccccaaaccccaggguuagaguuucaaaguuugcuacauuugcccuacuuuauuuauacuuggaaaauagugcaaguuuuaaaaauaauucugaauuugcucuuugcuuaaaauaaaaaauagauuauuuuuucuuuuuuaaccuuauaagcagcuuucacauauaucaggugaaaccacgaagauacaauauucuaaaauucuuagaugcugacucuuaguuuagcgcaagaaugggcaacuuuucugaaaggggugccguacuauguacuuagaucuguggagcuuccugaagguaggcacgucacuguguuccuguggguuucccauugucuagaaaccaggggaccggggucaauaaaugcugcuguguaaaaacuaucaucauccccauugcaccgaugagaaaguuauaauucaaggagguuguaauuugcugaaggucacacagaaaguuaguggcaaaucugggacuaaaauucuuuuuuuucugacaaaguugguucgagucagggcucacagauuuguugguagcaaucagcauuuuggaaugcauaauaggagauacaggggcuauuuucuauuuuguaaacuugacguacaacuucugaggggacaaaugaggcagcuucuuggauuccuaucugguggaagcaggaagaugugaggauucugagcagagagcaggagagcggauccaggaucagagcuggcaccuggagagcacguuaauggcagcuaaagaaggagccuaggaagaagauggugacaggggcacuugcuauuuucuucuguuaucaguugucucauauuuccuuccaugagugcugugguuuacaaguauuuggaugaacccuguuagauggugggauaauaucuggauacaaauaaaguauuuugcuaccagguaugguggcacacaccuguagucccagcuacucagaaggccaagguaggaggaucacuuggggccaagaguucaaaaccagccaggcaacauagcaagacuccaucucuaguaaaauuuuuuaaaaauaaauaagacauuguggcacaccucuagucccagccacuugggaggcuaaggugggaggaucacuugagcccuggaguucugggcuguagaaagcucugcugaugggauguccacacuaaguuuggcaucaauauggugacuuucugggagcagaggaccacuagguugccuaaaaaggggugaacgaaccugcccagaucagaaauggagcagauuaaauaagccauuuugguagaaacacaagugauuucugguuacuaggcacuaacuaggagagcagagaaacuguaagagacaugagcaaggagaaauguuccaaaaacucugaauccuggagagaaaaaucuguaaacuggucuuuaacugaagauggauaggugauuuggggaggaggaaguuaucaucuuggcagggcuuccuucuuucucaggaauggugaaugggaagaugagggucuaaugucagcaaggugggauaagccugacacuuccagcucccaccuucucaaaccaaugccucaucuuuugcuguguccucuuggguagaugugaggaaggccacugaucuggagagcugaauucuagcccuaacacugacacucuguauauggccuuagaugagcuuccuaccucucuugccauccauuguguaaaaggagguuccuuaacaaaugaucucuaaaauuuuucagcugaacacuuuaugauuuucugacauacuucccucaggucaccaauauugguuugcugaagauagaguuuaauagagaagaguagggaaggaugggucauuuuggaaaaguuggcugggagccuaaggagugggucuuugugcagcguuggcaucugucugagauagcauagguuuggucaaguaauuccuuuggcaucucuuucuuuagaucuaguaccacuggggaaagaaauauggaaaggagauccaggccaugcugugaaaugaaguucucuucacuuuuuuggcuacuaacugaaaacuacauccagguaccauuuagcuguacuugcacagcugacucaggccuccaacucacacauuccuguccagugcacaguuucccaaccuaucauucccauuucaaggauaagugaucuacauacuuggcugaaguuauuuucaccaagcuuacaaauagugcccacccuuuuacccagaaaccacaaucaaaccaaagcaaaccagaaggaucgaaaggcaaacauacugguggaaaaaguagugaugcccuccuuaaauagccu

SEQ ID NO: 17380 - RNA, 573 nt, Homo sapiens
uuuuauuuuuuuuauuuuuuauuuuuuucauagguauauaaacuauuuauuaacagacaaggccuacagacuuauuucuucuuggacacacccacggugcggccacggcggccaguggucuuggugugcuggccucggacacgaaggccccagaagugacgcagcccucuaugggcccgaaucuucuucagucgcuccaggucuucacggagcuuguuguccagaccauuggcuaggaccuggcuauauuuuccauccuuuacauccuucugucuguucaagaaccagucugggaucuuguacuggcguggauucugcauaacggugaucacacguuccaccucaucaucagugaguucucccgcccucuuggugaggucagugucugcuuuccucaacaccacaugagcauaucuucggcccacacccuuaauggcagugauggcaaaggcuauuuuccgcugcccaucgauguugguguugaguacucgcaaaauaugcuggaacuuuucagggaucacuagcgacauggcggcagcacaagcggcggcguguaggccuccuguggaggag

SEQ ID NO: 17381 - RNA, 2543 nt, Homo sapiens
augucucaguguucagguuuaaaucaucucuuaaaacugaaauuuaggugauaaaauuaucacugaaccacgucccuccaucuuccauaaggcaauuucuucuaggguuacaggguuuuaaguugugggauguuuucagcacugcuuggaguuaaaacacaauuuuauuugacagcuugaaaaauauuucauauaguucaaauauucuucaaagaagucuguggaaugaaugaauauuaggaaaggcuggggcaguggggcaagggaagaaggaaguaaagucuccacagaugcccuaggauaucugaaaaaaugagugggacaggguagcacagcccuugagagguagaaggaguugccugagagaaggagaagccuucugagaaaagaagccagguacagcccguggcagcugaagaaaaguccuagccgucaagagggaagaacaauucuaggcacagcccugagcauugcuccuaguggaggcccuacuggacucagugugggagaacaaugugaccaggaaauaaaaaugaagaaguuuuucuccucaacucuggaaaauaaagggacucaggcaguccugcugugagagcacuccaacccagugggacacagaaugaagcacaagacaauaugcggugccacuaagcaugcuugugggguagagggcgugaccuggcaggggaaaaugaaggugcccaguaggagguggcagagugguaacacccauugacacagaccaaaauauugaaggagcacuuaacagagcccuuccuggacaagugggaacaagaggugguggaauuggaguaaacuacuguuuauguacccuuaggcuuggaaggacuggggagaucugaguuacacagguagcuccaagcuccugccucuagugcccuauuccauucugcgcucucccuugggaaagagcucucacccaagcugacucuauuuaucagaaucacacacacacucaaagcuuaugaauauacagauuauaaauggauucaaaccaaaagcucuuugagggcauuguguuaacagugcccuuaacaaugggaaaagaucauaucugcguagagauguuguguuuaaacccacuguuacacacaucucauuuggucuacauaacaagucagugagguaagcauggagugugaaagccugaaguaaaaccaaauguaaguacagccagguaguugaaaaucccuuuguuugugggucucaagcucccacuaacaacuaccagcuucuuagcagagccaggucucacuccuccugugagccagacugacguggugaugugagaucuuaucaguucugaaagggaaagaaguuaaauucucguggccuucuggagaggaucaaguguuuugccuucuaccuagagagucgauucuucuugacaaggggaugaacucaugagcucauguaaggaaccaguccuuacagacucgguguguuuugaauuguguuugugagguuuguuuuaauaugugucuaccugccacggugacauaugccagugccugugugcugaggcagcccuuuuaagaaccuucccccugaaaagggccuuaaaauguggcagcuagccuuuggccuuacguugaagacacaccucacuguaugccucuaguccugccuccaaucaacugucgccuaacuuuuucauagggauggcagggaaaccucggaagaauaucauccuuaacacucugcgccuaaaucuuuccugaagugagauggguugaauuccacaauaucccuuccucacacauuaauucuguaaugcaauggagcugagucuucuccaugagacuucccaggaaaggucccuuugagcaaaaauugagaugcugaaaaccucaggaagccuggagauugacuuaccuaucuguuguagucaccagaauuucuccuccuacugcaaccacauuuauuaaaugccuuucagugacaaugggcuaugauagggacccauuuugugguuuuggagcucuaguugugacuuccauucacaggcuuggcugcaucucucauccaucucauccauuuacucaguacccauuucuuuuuuugagacagucuugcucugucacccaggcuggagugcaauggcguggucuuggcucacugcaaccuccaacucccggguucaagcaauucuccugccucagccucccgaguagcugggauuagagguggcugccaccagcuaauuuuuuguauuuuuaguagagacgggguuuugccaucuuggccagguucgucucgaacuccugaccucaggugauccacccaccuugggcucccaaagugcuaggauuacaggcaugaacacccggccucaguacccauuucuuugaguaacugugucucaugcaccaacuacuacuaacuaaauacuaauauuuaaugugugucaaauggcagcuacugugcuaaacaucuuacauacgacaucuccaacccuucucaacaaccuacaaggcaguuacuauuaauaucccccguuuuacaggugagaaaacaggcug

SEQ ID NO: 17382 - RNA, 13838 nt, Homo sapiens
gcgcagaggcgggucaggugggcggggcgaucuggaguaggaggugugaccggagggcgaaauuggggcuuccucugcucuggugacccagaaccgucaacugaaaugacccugucuguguaguacuccggcaggaugggccucggagcguaaaggcggcaaaaacaaaaauauuaaaaaaaaggagagagggacaaaaaaaagaaaacccgaaaguuucagcugcauugcugcggaacguuuuuuagccagaaggcgaaagaagaaaucggaagugacgucgcggccaaaacaagcccgggcuuggaggccuguacugaagcuggccucagaugggaaggcccgacucgcugucugcugucgucgguggucgcgagaccuugcacucucaccgggucggccuccagccccugugcccgggauccgcucgccgcggaugagcgagaguuucuuccugggacuuuucgggcacagcuggccgguggcgacagaacggacuuucuuuccugcaagagucuccccuccagcgggagacagcgggcuccugucucgggacgcugggacaccugucgccugugaggcaucauuuauuuucauagcaccuuccucuccuuguagaauaauuccaggaucaggaagaaacgaggggcuccuguuauuagcauccacaggaacuagcauagcugcccacuuuaucuccguagacucucuaucccuucaucccugggcucugacagaucgaggugaaccuagcuaucgauugccuuacccccuuuuucucaccaccaccucuucuaaguccuguuaccccacuccccucacccccgccucccucuccuguucuucaaaauuuuggccuaccaaucaacuuugcuucuccucucguuaaacugcugugccaagauaagcguucauuuuccacccacccccuucgccuaagcacauuugcuauucuccucucgaagaccuguaauuccaucuauaaacccugauuuguaacauggaagcuguuuagagcuggaaagaauauuagaaaggccuauuucaacaccuuuuuauaauagaugaauuucagaaaacuuguauuauuuauuuguccaggaguggccagcuaguuaguagcgauguugggaguggaaagccaggucuaaucagcaaauguuagaaauagaaaagaauauggaaaaaauuguuaaaguuaagaucagaaaacauuuauggagcaccugguaggaccaaguacuguucugugugcaaaaauuaguaagagugguccccauccuaggggaguuuucaauuuagcuguuauuuaaauggaaauugucaaaaggauggugaaugcuaaaauacagauacaugcagggugcucagagagcuuaggggaguugcacuuagccaaccgcuggauaggagaaagggggagaugguucuucccucaggaaacacaguucacauuguccagucccuuuuaagacgcauggacuaaugcauugcacauccaucucccuuugaaucacugaacuaauuuucuuuucugguuuccuucuuuuugcccaaauguauuaaccuucuuacuuccugcuuuuuuuuuuuuuccuuacuauacuauguguuauuuauucaacucucucguggagauuuuggcuuuguuuagggcugccucauuuuaauggucagagugauggagucagaagagcugaguaagcccucauaauucaugagcuuccuuuuuuaccccuccuagguggacauaugauuaccugaccugccuacucaaaggauuguuauaaagacuaaucuuugaaaauguuuuuaaaauuguagaaggugguuaucuguaaauguaugguuucgcgacccuugcuccacugcgauccuaaugcauuuuucuuuuaauuccaauuccaauuuugaaacacccugcacccucucaaaauuccuaagaggcaauuaacccuaacaugaaaaaauuaacuggauguuauuaauuuccuuucugucccaaaugauaauguaucuaagacaacuauacaucuuggaaagccaauccauaaucuaccuacuuuauuuuucaugaaaaccuacauuaaguugcuaaugcuuaaucggaacaaaaauucauaaauguaccuucaguucaucaaaaccaaagcuuuguaaagccuuucauggucuaggaaucacagguguuauagaugacaaugccaauaaacuuggauacaacaugaauuaucauuucuuaaauucaaacuaagggccaccuauauaaacauagcauauuaaagaacuaaccuuagguaagagauuaaaguuuauuuucauuguuagccugaucuuuuauccauuuggugauauucagauauaggaaaugggagaaacaguaacuaaaauguauuggaauuuaaugauggaggugagaauaucacuguacaguauuucauuuggucuuuaccagaacccuauaagguuaauggugauaucccuauuuuauaaaugacacggaagcucagagggauugaguaacuucuacaggucacacagcuaauuaauggcaaaguuuggauucauacccagguuucucuaccucugaacauuauauucuuucuauuauguguaggugcuuucaagagcauuguuacaauacuugauugaaaaugauuauuuuguguguuuuuaccuaagcugauagaauacuuuuaauuuucuaauuuuuucuuucagauuuuuaaauauccagauuccaagaacacacuggauacugcucuuacaaaaccaagaggaaaucaugaagaaauguuuuaguuauugaaacuacaguugaaaucauggauacaucaacaaaucuggauauuggagcccagcuuaucguggaagagugucccagcacuuauagccuaacuggcaugccagacauuaaaauagaacauccacuggacccaaauucagaagaagggucagcucaggguguugccaugggaaugaaauucauauugccuaaccgauuugauaugaauguguguucucgauuugugaaguccuuaaaugaagaagauaguaaaaauauucaagaucagguuaacucugaccuggagguggcaucuguccuauuuaaagguugaaaguuaugguauaaauaucugcauuuguuuuuguuuuuguauauuuggguuauuuucccaaucaugagauuuugaguuugggaagacaguuuagaagucauuuuuuaauaugauuuucuggaaucucauagaaaccaaaauuaaaauaauuucagauuauauaauaucuaauuuaaaggaaguacauguugauuuuuuuaaaaacuucuuguuuaauauuuguuuacaaauucccuaaugaaguucccuauuauuccuuuuaaaaucauagggccaggcacaguggcucaugccuguaaucccagcacuuugggaggccgagguggacagaucacuugaggucaggaguucaagaccagccuggccaacaugaugagaccucgucucuacuaaaaauacaaaaauuagccggguaugguggcguccaccuguaaucccagcuacuugggaggcugagguacaagaauugcuugaaccacagaggcugugguugcagugagcuaagacugugccacuguacuccagccugggugacagagugagacucugucucaaaaaauaaaaucauaagaaaaaaaaucauguuccuuuuagagaugaauuagcguaauauccauuccugaauauuccuguucuaugaauauuuaauaugcauuuacuuucugugcuuuaaugcagugaagucugucaucaugcucuagauuugcuuuuauaaugauacccugaauaauaaaacuauucucuuaggauaacaucacccaagauuaauauauuuucuuccagaacuuucacuaugguuauguagacuuuuuuuuuucuuugagccagagccucucucugucacccaggcuggagugcaguggcgagaucuuggcucacugcaaccuccgccuucuggguucaagcaauucuccugccucagccucccgaguagcugggauuacaggcguuugccaccaagcccggcuaauuuuuuguauuuuuaguagagaugggguuucaccauguuggccaggcuggucuugaacuccugaccucaggugauccaccugccuuggccucccaaagugcugggguuacaggcgugagcaccaugcccagccuagacuuuuuuuuuuuuugacuaaccauuaugcaaacaaggaaguauggacuuuaaugauaaaaacaauuuaguaucacuugauaaauaguuuaauugaagcuauuacaccucauguauuucuuuucaaauguagacauugacauagaacucuuacugaaaugcuuuuaauguguuuacauuuguuuuucacuuagcugaaugcaauauccauacaucuccuucuccgggaauucaaguaaggcaugucuacacccccucuacaacaaagcauuucucacccauaaaacagucaaccacuuuaaccaacaaacacagaggaaaugaggucucuaccacaccucuguuagcaaauuguaaguauuugccacugauguauuacuauauucuuaauguaauacuuucaagaguuugacuuuaaaacauuauuucauuaaaugcauauuuucuggauaaagaaaauguguuauacuacacaauggaauacuauucaaccuuaaaaaagaaggaaauucugucacuuggugacacauggaugaaccugcaggacauuaugcuaagugaaauaagucaggcauagaaagacaaauaccacacgaucucacuauaugagacaucuguaaaaguagaacucaguggaaguacacaguggacugguguuuaccagaggcugggagaggggaguagaugcugaaaagguagagauacugaucaaaggauacaaaguuuuagcuagacaggaggacuacuuaaugaccuguuguacacaauggugacuauaauaaauauaaugcacugaaggcugggcaugguggcucacaccuguaaucccaacacuuugggaguccgaggcuggugugucacuugagcucaggaauucgagacuggccagggcaacauagcaagacccugucucuacuaaaaaugcaaaaaauaaaaaauaaaaaaauuucaaaaaauagccaggcgugguggugcaugccuguguucccaacuacuugggaggcugaggugagaggaucacuugaaucugggaggagcagguugcaaugagcugaaauagcaccauugcacuccagccugggugacagagugagacccugucucaaaaaaauaaaaauaaaaaauaauaaugcauuguauuuuucaaaauugcuaaaagaguaaauuuuaaauguuuacaccacgaaaaaauaaguaugugaggugauagauuugugaauuggcuuuaaucauuccauaauguaaacauauauuaaaauaccccuuuguacuccauagauauacacaauuauuauuugucaauuaaaaauaaauaaaugcauuauacguaacuuuuuugaaagcuuaagugauguccuaguaguuuuagcaguuguaaacuuuuucauauauucuugcauuuuuaaauauuucauguggggcuagacacggcgugucacaccuguaaucccagcacuuugggaugcugagguaggaggauuacuugaguucaggaguucaagaccagccugagcaacauaacaagaucccaucucuaccaaaaaaaauuuuuuuuaauuagcuaggugugguggcaaacaccuguagucccacauacucaagaagcuaaggcaggaggaucacuugagcccaggaggucaaggcugcagugagcugugaucaugccacuguaccccagccugagcaacagagugagaccaugauuccaaucaaucaauaauaaauaaauaguucauguguuauauuucucuguugagagcaaauacagauuaaaauauuaauuaugaaaacuuaaaaguuuuacuguaaaaauagugaguuaauaaauaauaaauagagauuaaaaauaauaauucugagcccuuugaaauuaagacacuguauuuucaucuucuuagaguucaaggcuucacauuuuacuuauaaaccagaucacugaucaauaaaugauuuuguaguaaaagcugagugauuugcacuguaauuuugaauuugaauauaauaugaauaugaaaucaccuauuuuaacaccuugaauccacaauuuuuuuaaaguagaaucauuguagaggaaguuuuucuauuuaaaauacaaaaauauucuauauaguauaaguauguuaaaaaaaagaaaaacagcaacuguauuuguguuaguauuuaacuguauuucuguuagucacuguauuugagaauguaagauaaauauaucuauauucuaaagcaugacaaaaucuguuuuuucuuuggaaacacuaaaucccuccugauuucugagucacauacuguaccaacugagcuaggaagaaucuuccuguaggacucucaucccaccuguaggccauuucugguuuacuuauauaaauuugcauaggacaccaauugcuuuuccuucuguaguaaggccauccaaucguaucauugaagucaaugaucaaaugcuacuaauuuuuaaggagaacucucccuauuuggcauugucuuuaaagaaguugucuuaaaauaauccaccauagaauuuuugagcuaaaaacaaacaccuaagaucauuugauuuacaucucauguuacagacaaaaauguuuaaacuuauccaacaucacacagcuaauuagccacagcuaggccuacacucaagaauuuauucucaggccaggcgcaguggcucaugccuauaauccuagcacuuugggaggcugaggcuggcggaucacuugagcucaggaguugaagaccugggcaacauggcaaaacccugucucuacaaaaaauaugaaaauuaucuggaugugguggcacccaccuguauaguuccagcuauuuggggcacugaggcaggaggaucacuugagcccagaagguugaggcugcagugagcugagaucacaccacugcacucaagccugggugauaaagcgagacccugucucaaaauaaauaaauaaauaaauuuacucucaaggccaguuuuucauuugugacuucauuccuuguaaaaagaaaaccccauagaaucucgaaauaaaaauauuuaagaccacaauggggucagucaauaaaaagacaaaagagugucuucaugucuuaagacccaucuuccugauaaguuuggaugcagaaauagcauuuuaaaaauuaaauaucuaagccguuucuucagaauagauuucauugauaauaccaauuuguagauuuuuaaaaaaggcugaggcaugguggcucaugccuguaaucccagcacugugggaggucaaggugggaggaucugcuugagcccuggaguucaaggccagccagaacaacaugacgaaacccugucucauaaaaauaaaauuguagauaucagaauuaccuuaaauaaauaugaaucaauucucagauacagaaugaguacuuguaauuuuaggguacuuuuuuuuuuucugucacccagacuggagugcaguggcacaaucucaguucacugcaaccucugccucccugauucaagugauuccccagccucagccucccaaguagcugggauuacaggcacaugccaccaugcccagcuaauuuuuguauuuuuuguagagacaggguuuugccacguuggccaggcuggucucgaacuccugaccucaagugauccaccugccucugccucccaaagugcugggauuacgggcaugagccacugcgcccagccuuaauuuuaggauacauuuuaaguuauauuuuuaaaacaauaaaauuguaguuuuuguuuuggaaaagaaaauuggugacacaaacaugaaccaugggaugaugcaaguguacccuauagauaauucaugaagcauuuuaugauacucuuucagcuuugucuguucaccaguuggcugcucagggagagaugcucuaucuggcuacucguaucgaacaagguaauagccuauuuaaaaauauuuaaacaaauucaauaggauuuauuagauuuguuauuguuuuauuuuaauauaagaaaguccuaaagacaaaaacaaauaguuacauaaacucaccaggcagauaacccaauggauaguaaaaaaaaaaaaaaaaaaaaaaggaauauaaagcguaaaaguuccuuuaccaccguugccuuuuccccaaaagcaaacguuauaaguuucuuacauuuucaguaaauuuuuuugaaaacauuucuauuuauguuucggauuaugugugagaauguauaugugcuuguuauuuacacaaaagggaaaauauacacuacauugcaccguuuuacacugaauacuguggagagcuuuccauauaagcacguauuaaagaccuauuuuauucuuuucauaguuccauaagugugcauuguauugcauguacguguucuauguuauuuuuuuuuuuaacugccccccuuaaguuuuaaguuuaaacuuaaaacuuaaaaguauaucuauagggcagauucccacaaguagauuugcugggucaaaggguguauauauauauauauguauuuuuuuauauauguaaauauauauuuuauauauauaaccagauguguguccucacacaagagcuagaguuucuguuuccccacgcccucacugauacaggauauuagcagauuccaaauuuugcuaaucugacgugugaaaaauggcaucucagaguaguuucauuuacauuuuuuaaguuauggucuacuggaauuuuuugcgugugaccuaccugcuauauauuaguauguaaacucuaaauuaaggaaauuagcuuuuuuucuuguuguuguuuauguugcauauauuguuccccagcuugucauuuuuccuuugacuuccuuuaugaaguucugaaagcauaacaucuguaagucauaaauuuauuuucuucuuugugacuucuggauuguauaucuugcuuagaaaggauuucccauuucaagauuauaaauaaauucacucauuccuuauucuagaacuucugggcuuuccuuuuuacauuucaauauuuaacucauauggaauauguuuuguuguaaugaaguaaagauugagcuguauuuuuauuuucaugcuuuaaaaaguuagccaguugucccaaaacuguuuauugaauacagggagucugaucaaagaguuuuauuuugcuuaaucuugucauuuuuauaagaaagaaucuuauauuucuguuuguuuaugaauauuuggaggcuucuucaaucuacuaaauaaauuuagggaaaaggcuguggacuuaauaacuaguagacaaucuagggaagaaaaugggguucaagguagaauugcaugguacuguauuucagacuauucauucacauuauauuaucugucauccacauaacauuauguuagcaaaccacaagaaugagagaaauucacaggcagcaauguuagcuauggaguagaagauagcuucaauaagauucaauaaguuuauauauuucuguaauucugagggcuaucauauaaucucacuuuuauuaugauccucccaacuguacguugauguaagcaaggaauucuguauauugaagaaauuaagugucuugcccagggucacauggcuggaaagugacagagccaggauucaaacuguggucuccugauucugagaccaguguucucuugacugccuuguacccgacauuaugucaugucugguaguuuauacuuuaaguaauaugcuaucugaacccggcuauguacauugaggcauauuuuaauacacucagacuacaaauuacaacaacaugcaauaaauaggacaccaacauaaagucagcacaaagugaacuuuacugaguauuauaaucagcucuuuggaaugccaguuuuucauagugauauuaagauaugguuguuaaauuagaucacaaaaauugcuuuucuuuuaaauagaaaauguuaucaaucacacggaugaagaaggauuuacuccucugaugugggcugcagcacacgggcaaauagcugugguagaguuccuacuucagaauguaaggaaaaugccucagaaaauguauauguauaguuacuuaaguuaagucuuuaguagaguuuuuauauauccagccagcuagauauaaugguagaggcuaccaaaaaaaguuuaaugcuuuucauauucuuguggaacuuggaucuaguugggaaggcaagacuaaucauacaugcaacagugagaaauaauuuaacgcccagaccccucuacaucccacgggaacagaaguacugucagcuuugaaggagaaggcuucauggaggagcugugacuugacuccagagugaaaggauaauuaggauugauacaggacggaggaaggaaggcauccaggcaaucucaauaaaagcauccaugaguaaaaguuuccauuauuucuuuauuaagcccagaacauuaccaggccuaguguugaacuauaauuauuguugacaggaauaacaauauucuuguuuaaacuaauugagaagucuuuuaucucuacuucccauaccagggugcugauccccaacuuuuaggaaaaggucgagaaagugcacugucguuggccuguaguaaaggcuacacagauauugucaaaaugcugcuugauuguggaguugauguaaaugaauaugauuggguaaguuuguaauacuaaauuuaaaaugacucuagcaaguuuuagaauuuauuugguuugggagagaugcaguaaguuuuauuaaagaagaaauagacugagcaucgugguguacaccuguagucccagccacuugggaggcugaagcgggaggauagcuugagcccagaaguuugaggcugcagugagcugugauugcaccacuguacuccagccugggugacagagugagacccuguuucuaaaaaauaaauaaaagaauaaauaaagaagaauaauuaauuagcuacauagaagaaaaaguuaauaucauagacucaauuauuaguucugauuuaaguauccuucacaaaauauuaaaauuacuuuaaaugauuauaugucuaauucuaguaaaacuucuuacagcagcauuaaauuacuugagucuugcucaccgugaaaaacucugaaucaccuuuucauuuugcagaauggaggaacaccucugcuuuaugcuguacauggaaaucaugugaaauguguaaagaugcucuuagguaagcagauaaaaauuuagaaaaugccaugugaggacuugauuuuauuuuuucgaccuggccuccccugguacuacucaggagaaucauuaacuauuguuaaauacaugaaucuugcugcucuucacccuuagagcaccugccaccaaaaguugcccaugugagaagcagcuccaucacauaccacaccugcaauuggaccuuuuauccuuguugcuuucauuuggggggucacaugugaauccacuauguggccaggcacaguggcucaagccuguaaucccagcacuuugggaggccgagguggguggaucacuugagaucaggaguucaaaccagccuggccaacauggcgaaaccccgucucuacagaaaauacaaaaauuagccaggcaggugggcgccuguaauccgagcuacucaggaugcuaaggcaggagaaucgcuugaaccccaggggcagagguugcaaugagccgagacugcgccucugcauuccagccugggugacagagcaaggcucugucaaaaaaaaaaaagaagaaaagaaaaugaauucacuauuguacucuuucuacagugucuuuaugcgugagcuuuaucuuuaauuguguaugaguuucagcugcucuaaaggaugcuguuuguuugaagugucuucccuccaauccacuaaaguaaauucuaaguaccccaugcacucuguacuuugucagacuauccuaaaacauucuccaaacugaaaaaucucuccagcuauuuguacaugagccaauaacagacaaacauaucugcauuuucauuucauuuauguaguuuuucuauuuugguauagaaaguggggcugauccaacaauugaaacugacucuggauauaauucuauggaucuagcuguagcccuaggcuauagaagugguaaguauguuagaacuccugugucucaucuuaguaaagcucuguaaauaguauaagccaguacuccaaaccaucuuuaucacuguaauccuaaaacauguuaucccaacuccugacauauacuuuuaacuuugggaaaaguccacaaauuccuauaaagucuagaaaugaguuuguuacuauacuuuucaccaacccaaauaauugguuacuggaggauaagugcauaccuguuuauaagauuuauuucauauuuugauagcaaacuauuuauagggcaaccuuaggauaaccuuguauucuggacucuccuugaguuucaaaaauaaagaaacaaagacacaacguccaguaacuuggacaguuacucagugacagacuaaguuucaaguuuuuuaaaguauugcauuguauuauugcccucaggcuauguauguauccugcuuagaaauaacuuuauuuuaggaaaauauuggggauaaguuaaauuugauaguuuuaaaagaaauuuuauagucacugugcuguaaucuugauuaccuaucuguucuaguucaacagguuauugagucacauuuguugaagcugcuucaaaauaucaaggaguagacacagucaucagaaaaugucugcccuuuuguuuacuucuugguccuuauaaaugauaguuuuguuuacuuauaaauuuuuaccucaguugcaauauuuacugguuuuuaguagguuuuaauaaauauuucucugaguaauucacugguuuauaauaaauguaauacucuuuuuauaacuauguuuuacuguauauuuaaaauuauaaauuaauguuuucguggcauguaaauuuuuaugguacagauaguuaucaucagucuuuguaucaagugcuguaauuugacauuuucagaaauuauucuacccuagucaucuucacucguguauuaagucauucacuuuauauaggguuugcuauaaaucccuagaaaaaaauuguucuuauuguugaauaaaaaagugcacagugugauuguuuacaaaaugauauuauaaauaaauaaaauacuucuucugucaguuugcauacuacuuuuuuaaguauauaagauuauuaaagauuucuuucagauuuuuaauuucacccuucuguccugccguaacacuucauuagaucaaacaauauauguaauuaaaauaaacugaaucuaagucaaucaacaaagacauugucauuucuagaaguauauuuagaauauuuuucucuuuuaaggaaguuuuucaguaggaaaagaccucugugaagagaagucaauucuucaauauaagugagauauucuguaauggcacaaagggagcacuaugaauccauguuucacagaagccaugaagaaagagccauggguuagauguugauuggaccacugaguguaggacuugacuuacaucacuucaccuggaaaauaggauguuuugucaguuaugguacuugguuguaagccacauaaacuuggucuagcuaauauaaacagaauggaagggaaag

SEQ ID NO: 17383 - RNA, 7084 nt, Homo sapiens
cuguauacuaggcaaagaacuuuauuaaucuuuguuucaaacuugauucccaggcuucuucggcuuaauuagcugcaaagaaugaauuguguauaagcaaaaacugaaaagagcugcaguguccaaggggcuugggcuuaaaaauauuagagaucuagauuuuaucagauccauaaacaaaaauuucuuaaaaagcagucauaauauaaaauagcagcucccaguaacuucuucagguuuuaucuucagaaguugacucaauucaguuugccucauucuuggaagccucaucaaaauucuccacaagaucuaggaaaaggaaaagaguagaaauucuuaaaaaagccaaaucuacaaauaauuaucagauauuaaaaggggaugaaggaaagacauucauuugccaaugaugauaaauacugugucauagccccaagaacaagaaugcaaaaaaaaaaaaaagugaaaaaaaugccccccucuucccaucucauacauuggucaauagugggggagcagaaccaaagaauacaaugacacacaauguuaaaauuuuccuggauuccuaaggauaccugucuaugcaaagugggaauauuuaugaguccagugauucuccugcccaauaaauauuuuagaagaacguaaauuuauccaauaacagguaagagacaaaaaugucucaugauucccaaaggaguuaugcugcuacagauuuuagaaugcauauauauaucccaagauaccugaacaacuccacaccuucuuguaaauucaugaguuucaaaguagggagcaagggucauuagugcucugcagguaauaguuauauuuaggguacuauauauauauacuuauuuauucaauauuuaagguuagauaccuacacauccuugggaucccaaacagaaacaagccaagucaagucuauaaacauaauucucaauuaccuaauacugcauuauuuuucucauucuaaguaagaucuauguccaucuuaacuuaccaccccucuucccuggguaguuuuuccuacaaagauuucuuauucucccuugcuaagauucucuagguuaaccacaaguaaacguuccuaccuggaacuucaucaucaucauccucuccaguagcaaguggugcuuuuccauccacagcuaugaaaggaaaauguaaacauuauuugucuagguuuuuaauaaauauucaccaaaaaaaaaaaaaaaaaaaaaaaaagaacagaugaaaugccaaguguuguuacaacuuauuuccaugauaagggacauuugggauuuuaucuaugauacuaucaauaacaugauauucuaaugucuacaaauggguuaaaauacuaggaacagccaacaaacaaaauuccauacccauccuuucaaucccucugggccaccauaggcccugagguaguauaagggcaguagggaacucuuagagugcagguaaaacccacauaccaaaucauggugagauuuugggagacaaaugaagaugccauuuucucaacuacucuguguguggcauaagggugaugcucaacaaccacuuacugaaaugaaaaaaguuaaaguaaaaaaauuaaagagucugugagugguaagcauccacucuccuuuaucacacaagaauaugaacguacacaggagaguuauguacuaggcccauacaggcaucagugggauacuucaaaagccuauuucagcucugaaagcccugacaguuuagaaccugcaacucaaugugauaauaaaaaugaaaauugaggcagauuaagucaauaccuagaaaaacauggguaacuaaagagccauauauaagccucugacuuccuccugcauuccuauucuucaaaauuuuaagcacagaaaacagcauaacacugccacauccucagauguauauucagcuacacuauuuucugccccgaauaaaaucccuaucacacuguaauuaaaaaugccagaauacuggcaagccauuuuuaaaagauuacugguaauacgaacuauauagaugaaacugaaguaauuucauaauuuacacuaauuuuuuuuucaauuccaaacuuacaaguaguuauuggcaaagcaccaaauuaacauuuucaucauuucuaguuaauaaaguaucugauccaaaucaaguaaguagaaaacauuccacaaaaucaaguguaacaaucauggcacgcuacaucaauuacugcaaacuugagcaaggacaguugcuuaaaaucaguuacaaaucuguuauuuuuaaagcuugcauuuccaaacuuaaaaauacucauauccauucugagcccugagaucagaaaucagcugcuaaaugaguaauucccugguaaaaccauuacuaggaaacucacauuguuugggcagagcuucggccagucuccuuaaacuagucagacuauccgcaccaagcugguuuaagaugcuggguagcauuucugucagcugcuuugucucagcauggccuguaauggugaaaguguucgcugccagagaugccugaacuuuaggguuguuaaaguggaucacuguuccuugguuuguaaacauauucaccuauuaagaaaagaaaaauuuaaauuagcaaugcugaccagucucuuuaaaaacaaauguuuuauuaaacuaagucuggcuaacuaguauuucacugugaagcacaggugaaauuuugccuggaauggaauauguauucuaauagcauucagacuuaaugagcucccugauauuuauuaauuuaugguagaaacacaucuuagggacuuugaagucccuaaguuaaaaaaaaaaaaaacaacccauuuaaugcauuaacguuaacuuuucccagccaaaucuuguuuuuuaaaguaacaaaauuugauacuugccucuucaauaccagagauauuguuuaccccuaacuucuuuaaggagaacugaaguuuuuugucaucugcuguggcuguucuaugaaccaccuucuucuuucugcgagcaguucccuaaagucagggagaagaggaaagaaaacagcacauuuauaccacaacagauauuuuucaaaugggaauaguuuccaauucauuucugaccuuuggaucuguauaagaacauuaccauaaucauaaacuuaugcagugagcaggcaggcuaaggcgaagauagaagcaaaaaaugggaaaggaaaagaaugaucuuuucaaaguucuacuuuuuacauuugcucuaaaagugaucaaagagguagcaugugucaaucuaaauuaagcauuugaaagaauuccacauccagaauuauuaaccucuucuguuuuuuuuuuuuuuuuuuuuugagacagggucucacugugucguccaggcuggaguggcgcaaucucggcucacugcaaccuccgccucccagguucaagugauucuccugccucagccucccgaguagcugggauuacaggcaccaccaugccugguuaauuuuuguauuuuuagcagagaugggguuucaccauguuggccaggcuggucucaaacugcuggcgucaagugauccgccugccucggccucccaaaguguugggacuacaagugugagccaccgcgccugaccccuuuucuguuuuuauauuaaauaaaaaucaacauccaaauuaauauuuacaggcaagacaguguauggaacaaucaaaugaaucuguauauagacuucuauaggacucgauaguaaagucugaagcccuuaccuuaacuuacaagagcccuacacaaacuguccugcccuuaauaugccacuccugacugcaucugcuaccaucccucuucuuuagccaauaaaccuuggcuauucuuugaacaggccaagcaggcuaugacccaagggccuuugcacaugcuguuccucuccuuccggaacaucuacauggcucuuucccucacugcagaucucuacucuuaugucaccugaucaaaguggucuuucucaacuacccaaaguaaaauagcaacuuccacacucacucaucaauuucuuucuauccugguuuauuucucuucauaacacuuauuacuauaagagauaaauacauuuuaucauccaucuccucucccuagaauguaagcuccauaaggacuucuguuuauugcuauaaacccaguaucuacaacaguaucuagcucacugaaggcacucaaggaaagucuaucacacccaaccaccucaccgucccccaaccuccaucccuauuccuauucauccuuuaaaaucuuauucaagucauuaccuccuguuugccuuuccuaaauucugcaauuacccccuuucccuaugccaaaucauucccaucucuagauuuugaaaaugcuucuacuauuguacuauguauauuacacugugaaagaagauuuuuuuaagaaaagacaauuaucgccacugcuaggcuuaaagcccaccuagggacuuuaaacuucuuaaaauuuuauauucucaggauccaacauaguaaaggcuuaaauaaaucuuguuauuuaacugaagaaaauaucuauggcuacaaaaaaaaaaaaaaaguacugguuacuaaccucuccaaacuauuaaguacaaaaaucacuuugaaauggucauguauguaucugguuuccaaagaaaucuucucuaagaaacucaaaggaauuucuaagauuguaaagacaaacccagcauacuuucuagagguuucauacacuucacauauguagaguucaauuuucacuuaaauaauuauuauuaaugcugugauuagauaugaaaauaaagggcuuuuguaacauuuaccuaagagcaccuaacaccugcaguuuucucuaaagcaaaauuaacucaccuaauuucacaucccauaauaaguacguuucuuaaacaguguagaaauguuuccauauugugacuacagaaauacuucuuguauuauuagcuaaacgaguauuaagauguuaggacacaaaauuuaaucuuguuaucagcuuuaaauauccuagcaaaucucaagauuuccuuuacccuaaaaugaugucucccaaaguuaaagccuaaugaugagaguaacaacaaaaagacugcacauaagcacauuauucaaauuacuccuucugaaacuguacugaaaguaagagugguuaaaaacaccaauauaagagcauccaaacacugagacacaaaaaauuugaguuuugcuggcacuugaaggccacagucugauaacaauugauuaaagaggacaagaaacaucuaauguuguuaaauguguggguguggauccugaagauggcuaacguuaacaaaaauaaaaaguaaaaaaaaaucaggauaaauucaccgcuggcaaaguucaguaauuuaacaaagcuguauauuauuauuuaagucuaagugcaacuucuggcuaucucacagcuaacucuaaguuaaacgcuuaaaguugggaaaaacuaaaagguaauaaacauguaccauggaagcuuuacaaguuuuaccaaguaaagacaugcucuguuucaacaagcuaccacaccuuguuaaauacuaagaaugugcuaacaauacaaacuagguagaccucugucuacaguggacuucuuauuaauuacaggacaaucuaaaaaucagcuucaaaaaagaauccccuugaugugaaucaguauccaccaggaaaaaaacaauuaaucaaaaacugaucauuuaaaaaucagucacuuuaauucccucauuuuuacaguaauacaaagucagaacaggaaagauaccuacuuggguuauauuuucaaaucuaauagucacugcucuuaaacuccaaaauguacccguaucuucaaauacccuugaaauaugcaacuacccuaaagaauauuuaguucagaaagcaguacagaaaggucucaauuuacaagagagacaaacaagcacugacuuuagaaaacucaggccaaaacaagucaaggguaugaugugcacaacgaucuaacugaaaugacacauuuuccuuacuaauuaaauuaggaaacacuuuuguguucuacuuacacucuguaacacugaaaacacaaacauguuuacacaaaggcgauguuuuuagcucgucucacugaugugucuccaacccucgucucccccgcuccucgagauuugcuagcuccgugaauuucccucgauaggcaaaguuugucaccgauaauauaagaagcgcaaaaggaauauguuuuuuaaaauaccuaaaccuuaaaaaaaaaacccacaaacccgaacuauuaaaacuuacuuucccaccaaugcgcacuugugccugcaguuuggcgaguuuuuccugguucaugauuguuucuuucaucuagaaaaagaggaaauccucagcaaggauagguuuagcucacucuagcauuccaugcucguuauuucccaagauaccagcaggaaaauaaacguccuacacaggccgaaaccuggaucccaaauccaccccgcaaagcuccaaauuuggguuuccagggagcccaaagagcacccgccuccccaccacucccccacagcuccccgcucuuggcaggcccggaugaaaggcucuaccccacgccuggccagcaccccccaccccuggcccuggccuggccucggccuagccagggccugcccggcccggccacucuccgcaagccucgcgguaccugaggcuccuguccucggguuccgccgcgagguggagguugagacagcgucgccucgcccccagggcagccgccccuggcucgaccucgcccccgagagucagccugagcgggugcgccuguccgucgcaucgccuuccucuccuccucugcccugucccucccugucucgcuccuucagggaacuucccgcccccgcucccguccuccuaccacgccgccguccagagccuuuuuguaccuugucggagcgaauaaggggccgcgcgggggacuaggguuggugcucaaggggucucggguggaccaccugagauuaggcgcacacacgcggggacgcaagauggcagcuaaagggaggccggaagugacacaaggccacu

SEQ ID NO: 17384 - RNA, 493 nt, Homo sapiens
gccugguccgacccccaguggcacuaaugugggauccucaggacacucucccagcaaagccguggccgcccgggcagcaagauccacuguccggcagaggaaaaaugccagcugugggacaaggagcgcaggccgcacgaccucggcaggcacauggcggauguggcgauucuacacagaagauucaccugggcucaaaguugguccuguuccaguauugguuaugagccuucuguucaucucuucuguauuuauguugcacauuuggggcaaguacacucguuuguagauucaguuacauccaucugucaucugaagaaggaggaaaaaacccaucauuucuuggaccaaaaguauagugacuauccguucaugagagaaauuuucuguaagcuugcuguuuuacaggggauuuaucaauaauugauuuagaggagucaguuuuuuucuauggcuaauaaacuuuuuaauucacuuacaacaacaaaaaaga

SEQ ID NO: 17385 - RNA, 1058 nt, Homo sapiens
gguggccauuugaccauauuuugagaggcaucaguuuugaaaggacucuaaggaauggugcccaagcaacauugacuucauccaacuccuucucuuguauuguccuucuuuuuguuuuuguuucucugugaaaugaaaguaauagcaugagccacccuccuggcucuaaguaaugagaacaaauuaagagccauaacauuaggccugcaauacacugguggaacugaguggaaaaugcuguuugagaccaugccagaauuuucccacuuuccauuuucuuuuuguuugugugucaucuuuugggauauuagcccagcugaugaugacacuucuuacugaggccucugaugagaacuaugaggcugggcuccugguaaccauggguuuaugaaacagaauucuggcccuuaccucccaccccauagggaucuucuucauuccuuuguguaucccaagcauguaacagugccuggaauauacuaggugugcaagaaauacuuauuaaauugaugauaucaaggauugagacuaacaguuuucuccugugcuugaggcuggaacucucacauguggacucuggaggugugggcagcuucaucccaucauggagccuggggagcaggggaagccagucuuuggacaccaaggagucuuggagggagggaucugcagagggagagcuugggcuggcucccacugauucucuacuuucugcuuccaggauuuuucccaggccaagcugcaaacuucuuuaucuuugaauaaguuccuuucucugugcuuaaacuagcuucaggggcuuaguccaaggcaacacagaaaauuugggaguugacaugguagaagucuaggugugacuaauaggaagggccacauacugccaguggagcuaagacagguugugaccuaugagaaauccucagugaacuggcuacgacccaccccuuucucucccacucaucugaacucacagguguguucugacagugauauauggucacuggcuuaacacagaggggggcaugagaucuuuaaaccauaaaacugcaguuccacag

SEQ ID NO: 17386 - RNA, 1744 nt, Homo sapiens
ugagaugggagaggaggcuccagguuauaguucuguugcaccaccuuccaagaaugaagcuggucaaacuggacagaacacgaugguguaagugugacaguacagaaaguugggacagugcugcgccuucuggaaaugguagcccagcugcucaggugugggcaugugcuuugcuccuuuaugauaggaagccugccuuccaguuccucagcaucugcuuuucuagcuggguaguggcccaggccccugaguuuccacuuucuuuuuuugcuggcuuuuuuuguugucauuggaagucuggcaauucauuaacaucuccaccagaggaugggcaggagaaaggaaaacugggaacuccagucuaccuugcauuucuuaguaguuaguaccucuaguacuagcuggguuuggugggaaagagcuguacugcuggcuaaaaugagauuuugugauuaucuguggauuuaaucuggucuccucacaucuaccauuuccacaaauaauuagagauuauuagacacauucagaaguugcauuagccucaaagaauuuagagaaaaucuaaauaggcuuaaauaccaucuuggaauccagaauguuaagcucuaugcuccagauaauuaacauuuuuagggccccuuuucuccccauggggcuaaaaucacuccuggguaacaauuaacugaacacauucuaagucuaauauauuuugcagaaagggaugagcugagcagaaaaacagaugaugcacuacuguugcauuaaaagagaacaggccaugcagcauuggagguuuggcacuucucuguucucuuaagauguauucugauucucgagguauugagaagagccuuugcucuuuucccaccaaacccagcuaguacuagaaguacuaacuacuaagaaaugcgagguggacuggaguucccagcuuuccuuucuccugcucacccucugguggagauguuaaugaauugccaaacuuucaacaacagaaaacagccuuuauauuuucaaaauaaaucucaucaguuggcacgugugggagccucucagguagugggugauucauugagagagcaaugccugcuccaugagcacaagugugcugaccccuuuuccuggagaacauucuggacauaaaguguccaucaggagcaggggaugaaguguagagaggggccgcagcccuuccucaaugcccagagggcuccuuccagagaacuugaguggaguaccaccaugggguucuuuugauuacuuuccucccagugggagcccuacauuagcacugacaugcaguggcaccccauuauugcaggaugguugagaauaugaugaugagaguaucuugugcuccugcaauauuuaacaguuuucaaggcaauuuuauauauguuaucuuuuucguuuuuugagauggagucucacucugucgccuaacuggagugcaguggcaccaucuuggcucacugcaaccucugccucuuggguuaaagcgauucuccugccucagccucuugaguagcugggacuacaggaaggcaccacacgcacaccacagagcgcaccaccacacccagcugauuuuuguauuuuuaguagggaugagguuucaccauguuggccaggcuggucuugaacuccugaccucaagugauccgccucccaaagugcugggauuacaggugugaaccaccacauccugccuuucuauaugcuauuuuauuugauguucauaaua

SEQ ID NO: 17387 - RNA, 102175 nt, Homo sapiens
agacagcacagcacacacaugaacuuuugccacuuuuguauuuuauuguggaacugaguuuuuuuuuuuccuuuacaucaaauauccucaauggaagaggggauauugcacacaaauaucauaaaagcacuacauauuacuuucacuggaaacuaauuuucuacauuagauaugacuggauaggauagaagugaugcaggauuauaagacauaauaccauacacagcugcagacugacacaaacaccauucagaacaagagagaggagugugaagugcuucucagcugggcucaagaccacuucuuuccagugcuggaaagaggggcugcaugcaguguaggaaaagcgugucucugaacugccacaggguguucucgaaagggcagcccggucuugaugccacuucuccauggcuccuguuuuggggagcuccaaacaagugcagagaagcugccuauuuuuucccuuccuuuucaguuuuugaugcugccuuuaaaaaucaacuucaugaagucacagauuuuuuaacaguaaauaguuuuaauaccaggugaauaaccuaauugcuuucaaagaaaugcucaucccuaggcugcuuuugguguauuguucaguugguuaaaagauaaaagcuuacaguuccuuucaaauggaaacaggaucuuuucuucuaaaucugaagcacaaaaaaaaaaaguuauuauccuaacucacaauaucauuacugagcaggaaccuccugugacaggugacuaaagagaggcaagaaaagcaaauucagaauuguagagcagcuccuaagagcugaaauuugguaacagagggaaaaugaaaggugguaagauuuccauuagcaaaugauuaaaucuuaauuaaaugaguauuggaaagcuccuagacugcauaagcuauuggagacacuuaaaacauucauauacacuggggaaaccauucacuaugauauguaacguuaagaaaaaaaauuuuuuugaacuccauggaaaaugguguuuaaagaggggaggaggggaaguuagucauuguauccagucccaccacaagacugagaaagcaugcacagggcucaggguuuugagaaaggggacagaauugguuaaaauugaaaauggaggaucaucgcuaacauuuagucucuguagaauuuuguuuaagaauacuaccaaaaaggucaugaucaugagugcuaucucgauagaaucccaucauuuaaacagaguguaaauuccuuccacucaaauauucaaucuauacaauuggauuaaguaaucaguaugaacaaagcuccuagaagucugugucgaucuuuagcucucaccaugaauguacaugguacauugugauggcuguuacuaaacuaaucguguauuuauggaacuagcaaaauuagguuagucacacaggcaggaaaggugucuggaaggacaggagcaaccuguaaugcgaauauugguuuucuugguauacucaggcucuguggucauauugagaacaacggauggagaaagguacugauagauuucauaggaaaaagagccagcugacuagugacaguuuuuacauauuuuucccauuaaaucccauagcaaaaaaaaaaaaaaaaaaaaagagagagagagagagaaagugaggaggguggagugguuauaacugaagacuggcuauaauucuccuacaauguuuauaguuuuuaaagcaaaauaauguucagguuaaauacauuuaauugugaaauuggaaaauaacuugcaucuucugucaaagaaaaaucaaccagaggucuggauuuggcaagaaggcuaaaaaucugguuuucuucccacgcauuauguagaccaauucaacuuaagagcuaaccauuaaauaauuaucuugaguaucuuagguuguguuauaaaauaaauuugaaguagaugaguuuauacucaaugaaauucauuggcgucacaaugacuuuuccaucauguguuaauuucuuguacccuuaauauguuauuuuccaaggacuugaaagaaaugggguaauaaauaaaagcugcauuucuagagaagccuaacaaaaauagaauauuaauuuucuuuaaaaaauuaaacauuugaaaaauguaauucacagcauuaaguagacugcauagguccucagugaaaggacccugaagaagcauuuuuuuaaacccucaucauaguuagcagugcaaaacauagacuuaucagacaaaaaucaacuaaaauguuaauuuugaaauaaauaacuaacauagaaaauaaaaugaggucauuguucucuacuccguagaucuuagagucugcaggaaauguaaugugacagagcacagcacaguugucacggagaaguuugccucaucugaacacugggugcauugaucugcaacuugaaacuugaugucaguguuaaucaugaucuggcuucccagguucacaguucaaugaugacaaugauggaaauuuucucuaaacucuacaugaaccguaggaguugagaauucauuuguuuucaauguacuauuucuuuuauuuuuuuuuuccagaaaagaaaaucccaaagcaaauuugugcuaggguucuuugaacuuggcucuuuuaccucaugguugaagaucuugaaagaaguauguaggauaccacugggugauguacuugucaaggcccugaaaaguagccuaccaugccauucucccccacucucaaguagcacuuuuauguuaugggaaucaaggggugggagguaucauuauuccugguaguuauggguuuuuaauaaauaucauuacugcaauaucagacuucaaucuugccagaacuucaaaaaacauuauucaauuuuugucuuacgaaacacuuaaaaaaaaagacuaucacuugagaauuuucuuugcaauuuccuguaaaugaaaacauuuguuaaaaaguucaucuaugaaaaguucucacauaucuuaaaaaaaaaauucuucuguacacuuguucccauaauuauguugaaauuaauggaaaauuuaaaaagccaauguaagacaaaggaagguaaauacuguacacuugcugagaaccucuuccaccauaagauucacuguuuucccaguucugaucauagaagccauuucagucuugaacuugcaguaguaaagaagcugugaaaggcacaacuuguuugacugagaggccacaggugcacugaagugggauucaacacgcaugacucagcaucaaacuguuggaccaaucagaucagcuucuaguacccccacacacgcucacccacguguuccuuuaaguaucuauaauccuauauggauguuuuauaaacuugcugucucacauuaaaaaauaagugcaucaaguaucuuuguacauucaagucacuuccuaaggcaaauugucuaccauauguacucccaacugcuuugguauuugcuucaguuaauugggguggacuuggguguugcugcaugcagguuaaucgacucagaguggacuaaguggguggacaaaugcugggagcaugccuuagaucaaucuacuuguguguuuagagucugagaguucugaauggggcccaaaccacuugcauggccagucuacacucacuacauuaugucagugugcagccuucaaacugaaggagcuuaauuaagaugugaaaauaucacaugcccucauaacaaguguuguucuuuuuacuuucuucuagccaacuuguuuuagaaaauuaagacucuuuuugaugacucagacugacaaaaauggaaaacuuugccuauguagacuaaagaaugccuacugccugagaaaaugcagaccuaauuguugguuuauuuucuccuccuuaccccacccugcucucucuuuuucucucuggguaucucaccagaacucucugucauuacaucuccuucucuugcauuccuuuucuuucucauucuuucucucucucucuccugcguuaucuuugugcucucacucucucucacucucucccgcgcucucucucucucuaagacaaaugccucuaccuagcagaagucaguuggguuggcuagugcaugguuuccaaauguucagcagagaugaacugggguagguaauuuugcaggaauuugaacccuauuguggaaauacuguuauuucccuuagcaaucagcaaaaacugagaaauuuagugacuugcaucaccaugacacaguauagcauuuggcagguaauuguucagcgacuuaacuagaugaauugacuuuuuagaaaaggugauuucaaauugaagaauuucuggaaacaaaguucagauccugugguguggcuggccuugguuuuuacaguucaaucuugcaugcagggaaggauucaucuugcauaaccacugugcugcugcuugcuaaaaccaugauguugagaucuugcuguuucucaugggucuccugguaccauucccucaucacuucugagucaugaguugggaucagugucaccugcagggagagaaaaaaaaaauagcuauuuaagggcagaaacagaaaccauaugaaaaaaauugaauagcaagguauuagaccacuggaagaagaagggaaaugagagaaaacuuuucuauuuuccucaagaaaugcaaaggauuuuucaauguauauuuuccaggaaccagaauaaagcugcaaagaaaagcuauuguuucuaagggaaacugaaggcuggaaccaaaaagcaauuaaucaguuucucaguucuuuacuguuaagagaagugcuuccguuaggguacaauuuuuuguauuuccuuuaacacaacugguaaguuuugcauaaaagauauugcauauuuaauccaaggauuuuaucgcgcacuucaaagcccucaaaagcccacucauugugaguaacuaacauuuuguccugagaacaaagaucugcaccuuuacuuuaugugugugguuggggauggagguaugggguggguaaguaauguccugaauaguauaaauuccaucuagcauucaguagggagccacugggugccucucauuagauuucauaugauuaaauaacaaguaauucuauauaauaugauacaagcacaauuuacuagguaauuuuguacagaaccacaaauaaaacuugauaagcaaagaucacagcugaauuaauaauagcugguucuaagaaucauuuaaggccaggaguucgagaccagccugggcaacauagggagacccugucauuaaauaaauaagggaugguuuguggucaggcaugauguuugggaguugggaguguccugugagggacuauauucagcaaugcuccugcuguggaauuucacauggagagcuguuuuucuaaauggccauauuccuagccgcagucuacucauaaaacacaaaggaagaaaggcaauuccucaggagcucucauauggaaauaugaccgcuuugauucacacacacaagacucuuggcauacuggaggaagggcaauuaaucuuaggcccauuuugcagauaaaugguuucugcuuuaguuaaggugucuuuccuccaaggccgugguuggugguggugccaagaauauuauuucagacuaccuacuguguguuaaacugacuuuguucucaggauauuucgugugugacagacacaggaggcaccucauguggauccacgaucagccacaugaggugccucuuuaaacaugguuccuucccauugccucuggacacagcucaaucggcagugcagacacugucgaggaguucucaccugcauguugcugccccacugagccuuuccuuccaacaaagcguccaggacagcccggcugggcuccucagcagcagggucauucccacucaccacguaguaggaagaccgcacucucuugaaaaauuccacaucaacauucuuacuauugcugugguuaggaauguagcacagguccaaauacacagggaggccugggggcacagcagaugacuuggucgucuugguaguuccugguccuuggguaaauaaacaaagacaaagcaaggucauagcaaggugaagagaccauacauccagcacauguuccccacucaaucacaccuucccuauucaaucacaaguagguccucugagacaugcaaaguggugacagcauuuccaucucccugguaaucugucaagggcauuuacgcuagcaaugugacaaaacauaacaugguuguuuaccaccucaauaggagaaaugaagaaugggauaguuucccuuuguggacaaccaauauuaggaagcaagaagaguuugaaggccuuucccaagauggcacuagauauaauacuccuccuaaagaaguuguuaauguguuucuuuauuugauaagugaucuaagaaguagauuuuaaaagucaaaagaaaacgucuguauuuggcaaaacauagcuaagugaucuuagugcucuauuuuagggucucauugauagcaauuuuguccacagcuggauauuauacccuaacauucuaccuagcaaauaguuuugaucuuaaccccauaugauuuccaaggcccucagcaccuccaucucauucauaaacugaugaaacaccauauucucuccuuagcacaguauucugaaaagugauacuucuuucccuagacaaggcuggaugccaaacuugggcaaaggaagguucagaaagacuaggcuuucucuagcuaaucaggacauaucagacugcaaccaaaacccccagucaaaucacaaaggucugggaaaacuaacuuguuccaguuaggaaguuuaaagcuuuugaaauguuaauagaacuagcauuuugaggcagugguucuucagccugacuauauaaucagaaucaccucggaugcuuaauacugacacccaggccucauucucuagagucugacuuaagugggcuuggguuggggccuggaacuacugucuuuuaaaagcaccccaggcgauucuaauaugcagcugguuucauugcuguaaagccaauuaaaacaccagcuagauuuuacaugcuuaauccucuuucuccauaggauauuuaaagacuaucaucccagauugaaaaccaccagcuaauucuaucaacuguacaguuuuauuuuuagagagguuagggaguggugagaaucagccaaaguaauaauuggauaagcuaauucauucuaugaauagaucaauaguuuauuuuaaugaaucugagccgaaagcccucaaaauauccaaagaauuccuaaagaauucugacuuguacuagaaguuugugaguuacaguucuuccaguaauuaaacaugucugccaauuucgcccucuacucuaaaucacuaccaucaacaucaaaugaauauugcucacagaagcacaaacugacagaacugcccagguuugcuuuaaaagucaauuaguacugcaacuuugccuuuuuagacaucuaaaagcaucuccaaaauaaaugaaaauuaacucauuuucacuuauuacuuugccuuuaaauuaccucuuuaaauguccaaaaaaaguuuuuuuaaaaauugugugggcuaggauguauauguucuggcaaauuugcaguugguuuuaucuguuuaaauggauuucauguuuucuccuaagugcaggucaguugucaacucuuucagaugaaaggguuaauuaucuggugguuuuucauucauuuuaaacaugaaaaaauuccgauuauuuucuaugugcauguagaaaggccaaaugugcugagaacugagccuuaaaauugauacuccauauuguuuaaaguaaaaauuugcaguuuuaacaaauguauccuaaaguguacuuaauuggagagcuccaaagauuacucuaucagauuuucccuaauaaaucagggcaauguuauuuaaauuauguugugccuuacauguuuggguccauuuacauuacuuugugaauugugaucuaaaaaucucugaauaauuaccuaaagcaaauaaaauguaugaaugccaauccuugugauugaugugaagcaacaaaaugaagcaguacugccauagaccaguuccaucaaaagcccaggucauugcugagaaccugauaaaucugagaaucaugaccaaaaacaugaaugaucaaaaaucagggauaccugcucuugccaaguggcauuucauuugcuuauuuauuuauuuuugagagacagggucuugcucugucacccaggcuuggcaugcagugauacauacaauucuggcucacugcagccuugaucucuugggcugaagugauccuccugccucagccucccaaguagcuaagacuauaagcacgugccaccacacccagcuaauuaaaaaacauuuuuuuuuuuuuguggagacagggucuugcuauguugcacaggcuggucucaacuuccugggcugaagcuaaccuuccaucucagccucccaaagugcugaaauuacaggcaugaggccaugcaucuagcuucccaguggaauuuuaaucugaaauagcauugagucucuacuaaugaggccaugggguaagagaaggguaagagcagagccaucaauguuuuucucucaauuuucaccggacacucacuggucaacugaaauuauaguauuuuuuggcugauaagaaaauggaacacugccuuuaaugaggauuuaucuccaaccuggugauguuuuaaauaaaaauguaaacauuuuuaauuuaaaaaaaauuuuuuuuaaaaaaggacucuaaaucuugggucuagacugguugauccagucuugaugugaaaccucugguucuccuuaggccuuugggagcuccuggccuguguuacccugcuggauucugaggccaguauggcugaaaccagucuuccagaagcaccugaaagacacauccuugguucugaagauuuagaacagggcuguaguugcuguguucgaaaacggcacaaaaucaggaaucccagugaugaaucacagcugcuuugaaccauacacugagcuauuuccaagccuuaaggccacacuggacugagauauauaccuuugggcagaggagaagaguacagggaagguaaagcaucaauugugcucccucaucuucccaguacaaagccaaacagggaaauauaaaggcuguaaacgcaaguagaaugguugugacauauauccaaugcccagccuucucaaccuaccugcaguggcggucuuggccgacuuggaugcagaggcauuggcagcauucuuggucuccuugucuuucucuuccccacgugcagcuuugaccucaggaguggugguggguuuugcugccuuuuccacagauucuuucuucuuaggagaagccacccuggacacuuuauccgaggauucuuucaagcccgcugguuuuggugaagcugccaagggcuuagacuucccaucacucuuuuugacaggugaagaugacuuggucuuuguaccuggcuuuuugguuuuggucuucucuuucagaucuuucuuuagagcuuugcccagguucugcucaauggccaaggccucuggguccaccauggacacaucaggguggcguggcgaagggcugcggucuugcacgggagcuggagguggguccauguguuuguacgugacaguuuugucuguggggaugguuuccgacucgucuucagagucgauauuggcaucggccgugauggaggggcacucuucagucuccgggggaacaucagagucggucugggauggggcugacucgcugacugaggugggagggguuucaucacacugucggcccuguugcuuuccuccuggaggcgguggggcucccccugauugagugaggggcuuuucagauucuucaguggguucuucacuggcaaaccacucaagaggauugggauuaaugaaagagggugaaagcucugucuuggggugcuuguauucacaagaggacacgaggcauaaaucgacauccugacgggcuucugagggggacuucuuuucugcaguguagcauaggucugaagucucguaggaauauguggaugccugagggguucuagugauuuucucugcagucucguaacaguauguggaaguaucagggguucguguugucuuuguagaugucucauaggaauaaccuucagacucagggaaacugguaauuuucucagugguuucauaagaguagcugggguccccaaguguguggccaccauccucagagucaucauagccauugcugaugucauccagaagccuucuagaccucucagucuuuucauagcuguaaccacucacuucgggggggcugguggucuuuucacuuaugucauaugaguacccacccucuucagggguccguguggucuucucaauaauuucauaggaauagucaccaucuucaggggucuugguaguuuucccaauggucucauaggaguagccacugucacuuggagauuuugugguucucucuaucuucucauaguaauagccacccacaucugagguccggguggucuucucauaagacucauagucauaaucuucuucaucuggggaccugguuguuuccucaggcuuuugauaggcauagcuaaagucaccaggugucuucccuccacuguccuucuccaggccagguguggacaaaucucuauucaaggcuagaugguguugcauuguaucgaauaacacugaggcacggaagccauagggcucugcggaugcugcaucuauugguggagaagaggaacuguggcaaguugcuguuuucucuuugacugcagagguagaaucugaaaaaguaggugaauauaaaggagaggacucucguggggugaguggagagauaucagauuuuggagagagcuucucuccuuccagacuuugcacuuuuucagaggugagugaggcauauaaggacauaucucugggaggagcaacaucggauagaguaucuucuuggagaggagaagcgaucugagaagggguaugagcagaagagguggacggggaggccucuaccugagauacugagaugagcucagaaagaucauuaucuuggguguaggacggcuccuccauaggugguaucuuaugugauaaacuggaguccugcaugucagaaggacuguaguccacuucaguuggcccauuuucagugaugugaagcacgccugcacccacuguagggugaucuggagacugucgacugaaguccauagcaagggauugcucaggagauucuuggccaaauucaauagacauugaggacuguucagaucugugaucuugaacggguguccuggacuuugcaguuuuaggggagaaaucugguggagaaauugacaucggucuugggcauucuucuuuagauggagacauuucuguuuccuggaaugugguagguguuugcacaacagacacugaaagggagucaucuacuucuguggaauguggggagccaaccucagcaugcagagauggagacacaucaucuguuguuggcucuggaaaugagcucguagccacugaggcuguggacacugaggccacacccuccauaugagaguacgugucuucugcuacgcccucaucaacaggaguagcugacuugucugagacaguaccuucagaaauggacaucuuagugucuucuuuaaaagauccaaacugacugacaucuauuugugugggagaaacaucuccuaauuuccuuucauccagagccagugcugguugagaacucauggcuucaacaucaucaguuuucuuuucuuggccaaagucuucuuuuauuggugcaaagucugugcuuuucccuuccuguuugucuugguaaagacuaguagaagucauuucagaaacuggacuuacuuggucuggagagccuuguuuuccacucuuuucuucaaaaggacuuucggcaccucugccagaagccuugucaucagcacuuagaaaacuuucauaagcagacucggauccaaugaggggcgggcugcguaaaggagacaaaacuuuuucaauaggagacucugagucaggcacgggcucauccauggggcuuacugaagcccuuucauucucaucuuuggcaucacugaauucaaaacucacuggaacugcuggugguuuuucaaugacuucuguagggagaugacuggauuucucgucaguaggagauugauaguaaggugugugaccagcacugccagucacggacugagauggugacaccacuuccagagucuuguccucaggacuagcacaauguucuucaacuacuucuugggucaccucaggagacaccggggcuacuucugccucugcagagacuuuaaucucauugggcgucagagagaaguucacacuacguucacccaggggggucuuuucuaagggugaugguggagauggacucagggacgggcucuucgaugggcugaccuuuucacuugaaacagcugagaugcuaucuuugauguccaaaguggugcuggcuuucacuucagagcaguaagcaucacguaaagcagaucugcugaauuugucuuccuccauggaagaggguggugauaugguagaggcugaagcauuguaauccuugccaucaguggcaucuguuuuugauccuucagaaaauccguugagcgguguaacaucagcagguuuagaguauuccugagaauacaaugaagauucauauuuggugauauuuacgaauuccugagaaggggacuccgucucuucauuguuggucucaucacucaucacgucucgagggguagacaucucauccaugggggugggcucacuggauaucucaauaguagacugaguguagccagagguggcagugaauuccucaggcuggucuucucgauucuccucaucagaagcgguggccucgcucucugagccuccagguaaagucucaucaugaauugaagaugcagguucucggccaggagacugggcuccuaguugcuugguugguguggugaggaauccauacugcuccucggcaccaccagccucugcagccuugucgaccacagccaucacauagucuucagcuuccauuuuuuccggcucauauuccuccucucuggcaucuucagcuuuguccuccucaucagccuccucuucagauuguucagccucuccuuucucaauggccucauccaugucuucuucggcucggucauccccacuggccacagacucccucuucucccugauguaugcaucagccuccgccuuggcacuuuccucauccucaguggggcugugcuuggaggcgcucacacauacguguuccuccccauccucuucuggcuccucagccuccucaguuucugccuucucuucauagucuccagucucugaagauucuucaaaaccggcuccuucaucuucaaauuuuucaaugucgucuacucccugcuucucgacgggcuccagcuccucaggugucuguucacauucgcccuccccuucagugguagugauucccucaucaggggacucggcaggaccuuuggugacuucucucuccuucuggaugacguaggcuucgacuggcucaguuuccuucaguuucucuucgucuucgauuagcuccagcugaggcuugauguccuuuguuacaucgaccucuucagccuuuaacucuucaaaguccuugguuagauccucaggagaugacauaagggaccucucagcuucgaguucuuuggcagggccaauggcugcuauuccagcugccgccaugacagcugcugugguggcuccagugccgacagcugcagcgacagccucugcggccuugccuuccuucuuaaugacuuuuauuuuccccuucuccuuuggcuuuccggcagcaacagaaucuuucuugacagacucuuccuucuuggguacuuuugguuuuaaagcagcugguuuuuuugcuucagacagaggaguagaugauuucuuugcgucuuuagggagcuucuuaauuucuuuuuuggguuccuuuucuuccuuuuucacuuccuucuucucuuccuucuuaacuuccuucuugacuuccuuuggcgguguuucuuucuuaaccucuuucuuggguucuuuuuucucuucuuucuugaucucuuuuuugacuucuuuuuucaccucuuccuuuuuugguuuuuccuccuucuugauagguguuuuguccuccuuuuuagccacuucuuucuuuggcuuuucuuucuccucuuucuugucuucaggcuuuaccuuuguuuccuuuuucaccgucuucuccuuggcagcuuuggguuugacaucuguggcuugcuucucagccaccucggcuuucacuggagauggcucuucuuugcugggaaccuccuuuucagucacugaagguuuggucucuguuuuuauuggcuugucuuuuuucaccauuaccuuuucuuugcuuucaacuuuggguggcuuuuccacgugauucacuuuugugaccucagggguuucuucuuuugacuccuugcgcacggauuugcuaggaagugguuuugcggcuggcuucagacuuucucggcuaucagcccucuguuucaguuuuguuuguuucaccacaggagugggcaccuggccagugagauccuuuuggguggccaguggcugcuucagaaagucuagauguuugagcuuuuccaacccuuccaggauguuguacugggugcuguucccaggaaacaggacucggaugauuuucuccgcaggguuugcuggaugccacacaaucaaagaugagacugaaguuaaguaggaaaucgggagaucuacuucuugaccauuaggcagaaugaauucagccuugucuuuguugguaccaguccacugcugcauaaaauacugcauuuccuugcugcucuugacuggauuaagcacauacaucucaaguuuaccuacucccauuuuuuggaaaagaaugacaggaucaauaguauugccuacacuucuaaacagagguucugguuucauggacaauuuguuuagguacuggagagugaagcaggcuucuucuaugcuucucuucaucuugauguuuggcucuggauuuuugagauuuucagguacauugagaaauacaacuccuaagucaggggagaugagguuuuucauccagucacuauuugugguggagcccugggacuguucuuccucgagcucugcaauuuuccgcuguaacaugcuguuuauuccaggcaaauugucauccccaaugugggugagcaggauggaguccacucggucuaagugucggaugagcuuccagaagcaggauuuucucucugauccgccauugaugagcauauugaaaccauucacugcaaacaaggcagaaucgccccucccuccuggaaaaauauaacagcagggcuuggagagcuucagaaauccacccgaugugggagguuccaagaugucaaagggagaugggacuuccacugauucugagagauacucgguaaacucagaaaguccuuccauuucuggcaagauagaagcugaauugaguuuaauauugaugaagucuuggagauugugucugucaagauuggaguucuuccaguccccuucuucaggacagaacaggguuaagcuggcuuuguuggcaggauggguggugcuuaguaacuccccgaucuggguuuuaaagaaagaaagaaagaaagaaaagguguaagugauuaucaucacugauccaucaucuccagcuauaacuauguguuacaggaucacaggaugcacauaggaccaguuucagacaugcacucucauagugauguugguugcuuaaaugcugaaauacuucccuacuggaaggugaacagccuuuguccugagccccgcugcuacuggcuucuaccucaaccaguacccacucgcccuggcaccuccccaacaaccccuccaccaucuauuccugcccagcaggggaaugccaguacucugcuccaguucuaacaccagugaccaccugggcaacugaggauugugcugcagugguuaugaaacacuuugaauauuaccccuagaauaaaggcaaagaugcccuuuaaaaaaaaacguuaaacuaucacaagagaaagcugucugggucauuucaccacuaauaaaaaauauuuucuuuuauuccacuagacuuggcaaaaaaaaaaaaaaaaaaggccugauggauaccuuaaagaaauucagauuaacagggcacuuguuguggccuccuuucaggaucuggcauguaaaaaagaaaaaaccuugguggguuuuuccccauaggagacaagaaguuacggauugccuauuacuacaaaaaauuacugguuucuggcaucagugcacgcugauugaaacaugagugggucacccagcauauucucugcagauacaaauacuuuuuuauuaaagccaugacauuaaagugguuuggccaaguucguuccccauuugcucauguuuaacuccacagugagccacucuguucucuuacugcucccauucuuuucagggcaaguugggugugagcagcuaagaucaaauguggcugaaacauuuuucaacacauuguuuaguacuucccaaggauguaaacauagaaaagcaaaucaggaccaaaacagaaauugugguuuaauaaaaacacuacuugucucucucacuccauauuauggccauauauuucauggucuuagccuagcaaauuagugauggagaaucaugccaucaacuccaauauucuuuccgucucaguaaagcucacaaaucagcucagaguuucgacugaaaagggcucuguauucuggaugacaaaugaucaagggguaaagccaagguuucauuugguccaggcaucccugagccagcaggucugaacucuuaccuucuaguauuagauuaguuuccucuaucuccugacuaucagcauucugaggcuacuauuaugaauguguguaagaauaauuuauagaaucugaguuuuccuauauucgacugcaauauugcaguaaaauagucauuuuuguuuuguuagcauauuaguccuaagcauaacauuuuauguaaagggccgcaaaauaacaaaauaauaaaacuuugcuguuuuucugugacuucacaauuuucuguaaaaaggauaagaaucaacuccuguuuuugggagcuaagaaaagugaaaaagcaaaugguaauaccaucuuuggguagaggggacaggcaucuuugcucaaaugauuugcuggccaaagcaaacauagggcaucaaauaugguuuuuuguacaauaguuagcagagacucucaucacaaucacuauagcacaauuaaaagucucuagaucccaauuuucacacaaagcacaugcaaacuauucauguuuuauaauauguuuuagggggcaaaucuagaauaacugcuguaucuuuaauagugaaacuuaaaaauuaaguuuaguucauuuuaauuuuugaaauuccacccuagcugagagguguggcagccaaggguauaauccagcugugaguagggggcauucaaucacuggcucuuuuuauguaaaguauguaauuaccagguugaagcagaagguagaaagacuuaaggaauaucuuccuacuuuccgucuuuucaccucuauccagagaauuucuaugaaaugcaggaaaugaccccaaaacaaaacaagauugcacagaauucugagaagucagaggucaugaaagauagccaagagacacuggugaaugaacaaccgugauguacaaggcaaagcagaaaagaaagccagcauugcuuugacagguuucuuuccagagaaggaaaaucuggucccucugaagaaacagcagcacauucugaaugaugagacaagaaugcagagacagggcuggacagagcccucagucauaaaacagacagauggaauugggcagagggaggaggaggaagaacaacuccuacauccuuggaacuacacaacagaaugaagcccguguuuucccccacagccucuuuccagaccugugggccaacaagcacaguagagagugccucaagggcaaagacagggucuuaagaguggccagcccacggcagcaccugaccaagcuuauucaaugaauagaugagaaccauaaggaggauccaacaauguuagcaguggcaaggaagcuugugacuaguucuuagacuuggaaacugaggcuucuucugaacaaauugggaaaucaucaccaugauaaaugguaacuauuauaacccacuacucuaaacauuucugauagcaggaaauauaucuucuguaucuuuguaucuuaguuaucuuuguuuccucaauacauaaucaggcucaguagauguuuguugaucugugugccaaacuuggccaguucaacacauguuaucuuccuggaguggguacuucagauguaaccacacugagugcuacccugguucuuacaaaguuggaugacagaugcaacaaggaggaauaugcuuugggacaaagauaaucuuuuuuguuaauuacuuuuucugauuaaaugcaggcauacuggaagaggaaggaagauguaagaaauaaaugguuuuacugcagaugagauuaaugaaacaagauuugaauuucuaaaccauggccuacgaacuacauuuccuuuuugauuagguuacuugcuuggcugaugaggaaauacaguagacaguguaucucuggguuuuagccagacauuuaauaggaccccugaacagugugauaguagaauuagguggauuuccagccagccauauaaauagugcugcuuaaugucaaccuggagggaggucuaugaugggcugccucaagucucauuuucuggccuguauucacuuggauaaaaauggcgaaggcaugcauaucauauuugugcaugguaugaaaaugggagacacagcaaaauguggaauggcagaauuaagguauuuauaaaagcucuugacauugggaugaugguggcuaagucaauucuaacaggauggcauucuaaagggauaaauguaagguucaauaaaccagcaggguaaacuacaggauugggagauguggcuuaacaauaauauccauggaaaagacucagggauuuuaguugacagucaaauggauuuaucaugaagccaaagaagcuuaaacuucaagguaccucauuggcauggcccuguacuuaacuguauauuaauaauuguuucauuuuucuuaaaaaagagcccuuaaauuauauaaauugucgagccccucaaagccugcaucucuuccccauugacuuccccauugaccauuaaugguguauggugauggucaaaagucacuuuuagacuucuuuaauagaagaugguauugaaaacuauagacauuaucaacucucacaauccuaaccuggucaaaugacuccugaauaggguguccaguuugagucaugacauuuuagagaaauuagaccaacaagcaaaaaccugaaacaagucucccuuacuggcuccuuccucuuggccuuaugaccugucaacacuggaccugggcccuuucucuucuuaaaauguuucucacucuaggucacaucaugugucuucugggcuucaaauaccucuaauaugcuaauggauuucaaauuaguaucuccagcccgacucugaguucccugagcucuguucucauaaauccaacugucugauuucaaggcacuaaaacaugaccaggacuaaacuccugaauuccccccauacccaucccaucuccucuucuuuuuauuuuauuuuuuuaauguuuuaaguauaguuuuuuuuuuuuuaagagacagaaucuugcucuguugcccagguuggagugcagugcagauuauaacugagugcaaccuagaacuccuagccgcacgugauccucccacucuggccucccaaaguacugggauuacaggcaugggccauagcaccuggccuucaccucccuuucuugacagaggaacaaguuugaaggacagugagcaggguuaugaagaacuguggguaaaacugaagaugauuaaucugaaagggaaaaaaucggcaguguuggugaaggguaacuaagacacuguaggugggaaagggaucacaucacuuccuugaagauacaaugagacaaauaaggaaaaacuuuccaacacagagacugaaaaauguccccaggagaugaugauuucaccaucccuggauuucagggaggagugggguuagccagacaauuguaccgucuguuaguucugguuuuguuaauugaucuccagugauuaagacuccaaaaccugaagcucaaaguguacugauaguucuauuuuuucaguccauuuauuuuuagcuguucuuauauuuuuuaaaaaguaucauuuuuguuugucccaaauugugguuuugguuucccuggaguuaacuaguauguuucaaggacuggauaaaaggaaaagagcuggacaacaaguggucuucaagguccguuuguuauucaguuacucaaccauuuuuccaaggcaacaaugggcaauccuagcuccaaaaggcugauaaccacugguccaguccagugguuuucaauucacuuuagcuguggcauccuuucuuuguggguggcagaagagaauaugacauggucucugaccauaaugauaccugccugaguauaaucaaaauauguguccuccagaaccuaccccaauaaguauaaacccuggggaaucugcccuuccacggaacucgaguucuucaguuagggcaaauuuuuuuuucuguaauuaguggcaaaaucugacacgugcacaguccauggugcuaaaauuuugcuuccauaaucuaguaaaaaugauuaagcagcaauauucauaacaaccuuauuuaaagaaggggaaggagggauauuauuugagaugcaaauaugccaaaucguguuacuuccuuauugaaaaucuuggcaaugacacuuuucuuuacauauuuccuuugucugguuuuucggcaaaaaagacaaaccaaugacuuggguagaaaccaaccacuagaaaauaacuacagaacugcacaggaauguggaaagugcccaugugcaugcaaaugagcuauaagcaggccacuuaacugcucaccaugucauugggccacuuccagccuucugcagcuuucucucuucccugaggcaagaugcuaauaaugugugugaccccagagcuacuagacaaaugcccaccugccuccggguacaacaugcacauggggacauaaucuugcaaaacauucugacauuauagugaucaaacaacaacuucaggacaguaggcagagugagaauuguagcccuagcuuuggaauuucaaugcaauugaacagcggcuuacuaggccuuuacuaugugcaggugcaauggauaccgagaugaaugaggcaagaugcgugaacucuagcggccuuggaagaagacacagccaaagcuugcauuuugaagugguaaagaugaaccaacugugagugagcucugaagccucugagaaaggagcugccugccugggggaucccauccugguauguguuucaagaugcagaugacgccacaccuucugacagcuguggcuucaaaaauguuccuuuucacaguuuuacauucuccccaccccaguggcuggagagugaacauuauuaugccuucugaucaguguuuuuaaagaagccuccaggugacucagaugaaguugggcagugugcuuacaguucuugccagugaugaaaaguacaaacagagcuuucucugaaccucagggccaaggaaaauuaagugcagaaggacacguggcccuucacaguacacaugagacagacaagccaccaccucagaaagacaguuuuaaacagauguggggacucuucuuaucagaacaucccucagucccuccauguagaaaucugcuaucggccacaggcaggccccaaccugcuauggggaugggucugaauuguuucuguaauugcuauaaacauguaagcuagauaaacaaggugcauuacuuuggaaaguuucccagccaggauaaauucccaagcagaaauaagcauaucaaaaucuuugaucucauuuuacaaaauacgacuaacuucacacaguuuucaacacuuuauaugugucaucuuugaauaagauacgcauuagaaauaugaaugauccagcuucaguccagcuacuuuagccaucuuuuucuugggucacagacgugccccauuuuccuacguggcuccuuuuguaaagcccucucucuuuugugggcuguucaaacagcccaaguucaaacacuggggccaggcauuaaaguaaaagaaaucugaaauaauuaggccuggaaaacgaggugccaaaagccccagauaucuuuggaguauuauuucagaaaacaggaaacgcagguuuucuuuugggcucugacauuucaaguuucuccaucauuuuuaccaucuguaaaguguugacuguuccaaccccucccaucuauaucucaggcacauuaagaaugauuccaauuaauuguaaaugagugcucuaaauucuuuuggcaaugagccauagaaauaaaguauuuuggaucaugcaguuuugcuuauuucaggagagcugugagguucccucccuucuucuuuugucucccccagugcucucaaagaggaaccuaaggcaaccaagccacuagaagcacagauauucucagacacgaaccuaccucuugaucggugaaaaucucuaugaaguucuggaaggagaaagagccggacuggagaaugagcucuccgguauuuucaaagcacugcccggucagcacgagcagcuugugucgggcagcaucagugaucauuaagcgcaccugaaauaaagcacagaacguaggcccugagccaugggcagugcugccaucccaccuucaggacagggcuagccuucggagccaugggaguuuauuaccagcaaaaagcauucauuccccaaaggucuaauuucuccuggaggccagaagagcacgggaggguugaauggaucccuggcuguaggaucauccacaaagccaauaaguguaguuaucaguuugcccaagaaugccauuuucaaaguuucucuacaaucacgacaguagcgauaguugacuuucucccccuaguuuccuccucuuuuucaaagcagucuucacagcugguaaucauuuguuccacagcuguuagaaaugucugcuagcagcacguggucugcgaaaccagggaagacggaacuaucucacaggcugaaucaccauguacaguccagguuccccaguggccuccucaguaagcacgguguuccaaacuagggucccaaaccaaccccucccauaugcccuuccaaggcgugcagcaagcacacacacagcuccacggcagucuccaguggcaucaguaaggugcuugacauugaauauaaagaaaaggcugccccuaaauagcaaucuuugagauaauugcacaugguuugcgcuaaggaacucucugugcacuuuucaguggcaggaagccagcuguccuucagcaaacaccacucuaagcaccaagguauccauucugagcccaguucaugaauguucagcacauccuacuugccaggcaucauguuaggcacugaggggaggauacaaaaguaaacagaccaugaccccuuacccaagaaccccacaguguaaucaugcaaaaaacacauguaccuaaguaauuguuucagccccaucugcuccacaggcaagccuggauuccuuuuauaaaauuccauauuuuuccuuucucacaacucuuccgggcaguuugccuggacauauauuaauuuuccagcuuuuuuuuuuuuuuuucuccuuuugagacagggucucacucuguugcucaggcuggagugcagugugcaguggcgccaucucggcucacugcaaccucugccuccuggguucaaacaauccuccaucucagccuccugaguagcugggaccacaggcaugcaacaccaugcccggcuaauuuuuuguauuuuugguagagacaggguuuuaccauguugcccaggcuguaauucuccagcuuuuuucaagcuguaauuacuucccgauucuguuaguaacagagauugcuaucccaucacuuuccucagcuucacaccuucauggauugucagagguccugcugaucuaaagcaggcagaagucagucaugacaggugacaucacaacagccaaaaaguggaagcaacucaaguguccgucaacugaggaauggauacacagaugugggcuauccauacacuggcacuguucagccuggaaacgaaugcaguacugacacaugcuacgacauggaugaaccuugaaacuguuaggcuaaaauaagccagacacgcaaggccacauaguauaucauuauauuuauaugaaauguccagaauuggcaaaucaggacaggcagguucgcaguugucggcaucggggaagaauggagaccgacugcugaugagcucagggcuuuuggggcgugauagacguauucuagaauuagauaagggugaugguugcaaaacuuuguaaauacacuaaaaaccaccaaauuacacacuuuaaagggaugaauuuuaugguccuugaauuauaucuccauuuacaaaaacaggauacagucacagagaugcucaaaguguggguagaagggacgcugcaaacaaugaagguucccagggacuuuggcugcuuucauguccgagaagcaacucuaucucaaaagcgcucaacuauaauaaaggaaguggaaaguggagugauagcaacuccucuggccugggugaccagggacucuuggcuucaaccaaguucuuaugucacacugggcuccaaaauacccagugacucuccauagcaacaguuucauauggugguaauaauaacaaucacagcuaauauuuacauuucagucauuaugugccaugcucuguucuaagcacuuggcacuucuaagcacaacauuaaauaugaacauuaaauguagaaacuauuaugacccccauuuuacagaggugcaaacggagacaaagacaguaaauaacuugcuugaggcucccaccuaguaagaggcagaugugggauuaugaacccaggugaccuggugccagcccaugcuccugaccacuaugcuagccugccuuuccacagcgauaggagugugcaggagagcucugaauggggcuugcauugagaugccauucuugagaugccauucuucuccagguuugcccuguaugucgcggccugagggcuugcgucucuuuucccuaauacaucccuaucagacuccaucccagcagcacuccccaccacccccagcauaaauaccccaaauucauacucccuugccuggacaaaaucuuacaguuccagcuacuaucuucuucuuuguccuuaucaggaggaguggucuggaugguaccgaugcagggaaccagccacuuaauggggguugagaaagaccucuuaacccagaacuucucucuguugugucccucuccugcccccauuugcccagcccuucuaauccacugggucccuauccaguguguggggcccggccccagauucuacagagcugaaugcuuaccucggugcugacugcuucaucagaaggguugaucaggaccacuguuucuaaaacgucacuucggugaugaaggaucuuuuguccugcaggcacaaaaacacaaacaaaagaggagaccuuuagcuuuuccagauaaaaacugcccugccugcuccugggacagcagaggaauuucugccuccgacgugguacacagcacugaaauucucuacaucaucuugggaaacacaauuggugcuauuaaaaaagagggugcagccacuaguagguuccuccccaggcuggguuuguguggucgggggcuccucccgcucucacacucuccaguuuucagggucggucuaggcagccuccuugcgguaauggcgguuuucaucugagacaagggugggugccaggaaaacucaacggggcucuugacauuuccuuucucaugguaauuggggauguuucuccguaucagccuuucuucuggugagaacugcacugagauuaauuaggagccuuauugugaaaugaaugacauccagaaaccccagcuaacaauuagcccaacaaccagaauggcugucugaggcaggcuuacagucuguuggaguauucauuaauuaauucacuugcucauaggaaacuggagacaccguaagcaaaugaaaaguggagaacaacccucccaugaaacaggguggccaaacugccuccuaaaaacaugcacaguggacagagaacaacaaagcaaggcguuggugugaugaccgccugucuaaggagggcugaaacccugcggggcuguggcuccacaacgcugacucccccugcucacagguccuagggucauucgguggcugaaccagcccuccagccaaaguggauggagaccugugcaugaccuucuaugaagacucccccucccuggacaaugggaugaaaugaucaggcagauguguggcccaguuggugauacaugcuugggcagcugcuaaggacagggaaguggguguucucuccgaaaugugggagggagacgcaugguugggaggguagacacaaacaugucugcugcuuggaaguacaaugacucucaggcagcaggaggaaauggaaaagaaucugagagaggcagacaccagaggagagaaauacaagaggagagaaugaccaaaagcaacuguuuucuagaaaaauaguuggccaguucuucaaaaagcuaaaauagaauuacuguaugacccagcaagcccacuuccagguggauuugaaagcaggaacccgaacagaugcuuguaugccaauguuaauuguagcauuauucacaauggccaaaugguaagacaacccacauguccaucuauugaugauuggguaaaaugugguauaucaauacaauggaagauuauucaaacauaaaaaugaaugaaguucugauaaugccaaaacauggaugaaccuaggaaacauuaugcuaaaugaaauaagccagacacaaaaggauaaacauggugauuccaauuacaugaaaucucuagaauaggcaacuuuauagaguuagagaguagauuagaagguuccagggacuaagggaaggggaauggggaguuauugcuuaguggguacaguuucuguuuggagugaugaaaauguuuuuaaaauagaggugaugaaggccggaugcaguagcuuaugccuauaaucccagcacuuugggaggcugaggcaggaggauugcuugaacccaggaguucaaaaccagccugggcaacaaagugagaccccgugucuccaaaaaaaaaaaaaaaaaaaaaggccaggugcgguggcucaugccuguaaucccagcacuuggggaggccaaggcagguggaucacgaggucaggaguucgagaccagucuggccaacauaaugaaaccccgucucuacuaaaaauacaaaaaauuagccaggugugaugaugugcaccuguaaucccagcuacuugggaggcugagacaagaggagaaucgcgugaacccaggaggcagagguugcagugagccgagauugcacuauugcacuccagccccgacaacagugcgagacuccgucucaaaaaaaaaaaaaaaauagcugggugugguggcacacaucuguggucccagcuacaugggaggcugaggcaggagaaucaauggagcccagaaggucgaggcugcagugagccaagaacaugucauugcacccuagccuggguaacagagcaagacucugucucaaaaacuugauaaaauaaaaaaagaggggaugguuguacaaccuugugaauguaauuaaugaaaccaaguuguacauuuaaaaauaguuaaaacggcaaauguuauauuuuaucgcgacuuaaaaauuaauaauauaccaaaaaacauucacuaguacacuauaaauggguaaauuguaugguaugcaaacuagaucucaauaaagcaauuagaaaauaaaaaacauaaagcaguucaggauacacugguucuuuuuccuuuauaucaggaaggaccagaaguacuacagaaacagcaacauguugaaauacucaccaccaaccaccaucacuguuaccaagcccauucucccccaccauccuacuuucaguaacagcuaacauuuaccaacaaaccccacaucacagacagaagccuaaacagaacaaugaugaugucaggcaccguucuaagacuucacauacauggcuucguuuaauccucagaagaguucugugacauagcuacuaugauuaucccccuuuacugucgaaagcaaugagucuacagaagagaauuaaccugcccaaagucacacaacuaguaaguggucaagccaggauuuggacccgggucaccuggaucuagaguccuucugcuucacugcccuaugggguugguuacuggaacuaaaauuuguuaaaacagacaaggcacagacaccaaaugccaaaagacaguuagggaaagguccaaagaaauaaaaucagagaugagcuuacaaaagcaggaaggcagaaaauauuaagagaauauuggccaaaaaaaggcaacgguggcagaauaccccacauaaaagaaguuaaaauuaagagaaaauaugugaugucuuacuccaaaagccuaaaaauaaacuccaaaacagaacaaagucccacaguuugagcagacaaagaacggaggcuuaagaagaauaaaccacaggaaagaaaguucauuuauuaugaaugcuaaauacuguaauuuauuggacauugcuuuucggcuuuuugguuguuuuugguuuugacaaccaugugcauuuaaagcaaaagaaaaucaaauuaaauaagaaaaugauaaaaugaaaauuggcaagacacaugaaacuauccucuuucuaggucuuuccaucaguggucuucuugaaacaaagauuucaagagcuucaaaggcacuagguugagaugaaauuaagcaaaagcuuaagaccaaggagaaggaauagucauuucuuuggucacaauuuuguugugggcacccagagcaucagccagugcaguguccggguaugacugucaucacgucuguauucugcaggaauccauacaaguagacuugagcaagguacauaaaguggcucccuccacaagugaugguaaugaaaucccagccucuuucuuucugaagugauccuacacaacgcccugagcccgcuagcugcacccuucaacacccauguccaggcgacagcagccugcacaguccaccugccuccacagcacgcucuuccccaaacacacagugagcucgccugcugccgagguggccccuggcaggagccuucuuaccauccaccggcaguuccuuuccucuuuggcuucaucaguugcaaacaaaacaaaugccacgugacaguugccauuuaccuccacuccuuccaagucaaucuucagaccaguuugcccaggaauucaacuaacgauguucucuuuuguccaucuuuggaaauauugagaggaauggcacagacgugcaccaagaugccauggcugcuccuucaacaaaagccuuuuuauaggaucggauuugaaugaaggaggggauuuaaagggagagagagaagcuuccagcucuugucacggccagacuguuggccagauucuuucuggggacgacguaaccuggggcugggccgccccagcaucuggccaagccuggcagaggggcccugacgcgcccccaccccuggcauacccgugggugccagcuuuccugcggcaggcgggcggguucucagcgcaggcggcugggaugcucacaaaguugcauauuuggggaauguuucacacugggaaacgggccaggcauucugaagggaggccaccacccuggcuuguaaaggucucauucaguugccucagaaaagaaguucccaggaaagaaaggcagccggguuccagccucucucuccaccauuguaguccgcauucuccauucgacaccucacagggaaacccuuaggcagccccaugaauuguuaacuuuccccggcaucggucugagggcagcaaaagcgggggcucgaccuggaaugauugugucacuuaucgcuucauaagaaaaagucuuugagggcuuccccacaaaacucagcaugauugugaagccucgaccuggguggcggggcgggggcaguggagaagauugugugugacaaaagggguccgcgccaccucagaaucaaaagaggacagucuaaggacccucgaagcaggaggggccuugcagacaaugagacuuuuguuugugcucucccaaagcuggguuuggaacucaaaaggaagccugcauuuuuuggcuguuguugggauuuuauuccuuuuugaaaaugugacagauuaauugaaccuaugugucuuauaagguuuggcuuuuuuaguagcuuauguuuugcuacauucagcugauucugaaaucuccuaaagcaaaauauuauuuucuauguauguaaauuucuaggaugcuugcgggaucucuucuccacagaguuuagcauucaucuacacacacacacacacacacacacacacacacacacacacacacaccccucagaggcuucacccugguuuuggaagaaggaaauagaaaugguaguugaagaauaaagcaagccucugauuucuacucaguaugaaagggagaugaugaggaggguccugaacuauugguaaccaggacugaggggcagggcaugggcaggggcuuuagccaggagaaaagccguccuguccccaucucugccucccugcucugucagcucccacugcugcccucucuucaccuaccaacuacuuccagcccccugcccagguucaacacuggaguaacuuacaaugugaagauucuggaguuagagagaaaaaugugugagauaaaaaaggacuggguugauuuagcuaaaaguaaaguuuggucgaucaagaaagaccacaagcacuaaaugucuugauuuuaaagucuguuuuucaggccaggcacgguggcucaugccuguaaucccaggacuuugggaggccgaggcagguggaucacuugaggucaggaguuugagaccagccuggccaacauggugaaacgcugucucuacuaaaaacacaaaaauuagccaggcaugguggugcaugccuguaaucccagcuacuugggaggcugaggcacgaggaucacuugaacccgggaggcagagguugcagugagcugagaucaugccauugcacuccggccugggcaacagagugagacuccgccucaaaaaauaaaaaaugaagucucuuuucauuagaaggaagaagagaaggagggaagggaggaaggaaggagggaaggaaggaaaaaagagagggaggaagggaaggaagagaaaaugauagagucagaguuauucaacucaaccucuuuaccaaaguaaauuuuuuugagcggaaaccucuaaccucuaaccccucgugcaaaaaacacucuugagaguaaaauuuagcuaaauggcuaagagcaagaaaugaaaggugcuugguacaggaacuaagaauuaauaacuaaccaacaggucucccagaagcuuguaauagcagcuuauggugugaaaucauuuccagcuccaggccuccuuucugcagaaacccacauggcagguaaagcaaaugugugguugauuugaagagaaugggagcuggugaggcaggaggggagacgccugaagcagcagaguuuuguagugaaccuuuucuuccagagccccucacagaagucuucucuaucccuggcaacuaacgcuggggcccagaggccuggccggaaggaauccccaaaacuuccuuuucagagggaggaaagguaccagcaaauaaggaagccucacaagcagcccccaggugguucucccugugccccuccaucccaccacaucauuucuaagcacgaaaaacagagaggaagagaaagaggugaacauaguuuacccaguaaccaugcucugagaagcuacaaugagcggcucuccaucccaggugccccagcuuagagcuccggagaggguccaggagaaggaucgaggcaacccagccuaacagaagacuuccucggcuccccuggagcaaaaaccuaccucagcccugagggaggacaugaucccaaagcagggugagacacaaaacccucaccccugccacagaggugcuguuagaaaacaaaggugguaggagacuugguucuaauuccacggauccccaaagaccaauagcaucagcacagaaaacagaaggccaccuguuaccaggaaauuacacagaaucugucuccagggaaguaaaacuccuagcccuggagguagcuggauuucucagggguccucugcaucaaauuaacucccccaaucaacucauucaucuuuucgcauucauccgcucuugcacaucucagccugaggcuuggaaaagaacuuuuucuaggcugggugucucagaggcaacagggaacaugaacaaaaagguggcaaaagcauaauucaaugugcgugcugguuuuaaggucaugcacacauuggagcacguucuaugugccaggugccaucccuccuggguccaaaaaugacugaauacaaggcuaauacauagaaauggguagugacaaaaucuaauccuuugaucaccagagaguccaucaccagaacacagcaauaaaaucuugcauguguagagugccuuagaguugccaaagcauuuuguccuucagguaguucuuuguuuugucucacagcauuuuuaugaaguaguggggcaaauauuaucuucucuucauggacgaaagagcugagguuuacugacuugacaguguggaagaacaggccuggggacccuugucacgcuccaugaggccacucaaggccaaggucagugcugugacacuauuccuuucuccuuuuccugauccacucccauccaaaauaaagauuuucaagcugugaugccaagauucuccuuuguaagagguaagugugcagccaggguuggcugcuggucagccaacgccugcugaauugccuaagugugugugagugugugcgugcacacacguguguguggacccagcagggcacuauggccucccacacacgcccugagggcaauuccuucuugguuucugcugaaccaucagccaaguucuuucccaccuuccccuaauauuccuagaaaugacauuucuuuucugugggaaauaaauuuuuguuuauguaucuguuucaucucugaaaauguuccugaaucuauggcucuccaaauuuugaacacuuguuuucuuaagagaauaaaaaaacucaaguucaggagacuucgcaaauaauguucuuuaguuuaaauaaauugaucauugcuugugaguuagacaacauuuuuuuaccuuggauaucuuuuguguuacagggaauuuaguuauuaccuaauuugagucuauaccuaauuuucucuauacuuccuggaccuugugguuguuaguuuucuuuuuguugucagugguuuugguuugguuuuccaugugcaggauucucauuugaccugcuuucuaaauccucucuucgguguuucucuccuacccagucccauucucuuagguuuuccucuuccuuuuuuucuucucccuauuaaaaauucucaaggcaaagggaugagaaucaaggauaucaaggguuaaggugaaagacaguggaaggaagaaguuugcucccuuuuucucuguuuuauccucuggcugaaagaaguagaaauaaauaacguagaugguguugaaacuugggcucccuggagggcaccuaaguagaaccagcaaagcccaauccuggcaccagcugugguugauaaaauagccuaaggguuacaucuucaacaaaguacagaagcuacagauuaaaaauaaaaauaaaaaaggcacauggagugaagggugaugggguaaccugucaggugagccaacuccaggucucuuuaaauacagugaccagccugggcaauauggugaaacuccaucucuacaaaaaauacaaaaauucgucaggcaugguggugcacgccugugaucucagcuacucgggaggcugaggugggaggaucacuugagcccaggagguugaggcuguagugagccgagaucacaccacugcacuccagccugggcaacagagugaaauccugucaaaagaaggaaaaggaggaaagauagaaggaaggagggagggagggaagggagggagggagggaaggaagggagggagggaaggaaggaaggagggagggaaggagggaaggcgggaaggaaggaagggccaaagaggggaagggggaagggggaaagggggaaggagggaaggaaggagggagggagggaaggaaggaaggaaggaagaaaggaagcagaguucaaugccuauuuguguugguguuugcuucaccauuuccaaagcacuuucuucuguguccacuuacuuaagcucuaaugacaggguuccaagucucugauuugguuuccuccaggcugagacaaggugggaucugugagugcccuguucucuaagcaaaaccugcugcagacaaaggaaaauacacaugccccucaacgcacaagaaaggagucuccuccucugcauguaaaauguaagggguccagcagccaagaaggaaauguggcccccgcaagccuagcaggauuugucacucauacaguguaagaaaucagaauuuccucaccucacagaaugggaggaccugaaggaguccuggcgacaauuucguccccucucucuuccucuuguuuuacagaagagaaaacugaaucucaaagacgaggaguggccugucauaggcauuuccuaugcauauuguggucaguucuauuggagaguggguacuaaaauaguaacacuacccuucauuugugauggacuuuaugguuuauacaauuuuuuauuuucauauuaccucauuugcauaucacaaaggucaauguuuaucauucuugcuauuuuauagauggacaaauagaagcuauugggacagguuccucaauaagaguuagcugucuuguccagcaucagagagacaaaauaagcuacugaacuaggauuuaucuguuuauuuguuuauuuauuuugagacgagguuucucgcucugucacccaggcuggagugcagugguacaaacauggcucacugcagccuuaaccucccgggcugaagugauucuuucaccucagccuccugaauagcugggaccacaggcacaggccgccauggcuggcuaauuuuuuuguacuuuuuguagagaugagguuuugccauguugcccaggcuggucucgaacuacugggcugaagcaauccuccugccuuggccucccaaaguacugugauuacagcuugagccaccacgcccagcaggaacuagguuuuaaauccaguccacaggacucgugauccccacucucuuuucacugucccucacugcuucucagauuguuuuaaguguuuacgagguccagauccuuaaucuuuaagaauaagaucugagguacauuauccucagaauguuauagaauaaucccagcauuugagauauggaucugggaauuauuuuuguugugaugaaacccuguggugugccaggugcccugugcaguauuagguaaaaccaaaagauuaccgauaucagcuauuuuuaccacaaaaaagccacuuucacaugguuaauuagaccugacuuucuugagacuagaguagguuucagacaccuuuuuaaaaaaaucuucauggucuucuccugcuuuuguauuuccuauuuguuaaaacaaugugaauuacuuauagaagacaugguuuucuggagguuaauucaggcaaauuagugcuacguucauaaacugagcacugagauuaaaacaugaaugagaugcuaccccuauccugaagaaauacgguuuaaacaggagacaguguuuuuacaguuucuaaaucaggaaucguaagucauaaggagggucugauacacagcagaugcgcaaucaauauugcauaaagggcugaauaagaaaaauggcuaagguauauucaagaccugaccuaagcucuuuaugucugugaucugauguaaugugcacauuaaugcuaugaggaagccacuauccccauugcacacaggaggcaaaggcggcacagggcaguggagcaacagcccaacggucugcauuaguuaguagcggaacugggauggagaccagguguucaguauccaaaguccaagcuuucaacuaauaagcuauucuaaagggaagcaggaagacagaugacagagaguuugcuuggaggcaugcugaguuugaggucccuguaggaucuccagauggcucuguccaauaagaggcagaaauguggcucucaugcuuggcgcuaggcuuggccagaaacacagaugaugaauaccuuauugaucaauaacaacauaauaagugaccuccuuuaaaaucauccucacaugauuuuuauguauuccuauccuaauaccugaacauauuucuagcauuauuucccuugggagcaaauguaaucauuaaaggcucaaacaacuuuucccaguaaauauugauucuuggagucacuugacagguuuaucugauauuuaauuugccaucaaacuacugccauugaucaaauccagggaaaugguugaccuuucacccucaucuguuauuaucaaaccaaaucaucaaacuauuauucggucucaaaaccagcugccuuuuaaaaacaaaaaucuaauuagucuuuuuugguauuuggcuauugaaaagaaaaccaaaaaaaaagaaaaaaugcaaauggccgacauaacacauauuaaaccuagaaucuacugauuuccaucccucagaaaguuguuagcucuaggccagggagaaauaguaugaguugauuuuuccccaguaaaacugcgagggggacaauaucauugguaguggcagcaucaggcugggccacagcaaccagcuuggugauuggccaggaagggacuucuuaaggucaagauccugaccaaaaaggaugagguucaagaccugagcucugguccuggcugaaguggugccucagcugccaccaucuguaauaaguaauguacagguggacacucagguccugcaccccagccaggaugaauaaaucuggucauaucauuacaggauuugacauaaagccuuagcccaacccaagggaccugugauuuuuguuguuuguaugaauuguguuuauuccuccacugcaucauuucaaaacuccacugcaucauuucaaagggugagguggagauggaucauucguaagugacgacagaaucagcaccuacgcauuuccucuuugcacggugccuguguuguucagucauggcuggaugccuagcugcccagaacagcacacccgguucccagugaccuugguucuucccucuuccagaccugaagggugauucucggcacaccaggggcacaguccugauucuacuuuccuguucuuuauccuuaguuacaggcccugucugggaaaccaaaaugaugucucauuuaaagccuaguucucaacuucucccauuuggguuugauugaaucccaaacacguuucuuccacuuuaaaaaaaaaauuuuuuuugagggagggucucacucuaucacccaggcuggagugcaguggcaugaacauggcccccugcagccucgaccuccugggcucaagugauccucccaacucagcauccccaaguagcuaacacuacaggugugugccaccaugcccagcuaauuucuucuguuuuuuguagagauggggucucacuauguugcccaggcuggucucaaacucuugggcucaagugauccucccaccucagccucccaaagugcugggauuacaagugugagccacugcagcuguccuucuuacacuguuaaaugccuuuucuuuaaacucuuggcccacagauggucuuucaagaccucgacugcaucuucaggcacuauccuuugcuauguuuaucucaaaaaugucccccgaaaagccaccauauuugcucauguuuuccucuuuacccuuuuuccuuauucugagcagggaagacuucagucuuuucccccuuucacuuuacccuuuccuacucuauguuguccugacacgcagcagcaagagaagggugucacuuuugaaggcuugauaagcuacaugaacauaaagcuuuggauagauauucuagcccuauauauuaaacauuauuuuauguuauuuuauuuuauuuuugagauggaguuuugcucuuguugcccaggcuggagugcaguggcacgaucucggcuuacugcaaccucugccuccuggguucaagcuacuuuccugccucagccucccgacuagcugggauuacagugaccugcuaccacaucuggaucauuuuuuguauuuuuaguagaaacaggguuucacuggucucgaacuccugaccucaggugauccacccaccucagccucccagagugcugggauuacaggcgugaacaaccgcgucuggcuauauuaaacaucaaagaggaccacgcaacaaggucuuggcagguuaacuguucugaucaccucuucagaggcucugccacaggggauacugagccacuguguaugggauagucccagcuccucucggugggcagaaggaggagaaauuuaauaaaagaacuuucuccaacuaaaccuuucaccacuucuccuucaaccaaauccaaacccuguauuucagcaguaaaagauuuauuaaaaggcuaaauaaaacauuuaguaaaggguaaaugcuugcacgaacuauugaguacucucuuggaaacaucauacagagagcugaccuucuuguaaaagcuucccuucauaccauuguuuuuagagcagauaaagagaugugaaacccagcuugcugcugacucaggccuauggagaaucauacuuugacggauaggaugcaggcccuuggcuuuuaaauuagccauugaguuuuccauuucaccuaauagcauucaacuuaaagagccauacuacuaaagcuuacaugaaauagacugguaauuuacaaugcugauguguucauuuaauuuccacuaacaggaaucuaaauuuuuaguaaaucagauauucaugccaguuggucacugcauucauuuuuugcccuagugggauacuuugcuugaagguuguuuuaaauaaagaguguuguuuggugauagaauuuacugugccauaaaauaaggcaucauaccuacuuaaaucuaauccauuucuuacauguucagcucauauuuuuauuuccucagggaguaucucucuguccacuucaauucccagaguugucucuuauccccaaauucugguauagcaguuaacagucucuauacuauauagcucaauuagaggauguacauaguauuuauaugagcuauugccuccaaccaacuuauaagacucuaguuaacaaaaugcuuuuacauacuuucauguaccucucauugaacuuccugugaagguggcaauuucuauguaaaucucacaaagccuagauccgagccuuccaccuauagggauuuaggugaugacaaucuuuugcaaaaaaggacaacuaaaaauauagauacccauaguuacacacaaacacucacuccacuucugaaugggauuuaacaucauaguguggguugaaaugugugugugauucaauccacacuauuauguuaaaucccacucagagggauuuaacaagcaaaguaaacaaucaaagugugauuugcuuacuuugucuuuagaaguaagcaaaucaggugaucuaccuucaggaucugaaaaauauacaccugggccaucauuagaagaaacccacugccaugcauaaauaauuaaaaagaagacauugccuagcucuuuucaagugauuagggccaaaaacugccccaaagugucaggaguuguuuguguguuugguuuucucacacgcgcauuggauuuugccuguggucauucugccaccccuuaagaucucuuaaggaauuaaaaugaggcaucguuagauuucauuuugauuuuauauucaacgacaaggucuucacaaggucacuauuaauggggugccacaguaugcccccaaaccauauuuuuugcugaagguugauuucuuaccuuaacaaccuauuuuuuauuuguuuuaagaugaguaccguugaccucugggauauuauaauugaaagaauacaucugcuuauuuaggaaaaugugauguaguaaaccaaaggaauuaaguucugggccauauauuuaauuaaugguuuacuuaacaaacagagauuuguuucugaggcaauucaaccaaaucuggccaaugggcauuuucaaggcauugauaaauguacucugaaccaacagacguagcucuccugagaaacaggucugaaacccaugacaaagagcaagucaaacaagguagucaaauaaauucuguccucuucuaucuucuuuuuaaaagacugaaauuuuaguuuaaaaugaguccaaggagggagggaaauaaucuggggacuuuggggaaaauugcccuugagcaaauccccagauuuuaauuuccaugagaaguaacaaguucucuuaagaaaggcagcaugcauaaaaucacuuucuacauuccugucuugcauuauucuccauuggguauuuuuuauguauuuauauacacuuggaauauaugcaaugauccauauguaugcuaaucaaaguucuuagaauguauuacucuuugcucuuucguaaauaaaauaguauaaauugggagcauauuuugucucuguaaaaaugccaacagguaagccggcccuagagaaaaauggaccaaaucaagcucugccagagcucuggaguuuaacugaaagaaagaacaucugauuccugcccagaaagcaacacugaacaccucauuuauuuuggagcagaggcuguugcuggagaagcuggaaggugagauggagcacccuaagguugccgagggcaccacugcucaguguaaacucagauaucuggaaaaugcaaggcuucaaaguuaaggauuggaaaggcaggaggugagcaagccugaggcccuccucagcucagggccuuggccaagcgacaggagcuggacaggggcaagagccaaguggaggagcagugcuuuccgugcgucagcuaucccuccagaggagagucuaaccacauucccgacuccaguucucuuuauucucauaauucuuaaaugacagaagaugaugccuuaauguguuaucuacaucguucugaaaaauacuugcauuuccuuccgucacaucuaaucaaauucauuauaaaaguuccuguuucguaacuacaaaacugcucuaaagaauguuacuuuuuuauuuaaaaaaaaugaaggguuacugggggaaagaaagucuacuuaucaauacuucuuuugacuccaaugacaaaguaaaauauauuucucauuucugguccauucucuuucaauauaaaaugucugugcacucuugcuucauuagacaaagcauuccuuuaauaucuuggucuguuuuuauuugauuuaaagaaugacaguugcaaaaggauaucuaacggaacacuagagguacacagcuuggcacauacaaaauauucugaaugaguuuucuuacagauggaugauucuuuuaagugggcucaguugugugcuuuccccaguuugcaucugagucuuguggucaacugagaagugucuuguucagaacaguaguagagagagaaccagcucauacugucuuauuaauauuuucuggaagcucugauaauuacuuuggaguuucaacuuaacuugcuaacuuucuaguccuuggggguaaaauuuuugcuucuuguuuuaaaaaaaauccaauuaacaaauugcaaccuaugagauagaugcagugaaaaucaacccaaauaggaaauucugcucaauuauuuuccauaugacuugcauggaccagggaggugcugauuuagcagaacgcuaaaccaugauguaaauuuggauccccuguuucccuuuguuccuccucucucuuuuguaaugucugcauuuuggcauuucugcauugccucuuugguuucagagcuuucucaccgagccauuucccguggaaaaaaaaaaaaaaaagaaggaauauagcaauuagcauacauuauguggcuguaccaaaagcuauacucacaaacaugucugcaugacagacaagugggcuguguuucaucuuguuuccuggacugccccguccugcccacagucugccauuugccaacgggaagaagccagcccuucccuuccuccaccaucagcuuucccagcacugcgcgccagucagcuugcgagcucaaaguacuacuuaaugaguuuuuaauucaguuuugacucuggaacccagccagcuacugcugccuggggcuugcauuucccuuuacacauccucggcgaauagucauaaagacaagacgcuucacuguuggauuucuacagggaggauuagcucggccucgggccucacauuaucaccaggucuugcuggcugcagacaaaaaaagggcuaaagggaguuaucucacagagccagggggagaaucaggaagacaccucugagugcugggaagcugcugucucgaccucucuagggagugaacacugcuguuaucagugggccacaguucagugagaacuagacuacacggaauauuuuggaggccaaauuuacaugcauuuuuacaaacagaugcccaucguguaccgggauccuggaauacuccucuccaccaagguuccaguggccacuucuuucucuccccagaggcuggaaaggggucugcacacugcccuuaccucccuggauucuguugacgaucaugaaaucagugcugcuuagggaggcucuguacaagccacagaagcuauuacucuaggagaaaauguugagaaaacucucugaggcuuaaagugcugggauauaccuuguacaugauguaguuucuccuacauuugccaaaccacagcuagcauauuacaggguaaaauuucagggccugggacuugcagccagaagaccuggguuuaaguccucuugccacuagugucauuuggagcaaguaacacugagcccugucuauuaaauggggauaauaauaaugccuacccuaagaguuguugugaggguagaacaugaugggaucucagagcuacugaaauguuugcuaucacuaggauuucucccuucuagucuaucugguucuacaguuaggcuuuguagcuugcucugucacagcacauagcaugcucuaucacggugucucccaacaugcaguacauguucuacuggcaguaugcaagauuggggugauacacuuaugagcuuuuucacauuuuaauaguaaugcauauuuuauauguaaugaauauguuuaugguuauauggcacugcuuuuucaucuaggguagugauauaguccuguucaauaaauggcuaagugaacuaaugaucauuacaucccauccucuuauuuaguggaugggaaaacugagcccaagaggucaugugacuugcccaagguccuguuccugguuuuuggccaggaacaggacuguugguuguucuugguucuuccuccuggccacagacuccuucggaccauugaauccccuaaguaacaucucuauucuauuagcguuuuaaccaacugauguacaacauuuuaaauuccgauuuauuuuagauucugggucuguggacuugacguauauucuaugacuuaaguaucuauucauucauucauugauuugacaaauauauauuaggaacuuccuauaugccagguccuggagauaguggucagcaagacuuccauucuaguaggggcagaggagcaaaaauaaacaaauaauuaagacaauuaucagacaaugauuggcaaagaauuaaaauauggacaugugaaaaaaagcaaauugggugacuauauuuugaccaggggaccaagaaagauuaaggucaaggaauccacuacaaauuagcugacaaaauuaccuuuuauuuguaaaguguaggcuucaguggguccuguacuuugguuuuagccuuucaaaguucucaugguauuaaaauagcaacaguagggcacuguaucauacaagacauauauguccaauugcuaacagguaaacccaguugaaaagagggaaaaaaacaaggaagaaaggaaagagacucuuccaagaaaaauacucauucauggguaaauaucaccuaugaauagagauaaaacccccuaacaaauaaauauuaaaauuguuugaacaaaauacccuugcaaguaaaaacacgcagggaaagcaauguucacccagcggacugagagcucuucuguuuaagaccacaagccuuacccugucccugaggauaugcagaggagcuggaacugaggucccacccaccucagaauggaugucuuaguuaauuacugaaggcaacugcgcugguucccugguuacccugcacaugauuuccaugauccuuugccacugucauaucaggcaugagcucuacaacucagacaagaaagcuggcaccagcaaagagaugaguuggcaacauuaccagggaaacaguucccauccagcccaucaucagccccuuuuuaaacuguaagaagagacccagagaauagccaaauuagugucauucaaugaaggaaccacugcucuucaacucaagaugcccccaaaauucugaugcuaaaaauaaauuucauaccacagaugaugucacccuugucacaguccuggccuagauuaucaacacccucaccugaacuaugaaacaaugccuccuaccuugugaaaacccugggaaccaggucucugggaugaaaugaugcaguccaauuagaagucuuauagcaggcugggcguggcagcucaugccuguaaucccagcaguuugagaggccaagacaggaggaucacuugaacccaggagcucaagaccagccugggcaacauaacaagacucugccucuacaaaaaauuagccagguguggugguacaugucccaaguacuuguccuagcuacuugggauguugaggugggaggaucacuugagccuggaggucaaggcugcaguuagcccugauugugccacuguacuccagucugggugacagagcaagacccugucucaaaaaaaaaaaaaaaaaaaaagaaaaaaaaaaaaagagagagagagaaagaaagaaaagaaaaaagaaaaaagucauauagccuguaacacaggguuacagaaauaugaauuuauauggaucuauuccaaaccucuguuuuacagaugaagacauuaagguucagaaaggcuaagugacuuguccgaagucacacagcaagauaauggcagagccaggaguaaugugcagguauccacacauucacccuccccaaagcaagaggcugagguugcucccacaggaccucaugcccuuacagcucuaugaucccgacaccuccuuccuauauccauacuuuaucccacaccaaauggaagcauucuauuaaaugagcucaucucaaguggcaaaaaaaguaucugauuccuaaucuagacaugacucagauuccuuauuggaagcacagaugggcugcaagagaagcaguuuaagcucaauucuuagguuaccuauuugggucaaugaugguaaaagcauggaaucucauccaguuggcuacaaauguugggcuagaggcaaucacacauccucccuucuuuuggaaaagaaauagacuaggaaacauaacugccuuauuuacaaagcuaucuagagucagagaacucuucacacaguauguccagugagucuucucuccuuagguuucucuauauuuuucuuucuuuuuuuuuuuuuuuuuuuuugagauggagucucauucugucacccaggcuggaguucaguggcgugauauuggcucaccacaaccuccaccucccagguucaagcaauucuccugccucagucucccaaguagcugggacuauaggcacgcaccaccaugcccagcuaauuuuuguauuuuuaggacagacagggugucacuauguuggccaggcuggucucgaucuccugacuucgugaucugcccaccucagccucccaaagugcugggauuacaggcgugagcccccacacccagccgaggcuccucuauauuuuucuuucacagagaccccucaugacaaacuuuaaaugaugagugaaaugaaaauccccacaagugcacuggaaggcuucaagccagguggcauaaucacuccugagcaacacucacugugcuggaauuaauauucugcccgcaugcauucauaaaacuuaaaggacucaaaguggaagagaaaguguuuuuuuaaugaugaugguuuaacauuuaccaagucccuacuauguugggucccgcacaauguguguaagcagcaaagacccuggacuccaccgaggugacagaauuuaagcaaggaagcaaaacccaugugaacaucuuuauuuuuuuuuagaaauauuucauaagcgcuaacauaaaaugauaccuguaacugcagggagcagguaguaagcuuuuuauagggagcuuuuuccuuuuguguuuuuguuaacuuucuuuuucaggaugucuuucguuuucuuaaaaccauuuuauuucaucuuuccuccaagaaguaagagaagaaggagaaaaaaaaaagaugcccccccagucauguuacagcccuuacaucgaagauuuuucaaguuaaucacuuugaaaauaucucagagggaaugaaaaggucuuucaauugucacacugacagugacuuuuacuuuuacaggauaaaaauauuucugccauuauuuugguucuuuccuuucuccccagcucagacacucaucucucgccaaucacacccacuuugcuaguggcaugacuuaauccuucaucacagaauguuagguugcacgcagcacugaguucaguccccugccuggcauggcgugaugugucugcagugcugucuuggacuugaagguccuuuucacucucuggugaugauaacuuaguacuagcucuucauaagguuucugaacuggcugucaauucuguuuuuuucuuuucuuucuuucuuucuuucuuuuuuuuuuuuuuuuuuuugagacggaauuucgcuuugucacccaggcuguaguguaguggcgcgaucucggcucacugcaaccuccgccucccggguucaagcaauucuccugccucagccuccagaauagcugggauuacagacgcccacuacuaugccuggcuaauuuuuguauuuuuaguagaggcaggguuucaucauguuggccaggcuggucuggaacuccugaccucaagugaucugcccgccucagccucccaaagugcugggauuacaggugugagccacugcgcugagccagcucugcuuuuuuucaacaccuauguuuucagcacaccaucagcagaaccuaagugugagcugagggagcagaagucccuugggauagaaaagacaggcagaggaagucaggaaugccacugugacucuucaccaacugcaacuucccuguccaucuaucugcagaauccuggccaugcagggcaagaugcccuuuggguugaaaagagucucacagagagcaguauuuuucauuuguuuguccuuucauuggcacaccagcacuaguacuauuauucauaugagccacaauagccaccauguauugacugcuuauuauguauuguuugaguauuauuaugacauugauuccauuucucaauggcagcuguaugacugacuucacuguacacauggaaaaccaggguauagagagauuaagugauugauccaaagccagguggcuugugagugccaaaguugugacucaaacccacaugcaucuggcauggaggcucaucuucucucucuguccccugaguaccacugagucaaacacccuggcugacucaggguugcacucuucucaguccccuggccugggaucuuugaagguggauguaccagaaucuuaaggagaaacaacauguucuccccaggcccagggguaccauucacuagucauaugauguaaaugguguacacuggaguuaggcaacugaauuguacuauguucuggggucuuucuagccuaugaaauccccagcucucucugggccuaagucuagacccucucauucauccagguaacacuuugaggccccugaccaaugaacugucacuuauuuccauggucagucuagcuugcucuugaagcucuccagagacaaagaagccuguagcaaaucacaaugaggauucuggucccugagguggagagggugggagccccacuguuugcccuagucucuacuuucuguagauuaggagauuucaaagacuaaucaaagauuagucuucuuugauguugccuauauaucugucucaaggaauggaacuagcucuguucauucuucaguaggcuuaaaaugauauacgguagaauaaaaugaugacaucaugaggcuacugacuugauauaaacagaagacaccauggaacaaccaaccacaggaacauucaugaacccucccaccuaaagggacugcaaaaaauaaggcucauuucuaaacaauguaaucagccaggcuauucccagccuacacucauuuccuagacaauagucacacaguuguuuaaauaacaucagcuauuucaagccuggcaaaauaaauacaggcucacagaaaaguauaauuuguaguaaaagaccuaauaccauugcucuugaucaaagaugugauuccuuuuucagagucuuuuccaaaacggaaugaauacagaaaguuuuuuugguuuggauuuuuuuuuuuuuuuaaguuuccaacauacagcugaaaacugcccuuuauucucggucccugauccauaauaacauccucccuccuaccuucugauucccauuuaugcucaaagugaaaauggaaauacaaaaaaaggggaagaagauaaaggaauggcugaaacuucuucccuugcucaguuugaaaacacauuuuuacccuccuccauacaaacuaaaagagucaucacauuuuagcucuacaagacgcuggaggaagacaaggcauagagaaggagcuaguugggugugauucugaugaagcccccacucuuuaccaggugaacguauuauuucguguggcuggaggcugcauguacucaacaaccaugaguaaggccuggaucucacacuauucugucauggaaagucauuuccuuuaaaacugaacucagacucaaaugugaacuugguaugaagcuccuaguuccuguagggccucugaaaucuucacugaauuuucacaaauguuucuuuauuuucaucauugaaugccuugaaggcugccugccucuaaaaucuaucaacgccaauguuuuauggccauuaagagauucuagaaggcacuucuuccuccagggcauaaguuaaaucacugguauaaugguguuuaucaacaauacaacagcagauggucaacuuaaacagauauuuguacauacacagccaagcuugaagauggcccaguguuuacuugcuaguccacaggaaguaggcaucuagugauauuuuucauuauguuaacauacacuaucuaucugccuuuuuaguagcuuccagacaccagacauuuuugcucucuucagagaaauuccaaagaaucaccaaggacuccuaagaaauaaguccaaauguagggacaacagaguaguaacauacuguacuaaucuaaacacucuucuucaaagaaagaucaccuuucuacaguuuuuuuucaguacccuucugugaguuccaaaagcagccuuuuuacaaucuuucaucuaggacuguuuuuuuucuuccagucuugauugcacaagguuccuucucuucuagaggcucugaaagaggcuuuggagacuggcaaacauaaguucaaaucccagcccuacaacuugcuaacuaugaccuugggcugauuauuuaaucucucugacccucagguuccucaaucguacaugggaauaacaguacucacaccccauauggcuguugugaggauuaagugaggucuuacagguaagaagccuggcauguggauacucaagaaauggguguugcuauaaucacuagugauuaggccauguugcccaaaucucuaacuuucugcauaagugaacccuuucaacaucaaauuauaugcauuuacauaaaaccucucugggcccagauucuugucucuaguuaugcuccauucaaaugucuucugcccaugagcacuuauacccaaacugccucaccacauacgagucuuagaacaauaagggcaccagcuuuuuauuacaucaauccuaccugucgccuuccauauucauuuccacugagcccaggauuugggucucauuaggaaaucaccaaaauuucaaguugucauuacuuuaccaaucaauacaucagugguccucuccaaauuagucauacucaaaucacauaauucaaacaccauugaaaacuuccuuccccuucaaccauagggcagcucccuugugcuguguuuaaaggaauccauucacauuuucccaaacaccucuccucuuucuuuucuccaacugcuuuaaucaccuaaaucguuguaugaagugagacaagauuuaagguucauuuagguuugcaucguuuagaguuucccacuaucucuuacuaauacaucagauuacaagggcuaucauaagaaucgggggauaggccaggcacgguggcuuaugccuauaaucccagcacuuugggaggcugaggugagcggaucacaaggucaggauuucgagaccacccuggacaauauagugaaaccccaucucuacuaaaaauacaaaaaauuagccgggcgagguggcaggcaccugaagucccagcuacucgggaggcugaggcaggagaauggcgugaaccccggggggcggagccugcagugagcugagaucgugccacugcacuccagccugggcgaacgcgagacuccaucucaaaaaaaaaaaaaaaaaaaaauuagccagguguaguagcagaugccuguaaucccagcuacuugggaggcugaggcaggagaaucgcuuggacccgggaggcugagguugcagugagccaagaucgugccauugcauuccagccugggugacagagcaagaaagagugauaaaggcuagcauuuaguaacugcuuucuaugugcaaggcauuacugaaacugcuuugccuguauuauuuccuucagcacugucauuucccacaguccagaagcaauuacuggaagguuuugggcuuugcuuuuacagcaagaaucuauuaggggaaacuuaucaggaagguacaggcugucuagucauuuuucuccacuuccagggacugagaucaaucauuccuuuuagauucugcugcccacuugccccugagacccuccccgaucccuguaaucaaagguguccuccccagucaguccccagggaggguggggaagcccauggcucccuguccccgggaaucccaucuccaucuugucccuuggcucucacuggcugcaucccacagcugcagcuguugaccuguguuugcugcuauuugcauuucaaauaaguuaauaaaagcaacgaacuaaauaauaaauuggagauuuguguuuaaaacaacaaugacaaaggccuuugauuaacccacaguaccauagaaaagcaacucaauaauaccacuaaugguacuuuaugcacuuacagggccucucagcugauugucuugggauuucuacaaacauuacccucucauuccaaacugagugaaaaacaacaucuuuggguaggaaaaguaggucaagacagauauaaaagaaaugcacugauuugcauacgguuacaauuaaagucagugaaucauuccuccaucuguuuaacacacauuuucuaagcacugacuaagugcuggucacuggccacuugggcugcugugaggagcugacuuauaauuuauugccuucuacaaauaaaccuacaaggauuaggaacugggaagguuuaacaucuuccagcccguaaugaugcuacuacucaguucugacucgugacuuacaaggucuuugugagucuguuuccucaucuguaaaagggcaguggggaauggggagugaguuuggacuggcuacucuugagagcucuuuucugcucugauacucaguuggaccucugggguacuuuggucuugcucugugucccugugugggucagaggaaacacugcuucccauauugugcacggcaacagaagcuggaaccagaagaaucauguuugagucccuaaaucuuaccaaguccugguuugcaaaaugggaacaacgacaauucuuaucucaggguugcucugagauuuaaaugggguaacauaugggaacugcauuggaaagcacuguccgaaucugaguuaucacaaacguccaugaaaucugaggucagaaguggauagcucaucuuucuacuguccuuaagcaucucuaucauaucuuaugcuuuuacugcucaguuugcacaccauagcucuuauuuuguggccaugcuauuucauuuucaaguugccuuguuuuuguuuacguuuuaagaggaugagauuaaaaaauuuccugcuuucgccuaucgucuucuugcucacuuagucagacagguuucuauuuuuugcugcuaccuuuaauguuuaucccaagagagggcuuaagaaauucaguacauaaggaagugagguugaggagcagaggugguugguacacagguguaggguaccaggcugggcuuuccuguugccuucaugcaguggcagccaggaguagcaagugugguggugggugccauaaaggaaaaccaguguuucugaaggagaggaggugagaagcaggaagagagggcagggaugcaagcuuggggggccauaugcauguucaaaaugaaaaucaagcugggcgcaguggcucacaccuguaaucccaucacuuugggaggccaaggcggguggaucaccugaggucaggaguucaagaccaaccugaccaaugugguaaaacccugucucuacuaaaaauacaaaaauuagccaggcaugguggcaggccccuguaaucccagcuacuugggaggcuaaggcaggagaaucgcuugaaccugaaaggcagagauugcacuaagaugagauugcgccacuguacuccagccugggcaacagagugagacuccgucucaaaaaaaaaaaaaaaaaagaaaagaaaaucaaucaaucaauuaccucuuguacgcuuucagauuuucuacagaaaggcuacucaagacuagagaggaaacuguuaacaaaugaagagauuuuagaaaauauuucaaaaacagccccuaccagucagaacaucaccacucuccugacuccacugaugcugggaacaugguguagacaggcuccaaauaugguuguaugugcaaaacugcauauugucacaaugaaggaccuuaccuuuguguagacuuaaacauccugcuauauuuuucauuuaaucugucacauauucuuauuguuaguauaacuaucagaaacuuccagggacgggaauacauaaaacuauaaccuccauuuuugugccaacacagucucgaugaaucacauucucaauuacuguuuuuauuaaguugguccauagcucaggaaccaccaauggcuccucaguucccucaggauuaaaucccagcuccuugaccuauaauuuaagccauuucaccaguuagcucuuugcuauacaguacucuggggggagcaaaauguaccaaacauaggaucacuacucuugaggaguuuaacaauuuuguugaugaggcgagauuuuguagauaaaaaguuuagaaaauaauauaugcuguuacaaucaagugcuaaaccagugaauggacacaguguguaaggacacgguaacaaugcaccuccaacucaccagaacgucugggcuucccuucgcaggauaugcccuccucagaaaaauacauaagccauuguucaaucuggagucuagaauaaucuagcuucuggggcacccuaaugacauucaauaauuugcagugcaccagcauuuaucaggguaaaaguuccccagauaaaggauuccugguuuagaagacacucugaagaagugcagagauuaacaggaauuaccaggaugcugguucacagcacaaggaaaaaugcacacagaggaaccagugagaugcucagugccuacuggaaucuccagaacuagcagaucuggggaaagaggccccagcaaacaagacacagcuucuaaauuucccaagccuggucacaacuaguggcacaauugcuaggccuggcagccugguucuauuaagcaccucuccaucugguaggggaccuguguuuguuuauucaggaaaacucugguuggcaaaggucaugagcucagcugggcaggaagccggggaccgcugaaugauaaaccucagugcuccaacacuuuguucuggcucucaccugcccauggccaucuguaguggccaaauuagcuaaaaguugucaaacaucccuuugugucauauagauacuacuccugugucuguucacaaauagaugaggcuguuaacaguaaacuggaaugggaccaaaaacauucaauaggucccaaaauaugccagcccgauauccauuuggaggaaagucacucagucuguguggcauuauacaugggcacagagugggaccauccuaauuccuuggcccuaaauccuauucccucugggaacacuucagauacuauuucuagaaaucugagggugucuacagcaacuucacugugauagacacacgagaaugagcuaggaauaagagacgagucauaaagaaaaugaacaccccauggaauuuuagcaaaauaaaaaaauaauauuacuuuaccauucaguauuauuuuguuuugguuuuacuuuuguacaauaugugaaagauuaaaugcaggguauuuuaaugaagaacugccuccuaacuaugguuacaaucugcagauuuuaguccgaaauuauauggugaaggucaucuucccgaccuagggaaaagagauuuuuuuuuuaaaugaacauccuaaaaguaacaguagcaggcuuuggggggaaugucuuugugcaacacugcucauaaggucccacagcugagaccuggagacguuuuugucauuucuauucucauuuguuauucaaaguugaccaauguucucuaaacaaagggaaaggaaucuuuccaaaaaggacuugauugaagacuaacagaaggggaacccagagaaucaagaagggaaaguagacuaaaucugacauguucaaggguuuguauucuuaagaacccgucuucuucaccaccaccaccaccaccacacgccacauaucacccagcucugugaugucccaccaggauucaauuccaacuugucauuacaaaucacccccacacugacuccaggccucacuucugcuugucuucaauuaacuuugaguaagacuauauggaagauggguauccacagaaauggcaagagaccacugcuucuaacacauaguuucagauuuuauguaauuaaaagacuuucugccuuuauaugagugguucuugucaaauccauuguggucccugcaugugugagguagaguuuccagcaggaaaauggcaugggugugacauguccacccucccuccccgcucucucaugugagaucucugcccauggugggcaacaccaucugcugcuguguaacccagcacagcuaacccgcugccuccuguuuuuaaugggaaggaaacaaaagacaaaucugugcaaaaagaagcagcaaacacagaucugaagcaaacacgagguggcucggcaaauacuugacuauagucgggucggaauuuauagaaccugacgccagacauuuccauggugcaauuuccugacuaaauuuuguuuucuuauuuucacuccugugacucuagacaggcuuucuucucagacuucagucagccuugguuucccugugguuccucugguggaauugcguugcugcuuccuguuccagcaggcccagcagacccagcaggcccagcgagcaugagagcagccuggggcccacgcugcagccacuguauguccacaggcugagcugcacaauguucuccucacucacaacaguacuucugaacaaaaauuauuguuuucaagaaacuugguugauuuauaagaaaugcuauaaaaauaccauggggccaggcacgguggcucaugccuguaaucccagcauucugggugaaucacucgaggucaggaguucaagacuauccuggccaacauaguaaaaccccaucucuacuaaaaauacagaaacuggcugcgcguguuggcgggugccuauaaucccagcuacucaggaggcugaggcaggagaauugcuugaacccaggagguggagguugcagugggccgagauugcgccacugcacuccagccugagugacagagugagacucugucuaauaaaauaaaauaaaauaaaacaaccaugggauuuuccaaaugcuuucuuuauucuucaguuuuuccuucacagaccuggugucaguccacauaaugcucaggguaggaaggggagugaacgggguccgaccccagguuuugcagaacaaggaaucccauuuauuucaaagagcuagaggccaauugcuucacugugucccucucuccacuccuggaggaaaaaaacaucuacuuuuuacguaaaaaaaaacauauccauagauaggauaauuuaggaacacacccugcuagaaugcuguucuggugugcaccuuuagaaagaaccacaaucuaaauacaaugugggauaccgcauuggaucauggcaugguaaaaggacauucaguggaaaaccuggagagaucaggaaaaaaucugccauguaguuuaacuaacaggauguuaauuucuuaguuuugauaaaaaguagcacgguuauguaaguugcuaacaguaggggaagcagggugaaggggaaacaagaacucucuguacuaucucugcaacuggucuguaaaucuaaaguuaucuaaaaauaaaaauguguuuagaaaaaggaaucacugugaaaugucaaaagugauuaaaaacacaacccagugaugacacaaugauuauuuacuaucuaaagaacagggagggaacuguaaaaaacacagagagagaggcuggccccugggugagcccagcucagcacugccaguuugggaccacaccuauuucagucucacagagacaguuuuucuuuaaaacccucuaaaaaauuaugaaaacaaauccacacccauuguggacaauauggaugccacaaaugaagaagcagcaagcagaggugucuaaucacuuuacccagagacaaucauccuuguucaucuuugaccauguuuccuuccaguacuuuuuccacauagccauuuuuuuacauaguugagggcacaguggaaacacaauauuuugguccuguuuucuucacuuuauguucuaugaucaaugacuuccccacugcaaugcuuuggacaugacuuguuuguucuugccaaaucucauguugaaauuugauccccaaugugagggugucugaggugaggccuagugggaggggucugggucaugggggcagaucccucaugaauggcuuggugcuguucucaugaagugaguuuguccugguucuggcaagaugggauuaguucccaggagaguggguuguuauaaagcaagauucuuccuucuguuuggucccucuucaaauaugcccacuuucacuuugaccuuugccuccaugucuugaugaaacacaaaagcccccaccagaagccaagcagaugccaacgccaggcuucuuguacagccugcagauccaugagccaaacccccucuuuuuuuacauaaacaauccagccucagguauuccuuuauagcaacacaaaauggaccaagacacccccauuuauccaaagcuuuguaaacauggcacucaacagcugcccgcuaacucugcugugcaucaccuccacagcugaccuacccagacaccaacugcugcacuauuaggaugcaagaaaauuauggcugcuucauaaaaaagagugagaucauguccuuugcagggacauggauggagcuggaggccauuauccuuagcaaacuaaugcaggaacagaacaccaaauacuguauguucucacuuacaagugggagcuaaaugaugaaaauacauggacacaucgaggggaacaacacgcacuggggccuaucggaggguggagggugggaggaggcagaggaucaggaaaaauaacuaauggguacuaggcuuaacaccugggugaugaaauaaucuguacaacaaacccccaugacacacauuuaccuauguaacaaaccugcauuuguacccugaacuuaaaauaaaaguuaaaaaagaaaguuaugggugcuuaaggaaaaaaucuguccuauaugcagcccucucugggcuuaaguuaucccucacuggcaaauuaggcagaacagguaguuccagaauguuuggggucauuucggcuugcagccagucggugaugcuuaaaauauuaauacaugccaguuaccaccagagaaaaauuuaaaacaugagagacaagaaugcaaauuagguuuucugaguaauaacgguauaaaauauuaaauggauucugagucaguaauucauaucuaauaaaguaaaaauagcagauaucaagaccuaggaaacuauggugcuguuuuaaaugggccauucuguuuauauugcacaccaagucaacauauuuauuuuuguaaaagcuaaaugggacuuaauaucagcccaauuucaaaaaauggguaaaaaccuagguauguaaaagaugcggaaauggccuaggccuagcucuuauucuggaaaaugagaucccacaugauauacccacucagacacauacacacagccaaauccuaaaauaaacuuaauccugcuaaggauuuuccucccaguggcgcacucaaguggcuacaucaauauucaggaagaaaaaccaaauaugcauagagaagccagcuuugaggaauacacuuaaauucuuauuucuauuucauuugucccacuuccucccuccuggauauaggguguaucuggaaguagaaaaugaagagaaguucuucccuuuugcccucaccuccugcccucauccccgucccauuuucucuuccaacccaucagcccacuaucucuaugguucugaauaaaagcacagaggggugacagaagaggauagcaguauccccacugagcaaacagacucuguccagaggguguccuggagacgcucaacaaacuguuuaaaaaucaaguucuucuccagccuuagaaggcugggccagagucuuacuaaugagcuagugaucuuuucaauaaagccaacaaaucaccaaacgugucuuauaaaauucaguccucaucugauagaugaugagaccauacagugaaacaaaugucuauuguggaaaaagaaaaacgagauuuugcuuaccgccccuccuaaguuuaaacaggcuuaauuaguacauuuucccgaaagggaauaaaucauuuaguuagaaacaggaaauuucuuuccaaguuaguuugagggaacaaugaggcuuaagaccucagagguggucuacuacauuaaauggcaaaaacggcaauuacuuuugcaccaaacuaguaguuuucuaaaaucuagaaagagcagaaaacugugcagggauuuacaugagaguacuauauucaauuuuuuuaaaaauaagauaaucuuuaaugggcagccacuaugugccagcauugugcuaggugcugguggauacagcaaugaauaagacauggucucuacucucauggagggugagguaguaagcagauaaucacaagcugcaggguacauaacaggggaccuaaauuaauccaggugaaggggaaggcuggguccugaagagggaguaguaauucuuagcuaagugaaaugaguagggaagaaccucaguaaguucaaggagaaagaucagccaugugaaugcuccaaguuggagaguuaggcugccaucuccuaacuccucucccugagcacaccacaguguggcugcucccuuuguacacaguccaaacacauggucugggcuauuucgaagagcauuaaagagcaaggagucuucuccugcauuacugcaaacacaccuccuucccguuccuguuuccuuuucccaccucaacaucuccucggugcguggcaaguggauccacguccuagggcaguggcucuccaagucugaugaacagaagaaucaucuugugagcuuguucaaaaugcagauucccagguccuacccuggaagacccucugaaaacuguacauucauaagugcaaccccugcccuaccaagugguucugaugaauguuuuagcuagccuggucuuucugcaauuaauuugaaaagaaggauauucaaaacuggcaggguaacaucaaggacagguggcugauuuccuagaugcucucagcaaagaucucccuggguaugggcccuucugugggucucagcuggucuccaugaacagaggggcugagggacuguuccccuaauucucagaagacaggaaggagaggggauguuaaggagcccugugcagccucagggugaaauuuucauggaagacaguuucagaaguggcuugacuaagcuguucuuugguuccauaagugcagugcaaaagauggguuuuuaaaaguauuuuauaaaauaauuuccauuuuuaaaaucuuaauaucucucauaacuaucaugaaauuuauacuuaaucaauguagauaauuggcuauaaacugaguaaugccuuauaaucgauuguucugacauuuagagaaacuuaccauucaccuaguuugggugauuuucuuuccuguguaaguaaaagaaacuuuagaaaccacuguccugaacuccgcuuugcauagacuccuuuuaauuuucauguuaacuuggauccgguaagaaggcuuuguuuuccugucuguaaaucugucagugcagacagcaaacuggauccuccucugguucauuuuauagucagcaaguuucccaggcaacaaaccaccaagcccacuccaucaaauaguaaccaauuuuuuccccugacaugucucucaagaccucccucccagcuggccaucagcacaccacucaccuucugucuguacuggaggagaggauggguagucccugggagggcacaggaauacuggccaauugaucacccagcagaugcacagcuggggcguguccucgcaggccuugcccugggcuuccagggaccaagcaucuaugccaggggcuugccuuucuuucucugcauuuugugauuaucugcuuaaugucucacuaccccauaaggguagagaccccuuucuuuuuuuuuuuaaucacuaaaaaggauucauccagugacgcauauuaccuggaauacaaauaguuacagagcaagugaugaggcacagguaaccuucaagauauugccccagcaacaaagaugggccuuucugauucagcuuuaccgagaaaggugacaucuugguucuaggcuuugccauuuucuuuuguuuuuuaagaagauuuugggccagaaacaguggcucacgccuguaaucccagcacuuugggaggccgaggugaguggaucacuugaggucaggaguucgagaccagccuagccaacacggugaaaccuugucucuacuaaaaauacaaaaauuagccagucgugguggcgcaggccuguagucccuuagucccagcuacuugggaggcugaggcaggagaauugcuugaaccugggagucagagguugcagugagccaagaucaugccacugcacuccagccugggccacagaacaagaucugucucaaaaaaaaaaaaaaaaaagaagauuuggauaaaauguauuuuuccaucagacgugaaugacaguauccuugcaucccauagccaaggaggugcugcuuuugaaaaaguuuucaguugccccagaaagaggcugaugcuaugugucaaaagcacauacuuccuguacauggaaugcauuugccucaagccuauaagguucuuaggaguccugccuuggaaaacagaaguuccugaguuaaagaacuucccagugguauuugagggucuucagaauugagcaguaagcucugaggaccagauugcugggaucugaaccccaucuccauuacucacuggcugugugaccuugggcaugcuguuuaaccaugcugugccucagguuccucgugguggcaugaggauaauaauagggccucccucuuggaaggcuaugaggauuacauuggcgcauacacagaaagugcuuagagcagcaccuggcacaugggaagcauuuaguaaacguuaucuacgauuauuguucacuccccucaugaagaucaacgcaggcuggcuucacagagaaaaggggagcaaacccggacucaaauggcacuggcuacgucugagaaaggcaaggccuccuccauaggacaugauucacccacagaaaucacuagaaagguggccugccugacauuauuuuuagcuuuaaugaaaaaagcaaucuaguccaaauuagaugagcugggucacuguaagauccagcccuggggcauuguucagauuuuuugguucuggugucaugcugggcuggaauaaauugauuuaaaagaguuaauaaaaaauucagucucccuccuuccaacuggcauugcaaaggucccuaaaacaucucaacuaauaggcuacuuucuuguaaaagagacucucuuuaaaaaaagaguguaaauuaaaauuaccuagcuuuccaaaaucacucccaaugcgucucuucuuugaccuaucucuuuauccaacuugagccauccuggggggauuccucucaaauugcccacauuucugggucuuacuucacuccucaaugaaauuuaauggauuuggcuggugguucguuacugaacccacguggaacaauaugucaugcuucaugcaugauaaauaaaugacauuucuaaaacaauagggaugaauauaaacugagaucuagagcaagaaccuccaagugaccgcugggcauaucauaauuaacuagugauuuaggacaacucaauuucccaucaucauuguauggggccuuaaggaaauccaccaacacuucacugcuucuugaaggagaugcuuggagucugaauggaauauugucaggugaaauuaggccacuucugaguugugcaacauuccccuucaaaaucuugcugauuaugcaaacacugaauaauuacacugauucauguauuauucuccaucagaaugacaaagcauuagcacuggcaccccauuucacuuugcuaaugaaaaacagcaagcuuuuaagaccaccauccaucaagagagaaaaagaacucauucaguguaaugacaggugcaugacaauggaaacacgguucccucuuuuuuuuuuuuaagcauauggguugcugccaaagauuaaaaucauucugugcuuaauaucauucucuuucuuuguguuccucugagguuucguauuuucuuuuggcagagaaauaaaaagguugaagccagagaucccaaauucccaauaguaucuuucuaucauuucauacuguguuggugagcauuuuccacuaggguuucuaucacugucuuuaaagacuagugcccucccuuucaacaguccagggaacaaaucugcacaaagguaguucuuaaaaacuauuaacaaacugaacugagaagggaauuugucccagacagugcuccccacagcuggacagagcgugauuuucaccaaaacagaguauaauucacaggcagcaccagagauaggcagggauggggcccucuagaaucucacacaagcaacaacagucuccuacaacucagauggccaggggaagagaaggaucuguguuucaguuauaagaaggagugcauucuaguaccucucccacgcagccucuucucaugccuuucuagucauggccuagacuaccucucagaagcauuacuuagcuaauuuucuccccaacacucuaaaaaacuguuuaaaagacccaagcguaacacuucaugugucagaaguucuuuauccagcagcaucagcugugagaaauucagcgugggccuggcaugguggcucaugccuguaauccuaguacuuuugggaagcugagguggggggaucgcuugaggcuaggaguucaagaccggccugggaaacauagcaagaccucgucucuacaaaaaaauuaaaaaauuagcugggcgugaugguggacaccugugguccuagcuacuuuguaggcuaaggagggaggaucucuugagcccaggaguucaaggcugcagugagccaugaucgcaucccugcaccauccugucucugaaaagaaaacuuaaaauuuagcuuugaauucaguaaaaaaacauuaaaagguagagcgagggaaagccucugagcaggcaaaauagauaccacuaagucaaagcacuuacagcucaaagacuuuauacgacggaagacuccuuagggaagauucgggaucaagucucucucucucuuuuucuucuuuagagaggaggucuaacaagcuuagugacuagauuuuccaauccacagcagauucagaacaacaacauagaaggaagguguacuagauugaacaguauuccccacaaauguccacguggaaaccucagaaugugaccucauuuggaaaaagggucuuuauagaagucauuaguuaaaaugaggucacacuggauuagggugggaaucuuauucaaugacugaauaagaagagaaaacacagagacaaacagggagaacacgccacgugacacuggagguagauaauggaaugauacaucuacaagccaaguacgccaaguauugagccuaggaguucaagaccuaccuaggcaacaaaacaagaccuugucuuuacaaaaaaaauaaauaaauuagcugggcaugauggugcacaccugugguucuagcuacuugggaggcuaaggagggaggauggcagaaaucacuagaaaugaggagaaagguauggaacagauucucccucaguacccccagaaggaaccagccuucggccucuuggaaugugagacaauacauuucuguuacuuacgccacccaguugaugauacuuuguuauggcagcccuggggaacuaacauagaagaguacuuagaaacaagcacacugaagguaguuuagaaaaaaacuacuggcagugugauaucgagggaggauaccaagacagauauguuuuuuaaaagacauaugaauuaaaaaaccagagcuggcaucauucugucugguggcaaaccgauacguccucuccaagaagacacugcaaauauaaagacauaauucaauuguggaugacguucauaaugaugaccuugaauugguuuuuaaaaggcuggauucuguugaggguacuuaaacaaggccucacuguacugccucaccccauagcccuaaaaaggaaauguauuuguuugccacuuggauugcacuaaauauuaucuuuucuauuuggcaucucaacacggcaguguauucuuuuguuacuaaauuauugggacuaacauuucacauuuucuucucugggaauccugauaaaauuauacagcuucucuaugauacgugcaaagauguuucuacacuuaguugguauuugucuuucuauagcaacugcacacacucacgcacacacucacacacacacaagagaacacaacagaagaaucuaugauuagaacuccagcauauggacaccuaugcaaucagacuuuucacuauggauuucacacaacaacuagaaaaucuuauuuuuggagaaugaacuaugaagcugggccaagaaugauuauaucuugacuucaaaucacuuaaaaacucuaugccucaaugccaccccucaucuauuaagaaauagaauaaaaaacacagucgaaaauguuuacgcacuacggccuauauaaaaaugacccauaacaguucugcuccacucuauuauuuagccccauaccaugugcuagagucaauuuacuuuuuuuuuuuuuaauugaaacuuaugcuggagaauuuuucuuguucuacuuggggagcacuuuuuuuccugaaaaaaaaucccuuuuuucuuuuauuucaugucuccuuacuuaggcccaaaucuccuuaaaucaucuuuuaaaaugagaaguauauaacuuuauguaaauauauuuuaaauugucuuuuuaagguuuaacuuuacauuuguuuccacauaauuauuccucagcgagcuccggucuccuggcuuagaaacgccuagguacaguuuccccaucucuuuccuggugaucaaggagguuucaggucuucacuguguuaaaccacauagcggaauuuugcagacuaccugccccuccuccuugccugaugaaaugagguggauguagaaacacagucccccuccacaggcagagcagaucccauagcacaauccagucugcacaauaagcgaccgcccaggacuccaucucacaggaagaucuuaaaucacucccuuccacucuggcuuugaaugugcuccaauucgccuuccacucccagccaccuugggggaaguaggaagagugagggucacagggugggcaccaagcccagauggggagggacaccaaacugucacugggugggguuccacaggucucuuuugcuuuugccuugucagcauauuaggauuuggggcuggggacugcauuccagaaauaauaaaaaccacccauuuggagaaacacguggcagggcuuuauagccucugggccucucugcagugcugugcugggagaaacaggcagacagugagaguuccuugcuccaagaugcagggaaggucagccagaaccaguggaaugggauuugcugucguccccaguguaauccagaauuaggguggaaacguuugaaggaguauuuucucuaucuuuuuuaaccaagccuguaaguaauaugauaucacugccuuaggcuuuuuuuucuuuuuuuaaaccaugauccucuugcaaaccaaacauacaaucgucucagaaccucuccauauaaggaauuuccagacagacugauucuaugcaauauuucuugggcuuaauggagaaagucauucuagggcauuguccagcuuucugagucaugccaucaggguacugagaggcuggcucacccaggacaaggccuggccuuucugagccucaggaaagccaugagugagaaaggucacuccgaggcuacugaucccuaagcaaugcauuuaugauuucaagagacccauucaguccagagacagggcuggucugacuauacaauacccagcaugaaggcucugaauucaggacuuuccaugucuuuucuaacgugcaucaaaggccauuaaaaaccugcugaagaaauuaaagacuuguagcuacuauuaagcuccaaccacuuaaauccugcacuggugaccacuggucagccccaccagccaugcucagaugugugucacggcaccagugucucugcagagcaaaggcaaaagggaggggaagagaggagaaaugggaggaaagaaagaaagaagcuggagggcaggagaggaguaaagcguggacauguaccccaggagguaaaagaguuugaggugggagugaaacucugggugcagggaacgguacccuauacuggccuggucaaugcuccagaagacacagacaccaaaaaaagcagauggagucgugugaacgugggaggcugguggguauccaugggcaaugaguggucuggaagcuguagaagaggagaauggugcacccccaaccccaaaagguuucugucuagaaugguuuuauugggcggugauccuuugauucauaacgacucauacccugagauggggauucagacaaaaaaagaaaaauccaagauggacgcuagaaauaauaccagguccacuuugaucuuggcccuuuuauuuuuucauguugccuaaaguuggugauuucauucaucugcauagguguaauaggauugcuucgauaaucacaguuuuaccucuuucagaugcauucuucuugcuggaaaacacuggauauguguaaaucuccucuuuuaacauguuccucccacguuauuuuugucccaguuucugucacaauuaacuuaauaaagaaaggaucuauuuuccuuucccauguugcugaaaauaaauuuaugagugauacuuaauaguugucaggacaugcagcuguuuuucucucccuuaugcgcaccucuucaaaaaccucuauaccaguguucuucaaaugaaggcugcaauacuuuacuguagcaugaaauggucaaagccaguguuucuuaauaguauagaauaaaacagacuagaaaaugucauaaugcauugcagauaauaaggauaggcauuguuuuguuaaacuuuuguuucaauuuuagauguaugcauggaucagccuguauuuucuauaccaugguuaagguaaaagaaguuuguaggacagguccuguggcucuugccuauaaucccagcacuuugggaggcugaggagggcagauugcuugagcccaggaguucaagaccagccugggcaacaugggaaaaccucgucucuacaaaaaauacaaaaauuagcugggcaugguggcaugcaccuguaguccuagcuacuugggaggcugaggcaggaggacuguuugagccucuggaggcggagguugcagugagcugagaccgcgccacugcacuccagccugggugacagaacaagacccugucucaaaaaaaaaaaaaguuuguaauacauccuuauacaauauaugucugaauauguuugucuuuaagguuaaaaacuaaaguccucugaacugggcuuuucuuauguaucagguguacaggauaaagaucugcugccucuaaagucucaauuuuaaaaccaucucuaccacagaugggaugaaauuuagucugaugguaauuucaaacuuagauuuuuauguaagaaaaaaauacauuguuaaacuauauacgagguuuccucauauucagggacagaucucugcuuucauuuuauaaccuccacaagagaaucaaacugccuuucuuacccucaacugugguccuuuccaauaacuuaugucacggcaacuuauuauuaaaaaacgacugaaccaagaugacuucggacaccucugauccaaggguuggcccaaaaggagccucaaucugcuucagcauuggccagacaccccggagacuuacaucuuaccuugcagggcuagaaagugcaucagaaugccaaacuccaaaaaugaauaacgauccagcccuggaagaaaacucucaguucagagaguuggugacuugcccaagguuaaguacaaaauauauuugcagagcagccagaacgagaacccaggcuuccaaguugcagcagccccaguacacugcacugugauaaagguuugauauggaggcacagaccgacccuagagguuaccagaacuggagaucauagauuaguaaguuuuuuucucuuaugacuguuguauguaucuacucuaaccuuaacucagacugacauccguggcuuuucgugccaugucauuauucuaccacauacuauuuugagguuucugagguuaguauucauaagagcuuuccaaccucugacucaaaugagcucuauuuuccccagacacguaacuuacuauugaaucucauuuccaugaggaauacaaaagcgauagugauucaugucuccaaugcuuggcuuaccauuuuugaaaauguguauacuuuuuccugacuguaaaauacuaugugcccacugcauaaaauguaaaaaacacagaaaaagauaaggaagaaaauuaaaauaaccuguucaccuacugcucagugauaacccauauuacaauuugggugucauugaaauugggugucaaggaaaagacaaaaauuauuuugguaucaaauugugaucaaauugaaaaauaccuucaugaacccuucccuugucacucaacauuacacaucaguaaagauucuucgaagauaugguuuauaauaaugcaggccaaauacugaauucuauugauuaaucauuacugauuauacaugcccuauuguugagaacuucagguuuuuuuccaguuuuucacauagagaaauaacguagcaauaagcauuuuuuuacauaacauuuuuugugcauaucucugcuuauuuccauagaauaaauuccugguagggaauuacugggugaaguacgugagcauuucuaugacucuucauauauauugaaaaauuucauuucagaagguuguuuauauccaaauagcagaauaugaaggugccuaucuuguccucuuugccagugaucagugguaucauuuguuaaaaccuugcaacuuggagguaaaaauguguaucuuccuggguucauuuguauuccuuaauuuauaaagagguugaacauuuuucauacguuuauuggccauuugguauguguauaugugugucuuucuccacccaccuucuguguguauguaaauugaauguucauauccuacaccuauuuuucuacugaaauguuaaaguuuuacuuauuuauuuguaagaacucuuuauaucauaaggauauuaaacuuucaacuuuuauauuuggggcaaguacuuuaggaaucucuuuuaauuauguaacaauuuaaagugauaggguggguuagguuuuauauugucaccagcagagcaacaagucaugccaccugcugguaaagaaacagaauaguugauaauucuucauguuuccaagauacgaugcauauuaauacuuuuuccaugucaacuauuuuaaaacuuuggaaaugaaaaaugaguaauugauugaggcuauuuaugacauuucuuacacaugaauccuaugaccaagauccuuugaucacauuuaaauauuuuuaagguuacuucucuacuuaaacggggagaaaaggcuuugauacauauuagauguuaauaagagaaaguauaguucugaaucaucucaaagccauuucuguugucaauucugggcauaggagccuguacuuuguuuuaaggaaucauaauuauugacaaaauuuaacaaucagauaaacagggaggaguaacuuuauuauuuauuuucacaaaagguauuuucaaacagacaucuucaaaccagagcuucagaccuauacagaucauuuaaaaucaauauuugcuugauuuggccagguaaauuaagggaagcuccugccauuuaauucugaaugaagauggaucucagcaguuaaagaucauaagcuuuuuauguaauucaacuagaaaauaugauuuaauuuguggcuuacauaaaacaauagucauggaacauauuuauugccuaucaucccuuguagacuagucuaagaaaauaauacacucaagguucuacagaaauuuaggcugucaagaugauugacuauagcaauagggccaauaggucauugaauucacucauauauguggaggucaacaccagucuacaggaucuaucagcaaauggucugacaugccuaggaagauaaaaauggaauugcugcuuugucauaagccauccuuaugaauaaacugaacugacuuuuuuguacugugaauuauuacucagccuacaguucugacauaaacaaaaaugcaaaucaugcuaauaaccuagccaauuucaugugccauaaacaagccuucaguagcagugaagggcacuuggcccauaggguggaagaagaugcagaaaucagaaucucccugcaacucaaaaugaccaaauguaaaauacucaaaaccaaguucacacauuuuuaauaacaaaauaaaucuugguaugggcuuggcaaaaaauaauaauaauucacauauuauuuaagcacccauauuagcacccucuggacaauauuuuccuuguaguuuggcuuggggucaguagucaaaauguauauguuuauaguuuauaaucagaagaggauacaaaacaacucaaggacacacccuaauuggagggaaagggaguggcuggccaacaauugagucaagguacaaaacauuaggcuaggugugacuuggggcaggaucugacagaggguaguaguaaaaugauuaugaaaaacaacugagaaugucccccuuuuccuuccaucuagauuaugaggucuuggggagaaggagguagguuuuaaauuaucccagagaacugaacccagagaugaggacaagucuuggaugacagggccauacugacagcuuggagaggacacaauugaggcccugggaagaugacccgacuacuccuugagccacccaggaaaagaguaucuggccaucuccagacagcaauuucagcuuccauagucaauugcugauuuccuguuuguaauguccuuccuuugaauuauauuuacauucagguagcuugugguaagagagcuguccuguaugucagauaguucaaggagugcugggggugggaauagaggaaaugagggcaauauuccauagguucaggagaaacucaggggauagcacaugcccauggguauguuuaguacaguaacuagcacuuuacuuaguaccuaggugcucagcacacuuaaguacucagcacaaggcagugccuucuccuuuauuccacacaagggcaucaggacaggugauucagauggucuaguucuuucuagaacacuccaaaguuuccuuccaaccagcucaccaaaugcacuggccuugaagaacuguaaauggagacuccuggucaaauccuguugggcuacaccucaaaacccaguguuauuccaaauucuuucuaaaauaucaguccuacaggagcaauaaucaucuagguaauuggacaugaaaaguccaaugaggaaaaagaaauagcucaccagcugccuuucaaggcaaaacaagaaugcaaauggaaaggucccagggaaaucuggauggaaaauuaucaccucacaagagggucugaucuggauuggauucauccuuuuucacaggaugacucuguuccagggaaacuagaugcuaggaacauucugggauccaaauauggagaacugagaacuauuguaaggguuucuaaaaacucccaagaaaaauucacaaggacucuuuuucuuccagugcuuugggaaaauucaaaaaaccugaaauuccaaagccagucuaauccaggugacccucaaucucauagcuacugggucuacuccacaaggaggaaaucaagacugguaagaguuggcuaccugaccuguacuugcaaaacacugacacaaaugagagagagagagaaaaaaagaaaaccaccaccuuuacucacucaaguaauaaggucaccucagaacacuggcccauguuuugaaaggaaauaauuuuuagaggugaaaaacaaugguugauagguaccaggcauaacccuuugagaugcaaguacuauugccaauuaaugccauuggacagaugagaaaguuaaggcucggagcaaucccauaagcugccuacaguuacauagcccaguaaaagccagagcugguauuugaaccuagauuuucugacucaggguuauuguuagauugcuugaaaggaggccacaacucccuaccccaagucugacaaugauuuucuuccuauugcgggaggggcuggaaaugacugauaaaaauuauacucuuccaccaacucagcucugggcucaaagcaucugaaacaucaggauuccaccucgcuccugauuaauuuuuucauaugggaagggaacuaagagccuuacccugagacauaaggaaugagacuuuaagacauacuagaucaaugccaucacgaaaaagcaaaauauuucagaggucugaugggaccagccgccugccuuccuuuucuacucagcaguggccaagucucugccuuccuuuuucaggaacauuuucugcagcagggcccaggccauugugagcuuugagaagaaugauauucugcuuuuguaagaaaaggaggagauuucccaggcaugcuuugugucccagacgcuuucacuaauugauagagugccacuacagaguauauuuuuauucaugcagucagcacaugccugcuucuacguuuucaaguuuucuuuaaaaaaaaaaaauucuccuaugugguaagacaacagcuuccguuaacaaaaugaagcaaaaccaaauucuucuuaaugaaaaugaaaaugucaauaggacuucucuccucaugcuaauccccuguuugacaugcaaugacaucauccccuagaagcuggagacaaauguaaugucugcuauaauuacaaggcuuacccugcagaagaagggagguggccgugaggugcaggcaagcccuucucacugggcccuccuuggaaauacaauggaacccacuaaugcagugagggagucuugcugcgacaauacuaaaaggagcagaaaucaaaggacuucacugaccauggauucaggcuugauguucugauacaaaguuuauauccccaaguagcaauuuaaauaaaauugcauuuuucuuuuucaaucaaaucaaacuguggugucacaaaagacaacauguacacacacaaaacucucacucacaaacaugugaaaacuaaaguuaaaaaagaaagcccucauucauaagguguucacauagugacaauaagaaugcaugugacacuuuuggcggaagcuggagguugcaggaagggauuuuccacaauauccauaaagaagaaagggaguuuugaaaugugacagauucugauuaaagaaaaauggaaauguuuggcucuugggaacuucaaguauagagaacugauaaugcuacaaagaaaccauaauccugaaccaauuauggcugaauaauacuguagacuuuauaaugguacaguugguuugaacacugagucaagaugaaucagcuuuuccugcuuuaccaacauuucuuauucauuuccuugaauggcaaguuaaaagcauuaaucauuauuaagacugucuuuguauuuuguaaaagcauuguuauuuaaacaucucuuaaaaauguauuucuacacuuuacaugccuuauagcuacugaauuuucauaaauccucuguaaaguagguucauagauaaggaaacugaggcacagagaccuugugcaugaggugaagcccauauuugaacuuggccacuguagcuccugggcccccacgcuuuaccauucugcuggacucaaagaagguuggaaaguuuuugacacacucuucaaauaccugccccuaauccuaggaugcaagacaggaaaaagaagcuuacugcaggguaucagauaccuccuuuuccacugcucuccaucccgccuccagcgccucaccucagaucccaacagagcuggggguagaggagagagcuguucugcguuacagccugagcuggacaguugucucaggaaaaacaccuguaaguacaggcagaggcaggaggauccuggagaggagugcaugcuggucauggucuguaauauuuguacaaagaagaaaugcaaguucuaucuaauucucuaggauuacaggcagaaacuuggacaguaaagacagacuauuucuucccaggcuagcaucccacgccagaugcauggcugcucagggaccauggacccaggguggagguuauacaccugaaccugacuuccagguucuagaugagcggguaaaauugccagcucccaagugggcagccuugcuaaggagucccuacaacccucugcuggcaaaugcugaaccuggacagggaguuucagggauuccugaaccuccuucuuauacaggaaggaggaaacaaacagagcucuaaaugggaccuuugaaaagacucugcagcacaaggaaaaaugagcacugucuugagauuugguggaaaaaauauaucucuaaaaaugacuuuccauaggaacaaaauaaaauuuuagaaaaugacacuuggcuccuauaaaagaugcagacguugccacuaugaaacgacagagaacaauaaaaacagggugggcugaaugacaggcagagauuuagaaagaaguccccaguggaaugaacaaaagaauucaaggaaauacaaaaugcaauagcagaauuuaaaucugcauuuaaggcacucaagagcagaacaaauccugcagaauauugacccagugauguacaggacaaaugugaaauguucuccuagaauacacagaagaagaucgaagaggaaaugaugaguuggaggaugagaucuaagaaguuccauuuuaagaauuauacauauucuuaaggcugaaaucagaacaggaagagaaacaaugauaagagcacaugggaaagaacuuugcuagcggaaaaaagucuccaggcugaaaggguucagagcauuucagaaaaaaauuaaugaaaaauacuuguaucucaacauuuccuuacaccguauuuuaauuucagauagauucagaucagcugagauuugugcacacgcuacugagaaaauuacuucgcaacugaauuaugaacaccuucaaguaaaauacuacauagaacaagaaaaucuguucuucauuagauuuaauggugaaggcaggcuuuauuuuuuccaacaagggccauugguucuaaauaauauacagguuauuugcuucaguaauauccuccaaguaauagaaguaucuuuauaugcaaaaguugaaauuuuagauacuucaucacauaggaccaagagauaucaaucaacaugguagaaaagaaguggacauuucaaccaaaaaguaaaugguguaugaaagauaaucagacgugaugcaagaaggcugcguacuguuggccugaagaaagcaaacacucugagagaugacuggccuaacaaugaccaggugaggaacucauaagcaaguacagagaagacacugggaggaagguauugaaugaaccucuaaguaccauggacauaaacuaugauucuauaggcacucuggagcccuaauuauguuacaacacaaaccuuuccauucugaucucagaaauguugguugcuuuccuuucucuauuuaucauuagaauuuuugcagcccagaaaacuugucaucaaucccauguuuuuaagaggccaauaaauauucagauaguuuucuuuuacuuuauucuuaacucagagcagaguaguggaauccuuauaagaauaucuuaugaaaauauuuuagaaucacuucuauuggauuguuccuauuuccucagaaaugugcuauuauaaccucacauugauccauaugaaguccaggauaaaucugcguacucuauaccuauaaaacuaggcugaauugcuaaugcuguauuaaaaaggaaacauaagggaaaauaauaauaauaaaauuaauuuuuaaaaagggaaaaauacaguguccaaugucuuaaauguaaaauaaaaagcacucuucauaaaucucagcucuaaaguuuacuuaccccuuaccacaucaguuucuccuuuuacauauuuagauagcaccauauuauuuucccuccuacuuagcacagcuuguaauacaaauuugugugacuauuucaucaaugucugucuccucaccuugacugagagcuccaugggagaccguauagggacugugucuucauuugcuuauuuuuauuaaccuuaguacugacacauuaccagaucccauuagacaaacaauauauuugugaaaugaguauauucagccaagcaaguaauuguguccuaagaaucucaaaaaacuuucuggaaaaaccacacaucuugguuuauacaucagcuauguuugccaacuuuauauguaaacuauuuuuugaaaaaacauuauuugaaugacuuuuuucacuuguaugagagaauauuaacauaaauaggaccuuagagauaauaaaacugaaguucauaaaugcuaggcaacuuguccacaauggcacaaaucuacuuagcaguagaacugggauuaaagcucagauuuucugcccccgguuccauuccuuaagugcucuguccauggaguucaagacacuggcucuuuaccagagcuucuagacugccaagucucugaaaaguaauugauaguuuuuguaaauaaacacuuuaccacaucuuaauguuuaaaggaaaucugcaacaaagaaauuguuugcaauauagauaauuaauaaaagaugugagauuucuuaugcaguuuauuuuucaaaccuaagcgcuaacuuuaguuucucaagccuaugacaccucaucauucauugucauacacauacuaagcccacaugccuggcacuauucuaaggcucuuuaucaagggccauuaauuagccuaaggccucccuauuucgaugguuaaaagauaauugcauuccuuuuuucuuaugauucaguugacauugggaaaaagccauuucugaaaaguuagaauucggaaagauuaaacaauguaucccuaugauuauuuaauuuaagcccuuucgucuuuuuguuuguucauuuuuuuuuuuuccacuuuucuucuuuuuaaacuguaaguugggauuuuuaaaauuucuuuuuaauuaauuuauuuuauuuuauuuuauuuguaacuagcuucaaauuugugaugaauuugcucaccaagcauagaaaauccauuugcuggcuaaaggacucuagcaauagaauuucuaucugaugacagaaucauauuucuagaugaccccuggagagaguuaauuugccaaacuauuucauuuauauuuauacgcuggaauguuauuccaaaggcuccaaauagucucuguucuauguguaaaacaauaaaauaaagauaagacauugucuaauaauuuguauaacuaauacauaauguaaugcuucuuuaaaaagcaggcacugaucucauguuagauguuuuaaaauaaacccaaaccagcauuauuuguagaccacaagccugugacugguggcagggaggacacaauaagaaaaagaagaaggagagaagaaaaacaagugggaaauaggugacugcagcggagaggggaaaacgcgugagggauaccaaagagaaaacaacggaaggaaaggagguaaacccauaggaagugucaguuuuuucaucaacagauauuuacuuuuuuuuuuuuuuaggacggagucucacucugucagcuaggcuagagugcaguggcacaaucucggcucacugcaaccucugccucccagguucaagagauuuuccugccucagccucccgaguagcugggacuacaggugccugccaccacgccuggcuaauuuuuucuauuuuuaguagagacaggguuucgccauguuggccaggcuggucuugaacuccugaucucaagugaucugcccaccuuggccucccaaagugcugggauuacaggcgugagccaccacacccggcccuauuuacuuggaucuucuaaugcuucuugaaaagcgaaauacauuuugauacaauauaaaaacaaagccauacacauacacacacacauacaauuacauauguacauguaaauggcuacacaauuagcuagacaaccuugucucuuccuaggaucuaaagauauuccagauaaaucuuaaagcacaagugauuaagccuuuaaaaaaaaucucacuucucaucucucuuaccuuuugguuggauucuuguguuuauuagcuuauuuggagggagauggugcaacagagaaggcaauugucuauuuaaaaaauuacguuuucagccaaaugcaguggcucacacuguaaucccagcacuuugggaggccaaggcaggaggacugcuugaggccaggagauugagaccagccugggcaacuuagcaaggcccugucucuacaaaaauuuaaaaaugaaaauauaaaauuaguuguuugccuuggcaugugccuacagcccuagcuacuuaggaagcugaggugggaagauuacuggagcccagaaauucaaggcugcagugaaccaugacggugccacugcacuccagccugggcgcagagugagacccuuucucaaaaaauaaaauaaaauaaaaauuauguuuucauaggcaaggggauacaggaaguagaaagaaaaaaaugguugggacuuagaggcgggugcaccccacuguaugcacaucaggacagugcaaaugcagugagcuagugcauacuugcaaacucagguauuuucuucgaauaaccuagaagauagccauggucucuuuuuucacacuuucuuuuuucucuguagcaguuuugaguguuuuuuuuuuuuuuuaaaacaauaucugcaaucaaugacucuuuuucagaaggacuauaacauccagggauauuccuuguucuauauugaagcacaaucauauuaguauugaggacaccaccucaaaauaaauaguuugcucacuaaugauucagugauaagaaaucgcuacuaauccgcacacccucauguuuacaguauaauuaccaauagguucaucaugaggacccugaggcacagagagaugaucuuccuccugagucuuccaaggaagauucaauucuacuguucugaguuuggguuccaaguagguagcacggugugcacucaucuugccugaaugcaugucucuugaacuauauuucaauaaaaugccaguaucuaccuaaggggaacaauauguccuuuuuuaaaaaaagacugucuuugaagauauuauucuauuugggugggagaagaaacaacagauuuguaaguucaugucuucuauaaauaauuuaaguauaucuugggcuaauguauaaauuugguuuaggaaauucuaaguuaauucuagauaaauuuuagguguuuguguaaaagaaaugacuguauuauuggauucuacaacuuugaaaaauaauaaucccacgagggauuauuggcaacucucaauuagcuagaauauuugauuaaccaaaacguauuauccauggauauauuaucauuaauguuguuauuguacauaaauuauuucuuucuguuauuuuagaauacuugguaagcuuuguuguaaacacauaauaucacaccuagguuuuuuuuuaacuuuuuuaaaauuauacuuuaaguucugggauacaugugcaaaauguggagguuuguuacauagguauacacgugccauggugguuugcuguacccaucagacgccuagguuuuaaugagugaauuaacacuuuuuugcaaauaugaucaaauuagggauggaacaaauugaaguuuuuaccuuaaagguauuaaaaaucaacagccauucaaagauauauuaccacaaaaaucacuuuuccuucuggauaaucaugacuuucugauaaugauuaccugcauguaaauuguacacugucaguaauaaucugauucgaaaauugcuuccuucccaaggguguucauaucugcauguacuaacuugcuaaauuauggugugcuaauugguaguucacaugacaagauaugcacaguugaccaugcuuauuaaaauucaggccauccgcaguuagcgauaacaaacaaugugccugggacuuuuaacaccuucaaccugcagauaaucccuagaacucuugagguucaaucuucagccuccuuccaaagaucagugaauaagcagcuaaccugaagcucaaugcaacaccagauaccaacauggaaauucucauuuuaaugggaaacauauguagcuauuuccuauuuggcacugugaagauaaaacacccaugagcugacuuuggggauagucucuaugcaaguguuugacauugugcaaacaugauuaaauuuugucuuguuugguuugucugcaagguaaagacaggugggaaaagccagggccaagaauucccaaacugggaaaucagccugagugucauaaagcugugcaucuuuccuaaaauuaagaauacucauggaugggacaggcaguuuuuucuaaaugaaauucuuucauugauauuuuaaagccuggauuaaaagccauuguaagcugaaugaaguaagacaagcucccaucuacauacgagugaugagacaauuuaguaaaaauucauagaauaauggaauaaaaaaacuggaagggacucagcaaucauuuaauccauccuuucccagauuguguuuuacaggaaucuagauccaugggagagaguggugauagaagugacuagucaaauaggcuaaggaaauguaugguuagacaaaauugaacaaguuuauacacauacaauuuaugccuccucaaaaaauuagauggaguaugucacaguuuucaaacuuaagucaccaugaaauucuuuuccacugacuauuaauguuuugcagaacuaauggcuggcagaacaaaguuaagaugaccugaucuagccuaaucccuuuauuuuacagaaaaggaaaggacugacagcagcucuucagggagcaccaugggcaacaaugcucucagguguggcccagagcugcugcacuaggucaggcuuccuggucucuccggagggggaaggguccuggaaagcagcuugcaauugguguccccucccugcuucccucaacacagggacagcugaaucagacacucuccaaaguacccauucuagccucagggcagugaaacaauuacuucacauuuauuuccuuaaaacauuucacuuucacaaucucuucccuagugucuucagagucugccaauggacaauuuuccagcacucaaagauaaagacaaucuugaaauuaagcuuauacauccaggucaggaguuuuguucucacaugauuucagaagggugaauucuuaaauuaucgauucuaacucuucaucauugaauuaaugggcuuaaucuaaaauguagcuccaaacuaggaaauauuuuaauucaggcuggauucaaaauucccuggucacaaagaugauucagugcauuaggaucuguugcauuuaugccccaauuugcauggauaauauuauuuuaaugcuuuuuuuaugcacacagauuuuuuuaaaauagccugaacaaauagaauuuacagaaggaccuccuugcaaaauucucauuuggcacuuauuauagacuggcuuguuucauuaguuaucuuauuuccauacucaauuguaaacaacugaagacaggauuuacuuacaagucuucuuauggccugcagagcuaggaacugaacugugccuugcugcaggaacauaaauauuuaaugacagauuggcugauaauaggacacuaacaggacaccuucaaaaggagauaccauauaaaaugaaaggauugucuccuuuauaauagaugagaacagauaagguuuucucucucucucuuucucucauguaugcaaacacacacacacaaacacauaugcacauuauacuaaacuaacuacaaggcacuugagcaucuuguggggcugcuggaacuucacaccaaauaccacuuucaauugaauugcaccaccaaaaacuccuaguauuugagcugggaaacuaucuggaauucuagauaaaaaagcgguugcuacaucaucccuaaacaggcaucgagcuccauuaaaaagaggaagaauucucuuaggcaguuuucacaucuuucacacaucaaaacuuccaagugagagguuuuuaaaaggcacaagagacaacugcucaaaauggcucugcacuaaggaagcauuguucgccuggguuccagaacuuauuugaucuuuaauuuuauugcaauaaggauaacuucuccaaaugugacauucccauugauggauacacuucaggauccaaaaagccacaucuauguagagcaguguuccuggggccaggugcacuaaaaacguguugcucccucaggggaauagcuguuccuuccucgcacuauccacgugagaagccaacaagaaaucugaauuugagccacaaugcucaacaguggcguguuuacucacagcucccauugaaaaccuguuuuauugagaaagaaauggccagauuaauggcaaagugcguguuuagaggacuucccucuaugacaacaaagacaguccucaggauguucauauuucgucuuaaccccucaggaaugcaaggcagcaauuuugagaggcaaccucagcuugaguguuucaaaugaggugcgguacaacugcagagaggagccacauucaauaaaacacuacccuagcuuuucaauuuucauuccuaauuacuuacuuuuauuuuuaaaucacauguagacgcucuuguugcauuuucuauaagcaucaauuucaccaguccugacuauaggcaauccuuuaaccuagaagaguuuauuaaaauaacauuauuauugucuuguauuuauguuaauuucuccagucccuguggugcacuaagugcgcuuccccagaguaccucuuacuuucucacguuucucucagaccaaggaaaucugacuucacaugcaauagaaauuacccuuagaucacagccgagaaaacaaaagggguaagcccuggaguaugaugucuggggauacuugaucguugccuagguagcauuuaauuaguccuggguugcagcugggaguggggugcugguaccuggguaaccuuugucauugugacuaaacccaugguugaacaaucaaaaugcaaugcuuauuauacucuccauuuucaccccuuucuucuuuaggaauuagacacacacacucucucuuucucucucucugacacauauacacaguucgcaaauuaagagaacucucacgcugggcagggugacucacaccuguaaucucaacacuuugggaagugggggcaggaggaucgcuugaggccaggaguucaagaccagacugggcaacagagugagacuccuucucuacaaaauaauuuaaaaacuagcugggcauaggccgggugcgguggcucacgccuguaaucccagcacuuugggaggccgaggcgggcagaucacgaggucaggagaucgagaccauccuggcuaacacagugaaacccugucucuacuaaaaauacaaaaaauuagccgggcgucguggcgggcgccuguagucccagcuacucgggagccugaggcaggagaauggcgugaaccugggaggcauagcuugcagugagccgagaucgcaccacugcacuccagccugggcgacagagugagacuccaucuucaaaaaaaacuaaaaaaaaaacaaaaaaaacaaauuagcugggcauaguggcaggcugguagucccagcuauuucagaggcugagacgagaggguagcuucaucccaggaggcagagacugcagugagcuguaauugcaccacugcacuccagccugggugacagaggggagaaccugucucaaaaacaaaaagagauuaaaaaaauaaaaagaaacucucuuucuuuguugagaaacacagugaauuuuaaagcugugaaugacuuauuuucccaacaaaauuauaaacagugggaaauacuucauucuuccaaauauucccuuacaguugcuuucuuauuaauaagcacucaaaaacauuacuuggcacuuuuaaagugaucuauuaguuuaugcuuuauucuucaucuuccaccauuauuucuaguaggcuaccauaggugcugaacaaacugccccagaggaagaccaaaaagcaggcagaaaaagcaaagagacugugcuugcuugaugguuugcuguugcugcauacuuaaaaaaaaccuuuaaaaaaaaacucuacuaacaaaaaucaugagcucucuuuggucucuggagaugaagacaaaagcagugacacucagcaugaggugcuguccuugguuagcagcugucguggaacgcacuuaguuggguuuaauggagggguuauugacaucuccuaaaauggcuccugggcccaggcagcccauuuucugcuaccuuccugccuaugccugucuaugcugagugguuccacagugcccauuaggaacugcgugagagccauuacagucagcagaguaaaacauccuuuccacucuuaaaaaaaaaaaaaaaaagugagaugaauagguauuucuaggguggucugaaagagcccauuauuaacuacccugaggaaugaggaagccugaacauggcagugaaaugccauuuuauuccuuucugcuggccacaccugcaccaagggaaaaaauucccuuguaugugaggaucuggauauaaagaauccugaaauuugaaaguugaccaagauguaaagcuugcaggaauuaugccuuaugcugcguacacuauaaaauucuaaucuucuccuuggaaggucuggcucuuucaccgcuagaaaaggaugcaggugggggugacugggcugucugcugcuugggcggcaaagucucaaugggagcacuggggugagagcggacagcaugaggagcugccgaucacucuguucccugcaaccgggccaggagggcucagggcacggggcaagugggagaaaggcuagggauuugcauuaaaaugggacucuccuucccaggcaggcagcaaugaccucaaggaauauuaaacagagaucugguuaccuuaacgaauauaaugcucucuauuugucauuuucuucuaacauaccacgauuucuccuauaaccuuguaugaugaugcaaugaggaaagaugagcagagccucacaggcauggggacaaguaccuagaccugugcguguacacaaacaacacagaaaacaugaggauaaagaaucggcugucccucugaaauugcagguucccugagggugagucagccccuugaaugccgcuagaacauauauuugugugccuuauuguuuaaagguuggagcagggcugaaaacacauucauuacucccugucauagagcaguugauguauucuaggcacauacaauuaagcuauaauucuacacacaacagacuaaacacacaagucuagacagagaaagauggcuuaaaauauucuuagaccuuuucuaagaguauuuucucauuuucuuaucacucaacugguaaauauuaguuguaacccgugccucauuaaugucaaagggagaagauucgcaugacugaaauucaaagggcugauucuaauucuccaucgaaaaccaaucuccaggcaagauguuuuuagcaaucacucagcacaaaucuaaagaugcucagcugugguucguuuaucuucuaggaaaaaggcaucgguucuuaaaacaaaacugcccauauacaccauccaucacauuuuaugaugauuuuugugaaugugaucuagauguuauaaaacuagugacaaaauguaaauauaucaaggucuuacuguguauucagcuaagaaaauaaaccacaagaaaucuguuucuuaaaccuggcaacgucuauagucaccuguugauuggugagagcagaagagaaaagcgaguguagaacggcguggagggagugaccauggauggguuaucauagcaaggaggcaggccagcccucaaacugugcacacguucccugacagcccuugcgugggcacccacaggaccauuuugcaaauggucuccaacccccucucaggcucugcuuuaccagccagcacuuuaaagcauugccggcuuuuugcucucaagcccaaaggaccuuagaagcucagccauagaauguugucacccuuuacacauagucagcagcucugcgccuucugagaaugcugaaagcagucguuucucugagaaacaucuuuaauacaaauuuaaaauuacuacaaaaaggaaacuagccaaauaucaauacccgguauuucccacggauaauaacaaucaccaaauauacaagucaaauagauacuccagaagggagacagcacucguucacauuuguuuccaugugacaagcccugucuuaagagcuuuacacacuuuaauucauuugaucugcauugaaacuaugagguggggccgggcgcaguggcucacgccuguaaucccagugcuuugggaggcugaagugggcggaugaugaggucaggagaucgagaccauccuggcuaaugcagugaaaccccgucucuacuaaaaauacaaaaaaaaauagccaggcaugguggugggcgccuguagucccagcuacucgggagacugaagcaggagaauggugugaacccgggaggcggagcuugcugugagccgagauugcgccacugcacuccagccugggcaacagagcaagacucuaucucaaaaaaaaaaaaaaaaagaaagaaacuaugagguggaacugaucauccuuguuuacaaacaagaagacugaaaacgguuaguuaacuuguccaagaugacacagcaaauaaaccgugggguuaagaucaaacaaggcaguuugacuccagaaucuguacucuucaucauuaugcuaggcugcugaugaggagucagaugaucaaaauuuuuaaauuauuuuaauaggcagauaaaaguggcaaaauuaagggaaaaaauaaaaauugaaacugauuuucagucugacaucacuuguccugagaauaguuuuuauuuguuugcuuguuucaaaaugaugucugucuacgacagauaauuauggggcacuucuuacaaccccugggagauauccuucuuuacuacuauacauagacaguccuaaaguuacauuugggaaagaagcaaauggcaacggaaaaugaaauaaacccuguacagcaugguaagccuagcuuugcuuuuguggucagacuuaaccaaaaugauucucauccaacaugauuaggguacaaaaaacauaugauauaauagguaaauaaaaauuuuaugauaguauuuaaaaucauaacuuuaaagaaauauaagacuguuguucuggccgggcacaguggcucacaccuauaaucccagaacuuugaggccaaggcagacagauugcuugagcucaggaguucgagaucagccugggcaacauggggaaauccaaucucuacaaaacauacaaaaaauuaccuaggugugauggugcacaccuauggucccagcuacucaggaggcugagguggggggaucauuugagcccaggagguugagguugcagugagccaagauugcaccacugcacuccagccugggcgaugacauagcuaagacuguuucaaaacaacaacaacaacaacaaaagacuguugcucuauuuugaaaagacucaacuacugaacuuuccuuugaguaaaagauuagagaguguucauaaaggaacaccuaaccuuuucuuucaagaugacuguucucacuugauccagcuuagauguggccaggaauggcuuuacaucaaggcaaaucagcagagaccugcccugggcacacagcaaagguuuguugagugaucuuuaggcaaggcaaggcugcaauaguaaggcaaaauaauaguaagauaagcccagaugacugaccacuccaagaauuacaguaugccagaguuggacagagcuuaaagaucacagaacuaacauucuggggaacugaggcacccaccacccaccuuguguacagaaagcacucauauuucagauuccugcucaaaggauauuauucaagaugacuaagucuuucagaguggucuugaaugagaccuacaauccugaagaaauagucaaaucaaaucucaaaaccauauuuaaaaacuaguauaagggauaaacuaguauaaaggaaucaaucuugugccauuugcacaaucuguuagcugcaauuugaggcuaucuucagucuuuacaagugaacuccaauuauuaaaaaacaacaaaagcuaucauaaccaacaggaacauaagacagauauaugggugacuugagccuuaauuuacuuaugucauaaaaggcaauaaauauuuuacuauaacucugcuggccuuaaaacaaaacaaaacuguggcugggcaugguggcucaugccuauaauccuagcacuuugggaggccaaggcagguggauugcuagagcccaggaguuuaagaccagccugggcaacauagugagaccccgucucuauguuuuuuuaaacccaaaccucccaaaaaucuguuugaagccuggauuugaugcagggggcuagauuuuauguuggucuguauaugauuguuaaaugccuucuccucucacaagaauauaaguguaauaaagguaaugacuguauuuguuuuguucuucacaguguccucacucaccaagcacccuauaaugccugguauauuguaggugcuauuuuuaacaauguuuuaccuggcugaaaaauggcucuauuuuuuuuuaggggauccauccuucaucuugcuccuugguucuaaguuaauuuaagauucuugaaauuaggcaggugugguggcauguaccuguaaucccagcuacuuggaaggcugaggugggagggucauuugagcccaggaguuugagagcagccugggcaacauagugagacccugucucaaaaaacaaugaaagauucuugaaacucuaaaggaaaauguucagcuaauuccauuucaggggaacugaaguacaugaguuagcuagagaccacuagacuuggacccacuuaaaaacagacuucaaauuuuuccauaaaaccuuuccaguuuguucaggaaaagcuaaaggcuucccugggcccaauccagugaucauccugugaucuccaugucuucuuauccucuaacaucucuucucuuuaaaacacacuuaucugaaacugaaucugacaugugcuuuuaucaccuuacaguccugguuggaaaccuucaugcuccccacacaggagcaugacuauaauggcucuauucuagaugcuuaauucccagaggggagccuuggccuguaaagcguacucauaggcuugacagggaaagucguaauaucaguccuuucuagcauuggcaagaauaguaaagaugcuguguguccaaaggccaaucuccaaacacagccucuagcauaacacuauacaacuagguagguaacuaauccuuacugaaggugauagcaggagaaaggagaggagaaugggguacauuaggcuaaagugacaguuugggggaacuugaucuuccuacuccacaggagcaauacuaggucuugggucuagaaaugguuaauucuucagcaaugcuugcagccuuucauuaugcaauaugcaguugucacucuauaaagucaguccaaauaugaaugaacacaaugagaaccacaugacuuguacacacaaaaaaagaagucuuacaaacaaucauaguaaaaaagccagaacaaccuacagagaaaaaauaaaagcuuguaguuuuuacauuuugaaauaaucauacuuuuuggaaaacagcacuucccucauuuuuuuugugagaugguuuuaaaagauacggagauaucgcaagacaaaaauacaauaaaauaacaacaagagaaacaaccuuauacuguaccuuuccuucagcaaaucauaugcugucugacagucucuggauuccuuuuuucucaaagcaaaguuacuuaaaaacugauuuuucauguggcuuugcaggaaguuaacuuuuaauaaaccauuucuugcuaagcuuuucuuagcacauuuacucaauuccauacuugaaagcuacaaugcauuucaauaacugaaauguaugggauuuuauucuaauauuaaacucaaaaggaagaacugagacaguccuaugggcauauuacugcagccaaaugugauucacgaaggcacugauauucuauaaaagugauuucaaauaucaauguauauacacgacuaauggaauaugaccuaaccagucaaaauaggcugaaucucauuccugauguuauaucaaugccaauaaaauuaggaaucauauaacaaaagcauaugggcagaaaauagcuuucucuuauguaaaauucaagugauggucaagaaauaagauguaauacaguguuucugaugggucaauggcaaaggucuggagaaauauauuccagguuuggagucuuuaugggccagaaacugucucauaauuccuaaaugugaccaaaugggaggaauauagguuauugcucacaagaagaagacgagaugggucaguaugaauacaucuccagcgccagaggcaugggucagaucauagccccaggaagguggcugguuagugggaacaucuucacauaugacaaauuuuugcauccuuaccuuuaauuauucuuugauauucuuuuucaucucugaaaaaaaggcuauuuuaacagaaguuuguaauaucagauucuuuuacccacacgaagaaagauaagugguaaugcaauggcgggugauaaugcaauuaugaaaugaugauguauauuucauuuugaaaugcaguauauguuuccuuuuucuuuugcaggaagacaguucugggauccuaggagcauccaauuuguauucagaauuucauuugaguaagauuaacauuuaaauaguuuguagucccuugagcucagaguacagugagauacacauacacacacuauacuaucucucucucuuucucucucucucuuucucaagcccuggauaucaauucaaaauuugugugaucauugauguguguguguguauauauauacacauacacaacccuagaacuuaaaaacucauuaagaauccacaaaauagauaacccacacagugauaaccuagagugacuuccuaaacuguggcugcuggcuaaccuaguugauaauaacaaauacaaaguauccuuuuagcaauaagagagucuuuuugcugccucagacaaagcuuucuagcuugcuccuuguccuuuggaauucuaggcugaccaacacugagcggaagccucaccugggacuucaggagagaaucuugcagagugucgagauacaaaaaguuugaguucuugguccaaguugcauucaaucagguuugugucccaugaucggauuccuagggagggaaagaaagacaguugagagacuuccaguuagucauuucagagugguuuggacaacaucacuguaauauuucucaggcuuucagggaggaugugggaacuccuuuucugaagagcuugguggcuuagcaguggaugcccacaaaaugggagggccagggaggucucuccaccaggccacaagggagggauaauuagcaguguggacugagcuucugccccucauaaaaaguaaaugcaccucuucuggaagagucaaagaaaacaguuguuaggaaaaugacaggcuguacuccagggagggacuagaaagggcaggaagauguuaguucuuaagaagcuaagaggccaacagacuaacucuagcuuguagacagacuaacuccacuuguagguggcaagaaaauguagaauaaaggcaaagaaaauacacgggggcugccauucaagcacgggccuuuguuucuaaaaugauguucugguaguauacauguguaauuucuuuccuuuaccaaucccguuuuugacuuugguuuaucgagcccuggauaucaauccaagauuuaugugaucuuugauaaacagaguggauccacucaaucuucaagacuuggccugucuguccuuccaggcacuuuucuguuaccugaguagcuuggcaggcagcucuuuuauucacaauuguucauuguauucaauuuucuuauccagaggcaaagaaaaauggcaacuuuuuauacuuuauaaaacauuuauggaguuggggacaugaaucagcuauuccuacccuaggcugaacggaaaggaaguccuaucagacuuccuuucccuaggcugaaaggaauauccagggugagaggaacaggagggcaagaggcgggaugagggcagcuuccugugcucaugcccuacucucuagccucuuccuuccuccucccacuguccucuuucuccugcccucccaaaggggauggcccagagggaaccccagagagcaucauagaagggaggucuggagaguaagccagggaaaguuggggaaccccagaacucugguguguguguguguuuuacauguuuacauauuauauauuacauuuuuccuaauagguugcucaugguggagccagugugugguauccaucauuguaccuuuguauacagcauucucaauugccaggaacaaaucucuagaacaacagacauuuauugcauaccuccuaaagguaagggcuugaaccucuagguauaacacagcaggugaacuaucucuaaauuaacacccagucauguaaucauuuuuguuggacauuagucauguauacagacuugaaggaauaaauagcaguguguuacuuaaauacacacuggauccuuaaggcauauuuguauuuacccuugguuauauuguauucagucuuccuauccuguaaagaaucaagguggauuauacauagacauuacaaaaaaaaaagauucuggaaacucaguucacugcacaucuaaaauaucuuuagauuacacaccacagaccuuuucaaccaggaggaauauuuucaaauagauguguguccacuaaauacaggcagaaauuucucauaugaucaaugggaagaauucagauguggaagaguuaacgugcuuaaggaaaggucaaauuauaagggagaauuuuauggcucuuccuggaaacauuaauagccucaguuugcauuugugcuaauggaguauuugaauuuuaacaagaaaggcauguugagauuucgcagaucuuuuuagugcagaaaugauaaauggguucuuuuuguuucacagagagcuugacagguugagaggucugaauucauuagaauauuuuacuucaauguauacacuauauacuagucuagugcaaaaaaaucgaguuccugucugagcugcuuaauugguauuguugacugaauucuccuuguuccaggucugagcucuacuuugucuucuacccugucaagcugggucaauaaguuaauaaugagacauaugcauuuaaauuaaauucauacaauuuuucugucuuuguucuaaguaaugucuaaauugguacauuauuugaaugacuucauccaggguuaucugcagacuugcucuuacauuguuacuugccauuuucccuuggcuucaguuaacuugucauggcacacacaauuaaauguuugcuuuauauuuucauacauauuuuauuuuugacauauuuguaauuuagcaauagaaaaaguacuaaaugauaaauccacuuaguaauuucuaaauuauacuaguaaacggcugauaaaaauauuucucauuuuuacacucccaaugaaacuaaaaauguaggguucuuuuuucaagagagcaauuuccacccaaauuguuucuuagcaaugcacaaccacuacuaccacuuauaaaauaaagguuauguuggauuugccagcuauuuuaguuggaaaggaaaauuuuggaaucaggccacuuuccauaccaauuuuagaaauaaaauaauuuguaauuacuuuguaucuccugcuggauaauauugguaaaggcaaagaguaguuguuaaugaagguucauauugcauuuaguagguuuauguaguuccccuuugugccuaacaaggagccaacagugagcccucuaaaguuuacaggacagaaaaauaucucuuuggcccuucccauauucuccccucucugaaucuggcuggagggcauccugggguguuggugaagagguucuaaagaggcuuucagaagcaagucauccuggucucuguuggggagcagggaagcccucuuucuaauuuucaccccaauauacaccaagucaagcucuuccuggaggcuuuguuuccccagcauucuaagacuguaccccuucugggcuuacccaggugggggcagaauaacuccaggcaguuggaggcagugaaccccauucuuucaaugucuggagccaaaaggcauccgucaucucugagaacaaucugggccugcucuguggcuauugcccagcccugaaagugagcuccuugggaccagggagcaacaaaagaucuuuccuucucaguucucugaccccaggugguagcagugcacacaagggaggcugacaugcacaugauauacacagaugagaaaaggagaaaagaauagguuauggggcagggaggcagggaggggucauuaaagaacaagucagggugaaaaaugaggagaagucagguacucuugguguguacaggcuagauuguuccaaguuuuccaaucauguaagcauuuugcaggguuguuuaaugaaaccaacaauuuaaaaaagcaccucccauuuaaaagcuaaaauucauauuucuaaaggugacaguggauugaagaaagcaaaaugaaaugaccaugcauuguauguugauggcacauggguucuaucugacaguuauuugggccuuuggcaaguugauuuuccuuuaugggcuuuaguugcucccucugaaaaacaggcuuuuggauauuuuuuccaaguaccuaaaucauuaaccuagaaucauaagauuauauuuguaaaacuaugcuaaaaaguggucugaaaucagauugaaaucauaaacuaaauaaaugaacuaaaggaaaugcuacauuuaggaaugcuuuauuucucagaggaaaaaauucuuauuuuuucccuugaacucaucuuuaauuugcuuuuuuucuuuuuuuaaagccagcaacuugauguucauaacauauguauguaaugacgauaauaucuuacauacagagcucauaguuucaaagcauugauaauaaauaauuuaggucugagauaacaucuuacaacacaagcaaaugagaagugacauaauuauuugcuugucuaaaaaguuauaacuuauuuuuuuaaaguaagcccuuagagaaggugaacaauuuaaugaccuuaaauuuggggacugccuuguguuucagcauggaucacagagcugucguagauaauaccaauuaagcagugcaagcagaaauccaucugucuucgacuuugaaaaguauaggcaaauauaguaaauuuaagacucucuaacauuuaauucucaccacauaugguauugguuucuuauuuccccuguuaaaagaaaaggaaaacuaaaccccaaaucuuuccuggguuuuaaauucucuuaccaucuuagacugaaggacauucaguuaagugacaucagaauguaacaauguaaucagcuaaacuuuuaucuaaaaaugcagagcaguagauguuacauucaucuaucuuuucaccaacaaaucuugcugauucccaguguuaacuaaaggaaaaguuauaaucuaacgguaauugaaaacauccaacagacacuuaauauucuuuauauguuuuaguuccuuaaaaaaaaaaugaaacaaugaaaacguucacaaggcucuagaauucaguuugcaagacacggauguauguccucuauguauuaaaauaaaaccaagaagcaggguuuugcugaaaaugagaaccacuagcuaaauccaugcugggggcuaauuagggaggagaaaaaggaggugccaaagaguaguaguuggugguagcgaaaacgauuuggaauaaaguccugcauaacuaaauaaaugaagcuagccuaguccgaggaaacacuauuguuccaaacucuggaggagacauguccaaagcuuucauuaugcuuuccgaauauaguugagaaagcaagagggaccaucucucuucccugguuucaagaggcauuuacgaagcauccacauugggacguuccaggccuguugauuuacugcauuaccaccaugucucuacagauuuauagauuauuuucuaggcuucccagagagcccucaguaaucggauggcaagaauccaagucgccagggucuccaaacccagaaucucaguuaaggcaggaggggaaauaggaagaaagaguaacagaugcggaacugccuucccagccugcaacacacaaucaucagagcuggccccccuggagcagcuccaucuugcuucacacaacaaggcccaaaggcaccaagcaacaacagcaguggccucuggaggaggcccagcugagaccuggcggcugaagcagcagcuugucgugcacaggaaaacaggaccagccugcucuguugcuaagucaucucagacugucugaaaagcuaugggagcaggauuuucacuuagcgcuggaagggccugcaucuugagcugcagccaagaccccagaacccaggagagccaucuucagaggaaaagcagcaucugcuacgguguguaaagaaacggcucugcucacucacuugguugauucuuaaugggaucaauacagucauuucggaguuccaugcaaaaaccugaccaaauuagggaauuaaaaaaucaggaagccaugaugucuauugcaaagggaacacaagggggcuucugggguuccaguaaugucuguuucuugaucuggguaacccaggcguguccguuuugugaaaauucguugagcugcucaucuuugauuugugcccuuuccucucuauauaauacuucaaccgaauuuuuuaaaaaauuaaugucaagaagacaaaucugaauuuugucacuaagugcuaguaguguaaaaacgaguaaaggcagggagcccuucuucauagcaguacguggaugcgucuguuuucuccauaaauagaugcagcuuguauaaacccucugaggaauagggcgcugaaaggaugaucagaugaguaacaaagcaggaagauaauuacgauccgaaggugauugcugaaccaucucccagcauggggcgcugcccacaaguggauggccauacaaaggcaagcccugaaaacuguuguacugaaaccuuccucccaucauaggauguuagccaacccugcacuaacaucaugacagggucagaaaacgagugacgcugcaguacugguacuucugucacuuaugagugcugugaccuugagccgguucucuuacccuuccugccucucugggcccccagcucuaaaacgggguugaugaucccucuccuagcaccaccacaucgaaugguuaugaagauuuuguagauagaaaagcaccuccuaauauauuccuauuucccagaaaugcuacuuacaaauaauuuuuuaaagaaaaaaauccaaagucauugauucccacaauagccacacccaaagucaguauguguaaaauuuuuccaggagaaaauugugcaaauaaacuaaauuagaacagauuagaccaaaggccuauauagucugaaaaugaaggguuauugagaugcucaaauaagacauuucacuacugaaauaucucuuguucuugaauuuuuuggaauaaaauacuaugacuuucugcucacauuuuuuuucuuuuuuuuuuuuaagcuaaaagggaaaaucaagugcuuuaaaguuaaacaaaagaaccaggucugcaacuccaguccccacccugcagccuuuuguucuggggacaaguggccguuuccaacugcagaggcagaugacaagcauuuauuuuuucaucuaaaacaagguuuuucuuucgucuuuuauuggggagggggaguggggaacgagggcugcgugaacgcccuuuguccgccucgggcugccguagagaccgcagugcggacugcaccacgcccaccaaccggugucucccggagaaacgcuucagcaccaccccaggagaauagagcgcgggcuggggcugcggagggacccggcgaccucugucaggagcgaggggagggccgggacgccagggauaaagggaaaggcagagaccagagcugcccacccagggacucccagggcaacaaagccaggcaaacugagaggugggggcgcgcggcccccgccagcccgaggcccgggcggagcgcaagcccagccagccgugcccgacgggggcgccgcagugugggggggcagguguggcgggcgguccggaggcacugcggcagcucggguggggcugggggcggucucucugugcgcccgaggcugugcccgccggacccucacggccccgcccaggguccccggcguaccgcuauucggccuccgcagagcgcgccacuggugcgagcaccgggcgaggagcugacccuacccgcugacgucucccucaccgacccccuucaagcuaccacucccgaggcugggacuucuaaaagcagcagccccaccccgcaacuuggggucccauuguccuuucugagagcugcagccaaggccccaagggcgguagcgaggcgggcucugucugguggcgaagcgcaggcgguucugcaucccagcaucuccccggggaggggggggcggggggagcgggcguggcccuaggacuagccuagucauucugaggaaagaaaggaucgggagguuugaaaucagaaaaggcguuucucaggggcugagguagccguggugaggaugaaucccacgcgggcccuggcacaugggcuucggccccaggucugcgguggugggggucccagccuuuuccugaggccagaagaggacugaaaggagugguugcaucaggucucccccacccuucugccuccugcgguugcggcuuuauuguggccucugcuccccugacaccugcauuucacuuagcgggagaggcgguggccaacucagcacaggcugcggacucagcguggugacagaucccucaagguuauuggagacucucccucugggucucauaucuaauaauucggauuauucuuaauuagcccagaaagggucuggaccaaguaugagaggugacgaggagaggcaugggugcggggcgcgcgggaggagcgcagugaccgucgcgcccuggguggggucguguuugcgcgucucccagcgcgcgucucugggggcgcggggccacuuaccgagcucgauguugccgauggcacgccgcaggugcuccucggucacgaucucgccgacgaccaccagcaaguagaacuugcugucaaggaagcggugcgacaggcuaggcgagguggacgccgccggguuggcgaugcugccggacggcuccggcucgguggcuuccaccaccacggucgccauccugccggcugcugugccucggcgaagugucucgcuccggccgcuccucuccacugcggcaggagaaaggauuaucuccgaagguacugucuccgcuccgcccccugcguccccccu

SEQ ID NO: 17388 - RNA, 5279 nt, Homo sapiens
gaggucacauaacugcagcagcucacauaguccugacgcugagcaaaauguuuccaaaauggaaaucuccacacagcagcagaggcaaaugacaaacuuuaaaaaucuaagaucuuucauauugaaaagucccacccagccuguaaucccagcacuuugggaggcugagguggguggaucacgaggucaggaguuuaagaccagccugaccaacaugaugaaaccccgucucuacuaaaaauacaaaaauuagccggaugugguggcaggcaccuguaaucccagcuacucaggaggcugaggcaggagaaucacuugaacccaggaggcagagguugcagugagccgagaucgagccacugcacuccagccuggaugacagagcaagauuccaucucaaaaagaaaaaaaaaagagagaaaaaagaaaagaaaagaaaagucccacccagaaacucaaaacaggacugcaaccaucuuuauuaacuaagaaagaaucuccuugagaaugaaucaaauagcuucauaaauugcuccucuucuguuuuguggaaauagaggugaaguuuugcccucacaacauuauauuuaccuaaaauaaauagcaaaagaugacagugucaauggaaaauaaaagacauuucaguucaucaauaacuggacagugauaaaaauaggcucucagaagccacagcauaaaauaugcccucaaagcucuaugcuugugggaggaaauggauucuuuggcugauaacugaaaacuccuccgaggugguuguucuuuaaagaggcccccuaaggccccaggcucuucuaaauguccccuauuuugaugcaucucagcacuguucaagagcuuaaauaugaugccacuggugggcaauacacaaaaaaacuuucugcucacucuucccaucaccccagcaugagcugcugacuagggcaucucacccccagacgucgacacaaagcugauguucauagagaucaguggcuugucauuucuuucaguaagaaguuaagaaccagugcuagaaaggugaagcucagggggcugaagaccaaggcaaggccuuggaggugaaaacaaauugaagaagaaagaaacgcucccguguccugcuuaauguaagcauuaaacuuccauuuguaucccagccaccuaccagaucaaucccuccaaucucuguauuugguuccucauuuguaaaagagagauaauauuagcccaccucacagggcugaugggaggauuaacuaagauaaucaaugucuauaaagcacguagauauugcauggcacaaagaaaaugcucaaaaauugggagcuauuauuuuuguuauuaauaugcauuaguggcugggcacaguggcucaugccuguaaucccaacacuuugggaggccaaggcaggaggaucucuugaacccaggaguuugagaccagccugggcaauauagugagacccugucucuauuuaaaaaauaaaaauaaaaauuuaauuaaaaauaugcagaagucugggaagaagcaaaguguaauguuuccaguagccgugugcugggagaagcccaaguuauauucagagacaugauuauguuuuguuuuuucaagugcaggccuggaaaccaaauggaaaagucagcaagaggaugacugugcugcucacaucccuuuucacuaguucuugggguucaugguguccccaccaugcagcccguaacucccaugugagccccgaccccucugccucuaauaaugacagucuccccuguuuauccacaacugucugccacacacugucaacuagguuauuccaggguugauuuguauccaaugugacuguaaucgacacuguuaucauaccauaaaacccaaggucacagguaggugaagaugggcuaaagaaucuguuauguucaaugaaaauaauaugaauaaaucaucugaauaaaaaaacacaacuauaggaaaacacauaaacccaaacaacacaucacauuuuuaugugauuuuaugacuuacuucuuuuaugacucacuuuccuuccuucaggcaccuuggccuucacuugucugaggcagggacccucugcuguggucuuucauaacacuaauggggagagcuguuccuagaaaauauuuuggggacuauauaauauucguaaugagaauauggauggauuucagucaaagaauuucuuaaaaggcacuucaaggcaaaaaacugcugcucucaguuuaaugggcuacaagauuauuccccugauaagaguuucuagcauccccugaaagaugaaagucugaaugcaaugaccuggcagagaauuggcuucuuguccuugucugugugcaaacaaagcccugggccagaaggggagaagguucuguuggacuuuuuaaaggcccuguaaacaaugcagcagcaguaauuuuuagaucacgagcccuuccacaacuccuuuguguuuugggcacaacaccucucuuauugcugaugugauugauguccugcugagaacaccaagcccagacccacagaacacagagaaacaguguugggguaaauaucagaggacgaugcacugccuggacuacaaagacaggcaaaccagcucaaacaggguuaacgugcuggugauguuuguuaccuagauugucugauuuacccagaacaauucagaugaggucagaaccauacagauggaggucuuucuuugccuuucuguuggauagaacuagucuauguguuccagaauuccuuccaaacccaagcucucuaacacaauuaagccuaaucauuaccucuaugcaacagcucuuuuuuguuuguuuguuuguuuugagucggaguuucacucuuguugcccaggcuggaguguaauggugcgucucagcucaacacaaccuccgccucacagguucaagcgauucuccugccucagccuccugaguagcugggauuauaggcaugcgccaccaugcccggcuaauuuugcauuuuuuaugggggauagggggaacauaggauuucuccauguuggucgggcugucuugaacucccgaccucaggugauccacccgccucggccucccaaagugcuaggauugcaugcaugagcaaccgugccuggcuaaaguccuuuuuuaaaaaaauaaauaguagugauauagagaauaauaucuuguuuguuuguaaaucucagugauauggauaauaucuuuuuuguuuguaaauagcagugauauagagaauaucuuauuugaacaagcuugucaauguguaccaagcacuuucacauguauuugugaaagacuuuagaagcauauuaugguuucuguuguuacuucucuuaaauauuuauauaugcagccacaguuuaaaggugucuaaagggccuuguaguuuauuuuaaaagaaguuuuaaauuaauccagcagaagaccaauauaacaagauaaacaaauccuaguccaccucugguccagcaugccccaggaagauagcagcggcauaaauaaauagcucacaccagcauuagugcuacccacuuacaccagcaugacauagggaugcuucagcauuccagcuuuacgcagcccuuucugcugaauagcucagcaaggaguugagaucuguggacucuuuuuaaggaccagugccuugcacaaacccucugaccccagcuuucuagcuuauugggggcuuugagugaaaggugucgaguccugggguagcuagauaguucuaucucuccaagcaguuggggaucaaucauuauuugcugacuuugaaaggauuuucauuucuuugugucacuguguccuagggccuagggaugccuuuggcaccaggaguucauaauuucucuuuucuuuuuaggaucauaggugcaaaaaaugacaagcagagaaauuuuaucuguguggcuagacaucugacaaaauguaucucucugcauucgcauuuguguaggaguuuuuaugagaaaguaauauccuuuaagacaaaacccauggccuauaauauagcuauuauuuuugcaugaauuggcuuugguuaaccaaauuuggugaaauacucuaauuuuaagaagagguauucuuagaaauuuucuaucaguuaaaaaaaaaguaucaguuacuucaugucuucuuguguuuauuuccacaucccuuaaagggccacagauaauuuuaagcuugagcaaagaaccaggccucccaacacaauggaaagaaaggaggcaccgugugaagggaagauggcauacguggcacagaccuccaccucugcucaccaccacagaaggccacuccugcaugggcaggugacggcagcgucaggaagggaaaucagauuuacuuagguuguuagucauuauuaauugcaauagucuugugccuucauuuaaaaaaagacgaccaaaaaauaaaaacaaaaacaugaacacuaauuuugcaaaauauuuaagugaaaacuaccggcauaggugucauuuugcaaaagaauuuggcacuuggguaccuuacaggaugugucccuagcacagggaaacuguauucaaguuuuuaaaaagguuuugcacacagugugauuggaagacauuugucuacaguuuugaauauauguuauauauauuauauauagauagaugauguuuuuauuauuuaugcaagcacugcuuacaaacccuuauugcaaauauuuaaaaauaacauguaguuuaccuucucuaaauuuguauugagugagcgaggcagaaaaaugucccauguuccaguaagaugaaucuccuggcauuagacagagucuauuuaaccucuguacaaugauugacacacuggauguauccaugaugagcauuagugcucugcuaacgacguccucuugugcacaugauauugaucugcuuggguuccaguucaccaacuccagcugcucccugcuaucaggaagaaggugcugaauaagcaagggaaggaagggacagaccaaagggacuaauucuuucguuucacucgggaaggccuacgugacccucaacaacaucaacaacaaaaaauugcacuacaagccugccccuaacaguacuggauaaaugaauaugugguccugccuucggggggccacucaaggggcccgcaguaucaggaccugacccaggcccugcauuuuucucugguucuuccuauguguccugggaucccacaccaagaggugugggguuauucuuucauggccagaaacggggaaugcuucagagaauggaaagugggcg

SEQ ID NO: 17389 - RNA, 12306 nt, Homo sapiens
gugagugccacgaacaggccaauaaggagggagcagugcgggguuuaaaucugaggcuaggcuggcucuucucggcgugcugcggcggaacggcuguugguuucugcuggguguagguccuuggcuggucgggccuccgguguucugcuucuccccgcugagcugcugccuggugaagaggaagccauggcgcuccgagucaccagggugagccgcuucggacugcgaacuaacgcggccuucuuagcugcugccugcucucccugccucgccugcgggagccucccgagcgggagagggccgcaggagcgauuuggggaggaaggugggaggggacucaccaagagagcgccgaggugggcccaggccuggugagagagugugggggacgauggauggagggaggaaggugagaaagagaacuggacggauauuggauaaauguuuuggggagguggagagucgacugggaaccuuuugaaaaagugauagagggucccugagugggcccgccagcaacucuguaacccccuucccagagagaaggugucugcaauuggaggcuuuuucgguuuccuuucaaauguaaauucucgguauuuuagggcuggccaggacuaaucagggaaucccucaauugguaaauguagaggucggcggaaacugacuugucacggccgcagaguagacucugggacccauguuuucccucggaacccauuuuuagucggcuuucuuucugggaacuucuccuugugccccaccuuaauuaacccuugacuuacucgagccuucguggaucagcucuuaaaguggucuugcuucuuucagaacucgaaaauuaaugcugaaaauaaggcgaagaucaacauggcaggcgcaaagcgcguuccuacggccccugcugcaaccuccaagcccggacugaggccaagaacagcucuuggggacauugguaacaaagucagugaacaacugcaggccaaaaugccuaugaagaagguaacucucuuccugaccuaacuucuguaagagcccgccuuccaacuguggccuuugaugcagaaacauuucauucucucuguuucaucuacaggaagcaaaaccuucagcuacuggaaaagucauugauaaaaaacuaccaaaaccucuugaaaagguaccuaugcuggugccagugccagugucugagccagugccagagccagaaccugagccagaaccugagccuguuaaagaagaaaaacuuucgccugagccuauuuugguaaacuuauucuuaccauuguagagucuguugauuauuucuugucccuuauuucacugauacaugcaagagcauucaaaugaauaguaauauuaauaccauuuauugagugcuuagcaugaggcaagcucugccuaacauuuuacaugcauuaacucacauaaucuuuacacguacucucugagguauugucaccucuacuauuuaaaucauggcuuuagagagguuaugucagggucacacagguaaguggcccauaugggauucaagcucaggcugucuggcuucagaaucuaugcuuuuaauugucaacugucuuauauuccuucguuaaugauauuaaguaguagcugucugagccaaaggcuuuguuauccaacuacaagccaucucugcagaauuuauuggcguaaacauagaauguucucuugaauuuuuuuacugcugcauauggcuacuaaauaauaagccuguaacauuggaauaugcaaaggaguaaaacaggaagaaggcaacuuuucagggagugguuaagaagaugaauuaacacuuagccucaaaaauaauaacuuuuuauuaaauauaagguauguaaauguauucuaugauagaccuaccugugaaggaaagguaggucauguagaggaggcugcuuugaugaaauugcaaugaacuguauucugaagcucuguuuuuuuaaacuuaguuaaaaccaguugggaaaauuaucugaaaaaaacuuguugagacagagucuggcucuguugcccaggcuggagugcaguggcgugaucuuggcucacugcaaccucugccucccagguucaagcaauuuuccugccucagccucccuaguagcugggauuacagacgcacgccaccacgcccagcuaauuuucauauuuuuaguauagaugggguuucaccauguuaguguacuccugaccucaugauccgcccgccucggccuccgaaagugcugggauuacaggcguuagccacggcgcccagccaguucagcuucuuauaucuaaggauaagagauugaaagcuauugcuuuaguguugaauuucugggcauagcacaugaaauauguagccagcacagucuuugggcauaucaaacuacgugaggcuuucuuggaaggcccauacugauucuuaccuuugcuuucccacuuaguaagaaugccuuccccacccugucuuucauuuagcuaauaaccuuuucauccuugaaaacagcucaagcaucaacuccugaagcuuucccaaacuucccccaucuccacccccuguuccuagaaucagucuuuuuuuucccuuugagacagagucucacucuguugcccagacuggagugcaguggugccaucuuggcucaccacaaccucugccucccgaguucagugauucuccugcuucagccucccaaguagcuggggcuacaggcacaugccaccaugcuuggcuaauuuuuguauuuuuaguagagacgggguuucacuauguuggccaggcuggucucgaacucuugaucucgugauccacccgccucagccucccaaagugcugggauuacaggugugagccaccaugcccagccuuagucuuauuuuuguuuauuuuuuuuuucccaagacagagucuugcucugucacccaggcuggagcacaauggcacgaucuuggcucacugcaaccucuaccuccuggguucaagcaauucucuugccucagccuccugaguagcugggauuacaggugccagccaccacacccagcuaauuuuuuuauuauuuuuuuauuuuuuuauuuuuaguagagauggaguuucacgauguuggccaggcuggucucgaacuccugaccucgugaucugccugccucggccuuccaaagugcugggauuacaagcgugagccaccaugcccgaccuuauuucuuuacuuugucuacuaaauucagaguccuuugaggaugccaugaagucaaugccuuguagaguuugacuucaagaaggugcucaauaaauguuugaacaaugggauaaagggagcuugaaggaaaugguuaauggcgaugaaguuaguuaauccuuaguagucaggauagaauuuguguugaguagugagaagcaguuuauauuaugaaauaaagacuaaagacugaauugucauuuauuuggacuaacuucacauguugcugauaaaaauuaauuacuucucaguuuccuuugcagcaaagucuagaaugugaauuuauuugcuuccaacuuuaaacugacucacucuaaguuggcauuucacuguuuuuuuuuuugcccaggcuggaguagaauggcgcaaucauagcucacuguauccucaaacuccugggcucaagugauccuccugccugggccuccugaguaguuaggacuguaggcagcugccuucaugcccagcuaauuuuuuguagagaugaguuauugcuauauugcccaggcuagucuggaacucauggucucaaaggauccucccaccucagccacccaaaguacugggauuacuggcuugagcuguuaugcccaaccucauucuuuuuaauugaggaauuaaaugaucacuuuuuucuuuuuuaacagagacaggguuuugcuauguugcccaggcuggucuugaacuccuagccucaaccucagccucucaaagugcugagauuaaaggugugagccaccgcgcccaacccaaaugaucacuuuugauguuaaucacuuccuaaaaagaaauggaauaaaucugaaaagauacuuuuccuuuaaggaaaugaauuguaugccgauucagcagaauacuagcuugaguugguaccaauaaccugaacuucaugcccaaacuauagugcuuacuucuauuugcuauuucaagauaucucuuuguuucaagguugauacugccucuccaagcccaauggaaacaucuggaugugccccugcagaagaagaccugugucaggcuuucucugauguaauucuugcaguaaaugauguggaugcagaagauggagcugauccaaaccuuuguagugaauaugugaaagauauuuaugcuuaucugagacaacuugagguaaguauuaucauucguuuuuuuucuaaacugcaucuaacuuuaugaaaguauuuuccaucaauaguuuauaauaauacaagcaggacgugggcagcauuucuuaagagaucgcacuuucaaauucuccuucauggaauaccuauaauaaaaagucacuaaauaaaccaauggagucuauuugucacuuugugcaggaaaguucgaaguuaggguggauacuacuaucgcuuucuaaaggaaaauccacagauugaauuugauauguauauaugcgaucuccaccacguuuggaaugguuaagucccaaacucugcauuuuaggugauaacgggucaggaaguggaugaggauguagaauauacucaaagacuacagccaccccuaacacaaggcauuuuguguuaguguggcugaugugcauccaguuguuggugaaauuauuugugcccaaaaggaguacacucaaaagcuacuuuuuugguucacuucaauuugaucccacuuuugaaacuuucuauuaauggcauuugcccuuucccuacaaauacaagcacucuuuauggcagcauaaacauaguaacauaaauuauacuguuaccacauuuacguaguuuuuuuguuguuguuguuuuguuuuuuugagauggagucucacacugucgcccaggcuagagggcaguggugcggucucagcucacugcagucucugucuccuggguucaagcaauucuccugccucggccucccaaguaguugggguugcaggcacacaccaccaugccuggcuaauuuuuuguauuuuuauuugguuuugguuuuuuugagacagggucuugcucuguugcccaggcuggagugcaguggugcaaucucggcucaguccagccuccgccucgggucaagugauucucaugccucagcaucccgagcagcugggauuacaggugcccaccacaacacccagcuaauuuuuguacuuuuaguagagaugagguaucaccauauuggccaggcuggucucgaacuccugaccuuagaugaucuacccaucccggccucccaaagugcugggauuacaggccugagcaaccgcacccagcccccaguuguuucuaauguguugucuuaugucaucacugacauguucaucucuugccugcuccuuuuuggccucuccuuuuucuauaggauucuucugcaagacuucuuugccaggagcagccuucugcuuuuaguuucuucuuccaucuuucuagugcuuuuuaaaguuguguucuaacuuuggaggauucaauuuaguaaaugugcuguuucuuuuuuuuuuuuuuuuuuuuuugggacagagucucgcugugucaccuaggcuggugugcaguggcacaaucucggcucacugcaagcucugucucccggguucacgccauucuccugccucagccuccugaguagcugggacuacaggcauccgccaccacgccuggcuaauuuuuuauauuuuuaguagagacgggguuucaccguguuagccaggauggucucaaucuccugaccucaugauccacccgccuuggccucccaaagugcugggauuauaggugugagccaccgcgcccagccuguaaaugugcuguuucuugaugcuucguucuuguucugugcaaggccauuuaugcaaagcaaccccucaaguggcagaggagcugagaaaccaaggaauuaggcagauaaauggaguuugcugguauugggugacugaugagggggaauuuacagacauaaguauggucuuugauggcuguaagauguagaucucugcacuguaaccccucguacccacggcuuggguauguauacauuuucuugggcaaaguauacaugcucuagaaucaauguguggguggcugacagaaugcugcagacaucacagccuauaauguauacaauaauaucaagggcuguuuuggaggaaaggccaaacuuaaagugaauaggcagaagucacauugaauuaguauuuaaaauaaagucacuguuguccccacaguucuuagcuauguugcuguugggauuuaacccaggagcaggcaggaguguuguaguacauggguuccagcugcccugggaguuacugauauuuucucuacauaaagcucagguucuaaguuuagaggcuuaagugaaaagaucugagaugauaauguaguaucuuuauuuggaagggaguggaccagcagcaguuguggugaagaauaucguaagaccugacaauauaaaaaagcugucauacuguccuaucuaauguuugccuuuuuuuucuuuuuuuuuugggguggggagacagucucacucugucacccaggcuggagugcaguggugcaaucucggcucccugcaaccuccaccugccagguucaagcaauucuccugccucagccucccaaguagcuggaacuacaggugugcgcaaccaugcccagcuaauuuuuguauuuuuaguaaagacagguuuugccauguuggccaggcuggucucgaacuccuggcugcaagcaaucugccaacuucagccucccaaagugcugggauuacaggcgugagccaccacgccagccuucauguuugcuuuauuucuuggugaugguguuguuugugguugaccauaugaauaauugaauuaagaacugauauagauuauaaaugccccagugcuacuguaggaacuaacugaucuuucuggacauaaaugugucacauggagucauguuucuaagaauaaucagcauuuucuuuugcaggaagagcaagcagucagaccaaaauaccuacugggucgggaagucacuggaaacaugagagccauccuaauugacuggcuaguacagguucaaaugaaauucagguuguugcaggagaccauguacaugacugucuccauuauugaucgguucaugcaggugagcauuucaguaagaguuuucccuuccaggauucuagccgagucauaagaaacugauguuuucaggccagucugggcgcaguggcucaugccuguaaucccagcgggcggguggaucacaagguuaggagaucgagaccauccuggccaacgcaguaaaacccugucucuacuaaaaauacaaaaaauuagccgggcaugguggcgggcgccuguagucccagcuacuggaggcggagguugcagugagcugagaucacgccauugcacuccagccugggugacagagcgagacucaaaaaaaaaagaaagaaauaaacugacuuuuucaacuaaaaucuuucuugggggauauggugucauuaagauuuugcuaugggagaaugucuuucuaccucuccuucaucauagcucugugucuccuuuucaaacauuuuauucacccuauugaaauucccauugcagaauaauugugugcccaagaagaugcugcagcugguuggugucacugccauguuuauugcaagcaaauaugaagaaauguacccuccagaaauuggugacuuugcuuuugugacugacaacacuuauacuaagcaccaaaucagacagauggaaaugaagauucuaagagcuuuaaacuuuggucugggucggccucuaccuuugcacuuccuucggagagcaucuaagauuggagagguacagguuucuugagaaaccucuccguauggguacauuagggggaacacugcugcugaccaagcacguugaauucaacugaccuguauuauaccuaacuacauggggaagggauaaaguuguucuuuauuucuagucaggcugcauguuaauauuaggacuuuccaugggcauuugagaguuuguagacaaacauuuguaguuaaagauacauaugggcaugcagguuagugccaaaggaaaauuuucugaaagaaacucaguaacauggguuuuguuucagguugaugucgagcaacauacuuuggccaaauaccugauggaacuaacuauguuggacuaugacauggugcacuuuccuccuucucaaauugcagcaggagcuuuuugcuuagcacugaaaauucuggauaauggugaauggguaagcugugucccacagaacuccuaagcuuuuaaauuuuaaagagugacuaaauacagaacuuuuguuauuaaaaggcaauucaagugguucauaaauaugggaucuacugaaggaauaguuaaaaaagaugucuuagaauguuuccacaucuuuuuguuuuugagacaaggucucgcucugucacucaggcuggagugcaguggugcagucuuggcccacugcaacaucagccuccagaguagcugggauuacaggugucugucuaguuuuuaaauuuuuuucaugucagauggguaauaugcccacauuguaacaagguuugaggguggcacguuucacauguucacaugaacaccaaaucaucacacuuaugaacuacaaaagagucgcccaccagccugggcaacauagcaaauccucaucuuuacaaaaaauauauaaaauauauauauauauauauauauauauauauauacaggcacacgccuguagucccagcuacucuggaggcugagcuuuguauuuuuuguagacauggggucucucuauauuacccaggcuggucuugaaacucugggcucaagcgauccacccaccuccacuuaccaaaguguuggaauuacaggcgugagccauugcaaccagucgaguguuuccauuucuuucccugauuucaacuuuauucccuuugagaaagguagagcaacuuuuacuccuuacagauggagaaacuugaaggucaaaugacauacuaguaguucauucauauucauugauucaacaaaugcuucuccuaugugacaggcacuacccuaggucuuuuuuuguuuuuucgagacggagucucucucugucgcccaggcuggagagcaguggcgugaucucggcucacugcaaccuccgccuccuggguucaugccauucuccugccucagccucccgaguagcugggacuacaggugccugccaccacgcccggcuaauuuuauauauauauauauauuuuuuuuuaguagagaugggguuucaccguguuagccaggauggucuugaucuccugaccucgugauccgcccaccuuggccucccaaagugcugggauuacaggcgugagccauugugcccggccuacccuaggucuuaagaauagaacuauguagcugggugcaguggcuuacaucuguaaucccagcacuuugggaggcagaguugggcagaucacgagcucaaaaguucaagaccagccugaccaacauggugaaacccuaucucuacuaaaaauacaaaaauuagccagguguggcagugcgcgccuguaaucccagcuacucaggaggcugaggcaggagaaucacuugaaccugggggcggagguugcagugagccgagaucauaccaugcacuccagccuggagcgagacuccaucucaaaaaaaaaaaaaauuacaaaguuggccucaaggaaguggagucuaguuuuagggugggcaagucagcaauuacaaaagugcaauuagguuugagcagaggaagcaugagagcaccuaggaaaggagucuuuagcuuugucuuaaauuucaguuauauuaauuauacaguacccaucucuuuuccacuccugaauaacaucuaacaucuagaaacuuuaugaaaaucauuauugauuugagcauuuuuaacauuaacuuguugccuuagacaccaacucuacaacauuaccugucauauacugaagaaucucuucuuccaguuaugcagcaccuggcuaagaauguagucaugguaaaucaaggacuuacaaagcacauggugagucaauauaguggcauuguaagaugcugaaaaguguaauaauucaaacuuaaugccugcaaaugccugguuuauuuuuaaugaguuaauguuuuaaaugaauaccuguaucauugcaucuugugauuuuuuuucuuuugccucuuuaauugcuaucuuuuugucuuccagacugucaagaacaaguaugccacaucgaagcaugcuaagaucagcacucuaccacagcugaauucugcacuaguucaagauuuagccaaggcuguggcaaagguguaacuuguaaacuugaguuggaguacuauauuuacaaauaaaauuggcaccaugugccaucuguacauauuacuguugcauuuacuuuuaauaaagcuuguggccccuuuuacuuuuuuauagcuuaacuaauuugaaugugguuacuuccuacuguaggguagcggaaaaguugucuuaaaagguaugguggggauauuuuuaaaaacuccuuuugguuuaccuggggauccaauugauguauauguuuauauacuggguucuuguuuuauauaccuggcuuuuacuuuauuaauaugaguuacugaaggugauggagguauuugaaaauuuuacuuccauaggacauacugcauguaagccaagucauggagaaucugcugcauagcucuauuuuaaaguaaaagucuaccaccgaaucccuagucccccuguuuucuguuucuucuugugauugcugccauaauucuaaguuauuuacuuuuaccacuauuuaaguuaucaacuuuagcuaguaucuucaaacuuucacuuugaaaaaugagaauuuuauauucuaagccaguuuucauuuugguuuuguguuuugguuaauaaaacaauacucaaauacaaaagguaucuuuuuuaaaaaguuaguuuacugcuuccuuaggcucuuucuaaaucccacccaccugaaggacaucaauuauggauuuauccuucaugccuuguauaaauacagaugugcauaugaauuuuuauggguuuuuuaaaaaugugguucauucuauauacauaacaauuacuuucaacauacauaagccuaccuguauuugugcauuauauuacaugguacagauaaauagucaugugccccaugaacauuuuggucaaagauagauuacagauacaaugguggucccauaagauuaugaugccauauuuuuacuguaccucuucuugugccuagauacacaaauacugacuuguguuauaauugccugcaguauucaauaauaugguguauagauuuguagccuaggagcuauaaccuauacuauauagccuaggagugcaggaggguaugccaucuagauuugugugaguacacugauguuugaacaauaaaaucaccuaaugauagguuucucaaaccauaucccaguccuuaagcaacacaugacuaauggauucaaccauuuccccuguucguucagauugcuuuuucuuuuugccccuacaauuuuguugauaauacuguuuuuuggggcuuuuguuuuuguuuuuuuuuuuuuuuuugagacaagagucucacucugucgucaggcuggagugcaauggcgcuaucucagcucacugcaaccucugccucccagguucaagcgauucuccugccucagccuccugaguagcugagauuacaggcaugcgccaccgcgcccggcuaauuuuguauuuuuaguagagacgcaguuucaccauguuggucaggcuggucuugaacacccgaccucaggugauccacccgccucagcuucccaaagugcugggauuaaaggcgugagccaccacaccuggccaauuuacuguuuuauaccaugcuuuuuuguguguauucuagguucccuaaagcaaacaugcauuuuaaauuuugauagaaccagaugacauacaaaagugccuguuuucucugcauuauuaaaacugaagguaaucagucuuuuauuucuaugacuccaacuggcaaaaaauauuugccauuuuaacuu

SEQ ID NO: 17390 - RNA, 2654 nt, Homo sapiens
ccggggagcccggaggcagccugcgcgcagggaggcaggcagggggagagggcgcgccgaccccgggacgucccgggcugucagcggagaccggagggaggccggagaaagugcauccugagcgacccggccggucgcugccuuccggaucggucccuuaccgagcgcuggguacguccaccggcccaaggccgccgccgccgccggggccggccagcacguccccgccguauuucuccuccaucccggggcucacgagccgccgccgcugccccugucgcggggucuccucaugucucgccgcugccgcggaacagcgggugcaggcgcgucacucccccauggcagagaccccgucgggcuccugcaggccgggccgccacugccgccgucgccggcuccggcucacuagcacacacgcgucgggacuaggccgcgaucaguuccggcggcgccagguucccgggaagcagcggcgguagggacguugccaagccacgucaucaggcccagcaacccucacucccgggggagugcccagccuugcgucugcgcaagcagaacacucgccuuuccucgucccuuaggcuccucccgccacguugugucgcauugaagcuccgccuccuaucagccucuccggguggcgcucccugugcacuuaccugucccuacagugccaccuaugggccgucagaaguacagcggauuccuguagggcagagggggagggcguggaaaauguacagcgugugugauuaaacaaagcucaccaaucuuuuccucugcguuagggauucuuuuuuuuuuuguuuugagauggaguuucgcuccuguugcccaggcuggagugcaauggcgcgaucucggcucacggcaacuuccaccucccagguucaagcgauucuccugccucagucucccaaguagcugggauuacaggcaugugccaccacaccuggcuaauuuuguauuuuuaguagagacgggguuucuccauguuggucaggcuggucucgaacuccugaccucaggugauccacccaccucggccucccaaagugcugcgauuacaggagugagccaccgcacucggccuagagauucuuaaucuagguuaacauacccucugccucuaaguuuuugugaguauggaucauuuuugugaugagaaggcccgaagucuuaaaaguucacgugcccuucccccaaccagagauaacuauuuuugaagcuguagagaaucaauuacaaauagugguacggccauuucuuuugaacaaugccuuugauggacuuuggagaggagaaacuaguauugaccaaaauuugccuccucagcaaacuaucccagggcaauuuucuaggagugaccacgugcgaaacuucauggccuucucuccuacuccuaagggaaccuaaaggcaauuuccagauuucuaaagaaacauucuuauccugggcaacauggcaaaacccugucucuaucaaaaauacaaaaacaauuagccaggcguggcauaugccuguggucccagccacucaggagggagaggcggaaggaucgcuugaacgugggaggucaagguugcaauaaggcaugaucaugcuacugugcuccagccugggcaacagagcaagaccgucucuggaaaaaaaaaaaaaaagaaagaaaaagaaaggauucuucuuugccacagggagccuggggucaucuaucaaauaaaguaacggaggaaggugacugcuuuuguggcuuuuuguguggggccuggaguacugguaaccguuguugcuagaggcccuggaauccaacugugugaggacagaacauaggagaaggaagaggauuuuguuaaguguugcugcaaacuguuuugucuccuuuuugaaaaggaaagcguugauuuucuuuaaauucugccugugaaacuguguaauccaggcacaucuguaaaaacaggucagguaguguuaccugaaaaggggguccccauccagaccccaggagagcuuggaucucacgcaagaaagaauucgaggcaaguccauacaguaaagugaaagcaaguuuauuaaaaaaguaaaggaauaaaagaauggcuacuccauaggcagagggcacaguggcucaugccuguaaucccagcaguugggaggcugaggcggguggaucaccugaggucaggaguuugagaccagccugaccaacauggcgaaacccugucucuacuaaaaauacaaaauuagucgggugggguggugcaugccuguacucccagcuacucgggaggcugaggaggagaauggcuugaacccggagauggagguugcagugagccaagaucgcgccauugcacuccagccugggcaacaagagugaaacuccgucucaaaaaaaaaaaaauaauaauaguaauaagaaugcccaaccuccugggaaugcagccgaguaagucucccccuuguuuuacccagccccuauucaagauggaggcacucugggucaaacgccucugacaaguaggacuggguauuauaaagguuauuuuucuguugcuaaaaauuuaggaauguggguuccugugucagucuugguuugaaucccaacucugccacuuaguaauugugggaucuugggucaguuaguuggc

SEQ ID NO: 17391 - RNA, 2654 nt, Homo sapiens
gccaacuaacugacccaagaucccacaauuacuaaguggcagaguugggauucaaaccaagacugacacaggaacccacauuccuaaauuuuuagcaacagaaaaauaaccuuuauaauacccaguccuacuugucagaggcguuugacccagagugccuccaucuugaauaggggcuggguaaaacaagggggagacuuacucggcugcauucccaggagguugggcauucuuauuacuauuauuauuuuuuuuuuuuugagacggaguuucacucuuguugcccaggcuggagugcaauggcgcgaucuuggcucacugcaaccuccaucuccggguucaagccauucuccuccucagccucccgaguagcugggaguacaggcaugcaccaccccacccgacuaauuuuguauuuuuaguagagacaggguuucgccauguuggucaggcuggucucaaacuccugaccucaggugauccacccgccucagccucccaacugcugggauuacaggcaugagccacugugcccucugccuauggaguagccauucuuuuauuccuuuacuuuuuuaauaaacuugcuuucacuuuacuguauggacuugccucgaauucuuucuugcgugagauccaagcucuccuggggucuggauggggacccccuuuucagguaacacuaccugaccuguuuuuacagaugugccuggauuacacaguuucacaggcagaauuuaaagaaaaucaacgcuuuccuuuucaaaaaggagacaaaacaguuugcagcaacacuuaacaaaauccucuuccuucuccuauguucuguccucacacaguuggauuccagggccucuagcaacaacgguuaccaguacuccaggccccacacaaaaagccacaaaagcagucaccuuccuccguuacuuuauuugauagaugaccccaggcucccuguggcaaagaagaauccuuucuuuuucuuucuuuuuuuuuuuuuuuccagagacggucuugcucuguugcccaggcuggagcacaguagcaugaucaugccuuauugcaaccuugaccucccacguucaagcgauccuuccgccucucccuccugaguggcugggaccacaggcauaugccacgccuggcuaauuguuuuuguauuuuugauagagacaggguuuugccauguugcccaggauaagaauguuucuuuagaaaucuggaaauugccuuuagguucccuuaggaguaggagagaaggccaugaaguuucgcacguggucacuccuagaaaauugcccugggauaguuugcugaggaggcaaauuuuggucaauacuaguuucuccucuccaaaguccaucaaaggcauuguucaaaagaaauggccguaccacuauuuguaauugauucucuacagcuucaaaaauaguuaucucugguugggggaagggcacgugaacuuuuaagacuucgggccuucucaucacaaaaaugauccauacucacaaaaacuuagaggcagaggguauguuaaccuagauuaagaaucucuaggccgagugcgguggcucacuccuguaaucgcagcacuuugggaggccgagguggguggaucaccugaggucaggaguucgagaccagccugaccaacauggagaaaccccgucucuacuaaaaauacaaaauuagccaggugugguggcacaugccuguaaucccagcuacuugggagacugaggcaggagaaucgcuugaaccugggagguggaaguugccgugagccgagaucgcgccauugcacuccagccugggcaacaggagcgaaacuccaucucaaaacaaaaaaaaaaagaaucccuaacgcagaggaaaagauuggugagcuuuguuuaaucacacacgcuguacauuuuccacgcccucccccucugcccuacaggaauccgcuguacuucugacggcccauagguggcacuguagggacagguaagugcacagggagcgccacccggagaggcugauaggaggcggagcuucaaugcgacacaacguggcgggaggagccuaagggacgaggaaaggcgaguguucugcuugcgcagacgcaaggcugggcacucccccgggagugaggguugcugggccugaugacguggcuuggcaacgucccuaccgccgcugcuucccgggaaccuggcgccgccggaacugaucgcggccuagucccgacgcgugugugcuagugagccggagccggcgacggcggcaguggcggcccggccugcaggagcccgacggggucucugccaugggggagugacgcgccugcacccgcuguuccgcggcagcggcgagacaugaggagaccccgcgacaggggcagcggcggcggcucgugagccccgggauggaggagaaauacggcggggacgugcuggccggccccggcggcggcggcggccuugggccgguggacguacccagcgcucgguaagggaccgauccggaaggcagcgaccggccgggucgcucaggaugcacuuucuccggccucccuccggucuccgcugacagcccgggacgucccggggucggcgcgcccucucccccugccugccucccugcgcgcaggcugccuccgggcuccccgg

SEQ ID NO: 17392 - RNA, 1905 nt, Homo sapiens
uaaaauugaaugguaaccccuauaaauaauauuuaggaaaaauuuaucaauauucacuuuaccuccagaggaaauguugcugugaacacauuuugcaccuuguuagaauuucucuggguuuuuaaugagugagucugcugugggccaauauuuaucuacaucuccagguucagcauacugugauuuuaaguggccacaucauuaaccuuugaaaaauggaggaagucauggaaaaaaacuaacaaagaaaaacagugccauagcaacugcuguuagcaacaucaaaucuccuacugauaaauuaucagaaaaacuuguggggcuuugguuguagaaugaaaaaguaugauuuucaugucuguauuucuuugcugauauguucucaaaauuguuguuaaaaacugauguuugccuuugcuuaguggggauaguuuaacacuuuccucucugucucuaccugcccccuuccagguggugcauaugaagucaaacagcaucgauucuuccguucuuuagacuggaacaguuugcugagacagaaggcagaauuuauuccccaacuggaaucugaggaugacacaaguuauuuugauaguaugugcuuuaucugacauaaaacauuguuuggccuuuacucgauaaauaauuaucuuugcuuuugaaccuuuucauaucucugaguucuuaaacauaauguugauccagaaaaucauaauuaaaauaucuaaauguugaaaaucugaguaauuggaccuguucccaaacauuucacugcagcucggucugagaaguaucaucauauggaaacggaggaagaagaugacacaaaugaugaagacuuuaauguggaaauaaggcaguuuucuucauguucacacagguuuucaaaaguaagugaaauguggcauaaacauacagagucucucugggaggaucucccgcuggccagauaguauccccgaacagcuggacacuuaccguuuuccaggguuugaggucuccuaugcuuaaacuuccuuuuguugaagaaaagugaccuccucaacuuauagucugucccuauccccuaggccuuuagacugccauuuuaccuucucucuuuccugugagacaacagagauucagauagcugagaccuugggcuuaccugagcucugauccccuucaggaaccccggcaccaauauauuucucucuccacaaauuaagauauuguuuucuuagaggcauagccuugcacccacagucuuguuuuuggagugugugacugcuacuuauaugaugaccuugccuugaacgucucucaccuggcucaaugccaggcugcagagguaucacucauugcuuucaacucaggaugaagagcgcgagcuucacuguguacagagucaucuccgagggauuacacagaguacaacaaaaggagaaggcucaguccuugacauaagcaaagauaccugcggacaguugacuguaggauuguaaagucucauaacugccaggcauaguggcucacgccucuaaucucagcacuuagagaggcagaggcaagaagauagcguaagcccagcaguucaagaccagcccgggcaauauagugagaccccguucuccacaaaaaggaaaaaaaaagccaaaaaaaaaaaaaagucuuguaaccaauaaacagaaauuauaagccauauugaaaaggcaguaggaagccaagcuagaaucauuuagauaauugaugcuugagaaagaugccuuuuuaccaguacaguaaaaguuaaaaaaaacaauuaaucaaaacaaagaaaacugauaguacugagacagaacaaggcccuaggaaaaacggaaaucaaccugagggcacccuaccucccuuuugcuauuuucaguagcuauauauuuucuguugcca

SEQ ID NO: 17393 - RNA, 1154 nt, Homo sapiens
uacuuccgugaccaccaaaucuccuuuuaugacauucaacagaaauuuauuucaagcccagaaugaacagcaugacuauuuaacaccucccagcucuacagcauuuggcuuuuauauagcaguuuggcauaacguucugcccacaagugaacugucccugauuucaugugccuccacaaucggaacacaaacauacaaauauaagaaaccgacaccagagcuccacuuuguucuuuuuugugagaagucauguggcaaaaagccagugucuuucuguucagcauguuuuguugcuagcugcuccuaauucaguaucuugcaaaaugacauucuguuaaugacaugaaugucaaagcugugauaaugggcagaaguagaagaaaauguuuccugaauggagaagcaacaggaaaacugccaaacggauauuaaaauuaguugcguguuuauccuauacuuuagugcuuggucccuacuauuuguuucuaacacgaaaagggaaguagucucuaaggagcgaagaauagcccaccuuggugaaaagcgcggaaaaaaaaaaaaagaggucaaaggaauguuuucccuuaauuaacuugacagaugucuuuucuuuuccucauuuacauccacuaauguuuucuuagucauucucucauuuugcaaagaugaaauuggccacaaggaaccaauucuguugcuaaagacaggaggacuggggaauuaccagaagacgcuggucuuuaagaugcucaguauucagucuggguaaugaguguuccuugcuguuguuauuugugggguaacagaauuuuaggucuggaagacaacgaagugacuugccaacguagcaccaccaauuaguggcaaacagagccuaagaagggagguuaaguggcucccacaaccaggguacauuagaagguagaaaucugcaugagacauauggauauacuugacuacuucuuaugugaacauacaguaacuguucuacaaaggaagagacaguucuguuuuaaauuaaauggacucaguuucuuaagagaaugcagccaugaaauacaaggacuugccauuaguagaucuacuguugaauuccaaacccacuaagccucaauuuacugaucuguagagcagggauaauaauaucaauaauc

SEQ ID NO: 17394 - RNA, 44895 nt, Homo sapiens
auauuuuuguucuuuuuucuaguggcuuuucauggccugccacugaaaaucaagaaagaaccccacaguccauguucagaaaucagcucugccugcagucaagaacagcccuuuaaauucagcuauggagaaaagugccuguacaaugucagguaaagccaccagguguauguauguaggauagugguucuuauugaaucaaaaaguccagaauaauaugaaaucucaagucauauuuuaugaguaacgucuuuaauauguaacaagcuaauuagguaaugcauuuagcagaacucuaaagaaccauuuaccauccaaucacacacuuuggauucauuuuaaagcaauaauuuuuauccagaucauuaguugcuuuucuacuguagugaugcaucuuggguuugaaaaagggguuuuacuuggcacaagcagcuuuugaaaguucccauuagaaugaaugcauuauacacuuuagauagagaguuugcagaaaaaaaugaaacauuuggcaggucugagcaguacauuaguuaucugccaggcuuugcagaugaucuguaagaugaguucauggacaauugcaauaaaacuggaauuucauaaggcuuagcagaggcuauuaucuauuaaaaagcugguuguucuucugaugauaauaaaggguggugcaguaaaagugcauuguucauuuauuagaaaauuugaucacauauauguucauuaaaaacccuucaaaguaaauuguaugaugcuacuuuucauauuggccuuuaauugcauaaagaaaaaguuggcugucucuacugaguauuaucacucucaauuacaguagaaacuuaguucuuaaaagaaguuaguuugcaaacuuacacaaauuauuccaaauauucauacuguuuuauaaguuauaucaauucagauucauuguacauuaugacccaaaggggucuucuauuaaauaauuccucagauauuuauugcauacgcuguuuauguccaagauauguaagauucuagaaacauaggccagacgcaguggcucaugccuauaaucccagcacuuugggaggcagaguugggcggaucaccugaggucgggaguucaagaccagccugaccaacacggagaaaccucgucucuacugaaaauacaaaauuagcugggcaugguggcgcaugccuguaaucccagcuacuacagaggcugaggcaggagaaucgcuugaaccugggagguggagguugcugugagccgagaucgcgccauugcacuccagccugggcaacaagagcgagacuccaucucaaaaauaaaagagaaacauagacuugugccauuauggcagcugaccaaugcucagauauuuuauuaccauuuguucuugcaaacuugucuuuuauauuugcuuuucuaagagguucaccagagccugaaauuaugagcuagcucaauugaaacugcaaaguuuuauaaaaaaggucucuuguagaagguaacuauuaaagcauaaugaguucagauaagacaguauugaucgaucugaguuuuauuuuauaguuuaguuuuguuuuugcauuuucuccuuacaaguacuguguauccacagcauaauuauuuaacauauugaggaauuucuagucaauggcaguuagauauagaauugucauugccuuucagcauuaaucagaauugugacugugaaaucaucacuguuuuauaugccauaucugacauccacaaaucaauaauaaaggaauugccugaauauuuuguguuucuuuugggggaugaaaaguccccacagugauauauggcauaugcaauaaauucugguacuuccaucgcuauacagaaaauauuauugaguacagcauuucaugggggaauaguaucauuuguuucuucauucaugagaaugaguuaggugaaccauuucacaaaagaaguggguuuuucuucagaaauacugguaaagaacauagguggaaccaaacaugcaauucauuauaugaacacuguugacuuugcuuugaagcaagagcugccuugugcagcauauauuccuuuacuccuuguaaaagauuuuugcagcuggauauaauuccguugcauugauggagcaacagaauaaauuauuacauaauuuaauucaaaaagaaauauuucuuucuaaagaaaaaaguguacugaugauugcuuuuuauuuuauuuuacuuauuuuuuuuugagacagggucucacucugucagccaggcuggagugcaguggcacaaucugggcucacugcaaccucugccucccgaguucaagcgauccucucaccucagucucgugaauaucugagccuacagacaugcaucaccacgcccagcuaauuuuuuguauuuuuaguagagacgggguuucaccauguugcucaggcuggucuuaaacucccgugcuuaagcgauccucccaccucagccucccaaagugcuaggaucaggggcaugagccacugcgcccagcaaaaugaaauacagcauucuaacuuagaaaugcccuguuguuaaaaaaaauuuaagaaaauuuaguuuuaguaaaauauuuuauagaugaccaaaauuagcuaaaucacauuccugaaaguuacaccuaggaaagcaguuuaaaaucauaauguaaaaucaagcuuacucauuuuauucuucuguaacuguguuuagaaguuagacuauaauaggauuuuauuccuaaugacauuauuuuuuacuuauucucuaagaaaguuuaaauauaucagacauuuuaauuuaccucauuaaucuucauuaucccauguggggaaguuaaugccaagcaucauuuauuuaauauaauaaaaugaaaauaaaguaaaagcauugccuucuuaaaaucccaccacaaauaaaagcaagccagguguggucucugccuuauuaagcugauguuaguucuuguuuuaaaaucuuacauaauauaaaagaagaauauaauaucagaaguauuuaaugauuuaggaaagaucuaucaaacuuucucaaauagauauaucaagaauagauggaaaaaauaccacugcuuuuuuggacguaauuuucccuguacuaaguuguuuguauaugcauuaaaaauacacauuuaauauuuguucuguuacaagguuuugcauuaaucauccuauuuucuguuuaaggguguugugauuuugaaguuuaucuguucuggauuuaaacaacaauagcaacaacaaaguuuucauuuccauuugacuuaagucuaaaauaucuuuucuuccuuuggauuagaaacuuuuuuaaaaaauugcuccaaagaaagaaauguucucucuucuuuuguccccuggguagugccuaugaucagaagccacaagugggaaugaggcccuccaacccccccacaccauccagcacgccaguguccccacugcaucaugcaucuccaaacucaacucauacaccgaaaccugaccgggccuucccagcucaccucccuccaucgcaguccauaccagauagcagcuaccccauggaccacagguaaccugcagauaccaguuuucuagaaacuguuuuuugcguucuuggaaaaaauuucuauuaacaauucugaaggccuagaguagauuuaaggugagccuauuaauuuugcacaucugugcaaaauauuuuuagaaagagcucacucuaucuauacuuauaauuuguggagaaagucauuuauaaacauuccuuuuauaaacauuuaaauugguugcuaaaauggaaaauuaaucuaucuacugacauuugagcauuucccuuucgcuuugcuugaauuaaauugcuucacuuaaacuuuaaaucagaucaucccauuuuuaugagcauauguguguacuuguucuguaaaguuaggagacuaauuuuaguagguagcuuauggaauuagguuuucuaccuuauauugaaugguucagcuguacauaguuuugcagaauauaacuuauuugauuaaaacuguugaccaucuuuuccaggugauuaauauuuaauaucaguagacgcaugacucuggacacugcgaauauacaauuaaagagauagagacucaauuaguauuacuuagaaaggagcaaggcaagaagcauagcauagaucuaaggagaauacugcguuagguaauucaugacuccuugagauuaagaaauucauauuuaaguaaaauacuaaauaaaaccuguagagguucugagauguacuaccuuaauauacagcuuaaaaucagguugcuuauauacagcaucucuccuucuuuaucucuucugcccugugcuucuguaugcaguggcgugcugguaaauguuuagcaacagccugcaugagagaaaaacaaaacgcccucaucaguagcuuuugcugggucugugauguacauauugcuuucauggcccacuacgagccaucacugugagaacccugaaugccgaguugcaaagaugcaauagcacagcguaauguaguauuucuagcauacggauaccagagacauaaguaaccucagguguauaauugguaaugaaauguaguaagauaauuagaaagugaugaguuuugcauuuuuaucuucuguuuuuaacauauuuuuugauugugaaguuauauaauuuaacuguuaauaguggcuguguuuaagaacuggcucaaaaaauuccugcaaguuugacaauaagucagugcaaacuggcccugagacaccguuguaaaaauaacucagccaaaggaaucuucuagaucagcagaggaaagcagaagaugugccacuggcaacuuucugaaaauaagggagcacucaaaugugcuuuuuauagguuuuuucaugggacucaaucucaaauucagaaacucauuuugcuauaaagggcguaagaugaaagcguucuuuacaaugugauacaaagccuugucuuuuccacccuugguuccaucacuaaguccucuugugggguaguuauuaaaugcuuccuauuaucuuuuucuucucacccuguagccuugagacuuugucagagugcaaugguaugugcaucuguguaaacaguuuuguaaauacagaugaaagaauucuuauugcagggugggccauuaaacagauggacauugugcagagcugaaagggaacaaaaaaauaugaacaaaccaaguuuuauuuucuccacuacuggugacuucugaguucuugauaacugaaucucacucuucugaucagugccagaauuauagauuguauaauucgcuuuuugugcaaacugguuauuucuuagggaaggugccugcugaauaagcagugugccugguuuuaggugaccuaacuugaaaugcuuuagccaaauucauuuuaguuucucuacuugaagucagauauuugagacugagaacagccggcccggaacuccaagagggaagcucggggucuuuucccacugaccccugacugaguuuugaggacaguaccagcuggccagucccaggaaaaucucuaaagccguauguuucugaggaggauuucuuagagggcucuggccaacaaaugacagucccucaguuauaaauggcaaauuugcucugggaacagauccuuuccccaaaacacccccuccagccaggcaccccacuucacucugggaaugcuuuacggccaacuggccugcacccugcuuccuuuccucagccucacucugcuccuggggccagcccuuuggcacuuuuuccugaacccacugugcaggagcccugucucucuuucucaguguuuccaccacuuacacccuguuuuucuuuaucugggaguucaucagcauguucuccuuaucuguuaacuccuuuccagaagcuucuugaaucacuuucucuuuaccauuggucaguggcuccuaagaauugcaccaaaaccuugcaaauuccugagaagcaugcguguuugauauauacauguuccccagcaacuuccaacuggaaucaggucgacucguaaaaacaaauggcuugauuccuuacaaagcuuucaguuacaaguauuauuaacuuccuuuuaaggcuucacaagugagccaguuucuuauuuuaacuucaaguuacaauuuucugauucacuccuugacaguucuuaaugauaauuucuguuucuuuuuuuggcuaaugaaauaagcaagagaagggaaaugaaugcagugccagucagccuaacugcucugcaauauccgaguuucuaaguuuauuuucugcagguguagguggaauuucagugcuuuccaugaccaccagugagccuagaguuaaaucacaggauggaguguucuuagaaaugcuaaagcaaucgcuuugccauucuuuagcuuuuaccuuauuuuuauuuaacauuaccgaaauuaaaugcuaacuuuccaaauuaaagucucaggaaugcuuuuaguggggggguuauuaggcuuauauuugcucauagaaauguuuuauagguuauuuuuaagcacuccuggggcauuuuuagagcacuuuuaaaucuuuaauuaauccacaucuuuguggugggucaaugauauuauggaugagaaacacagaacagaacgauuaugugauuagccaauuguuauaaaguauaaccaagaacaaagaggcauaggacucauuucuagccuucugcugaggccucagaacuuccucauguccuaacagcgggacuugccccaaaccuauacaacacuauauguuauuuucaccuuuggagaucagcugugcauuuaugcuuauuuuuaucaaccugauacuguauuugaaucuauuggaagccaauauggucugcauugcuguuugacaguaaagagguagucuuuuuacaaccggcuuggguuugaguccuuauaauaccuaguuuuguuucuuacuagaacgcaauguuaauuaggacauuguugaggaauugaaaguccugauuugagaaaaaagucauuccucucuugcuuucucagcagguuuuugguugguugguuuuuuguuuauugaucaguuugguaacagaauuaaaagauagaggaugcaguuugagaucuuuuucugguauauaaugauuuaagaaucuuguguggaaauuauccgugauccaauugauuuagaacuaggcauuuuagccauuaaucguuguguguguguguguguguguguguggguguguaaaauccucaaaguuuuucauugcucuccaauccuuacucaaaguacaucuuuaacucauauacugcaacagugcugcaaaagacugauuagaaagggaauauaagucauaugauuaaaaaacauagagcuacuaauccaggaaagaaaaacguaaugcuuguuaaagauuuacgcuucaggucagcugguaucauguucguucacuaagaaauggaaaaccguauccguauuuuaaagaauguuccauguuaccguuucaucugaaacacacucucuuauucccuagauuucgccgccagcuuucugaacccuguaacuccuuuccuccuuugccgacgaugccaagggaaggacguccuauguaccaacgccagaugucugagccaaacauccccuucccaccacaaggcuuuaagcaggaguaccacgacccaguguaugaacacaacaccaugguuggcagugcggccagccaaagcuuucccccuccucugaugauuaaacaggaacccagagauuuugcauaugacucagguaggccugcgcucugcgcaaauuacauucaaggcacuuuuucaccucccuugucacauugguuaguguugguaucagacuagguagcuccugaccauuuuuuaauaagaucuuucagauuuuguccguucauugaaacuucaucuacguguaaagauuugaacuaucaggucauuuugacaugaggugaugguugaaauagugucuggaaacaaaaccaguuuaaagaaaaauacacuuuacagaauuaugcacagucucagcucgagagggacauugcaauuuuuuuucuuaauucuguacuuuuuuuucuucuuauuuugcuacuacagugcuacuuaauaaaaauguuuacagaaaguaauauucuucugaacuaggucacauguugcuuauaacauuuaagaaaaaauuacuggggucccggugcaguggaucacgccuguaaucccagcacuuugggaggcugagaccgagaucgaggccacccuggcuaacacggugaaaccccaucucuacuaaaaguacaaaaaauuagccaggcaugguggcacgugccuguagucccagcuacucgggaggcugaggcaagagaaucgcuugaacccgggaggcagagguugcagugagccgagaucgcaccacugcacuccagccugggugacagagagagacuccgucucaaaaaucucaaaaaaaaaaaaauauauauugguggcaaagauucuaaguguucguaaguaagaauucuuacauauuaagaggggaauaacagauuauucguagaguuuagcuuugucucugugagcuagaaaguaguacaaagcagcgggucaagugggggagugggguuuccugaaaggagggaggguuuaaaaucuuuuccagucugguggcucacgccuguaaucccagcacuuugggaggccgaggugggcggauuacgaggucaggagauugagaccauccuggcuaacacggugaaacccugucuguacuaaaaacacaaaaaauuaaccgggcaugcuggcacgugccuguagucccagcuacuugguaggcugaggcaggaaaguugcuugaacccaggagguggagguugcagugagccaagauugcgccacugcacucuagccugggugacagaguaagacuccgucucaaaaaaaaaauuuuuuuuccaaauaguaccaccaacuuugccaauauuugaaccuugagacuuuaaaagaauuacuuaacccugcugaguuuuuccuucuauaaucugccaaaucaggacaucuguuuuuaacacaucucagguauuuugaaagauaaucuaugaaauaaaagcuaauguuuauaagguuaccauguaccuguaaaauauuguuaacauuauuguaucuguggucaauagaugguuguggauguggaaauauuugagaacaguuucauuuccuuuugucuggauauaaaguuugggcauucuuuaugaagggaguauugcguccucugcugaguuuuucuaucaucagucuacuugaguaaagaaaacuaccuccaggucuugaguuaccaguuugcguauaagauuaccugguugauaaugaacugcccuuaaggcucugcaaaagagagcccugugacuuagaagucucccucuggucauccuucuacacuggccaauagguucaaaggacgaagggaauuggccccguugaggcaugccucaacuucuagaaagcaugcaagcuccccaaaaccuaugaauucucugcccaaguggccuugagucuacuuccagggccugaguaagugcaucccaggcccuguuuucugaaaccagagcacauugcuccuauauauagugcuagguucaaggguggcuaaagggcaguuguucgugaaggcaugaggauggaucuugaugugugaaacucucacaguguggcccaauauugagcucaaggauaggaagagagacaaaaaguggggugugucaggaucugaagacuggguacuagcucucuccauaccacauacucuuccaggcucauuuuagagauuuccucagcuacuaaacuugacauggcugagagguuguuaugguauacaguugcaaagaugagaagacaccuuauuuaucaguuugcuuggccgauuuauaauuuaagaaauuuuaacagauuguauaagagucuuuauuugaauuuuugccccagggacuguaauuuggggaguaucuugaaauucccauugugguuucaguuuagaaccuuuuguaucguccacuggugucucuaauuaagaacccugcaauacagugggcucuauuauaaauaguacacauuuaucucuguaaauuucaaauccuguuaauugauauuauccuuauuccccaaaccacauuuuaauuuguuguaguuuuuaaaauucauuaugauuucaagaaacuuuauguggaaaucauauaaauuaucucaaauaaucauuccaaagaacauguauagcauagcacuuaaaauauuucuuuuugugcucuagaaaugaauuuuuuuugagacggagucucgcucugucgcccaggcuugagugcagugguguauucucagcucacugcaaccuccgacccccggguccaagcaauucuccugccucagccucccgaguaacugggauuacaggcacccaccaccacacccggcugauuuuuguaguuuuaguagagacgggguuucaccaugguggccaggcuggucucaaacuccugaccucuggugaucgggccaccuuggccucccaaagugcugggauuacuggugugagccaccaugcccugccuagaaauguuuuuauauguauaauaccaaaaagagccacacugaaacucuucucuuuuuuuuugagauggagucucgcucuguugccaggcuggagugcaguggcacgaucucggcucaccgcaaccuccgucugccagguucaagcgauucuccucccucagccuccggaguagcugggauuacaggcaugcgccaccaugcccggcuaauuuuguauuuuuaguagagacaggauuucuccauguuggucaggcuggucucaaucucuugaccucgugaucugccugccucggccugccaaagugcugggauuacaagcgugagccaccacgcccagccugaaacuguuuucuugauucugugauugcuccauguauaucuucuccucauauuuauauuguauauacaguuauauguagugugguauugagaauguauaacuuuucuuaagaagaugugaaccuaauggaaaagagauuuuaaaauucuaauaagggcgaaauacagcaucuugugcuguaagaauuacauucauacauaauauggacuucagagccagucacuauuugacccucaaaagcacagauugagucauauauaaucuucaaaacauaguccagcaucguuugucgaagguauguauggcaucucuuuuguaaguuaaguaugccaugucuugcagauuacuuguaaaauucuuaccuaaaaagcuguuaauuuuauauugcauucucccuuuuaaauuauauuuaaaauuaccaaaguuguauaccaccuuugaguucuaauuucaauauugccaauaggauacaguuguguuuugcuugaauaguuaaaugguaaaauuguaucuuucugacaggauuuaaaauaaauauaguaaccccauaaccagggccuaugaaaacuuaaucugugggugucaaaauguauuuuacuugccaugaaauugcugcaguuaaguugacacauauguauaugucauacauggcaaucaacaaauaugauucguagauauuuuguuugguugucauuaauuuuuucauccuugcugaaaguacacuuaauaaccuuugaggaaaucuaaugcauuuaucacugaaucagugauuucuuuuuucaccuauugguguugaacaaauagcacauuaggaagcacauagauuuauaugugguuuaaaaacaauguaaaaagcauuuuguuuauuuguauuuguauuuugagauguaguuucauccugucgcccaggcuggagugcaguggugugauuucggcucacugcaaccuccagcucccagguucaagcaguucuccugccucagccucccgaguaguugggacuacaggcgugugccaccauguccagcugauuuuucuauauuuuuaauuagagacagggguucaucauguuggcuaggcuggucucaaacgccugaccucaagugauccgccagccucagccucccaaagugcugggauuacaggcaugagccacugcacccugccguaaaaagcauuuucuaagucaguuaacucagcaucuaugauccaaaggcuauucuuacggaagaccuuuagaacucuuuauugcuuaauucuauacaccauaaauguugugaaaauaaaagaagccucguaagggaaaagguagcuuaugauugugcucuaauaaagccugacauuaauuaugacaugggaaauggaaggucuauuaguuauaauuauaauuacaggaaugcaauuucaacugccuaauauuuaagauaaaaaaugcaaaauaguauguuaguagaguauaaauuuuuauucaggagaaaagaaaaagacuucaaucagaagacagugaggaaacaagaaauagauauuuagggcuagcuuaaugaaccaguacaguaugaucaugauuguaucaugauacuagguucuaaaagauccaauccaauccaucuauuauugucccuuuccuucucuucucuagccuauuaugcugcauaaagcaguacacauuuuuuguuguuguugguugguuguuuuugucuaaauccaacaugauauuuuuuuucaugcccuuauggucaaaugcccacauaagaaguguuaaauacacauugagugcuucaucuggagugcgucauggagauucccguagaaaguauccuauuuucuuagagucaagacuguuuucucauuuucaugaccacauaugagguuuugcaaauucagaauguccagugacgcaaauauuuuagauguuuauagcaauauauuuuauuagagcugaaaguguuaggugguugguugauauuuugcuuuuuuuguuucauuuuauuuuacuuuuugauaucuuacaguagauuuuuuuagggaguagugagcacaugaaacuaaacuuugacuuuagagaauaucagcacacaauguucacaugguaauuucacucucaggaauuuauucuaagaaauagugaaagaugcauagugaauguuugagagagacagaaagcaaaauauuaaaaauauauaauaggugaacgguaaaguaaguuauggguacuuguaaaagaaauauuaugcagccauuagaagucagauuuuugaaaaauauuuaaugaaaugagacuacugaguuuuuaaaaguaugcaaggcauaacucaugcaaauuaagagccaguacagaaauaccuuggcuauauauagguggugauauuauaggugauauuuuguaucugugaaguauuaauauuuuauauuuuaacaaugcuuaugugcugcuuuccuaaucaaacagaaugaguauuuaaaaaaaaaaaucagucgggccaggcgcgguggcucaugccuguaaucccagcacuuugggagggcgaggugggcggaucacgaggucaggagaucaagaccacggugaaaccccgucucuacuaaaaaaaauacaaaaaauuagccgggcgcaguggcgggucccuguagucccagcuacucuggaggcugaggcaggagaauggugugaaccagggagguguagcuugcagugagcugagaucgcgccaccgcacuccagccugggcagcagagcgagacucugucucaaaaaaaaaaaaaaaaucaauuaauguauaguugaagaagagaaguguccaaacucaucacgucaguccuauaagugaaaacaaguaaaugauguuauagucucacacguuguaagcguaaaugacuuucuauugguuugugucuaguacugccuuagaggagggagggaaaaugaugccuuacuuagugggauucauguucaccuugcacagugcuugcaaugcuaccauuaggguuuuauuccuuugcacauugcaguguauuaaaaaucuuaacucaguaguugguuggaggaguaauguacauuaauaagguguuuuuagcccugaagaccuauucuguuauccuaauagguuuaaacaaugcuucucggccaugugguggagcaacuuaaucagaguagggaaugaagagagggaaagaagaacuuucaaaggcaagaggaagauagcuaaaauaagaaaauaaaggacaaugcugcauacuuugagcuuagagagagcaggaaauaaaagcagaggguagaggugagaacucaacaucauauguuugccgaagaaacgguuuuugcauuuuuaaauuguguuucuuaaggccacuccugcugcuacucaugaggccuuuuuucaauuuggaggcacguaacucuuugacagcaaauguuguucgugcuauuuuaaacugggaaguugacacaaauaaauguuucauagaauucuaaauccuguuaucaugaaagcucuugaaguucaccuacuucaaacuucuccacacccaaauuuuacagauaaauaucugagguucauccaaaugaaguaauuuaccaucaguuacagauauauugugaagcagccaaaacuaaaauuaggauuuucuaauucuuaguuuagugaagaguucaugauuugucuuucuacauaauuguucagauuaaagggaaauacugaguguuuuuguaugguuuucgaaggaucuucaugauccagggcaucugcuugaagauacgaggugugcuuucacuaauuugggaggagcacauuucacauuaaauagugcccacauuuuacucuaaauguuagguguucaccgcagugagguagcaaaauagagcaauucaacgauauaaauuaugaagaugcauucugcuuucuuuuaaaaaauauaccacgagcauucuuaagaacugagauuaucaaagaagugaucuuuuauaauagcucuuuugaaaaagacugaaaaauaaugagaagaaaaaguggcuaauuaauggcccuuccaagcucuaaguccuugauugcaugaacauagaguuugagucuucucauuggaccucgcucuuucuuucuuaaugcccuugauggcucaguggcuuacacuucaccuucagcugugcuuuucagaccauugucagcugaauccauuuuucacaaguaagcuuaugagggacuacaggaucucaaaucgauguaaagaaagcuguuguugaggaauagggugcuuuuuccauucuucauuuuauuuuauuuuauuuuuuuaauuuuuuuuuugagacagaguuucacucuuguugccccggcuggaguacaauggcacgaucucagcucaccacaaccuccgccucccugauucaaaugauucuccugccucagccuccugaguagcugggaucacaggcgugcgccaccaccaugcccggcuaauuuuguauuuuuaguagagacggaguuucuccguguuggucaugcuggucucaaacuuccgaccuuaggugauccgcccgccucagccucccagaaugcugggauaacaggugugagccacuguggcuggcccauucuucauuuaaaauccauccauuauucaccccaacaaccccucccaggcuccucauauacuuccuuauuacccuauuagggcuuugauaaaagccaguagaaaagccuguaaauuuagagaacgguuaucuguccuuagcacaucgaaaaauuauguguaggcagaaaaaugaugaaauaaauacugaaaaaauauuuaccuuauguuaaauacguuaaaacuggaauauguuuaacuuucaucugucagagcugacaaaucuaucugcuauucacauaggcccaagcuggcacuuuaaucaagaaauuuaaauacucuuggguuucugaaauggcaagagaggaauguuuuuauauuguaaauguuauucuauguuuugcuguguugguggauacucauccuaaucaaauaguaggaaaaguagugaaguaauuccuaaugcugccuguaguaguaagcauugcuugggcuuccccuugcagaguuuauaauaugguuugaaagugaaacuuguaggauuaaauaauuggguaauggagcaagaacaacaugguuauuuucugcauccauauaaaaauauaaauguguaguguuuuauagguuuggagaugacaugucagagccucaaucaacugacuaaacuugcacaaaacuuaagaaaaaaauaacaacauucagagggcuaaaauaucccagucauuuauuucuaaacuauuacuauugcauuuauuacuacuacucaucuagcaauaucucagaaauugugucaucaggauauuuuaccuuaaaaaacaauuuauugcuauuuacuuacaagaugagauacguguucuagggaaacuaaccucauacauauuuuccaauacacuuuucuuucauccuuucugaacaauuggggcacacauaagcaaccaaaaauauuauccaggaaacagaaaguaugcagugauuacaaaaaggaaagcuguugaaagacacuaauuaaagucagauggaacacagggaguagaaauaaagguaacugauauuuauuuugaauauucaaggcuuaccauaaacuagcaggcuucauuauuuccaaaauggaaagcccaugaucaauaauuucucccucuugaacauucuaugugugugugucuuguuuuguuuuggcugauguguuuuaaagagauagggucucgcugucuugcccagguaaguugcuaacucuuggccucaagcaauucucccuccucagccucacuguaguugggauuacaggugcaugccaccacugucugaacauuccaaugucacuuacuauucaguguuuucacauugaagacauuauuuuaucuuaguuauuuuuuaaaaauuguauuauugcugggauucuaauuaggcagcuaaggaggaaaggaaguagaauaguauuuuucuauucauauucccuuugaaaguauggaagugucaccaaguuguuacgaauguaugccuucuucucuucucagcaaccacaacagucuaucucaaggcccgccucccucuuauauaguuauagaaggccuagaauuauaaaaaccacaauaucuaaaacucugaacaccuaaacaaauuauuucaauauagauaaugcauauacuucucaaaucaaucuauuaugaauuuuauauccagccccuaauaauuauaaauuuauaauucauguauuacauugaucagacuuuaaauauauugaauaauggaaguuagacaacauauuacaauuauuuuaaauaugaaauauuacauuugaagauauucauuuucaguuugucauuuuuauuuacauauuuuugaaccaccuuaaaaaguaauuccuuagaaaauauugaauauuuuuaaagcccuggaaaaaaaguuagcaauaaauuaauaauucgguauacguucacucuuuggugauuuuccucugucccauauuuuuucugaaugguggguucaucucccaccugccuauguuaaguauuuuaguuuugagcucuaacauacugccauaaauuuauuuauucuguaugacuguauuaaucagauauuagaaauuggagguugaauauuugucauaaugccauaauaaauaauccuucccagguuuaaaaccaaagacugggcaguuuuucuguuuauccucuuccuuuucuguaggcauggcaaggaucuguugaucagugguuuagagauauacacagggacuguuuacugcaacuuuuuucucacauggcuucaggucacugaaagaaaaaaguguuuuuuuccccuucggagucaaggaacaaaguacaaauggcugauaaaacccauuccauauucaauacuauucaggauaggauugacucuucaaaaaauauuuccauaauugcuuauauauugcuuccucuccauaaaaacucuggauauuuuuaaauauugccaucuuuaguaauuuccagggcagcaaugauuaugauuccaugaacuuuggccuuuugugcuugauauguaacacuuccaaaggcuaaaccguggccuuauuccauuacaaaacaucacuugcuuauggcuacauuuucuccugaaacauggcagcucauuuuuucccuccuaacucuaaaacuauugcuuaaagaaauucaaguguaggaucacuugggaacuuuaaagaaugagcuauugaacuuucagaaaauguuaacaucuuaucucuuucucaauauccaaagauaauuuucuuuuacacauccagugauuuguggacuaguagaucacuuaaucucugauuuuuaggugcuucaauugugaaaagugacagugaugucuuccuaauugauuuuguuauugcaauagaggucauagauuggccucacaauuugacuuugccuuuuauugcuuagcaugucucauaugaguuuuccucauuucuuuuggaguuaaaauugcaaaucucccaaaucaguacucuggcccacuauaucaguuuuucuaagaaauacuuaaauaugcucuaaaucuacaguuacaguaaguggcauuggcucuagugauuugauuugagaguugagacuacagucuggauuuacucuuuaugcauuaacacaggccaaauggacagggacugcauuuuaaggcaguaauggaaggcugaaggcugucuuaaaccaaucauaccaguuuuacccaugacugauugaucccuaggggcagagcccuguaagcauuucucuuacaugaauggacgcuauagagccuggaguuucauucauaaaauggagacugaaaggaaacacacacacacacacacacacacacacucacucacucucucuggaauguccauuuauacagagcugaaggguguaguguuccaucagcugcugcuuaugccaguugacuggaaguaaugauuaaugcucauugguccugcuugcaaguaaccugacacuauuuauggccuugcaguguuccuaauguauagugaaugagaagacaacauucucaaaucagaaacauaaacaggaacuggugggucugaauuccauucaaauaugucauuucagccccacaguguuugucuaacuuggauuuuacaggcaggaaagggggaagggauggauaaucugcuugugaguuguacuagcuuggaaaaaggcaauuagaaggggguggagugugcuuuuauagggugggacuuuuaguuucuuuuuuaauaaaacaaccaggauauuuaggcccagaacugcuuauuucaaguggguaaagugaacauacaacuguuuuuauaaguggaacugagauuugaaauuaaaugagacaguuuaaagauacauguuuggaucucucuucucucucucucucucucucugugugugugucuuuguguguuuuugucuguuucaugaauaugaacaaaagaagggaacauauaacauuuuuuaaaguguuuacauaacuaaguaucuguuuuuagguuucgaauauaguuuuagaauuuuuacacuuaaaugauuucuauacuuaaaugaguuaacuaauagguuugaggaaaagagacauuuuauuucauaaaacauuuucaacuaggauaugaacaacuugaaaaaauuuucaaggaauuuuuaucagauuaaauagaugguuauuguucuuauuuuguguguguguguguguguguguguguguguguguguaugguuucuauuuaguuguuucuaacaaucuggaaaauuuuacaggagaguaauucaaagauaaauaugaaaaguaucaaaaaaaaaaaaccaaaagaacaacaagcauguguuauugugauucauuuaacuauucucuuuaaaaguauuuuucaacucucuguucugguaauuuuuuuuuuuaguaugugggucuguacauuucacugcuccaucuguuuuucuuaguauuaaaaaauaaaaccacucacuuaacaugacacuggaaauauuauaguaaauccugggccugacauccauuuacgauuugugucauauugagcauguuuuguaaccccuuaugccuccaguuucuucauuuauaaaagggcaaauaacucucaucuuuuaguguuuuuguaacggguaaauaugguuauguuuauaaagucacugauaccguuucuagcacauaauaggggugcaggcaauaauaaaggauucccauugacaugauuuuauuuugacuagauacuucuucaaagacugcuaguccuuuauuaagaugccauuauuauuucuaauaauuuaaaguacaguauuuggggcuagaggauaagauaaaauaagagagacaauacucuuaaaacaaucauauugugcuaguccagcaagagaaacagucuugcugaacuucuuuuuuuuuuuuuuuauuauacuuuaaguuuuaggguacaugugcacauugugcagguuaguuacauauguauacaugugccaugcuggugcgcugcacccacuaacucgucaucuagcauuagguauaucucccaaugcuaucccucccccguccccccaccccaccacaguccccagagugugauauuccucuuccugcguccaugugaucucauuguucaguucccaccuaugagugagaauaugcgguguuugguuuuuuguucuuguuuacugagaaugaugauuuccaauuucauccaugucccuacaaaggacaugaacucaucauuuuuuauggcugcauaguauuccaugauguauaugugccacauuuucuuaauccagucuaucauuguuggacauuuggguugguuccaagucuuugcuauugugaauaaugccgcaauaaacauacuugugcaugugucuuuauagcagcaugauuuauaggaaacaacaggugcuggagaggauguggagaaauaggaacacuuuuacacuguuggugggacuguaaacuaguucaaccauuguggaagucaguguggcaauuccucagggaucuagaacuagaaauaccauuugacccagccaucccauuacuggguauauacccaaaugaacuucuuacuaguauuauucauaugcaaagcaaauagaaaaaguuaucugaauauuguggugauccaaggagagaugaaaacaagaggacaaagcuguucaugguauguuuuuuuucaaaucauguaguuuccagcaagagagaaauuuaaaauugaaauuccacauuaaaaccacuaucucuucagaauuuuguguggcccauuuuggcagcuaauggcauccuguaucauacuuucuuuuucuuuuucuuuuuuuucugagacagagucucacucagccucccaggcuggagugcaguggcaugaucucggcucacugcaagcuccgccucccggguucacgccauuuuccugccucagccucccgaguagcugggacuacuggugcccgccaccacgcccggcuaauuuuuuguguuuucaguagagacgggguuucaccguguuagccaggauggucucgaucuccugaccucaugauccacccaccuuggccucccaaaguucugggauuacaggcgugagccaccgcgcccggccucauauuuucuuuuaaaccucuguuaauugucagaguaugguaguaugaaauaaauacucaaaguuggucaggcgcgguggcucaccccuguaaccccaguacuuugggaggccaagacggcagaucaccugaggucaggaguucaaaaccagccugacuuaagauagugaaacccugucucuacuaaaaguacaaaauuagcagggcaugguggugcaugccuguaaucccagcuacuagggaggcugaggcgggagaaucacuugaacccgggaggcagagguugcagugagcugagaucgcaccguuacacuccagccugggcaacaagagcgaaacuccgucucaaaauaaauaaauaaauaaauaaauaaauaaauaaauaaauaaauacucaaaguuacaguugugucuauguuuucuaucacuucaacuuuauuuuaaaauuucagcuuaguaagacuaucacaggcuuguaaaacuuguaauagugcgagccuaguagaucauauaaucuaauguuguuuggaucuggucauuauuugugugggguauuguccaaaagaaaaccccaggugcuuacaagagaaguuuauaauuguguagauaaaauucuauacuguuauuuuucgccauguagccuuaaacuuucaaaagcacguaaauucagauaacugcgauaacugcauuauuuacuuauucuacuuuuacuuuuucuuucuuuacuuuacuuuuacuuuuuuuuuuuuuuggacaaggucuggcucuguugccuagguuggagugcaguaguaugaucugggcucacugcaaccucugccuccugcgcucaaaccauccucccaucuuagccucuugaguagcuggcacuacaggugugugccaccacauccagcuaacuuuucaaguauuuuugguagagaugggguuucaccauauugcccaggcuggucuugaacuccugggcucaaucaauccucccaccucggccucccaaagugccaagauuacaugcaugagcuacugugcacagccuacucuuuuuuugagauggagucucacucugucacagcuggagugcaguggcgcgaucucggcuuacugaaaccuccggcuccuggguucaagcgauucuccugccucagccucccgaguagcugggaugacaggcacgcgccaccaugcccagcuaaauuuuguauuuuuaguagagacagguuuucaccauguuggcuaggguggucucgaaccccugaccucaggcgauccgcccaccuuggccucccaaagugcuaggauuacagacgugagccaccacgucugaccucuacuuuucucucuuuuuuuuaagauuuugcaaaugcuauuacaagcauauuaaaaccaucuaaaaauuaacauauuucucccccauacucaaucaauaguagauucaguacauccgagcuauugugaaguaaguaucucugcagauuuuacauuauuuauauucacaguuuacuuaaaacccuaaagagaaagaucccaucuaagugugagugagguaauacuaaauucaucacucccuugucaggauuucuccagcuuugcugccuucuucacaugagguucaguaacuaagauguuacauucaugugaaguucaguaacuaagauguuacauucgcauccaguucaguaacuaagauguuacauucacauccaguucaguaacuaagauguuacauucacaucaaguuuaguaacuaagauguuauauucacauugagcuuccuaaugaacagcaaauaggucuuauaaaacuugacuuuuuugcuaucauucucacaugaauucagauauauauguccuuauuuuggaagauaauuacuuuuagacuuguucugcaauagaguggucauaugguaaaaguaaaaaaaaaaaaauuauuuccauuaucauucauucuaggaaacuuuaugaaauaaguuuucucaauugagugcacucaauuugacaugugacaauuggaaaagcaggcuaaaaguauggcauauacgugauggcuuugcauuuaaacacaucugcauaaaacucagguaaucuaugcauccuuguaaaccuuuggauuuuaaacauaaacuaugagcuuaccagcaaaugagaagaaguaagcaaacaaaaaaucuagugaaguacuaaguuuaaaagagauaaaauguuggcaagaucugucacuaugcucaucuuucuugaaugagauuggugauauuaauucuuaauacaacucaguauuuuuuacauaauagacaaauguuuuugaaaaacuaguugaaacuccuagguaugcauugauacacacauuuuuuacugaguauaugauaauuucagauauguguuuacauacacauuuuggcucuggauauuuuaugcaccaaguuuuagaaaucaucaauauacaauagacaaguuuaugugcacuugauuuugucauaucaacuccacaaggaguuagucaaguguauaaucaauccagcuuugcacuauauacuuauaggaaagcaaaaccacauuaaaauacaacaucaaacauauuuauauuuuacugagauuucucauuuccucuaagagauucaaaugcuuaauuaaguuauacagucguuauugguagaagaauuuaaccaaaagcaucaaauggaaaagacuuguuuuucucccuuauuuagagguuauaauauguuauaauuccagauuuacacacuauuugauagcagagcaauuucagccagcucuguacagauauuucaggcaacuguggcaaaucuuuucucuuugccguggccugauguagauccuugaaauuuuaagcaaacucugcccuaaaggagagccuccauucugcuauagaggcagcaaauaugcaaaucagagagugccuagcaauuuuaaaugugcaaauucaauacugcacuuuguggucaaaccuuugguaaagcuucccaaaucaauauuauguuucccagcauagcuugaaaaugcaaaucaagagacagagaagaagguaacuuuuuuuuuuuuuuuuuuuaguuucuugucugcguauuuuaauuugaagagaacuuuacugauguuacuaaacgugaaaacuaaucaaauuagauaguuugggguguuaguuuauuauucuucuuaacuuccgcuacauugauuagugcauuaaaaugacaacagggcuuuguugcuuugaauuuuuacagcauauuagaucagcuuucaucaccaugaacucaucuguaacaaauuauaggcaguuuaauuucuguaagcugauuuggccaguacuaauaugucauagagcauuuugauccacaaguuuugaaacaaauaaaauucuuuguccuaaauuaaauuuacauaauuuaauuuuuagauuuaauuuaaaacuuuuaaaaccagagcgcuuuaggagcuaacaugaggggguaauacuguaaaaagaagcucaaaagagguacccccggccgggcgcggugacucaugccuguaaucccagcacuuugggaggccgaggcggguggauuacuugaggucaggaguucgagaccagccuggucaacauggugaaaccccgucucuacuaaaaauacaaaaaauuagccaggcaugcuggcgggagccuguagucccagcuacucaggaggcugaggcaggagaauggccugagccgggaggcggagcuugcagugagcugagaucacggcacugcacuccagccugggcgacagagcgagacucugucucaaaaaaaaaaaaaaaaaaaaaaaagagguacccccaaauaguuaaagcaucuacuggagagucuggcuuaaaccuuauaaguuuauaaugaauuuuauuguauuuuagauaucauagauuaauagauagauuugugaaaaauauuccaaaauagauacacuaauaaucaacaaaucagucaucucauauaauuuaagaacagcagaguaagauaacaaauguaacuuauuuagauauauaauuauuuuuaguuuuaaguacugugguuaaaguacucaguuuaaauacuugugaggaucacuuaaaaauaguguuauuaauaauaagucccauauggugaauucuuacagugugcagauacugugcgaaauguugcacauaacuuacuccacgugguccucccaacaacccuuuuaaggaugucauuauuauuauuauucccacuuuacagaugaggaaguugggaguuagagauguuaaauaacaacaaaaugucauacucccaugcaaugucagaacugagauucaaaaucaguucuaucagaugacaaggugccuguuuauaaccauugugcuguacuuguacuaaugauccuuaaacuauaaucuguggaugcauaauaggacagugugaauaugcugucaucuuaauauuuuugcaugaguuaaacuacagcuuguuacgguuguugaacuuuguacauuuuauucgugaagaaacagaacugaaugcauaugcaaugccuccuuccucugccacaaaacauuugccuuugaagucgccgcuuagcuaguuuggaucauagucaagcauuuaacaaaaguuaaaauguaaugccaaacuucauugguuggauuuuuuauuagauaagguagaaaugaaagcagcaggcaauuuaauuagcaguaauuuuucugggcaagucauuacuuugaugaacuucagagcaauguuuauggcuccuaauuaaccauguuagucauuugauugaauaaucacuuuggaaauguuucuacaauuugauuagagucugacccacucugauagucauaaauuaacugauaucacuuaaggauaacaugacuuuacuuacuuuauggggauaaucuccccuuagccauauuuuuucaggcuucucuggacuguauaaaggacaccaauuuuaaguauagaccagauuuaaacaaugcuagccaaguguauccauuuuaagagcuagauguuaauuuuauuuacacuagaguauaaauaguaacagcaauuggcaaaaacacagucguauuccauauauuucuaaauugccauccauugcuuuuuugaguucacaaguugggccuuuggaaguguaauggagauucuggcauuaaccuuauuauauguuauuaauuuauuaugaauuuuaaaucaguauaucuuaaauaucauagauuagaauuuauuaagaauguuauaaaguaaauauagcaauaaacaaaucagccauuugaauagagaugguauuagugaaauuauccaucagaucucaaauuugaugucaaauaucuaguuuuccaggguuaugcuaauuuugucauauguuaaaacacuuuuauaagguguucuuugacauuaaauagugaauuucucagaaauguuugcacuuccuuucucccuccuuuucucccacucugggaaggaaagacugcauuuagucacacuuauauguaauagaguuuagccuaucuguuuuccucuggcugccuccagagucagccagcuguuuuuauagccgcaauccaggugugcagcagucaauaaaaguauuuuguggcagggugucaacauuaguucaacaaaaugcuugccucaaagcagcugcugagcugauggcagaguuauuaacacugucccuuccagucccagcugcuuuaagggaccuuacgucugggaauaaaucaaaauagcauuaaaaauuaauuugaaguaccauugguuaagaaguugggcuaaaauggauugcuaacuauuugguaacccaaaagauuaacuauacugcaacccuauuauaaaugcagauaucaggaaacaguguuaacucugucuuuuauauggucagaauuauaugcuucauaauacuucauaugaagaaggcauaguauaauagcauaauaaaacuuuugauaauacauuuuacaguauuuucaacuugaaagcuucuaaauauuuccaauguugcuauauucauagaaugcuaugggauuauacaaauuuauuugcuaaauguccugaugcauauuuaaaacuugugacccuguuucaaggacaccaucucauucauguggguugcuguuugagcugacuuuuagcaagguuuauuuggguaaaacuuugaauucaccuuccuauucaagagaaucagcauucaccaagauauauacucuucauucuuucauuucaugugugggcccugccugaaauguugauuauauguugacauguuccccacauuggaaccuguguccguuucuguaucuucucugucugcacccuguccauugauaaccgcagcguuucagcuccagacucuuuuugaccaauauuguuuccucuuucagaagugccuagcugccacuccauuuauaugaggcaagaaggcuuccuggcucaucccagcagaacagaaguuaaguuguccaccacugaaauuccguguaaauaccguucagaauaaucagacaucccaaauaugacgucauuuaauuaaucauuauauuauuugggaaaaaucauuuauguucccuaagcaauuguuuuaagacuaucuccaaaguaaaaagaagauguuucaaguagugguaucuuguuguuaacaugagucauaugcguagaaacaacugaaaaguggauuucuguguucuuuuuugccaacaaccacauccuuuuaaaauagaacauaugcuuuauagauuagcccacuuuacuacuacugaaauguaucuuugaggaauauuugguuuugcuuuuacagaccuagucauaguuuuggaguaaaaugccaucgauuuaaagguuuucaccuuuaaauguucuggauuuuauauuuuuggacaaauaauuuauaugaaugagauuucacauaggaggccuagagaaagaguuuucucauagacaggcuugugguaaccgugguaggaaagcuuugccuguaaaggacuuugauaccuaaaaaguaaugguaaaaaugauuucgucuggauauaauccucaauaaaggauuucugaaauaugugcaugguuccuaaccuaaacacucuacaucucuuuaauaggauugacuuggaugcauucuuuuaggcuaggucuaauauugguuauuuuguguaaaugauauuaguagaauuuuaaaggguaguaugagaugguaaauguaaaauauuugaaauuaaaaguuuugcacaaaugcaauguaauuauuguugcuucuguuguuaguauuauauacccaccauaaagaccaauacauuugagaaauaaaaguaaacucuaugaaauuuauuccugguaaucacagauagcaacaacgaaaguucacagugaaggauauuugagagaggacauuauuaugaaaagcuguugauuuauuuugcauuuuuuucuguggacuuaccuuacagcaaaaaaaaaaaaaaaaaaagggaaacuuuuuuuuuccucuuaucuugcuaauugaguacaggaagguuaacccaucuaaauauuuuuacaagaaaguaagaggauaaaauaaaucugucucagagcaucagacuaauaauauaaugugaauaccaguaauucaccuugcuuucucacuuuuucauugaacaauaaaauuuagaugaaucuaaaaaaggagacgauacguuauaaauccuugccaauguuuaggugagcucuggcuugaguuaacaauguaaauaacuaacuuuuauauuucacuguguacuaggcaucacucuaaacuacagcaacccuauaacaugauaagugguguuacugucaucccauuuaauagaugaggaaacugaggcacagagguuaaauaauguguccagggcucaaggaacugaaaggugguggcagagucauuuucuaucacaauuuuuauguuaaaugguuauauuuuaaguguuugugagcuucauuucuaucaugaauaaauguauuccuuuuucauccacaggcuguauguuugaaaagggccccaggcaguuuuaugaugacaccuguguugucccagaaaaauucgaugguagguuuuacacuuugccucaaguucugauuuuuuuaaagauggagugauuaccuucgcuucuucugaaaacaguggacaucccuacuuaaagauuccuaugcacauaauucaucaugcacuuaauuuuagccaacguugaccuauuacaauuuaucucuuccuugccccaguaggaaaccuuuucuuuuguguuaggagggaguucauuuuuggagaaauagacaaagagcaucauucuugcugagcuuuguguagcguaagagggggcuuuccauugcccugcugagcacaugcagcuuguuauucgagauuuauugaaagcugauccuguaauuaacaaagcagagcagaaaacgugcugcuguggauggaccgaugacuaacgcggccucucuucuuucauuguucauggaaagaugcauuauggaacacaggaacaacauaacugcccauuuaguuagugauuguuagucccuuuuuuuuuuuuuuuuuaacuggggaagauguauguuacuaauguagcaugacuuuguaauugcuuaaaagggaguuaggaaagcauuaccuuuuuaauaucacuugcuauugcaaugcagaggucucagauguuagaaaagggugucaaguuaaauugaauuuuuuuuuugacaaaggugacaaaaguuggcaucuugaggaagcuuggguaaaaaguaaacaguuaauugauuuagugguucuucagagugguuuucauauuuccugcuuugaucguuugacaggaaaccagcaggggcccugugauucacugauugcacaaacuuugggggucauggcuauaaugacuugggugcucucugaaguuuuaaauugucauuauuuaaacagcaauguacaugcucagauugcuuuucaauuucuaauuaguugcuuggagacuaccccauguucccgagcuuugugcuacccuuacccuucucagaagggcugguaagucuagggaagaucugcuucuuuauccuccuuuagauuucuaaauucauucaaggucaaaaaaaaaauuauaggaaucacauuuuugguuuuauucuacaacagauguuagcuuuaagcuuugcauuucagaggggugagccguacuauuuagcaacauuagcagagcaucagcauucuuaaaauauagcauuuucucuuagacaaaguauauaaagccucuuacucuuggaaugaccuucauuaguuucuuucguguuuggugagcuucauauuugcagagaucuugaaaauuaguaagggcauauaagaaagaaaaauaucucaaaauuauggacagaauuacaauauaaucugacaggccaaagucacacuaauauuuagggaacaagcugccuugauuauuuauucccuucgacuuuuaaauacucuucaauuuuacacuaauaaaacauuuuuuggaagauaguauuugccuuguauuuuauaaguaauguagaacaagaagaaagaaaaaugaggggguuauuuuuucacuguacauggucagugugaucagucacauuuauaggcagaagcaauauagagacuauaaaauguaacaguguuucacucuaucugcauaauuacucaguuacucccauaaaaaaaacauuguaaaucucagaaggaaaaacugagauaaauaaaacugucauugaaaucgauaugaagauacacuucuauauuaucauguuaagaccaaaacaacauaaugauuuuagcagcuauugacucacacauuuuauauuuugguuuagguuuuucaaauguugcccuuucuguaauuauuuuaagagguauaugucucucuacugaccauagguaaguuuuagaaagugugcaauuuggucuauuuuauaaugcacacuuaguaugacuacauaggcuuagauauauuuugucuggauuguuucuuuagcggagaagagcaauuuaugcacuaacaaugacauacuugcagggcccuagacacucaauccccaaugugagcaguuccaccuauuuuugagacauguggcuggagauggaaguaaauaaucagaagucaugaaacuuuguauuuuuuuuuguaaaauuaauauaacugaccagauuuauaccagaagcauugcaacaugaacaccuuuauugcugugcucuauuuaacagauuuuuacacuagauaugaauaucaaauaaauauaacacaaacuuuuugugcuuaaaaauacauacuuacagaaaucucucgugcaugcauuuuuaaauuggacuuuuagaaaaaacaauagcaaguuaaauucaagugagugaaguacaagcaagagauaaagaaaaaugagagagaauuuuuguuaccaguugaaaaaguaguagcuuuaauaggaagguauaugaugcggugaaggaaggguaguacuacgauaaugcaguaugcccugaauuacccacaagauuuuccuuauuuauauaaagugaagauuacuuaacucaguuuaggauacuauuaaauuugcuuugaaauauuugcauuaaaauuuucaauaguuuuucaugagcaggucaauaagauauuuauaaauuauaguuugcagaauuuaauuuguaugaaucaaaugcccagagcuuaagauugauuauucccucuucaguguugccuagagcaguggguaauagcauuaacaauaaaagcaaagaagucugauuagauacgaugguuuuuaaagaaaucaauuuaaaaaaaaagauaguuccacaauauuuuuguaaguaaaugaugugugucauucauauugacacaggauuuauucugcaccuguguuauauauaguuaucuguaaguucguacagcuugcucauuuauauucaaccauuuaacuauuuuaaauuccucuuuaaugguaauaauauauuucauaaaugcccauaaagugguugauugugguuuaaccauauuagugauugauuuaauguacauuuuauguaagauagcauaguauugcuaauaauagaaacuuaaaaauguuuuaauuuaggagacaucaaacaagagccaggaauguaucgggaaggacccacauaccaacggcgaggaucacuucagcucuggcaguuuuugguagcucuucuggaugacccuucaaauucucauuuuauugccuggacuggucgaggcauggaauuuaaacugauugagccugaagagguuaguuuaauagauuuuaauuaggacacucagacauguuauaacauaaagaaacugacacauuugauuaauauaccaaaaauguauucuuaaucauuucaagacuuuagggaaacuuucugaauuaaaaagcaugcaaagauaaaacaugucuaccuuuaaaaucaccaauguauugcguguuccuuccgguuguauacaauccuacaaaauugauguuggagaaaauuaaccagagcaugcuuugcaccuuuauuuaagaaugucuggcuucaggguuucuaaaggagcaucugaauuagagaaaagaggcaggagggagguuuuaugguccuuaggagagaggaacgaugucugcaaaagucaacugguugggggaugggugaauuauucuuucaaauuagcaaucauuauuuggacaacuuggauuuugucaugaggguuggagaggagcauuuagaggccaaaguuauguucaaaagaagauuggggaaaaacagcuguggcggauaaagggaugcaagggcaacaguggaaaauucucagcccuuaagugucucuuacaagacacaggccugguagaaacauuuuccuuuguccgugacacuuguuccaagucagcuggacuggcauacuccauuggaagguugggaugaaguuuaaaauguugccauagcacauaaaaaauuacuaaaauaagaagagccuggacagagauaauacuguacagagaaauggaggacaccuucaacuaacuucaauuguccccuccuucccacuccccacauacaaauggaguauuuccaugaagaauuucucaguucaguuuuuauucuucccagaacuagcuuuaggcuuaaggcuacuauuguuccuguagcauaacucaucaauagcauuuuggacugcugauggaaaggugaaguuaauaucaaauuguugugucuucauuacuaaagauacuuucucugcuacuauuaaaauugacuuuaguuuauaucagccaaaaaagcaauggaagauuuuuagcuaccauaccucuaacugauuauauuagguauugaaucuaaacaccucaguaauauugaaaaauucaguaaguuuaaaaaauguuugaacccaaagugauuuucauauacacugaacauccacacccuugacuacuggguccaucaucuugaauuuucugucuuuauuaaaccacguauucaacuauaaucagauaauaugcccuaauuugaugcccagaagauaaguuuacauaacuucuugaaauuuaagagauuaucugacucgagaauguacugaaaguaugaaauaaaaggcacugguuagaacagucaagucuccuucaguuuauaucaauacuuuaguaacacuagaggguuaguuuugcaguaucucccuugccccacaucaagcacgcacacacagaagacucaaugucaguauuugaaaauucucauuaucuaggaugacguuuggguguuugaaugcuguaguguguuuaaaauuaacuuagcugucaaagaagauuaguuuuuucauagauacucucacaugauguaagugaaagaaccacaaaaauguuaagcacuaacaaauugagacuagaagcauuuaacaaaguaauuugaaagcccuuucgcaugaugggagugugugcucuucaccucauggaagauguuaauaaucacugcaagaguugguucaugcuggaacugagcacuuucuacagggauuuguaucaguuaaacaguuauuucccuucaccugugauuaaaaugaacugagcagagguuuuuguuguuguuccugccauauauuuguuaagauagggaacauuacugaauuaugccaguauuucuugauccacucagaagaagaaaaauucuuuugcaaaugauuaagcuuuuuauauagcaacuguugacuuuuaugauguucagauuugaguaaguaggagauuugacuagaugaccauuaaguuucaucaaauucugaguuacugugauuuuuaaauggagggaagaaguagaauuacaucuguuccauacaacagacugacauuuagacaacucuucuguagcagccucauaaaguuaaaaagaggcuggauaauucagagucaguagagcguuuccaaauaauaaccaacucaaugggaauugugcaauaagcacugaaugucuccuaaggcuuuuguucaaaaugaaacaucccauaucugauugcugcauugcugacuguugcaauuacuuccaucaggcaaugacuguagggucuuguuuaaauuucuucuuuggaaaggguuugugaaauuucuugucuuugugaccuguggucacccuguucccucuacugccuagcagcucauugggugccugugucagcacaguccgugaaagaugucucugaagccaucuuauuggaauuacugauggguuccauuucuuuauauuucaucuugcauuuuaaaaugauauugagugagacuccagaccugcacagauuaucugcucaguguguuuaggguaacuuuagaaaacgcauaaucuuuaacaugucuuuuucuuagauauuugagauaaugaaauacuauuuuugaauuagucaugucuccuagggaauuguuccaggaaacaauuuuuuuuuuuuuuuuuuuuugagauggaaucucacucugucacccaggcuggagugcaguggugcgaccuuggcucacugcaaucucugccucccggguucaagugauucuccugccucagccuccccaguagcugggacuucaggugugcacccccacacccagcuaauuuuuguauuuuuaguagggacgggguuucacuauguuggccaggguggucuugaacuccugaccucaggugaucugcccaccucagccucccagagugcuaggauuacaggugugagccacugugcccggccgggaaacaauuauuaacauagaaagucgucuguaagacucaguauaaaagucuuuugaugaaauugaagcuuguugagcuggaagaguuaccaggaagucugauagccaggcccugauuguuguuaucagguucaguguuacauauucaagcgugauauuuuaaaauaaguugauuaaugcuugaacuauuacauuaucuuauuuaauuuauuugacaauaagggugaaugccauagugcuaucaucuuuuuacucucuucacuaacaacucaaguuuucauuugaaggcguauauaaggaagucacuggaaguuuucccaccauuuuucccacuccauauuggaaacuaugccuugacuuugagugguguuggauaugguggcgauuggucggucguaugugaaggcugaaugaacuuucuuaguuggugguuggccuaccuggccuggaauuauuuacgcuguuaauuuauaacuuuugucuugucugcaucucuuaagcauauugcucucucccauuuaccucaacuuuaugaggaauaugacacuaaaacaacucuaagacuacauuuuauuguuuuuaaauguccacuaauacccaugaugcugagaaugaacuggcaugauaaguaucaaacucugugguauuuuuaaaaaucauauuucucucuccagagaccuccacaacauuguauuaaaguuguugugaguaugugaguauuuuauuuucuaggugcauccuggugaguuucuagaaaauaauccuuuauaaaugaauaaggauucagaaauuauuguuuaaggagauacuaauacuuuauuuucacauccccuccagguuugcauauaguucggcugcuaugccuauuaaagguucacugauguccauaguuagguuuuugaaugaaauauucuuuagaaaaugcuuucauuucuuauugccuccccccagcgcccccacccccgcuucaauucacuauugcucagaagauuuacauuaaaaugaaguuuaucuuugggaaauugagauguuccugccacugugauugucugcugggauauaugauguugucccuguuacaucgcaucucucuacucuuaaaaaacauacugaugcaugucauuaaaguacuuuauuucuucauucagagaauaaaaauuacugagagggaaaauagcuaggaucgguauuucuaaaggaaaaaaaaaaccuggagaaagguuauuacuaauaaagcaaagagagacagaaugaucucuuugaaaagcaaucuauuuuaguauauaugacauagcaacaacuuggaauuuuauggaaaugaaggcgcucccuagcccuauuagauaauguccucuugggguugccuagguuugcguggcagcugcaguuucuucucagacuaauaaaaaguggaaauuaaugagagagugacuuuagcugggguaggaaaagcaagcuacacuauucuguauacugcuuuggcuagccugggguggugaugagguagggauauauauacauugaggagagaggauuuuuuuuaaagcucuauugaaaaacucuuagauacauugcuccuccaaagccacauaauaaaaagcucugaguuuuuuuauuaaacaacagaguagacauucugcuuuagagauuuuuguuuguggacucauauacauggugaccuuuuccacuuccuucuuauuuuuagcauccaauuaccguucucuaaaugaaugcuuaauucuucaguuugguauuacccacaguuuuauucggcugcugcuuuaggcaauaaaaaguauuugcaguucgguuuauuaauuuguguacuguuuccucugcuacacacauugucacuuguucacucuuucauauaguauugagcaggguaucuuuuuuccuuuggcuuaucauaaccucaguaaaacaccuuuacaaggagaucacuaagcugcucuuuaucuauaguuuuugucugaaaaaccaagaaggauaaaacagacaguauaucucagaaugaaaaacgugccucauuuuggugaacuguagccuguucauuccuguuguaagaacauuuccuuauuuccauuuaauuuuguauucaaaacaauagugacaaauaauucuauugugguguuuuagaaggaucacugcacgccugguuuaaaaugcaaaccaggccaggcgcaguggcuuacuccuguaaucccaacacuuuuggaggccaagguggguggaccaccugaggucaggaguucgagaccagccuggccaacauggugaaaccccaccucuacuaaaaauacaaaaauuagccgggcgugguggggcccaccuguaaucccaccuacucagaaggcugaggcaggagaauugcuugaacacaggaggcggagguugcagugagccaaguucgcgccacugcacucccagccugggugacagagcaagacucuguuucaaaaaaaaaaaaaaaagcaaaccaggagacaggaaauccagauuacgauagcucuugcuacuuuacuuauauccuugaguuggacauuuuuguggguuuggaaguaauuaauuaaauaauuuuuaugaaauaugcugauaaguuaauacuuaacacuacaauguaauucuguuucgcggcagguggcccgacguuggggcauucagaaaaacaggccagcuaugaacuaugauaaacuuagccguucacuccgcuauuacuaugagaaaggaauuaugcaaaaggugagcagcuaauacagcauuaaaauucauugaaauguugcacauuaaucugaacaucauacuuuaaacgccacauaucauugcauugcugaagcgaguuuuucacucauuuuaacaaaugcuuagcucuugguuuugguauuacaagccuuucuauguauaaaugccuagacauuguagacaaauguguagugauauuguauacagaauaauaggcuuucuggaagguccuacuuugcugcacaugguuaaaaaagauuguuuuaguauuaauagcacaucugucuucagaaguuuuuauugcacauugucuacaauuauauaauuuuggaaugcuuuuguuuauagcaauaaagaaucuuuagaauaaauuuguacuuuuuucuuguuuugauucuuaaaacagacauuucuuuuucucauuugugaaaacauuuucuuccuugccucaaaucuugccuaguuuuaucaucugauaguuugacauccuaaaccauucauuaaaaaugaacauuugaucuuauuugguuuguggaaguucaauauauuuuauuucaaaugagcuucccauaauauuugaaaguagcuuuuuguuuguuuguuuguuuugagacagauucuagcucugucgccuaggguagagugcaguggcgugaucuugguucacugcaaccucagucccccagguucaagcaguucuccugccucagccuccuaaguugcugggacuacaggugcgcaccaccacacccagcuaauuuuuguguucuuagaagagauggcguuucgccauauuggccaggcuggucuugaacuccugaccucaggugaucugccugccuuggccuccaaggggcuaggauuacaagcaugagccaaugcacccagccaagaguagcuuuuuaaaaaagaguagagaaaaaacaagugaauuacacuuaaaauaaaauacaacauuuuugaagaaaggaauaaauaaaugaaugaagauaaaacguggauauuuguuuuuauuacacccuuuagcuuugcaaguguacagaaaucuaauugcuuugacugugaaccaaguuuaugauuuaccuauugugaacguuacaguuuuauuuuguaucauuuguuuauuuuaggguuuguaaacauaguuacauguuauagauuguggcacauuuuuaugucaccauaguuuuacccagaaaaacuagaccaguugcuacaugaagcuuauuagagcagcgaaaaauagcacuguugacuuuccuagaacauugucuauugacaagaggcauauuaucucagugcccuagaauuugcuggcucagacguuagaacuuccaugauccuuaaaagaaaaggcugacuucgauuuucaguugcuuccuguuuucucaaucaugccuucaaaauguauaacaguuuacuaccugcuccuccugucuuuuucaucucaacccuggggucauuucuaauuccucccuuucucucaccuaccuuuuuguaguaagauccuucaaauacauuccauuccuuucuuuucaccaccaucuuccuaaugcgggggcacauugccugggcugucacagauggugcucagcaguguccccgggcaguauugcacagcaguaacagauaaggcagucaggaauuagguuugaaugcuagccucucaccagauuacauucuugaacagauuauuuuccuaguaaauggugauauucuugccucauuaaaguugcugugauuauuaaaugaaauaauguacuugagauacuuuacauuguaacuggcacaauguaaaguauaucugaacuccugggcuccagcaauccuccugccucagccuccugaguagcuggaacuacagguuugcaucacugcacccagcuaaucacauucucggauauguaccauucugauguucaaguaaauucuaguauagucauucagaggaaaacuaugcuguccuuuuuuaaauagcaaaaacuaugauguugaauuauauauuuuaacauguaggagaaaauauuuauauggcuauauuuguucacuaacuuaaaacuuugugggcauaugugguguauauaauauagaaaauuagaagauuagagaaaaauaaaaauaacuuacaucugaacauguuaaaaaaauugaaaacugguaauuaauuuuaguaauacggaagaaguaagaaacaauggaacaguguauguuuaccuuacagacaaugccuauguguacuucuauuucaaaauuaggaaaugccuagaacaauauauaccaauauguuaauggugauuauauucuggaugauauaauuauagacccuuuguuuuaacuuaauugauaauuucuaauuuauccuucaguauccccauauuacuucugaaauuuuaagagauaaaacauaauuugaauauccagccauugaaagcacagcucuaaagcuaucuccuuguuuacuuuugauuuaucucccuggaaaaauuccuguuuuuucugucugucucaguguugcauuuuggcuauacuuaauguacagcauuuugcacguuaguacuucuguuacucauaauggaagacaucauuccccuugguugguuaucaucccuuguucuaaacucaguagcauuuaacauaguccagcaaaugaaguaguagcccuaaaaauguuuauucaaaagcaauacagaaggaagcagugaggaaaggcagaguccuugagagauugcauaagcuugauugcauguuacacauuuuaauucauuuauuacauaauuuuuaaguauagccaguagcaacccgucaaaggaaguccaguacuuaaagcaaauguaucuuccuccacagccccaaacaaaacaaagcacauuauaaaacacucagagguaugcaggccauuuauuuuauuuuauuuuuucuccaaauacuuugaacaaagaaaaaaauaaaggaaaacuaggauuuacuaucucagcuuuguuccugauagugcuauuuuuauguuuauggucauuucaucauuucaccuuuaagaucuuaauuuucuuuguaugaaggacuaaaguaaauaaauguaugccagacuccucuguuucuggcacagugcucugugcuggagacuuccaucccaaccuugcaaugggcuuucugaggcgccauuccugucuccauuucacagcaaaggccacugagagguagucuaagaaacagguccaaauucauaaaaacuacuaaauguucauucuuucaaaccuagguacauucagauuauuugaauucucuaaagugguuccucuuacuuaaauucagggcaaaagaaacaaaaaauguucuaaauuugaauucagagcagcagcauucauugacaauuguuacuuuucccucaaagauauaacaauacuuuauaacccaggaacacacuguugccccacaucaaaaaucaacuagcaaaugccuuguugauauacaggaacauggagguguugugucaccuucagcuuucuaaaaucucauaccuuuacacacacccauacaaagugacuaucaaaguuaauagaaagaacuguauucauccacccauccccccaccccggguuuugagagcaucucagcauugucuauuaacaagaggcguauucaucucacucaguuguuuauaauuuucuagggaagcauuacucuucagaauuuaaguuugggguaugucauacccuauaaauuaugcuacuucuuuauuccaggcaguugucacauuucuuuuucucauuuccucccugugcauuguguauuuuaaauuccuuucacuuuuuuacaccucuuacuucaauuugacacuuuacacacauccuuaacucugucuaaugcaucuugccuucauuuuuaaaagugauguacccaggauacuguccuuuugauccaucuuucauuuaaaugaggcuguguauccuuucuuucuuucuuucuuucuuucuuucuuucuuucuuucuuucuuuccuuucuuucuuuuucuuuuucuuucucucuccuuucuuucuuucucucucucuuuucuuucuuucuuuauuucuuuccuuucuuucuucuuucaacacacacugccaaaaaagaaaaaaaguaaagaauccauuuauucugugaaucagugaauuacuagucuagucuuauugggaauaaagcacauuuuucuuuuaaauuuugaauuuaguuuuucuaccauuucagauauguaauauuaagagggacaguguaccuuaaaaguacagauuuguagauacuaccuuuuaaaaugcagaaaaaaagcuuucaauaugaaaugccugcauuaaauaauugacuuuuuuucaaaacaacgauguaaguuuaccucuauauuaagacaagcaaauuccugugcuuccuagcuauaucuggaauuaauuaauuauuauucaaggucaacauuuugcaucucccuugacugaacuguaguuuauuccacaaaguaaagacuuuuuuuuuuuuauguguaucugcuauuaguuguuugcuuuuuugggccagaguuacccauccuuuccuguauauuaaaccacguuuuuggcuuuuuccuuccuguccuuccccaucuggcgauggugaggauggguuuuucucuuccauguuaucaucagguggcuggagagagauaugucuacaaguuugugugugauccagaagcccuuuucuccauggccuuuccagauaaucagcguccacugcugaagacagacauggaacgucacaucaacgaggaggacacagugccucuuucucacuuugaugagagcauggccuacaugccggaagggggcugcugcaacccccaccccuacaacgaaggcuacguguauuaacacaagugacagucaagcagggcguuuuugcgcuuuuccuuuuuucugcaagauacagagaauugcugaaucuuuguuuuauuucuguuguuuguauuuuauuuuuaaauaauaauacacaaaaaggggcuuuuccuguugcauuauucuauggucugccauggacugugcacuuuauuugagggugggugggaguaaucuaaacauuuauucuguguaacaggaagcuaaugggugaaugggcagagggauuuggggauuacuuuuuacuuaggcuugggaugggguccuacaaguuuugaguaugaugaaacuauaucaugucuguuugauuucauaacaacauaagauaauguuuauuuuaucgggguaucuaugguacaguuaauuucacguuguguaaauauccacuuggagacuauuugccuugggcauuuuccccugucauuuaugagucucugcagguguacaaaaaaaccccaaucuacuguaaauggcaguuuaauuguuagaaaugacuguuuuugcaccacuuguaaaaagguauuuagcgauugcauuugcuguuuguuguuuuauuuugcuuuauauaugacuugcagaggauaaccauaaaauggguaauucucucugaaguugaauaaucaccaugacuguaaaugaggggcacaauuuuggacucuggcgccaaacugagucauaggccaguagcauuacguguaucuggugccaccuugcuguuuagauacaaaucauaccgucuuuuaaauauuuugaagcccauuucaguuaaauaaugacaugucaugguccuuuggaaucuucauuuaaauguuaaaucuggaaucaaaaugaagcaaaaaauaucugucuccuuuucacuuucuucaguacauaaauacauuauuuaaucaauaagaauuaacuguacuaaaucauguauuaugcuguucuaguuacagcaaacacucuuuaagaaaaauauccaauacacuaaauagguacuauaguaauuuuuagacaugguacccauugauaugcauuuaaaccuuuuacugcuguguuauguugauaacauauauaaauauuagauaaugcuaaugcuucugcugcugucuuuucuguaauauucucuuucaugcugaauuuacuaugaccauuuauaagcagugcaguuaacuacagauagcauuucaggacaaaauagaugacucaaaccauuuauugcuuaaaaaauagcuuacgccaugcuaugcuauaagcagcuuuuaugcacauugacaaaugaagaguaagcuucagcuugcuaaaggaaacuguggaaccuuuuguaacuuuuggugauauggaaaauuauuuacaaaccgucaaagaauaugaggaaguugcuguaugacauagugcuggcacugauauuauccaucaucucuuuuuggacacuucuguaaaugugauuggauuguuugaaagaagauuuaaaguuucaaaguuu

SEQ ID NO: 17395 - RNA, 44895 nt, Homo sapiens
aaacuuugaaacuuuaaaucuucuuucaaacaauccaaucacauuuacagaaguguccaaaaagagaugauggauaauaucagugccagcacuaugucauacagcaacuuccucauauucuuugacgguuuguaaauaauuuuccauaucaccaaaaguuacaaaagguuccacaguuuccuuuagcaagcugaagcuuacucuucauuugucaaugugcauaaaagcugcuuauagcauagcauggcguaagcuauuuuuuaagcaauaaaugguuugagucaucuauuuuguccugaaaugcuaucuguaguuaacugcacugcuuauaaauggucauaguaaauucagcaugaaagagaauauuacagaaaagacagcagcagaagcauuagcauuaucuaauauuuauauauguuaucaacauaacacagcaguaaaagguuuaaaugcauaucaauggguaccaugucuaaaaauuacuauaguaccuauuuaguguauuggauauuuuucuuaaagaguguuugcuguaacuagaacagcauaauacaugauuuaguacaguuaauucuuauugauuaaauaauguauuuauguacugaagaaagugaaaaggagacagauauuuuuugcuucauuuugauuccagauuuaacauuuaaaugaagauuccaaaggaccaugacaugucauuauuuaacugaaaugggcuucaaaauauuuaaaagacgguaugauuuguaucuaaacagcaagguggcaccagauacacguaaugcuacuggccuaugacucaguuuggcgccagaguccaaaauugugccccucauuuacagucauggugauuauucaacuucagagagaauuacccauuuuaugguuauccucugcaagucauauauaaagcaaaauaaaacaacaaacagcaaaugcaaucgcuaaauaccuuuuuacaaguggugcaaaaacagucauuucuaacaauuaaacugccauuuacaguagauugggguuuuuuuguacaccugcagagacucauaaaugacaggggaaaaugcccaaggcaaauagucuccaaguggauauuuacacaacgugaaauuaacuguaccauagauaccccgauaaaauaaacauuaucuuauguuguuaugaaaucaaacagacaugauauaguuucaucauacucaaaacuuguaggaccccaucccaagccuaaguaaaaaguaauccccaaaucccucugcccauucacccauuagcuuccuguuacacagaauaaauguuuagauuacucccacccacccucaaauaaagugcacaguccauggcagaccauagaauaaugcaacaggaaaagccccuuuuuguguauuauuauuuaaaaauaaaauacaaacaacagaaauaaaacaaagauucagcaauucucuguaucuugcagaaaaaaggaaaagcgcaaaaacgcccugcuugacugucacuuguguuaauacacguagccuucguuguagggguggggguugcagcagcccccuuccggcauguaggccaugcucucaucaaagugagaaagaggcacuguguccuccucguugaugugacguuccaugucugucuucagcaguggacgcugauuaucuggaaaggccauggagaaaagggcuucuggaucacacacaaacuuguagacauaucucucuccagccaccugaugauaacauggaagagaaaaacccauccucaccaucgccagauggggaaggacaggaaggaaaaagccaaaaacgugguuuaauauacaggaaaggauggguaacucuggcccaaaaaagcaaacaacuaauagcagauacacauaaaaaaaaaaaagucuuuacuuuguggaauaaacuacaguucagucaagggagaugcaaaauguugaccuugaauaauaauuaauuaauuccagauauagcuaggaagcacaggaauuugcuugucuuaauauagagguaaacuuacaucguuguuuugaaaaaaagucaauuauuuaaugcaggcauuucauauugaaagcuuuuuuucugcauuuuaaaagguaguaucuacaaaucuguacuuuuaagguacacugucccucuuaauauuacauaucugaaaugguagaaaaacuaaauucaaaauuuaaaagaaaaaugugcuuuauucccaauaagacuagacuaguaauucacugauucacagaauaaauggauucuuuacuuuuuuucuuuuuuggcaguguguguugaaagaagaaagaaaggaaagaaauaaagaaagaaagaaaagagagagagaaagaaagaaaggagagagaaagaaaaagaaaaagaaagaaaggaaagaaagaaagaaagaaagaaagaaagaaagaaagaaagaaagaaaggauacacagccucauuuaaaugaaagauggaucaaaaggacaguauccuggguacaucacuuuuaaaaaugaaggcaagaugcauuagacagaguuaaggauguguguaaagugucaaauugaaguaagagguguaaaaaagugaaaggaauuuaaaauacacaaugcacagggaggaaaugagaaaaagaaaugugacaacugccuggaauaaagaaguagcauaauuuauaggguaugacauaccccaaacuuaaauucugaagaguaaugcuucccuagaaaauuauaaacaacugagugagaugaauacgccucuuguuaauagacaaugcugagaugcucucaaaacccgggguggggggauggguggaugaauacaguucuuucuauuaacuuugauagucacuuuguauggguguguguaaagguaugagauuuuagaaagcugaaggugacacaacaccuccauguuccuguauaucaacaaggcauuugcuaguugauuuuugauguggggcaacaguguguuccuggguuauaaaguauuguuauaucuuugagggaaaaguaacaauugucaaugaaugcugcugcucugaauucaaauuuagaacauuuuuuguuucuuuugcccugaauuuaaguaagaggaaccacuuuagagaauucaaauaaucugaauguaccuagguuugaaagaaugaacauuuaguaguuuuuaugaauuuggaccuguuucuuagacuaccucucaguggccuuugcugugaaauggagacaggaauggcgccucagaaagcccauugcaagguugggauggaagucuccagcacagagcacugugccagaaacagaggagucuggcauacauuuauuuacuuuaguccuucauacaaagaaaauuaagaucuuaaaggugaaaugaugaaaugaccauaaacauaaaaauagcacuaucaggaacaaagcugagauaguaaauccuaguuuuccuuuauuuuuuucuuuguucaaaguauuuggagaaaaaauaaaauaaaauaaauggccugcauaccucugaguguuuuauaaugugcuuuguuuuguuuggggcuguggaggaagauacauuugcuuuaaguacuggacuuccuuugacggguugcuacuggcuauacuuaaaaauuauguaauaaaugaauuaaaauguguaacaugcaaucaagcuuaugcaaucucucaaggacucugccuuuccucacugcuuccuucuguauugcuuuugaauaaacauuuuuagggcuacuacuucauuugcuggacuauguuaaaugcuacugaguuuagaacaagggaugauaaccaaccaaggggaaugaugucuuccauuaugaguaacagaaguacuaacgugcaaaaugcuguacauuaaguauagccaaaaugcaacacugagacagacagaaaaaacaggaauuuuuccagggagauaaaucaaaaguaaacaaggagauagcuuuagagcugugcuuucaauggcuggauauucaaauuauguuuuaucucuuaaaauuucagaaguaauauggggauacugaaggauaaauuagaaauuaucaauuaaguuaaaacaaagggucuauaauuauaucauccagaauauaaucaccauuaacauauugguauauauuguucuaggcauuuccuaauuuugaaauagaaguacacauaggcauugucuguaagguaaacauacacuguuccauuguuucuuacuucuuccguauuacuaaaauuaauuaccaguuuucaauuuuuuuaacauguucagauguaaguuauuuuuauuuuucucuaaucuucuaauuuucuauauuauauacaccacauaugcccacaaaguuuuaaguuagugaacaaauauagccauauaaauauuuucuccuacauguuaaaauauauaauucaacaucauaguuuuugcuauuuaaaaaaggacagcauaguuuuccucugaaugacuauacuagaauuuacuugaacaucagaaugguacauauccgagaaugugauuagcugggugcagugaugcaaaccuguaguuccagcuacucaggaggcugaggcaggaggauugcuggagcccaggaguucagauauacuuuacauugugccaguuacaauguaaaguaucucaaguacauuauuucauuuaauaaucacagcaacuuuaaugaggcaagaauaucaccauuuacuaggaaaauaaucuguucaagaauguaaucuggugagaggcuagcauucaaaccuaauuccugacugccuuaucuguuacugcugugcaauacugcccggggacacugcugagcaccaucugugacagcccaggcaaugugcccccgcauuaggaagaugguggugaaaagaaaggaauggaauguauuugaaggaucuuacuacaaaaagguaggugagagaaagggaggaauuagaaaugaccccaggguugagaugaaaaagacaggaggagcagguaguaaacuguuauacauuuugaaggcaugauugagaaaacaggaagcaacugaaaaucgaagucagccuuuucuuuuaaggaucauggaaguucuaacgucugagccagcaaauucuagggcacugagauaauaugccucuugucaauagacaauguucuaggaaagucaacagugcuauuuuucgcugcucuaauaagcuucauguagcaacuggucuaguuuuucuggguaaaacuauggugacauaaaaaugugccacaaucuauaacauguaacuauguuuacaaacccuaaaauaaacaaaugauacaaaauaaaacuguaacguucacaauagguaaaucauaaacuugguucacagucaaagcaauuagauuucuguacacuugcaaagcuaaaggguguaauaaaaacaaauauccacguuuuaucuucauucauuuauuuauuccuuucuucaaaaauguuguauuuuauuuuaaguguaauucacuuguuuuuucucuacucuuuuuuaaaaagcuacucuuggcugggugcauuggcucaugcuuguaauccuagccccuuggaggccaaggcaggcagaucaccugaggucaggaguucaagaccagccuggccaauauggcgaaacgccaucucuucuaagaacacaaaaauuagcugggugugguggugcgcaccuguagucccagcaacuuaggaggcugaggcaggagaacugcuugaaccugggggacugagguugcagugaaccaagaucacgccacugcacucuacccuaggcgacagagcuagaaucugucucaaaacaaacaaacaaacaaaaagcuacuuucaaauauuaugggaagcucauuugaaauaaaauauauugaacuuccacaaaccaaauaagaucaaauguucauuuuuaaugaaugguuuaggaugucaaacuaucagaugauaaaacuaggcaagauuugaggcaaggaagaaaauguuuucacaaaugagaaaaagaaaugucuguuuuaagaaucaaaacaagaaaaaaguacaaauuuauucuaaagauucuuuauugcuauaaacaaaagcauuccaaaauuauauaauuguagacaaugugcaauaaaaacuucugaagacagaugugcuauuaauacuaaaacaaucuuuuuuaaccaugugcagcaaaguaggaccuuccagaaagccuauuauucuguauacaauaucacuacacauuugucuacaaugucuaggcauuuauacauagaaaggcuuguaauaccaaaaccaagagcuaagcauuuguuaaaaugagugaaaaacucgcuucagcaaugcaaugauauguggcguuuaaaguaugauguucagauuaaugugcaacauuucaaugaauuuuaaugcuguauuagcugcucaccuuuugcauaauuccuuucucauaguaauagcggagugaacggcuaaguuuaucauaguucauagcuggccuguuuuucugaaugccccaacgucgggccaccugccgcgaaacagaauuacauuguaguguuaaguauuaacuuaucagcauauuucauaaaaauuauuuaauuaauuacuuccaaacccacaaaaauguccaacucaaggauauaaguaaaguagcaagagcuaucguaaucuggauuuccugucuccugguuugcuuuuuuuuuuuuuuuugaaacagagucuugcucugucacccaggcugggagugcaguggcgcgaacuuggcucacugcaaccuccgccuccuguguucaagcaauucuccugccucagccuucugaguaggugggauuacaggugggccccaccacgcccggcuaauuuuuguauuuuuaguagaggugggguuucaccauguuggccaggcuggucucgaacuccugaccucaggugguccacccaccuuggccuccaaaaguguugggauuacaggaguaagccacugcgccuggccugguuugcauuuuaaaccaggcgugcagugauccuucuaaaacaccacaauagaauuauuugucacuauuguuuugaauacaaaauuaaauggaaauaaggaaauguucuuacaacaggaaugaacaggcuacaguucaccaaaaugaggcacguuuuucauucugagauauacugucuguuuuauccuucuugguuuuucagacaaaaacuauagauaaagagcagcuuagugaucuccuuguaaagguguuuuacugagguuaugauaagccaaaggaaaaaagauacccugcucaauacuauaugaaagagugaacaagugacaauguguguagcagaggaaacaguacacaaauuaauaaaccgaacugcaaauacuuuuuauugccuaaagcagcagccgaauaaaacuguggguaauaccaaacugaagaauuaagcauucauuuagagaacgguaauuggaugcuaaaaauaagaaggaaguggaaaaggucaccauguauaugaguccacaaacaaaaaucucuaaagcagaaugucuacucuguuguuuaauaaaaaaacucagagcuuuuuauuauguggcuuuggaggagcaauguaucuaagaguuuuucaauagagcuuuaaaaaaaauccucucuccucaauguauauauaucccuaccucaucaccaccccaggcuagccaaagcaguauacagaauaguguagcuugcuuuuccuaccccagcuaaagucacucucucauuaauuuccacuuuuuauuagucugagaagaaacugcagcugccacgcaaaccuaggcaaccccaagaggacauuaucuaauagggcuagggagcgccuucauuuccauaaaauuccaaguuguugcuaugucauauauacuaaaauagauugcuuuucaaagagaucauucugucucucuuugcuuuauuaguaauaaccuuucuccagguuuuuuuuuuccuuuagaaauaccgauccuagcuauuuucccucucaguaauuuuuauucucugaaugaagaaauaaaguacuuuaaugacaugcaucaguauguuuuuuaagaguagagagaugcgauguaacagggacaacaucauauaucccagcagacaaucacaguggcaggaacaucucaauuucccaaagauaaacuucauuuuaauguaaaucuucugagcaauagugaauugaagcgggggugggggcgcuggggggaggcaauaagaaaugaaagcauuuucuaaagaauauuucauucaaaaaccuaacuauggacaucagugaaccuuuaauaggcauagcagccgaacuauaugcaaaccuggaggggaugugaaaauaaaguauuaguaucuccuuaaacaauaauuucugaauccuuauucauuuauaaaggauuauuuucuagaaacucaccaggaugcaccuagaaaauaaaauacucacauacucacaacaacuuuaauacaauguuguggaggucucuggagagagaaauaugauuuuuaaaaauaccacagaguuugauacuuaucaugccaguucauucucagcaucauggguauuaguggacauuuaaaaacaauaaaauguagucuuagaguuguuuuagugucauauuccucauaaaguugagguaaaugggagagagcaauaugcuuaagagaugcagacaagacaaaaguuauaaauuaacagcguaaauaauuccaggccagguaggccaaccaccaacuaagaaaguucauucagccuucacauacgaccgaccaaucgccaccauauccaacaccacucaaagucaaggcauaguuuccaauauggagugggaaaaauggugggaaaacuuccagugacuuccuuauauacgccuucaaaugaaaacuugaguuguuagugaagagaguaaaaagaugauagcacuauggcauucacccuuauugucaaauaaauuaaauaagauaauguaauaguucaagcauuaaucaacuuauuuuaaaauaucacgcuugaauauguaacacugaaccugauaacaacaaucagggccuggcuaucagacuuccugguaacucuuccagcucaacaagcuucaauuucaucaaaagacuuuuauacugagucuuacagacgacuuucuauguuaauaauuguuucccggccgggcacaguggcucacaccuguaauccuagcacucugggaggcugaggugggcagaucaccugaggucaggaguucaagaccacccuggccaacauagugaaaccccgucccuacuaaaaauacaaaaauuagcugggugugggggugcacaccugaagucccagcuacuggggaggcugaggcaggagaaucacuugaacccgggaggcagagauugcagugagccaaggucgcaccacugcacuccagccugggugacagagugagauuccaucucaaaaaaaaaaaaaaaaaaaaauuguuuccuggaacaauucccuaggagacaugacuaauucaaaaauaguauuucauuaucucaaauaucuaagaaaaagacauguuaaagauuaugcguuuucuaaaguuacccuaaacacacugagcagauaaucugugcaggucuggagucucacucaauaucauuuuaaaaugcaagaugaaauauaaagaaauggaacccaucaguaauuccaauaagauggcuucagagacaucuuucacggacugugcugacacaggcacccaaugagcugcuaggcaguagagggaacagggugaccacaggucacaaagacaagaaauuucacaaacccuuuccaaagaagaaauuuaaacaagacccuacagucauugccugauggaaguaauugcaacagucagcaaugcagcaaucagauaugggauguuucauuuugaacaaaagccuuaggagacauucagugcuuauugcacaauucccauugaguugguuauuauuuggaaacgcucuacugacucugaauuauccagccucuuuuuaacuuuaugaggcugcuacagaagaguugucuaaaugucagucuguuguauggaacagauguaauucuacuucuucccuccauuuaaaaaucacaguaacucagaauuugaugaaacuuaauggucaucuagucaaaucuccuacuuacucaaaucugaacaucauaaaagucaacaguugcuauauaaaaagcuuaaucauuugcaaaagaauuuuucuucuucugaguggaucaagaaauacuggcauaauucaguaauguucccuaucuuaacaaauauauggcaggaacaacaacaaaaaccucugcucaguucauuuuaaucacaggugaagggaaauaacuguuuaacugauacaaaucccuguagaaagugcucaguuccagcaugaaccaacucuugcagugauuauuaacaucuuccaugaggugaagagcacacacucccaucaugcgaaagggcuuucaaauuacuuuguuaaaugcuucuagucucaauuuguuagugcuuaacauuuuugugguucuuucacuuacaucaugugagaguaucuaugaaaaaacuaaucuucuuugacagcuaaguuaauuuuaaacacacuacagcauucaaacacccaaacgucauccuagauaaugagaauuuucaaauacugacauugagucuucugugugugcgugcuugauguggggcaagggagauacugcaaaacuaacccucuaguguuacuaaaguauugauauaaacugaaggagacuugacuguucuaaccagugccuuuuauuucauacuuucaguacauucucgagucagauaaucucuuaaauuucaagaaguuauguaaacuuaucuucugggcaucaaauuagggcauauuaucugauuauaguugaauacgugguuuaauaaagacagaaaauucaagaugauggacccaguagucaaggguguggauguucaguguauaugaaaaucacuuuggguucaaacauuuuuuaaacuuacugaauuuuucaauauuacugagguguuuagauucaauaccuaauauaaucaguuagagguaugguagcuaaaaaucuuccauugcuuuuuuggcugauauaaacuaaagucaauuuuaauaguagcagagaaaguaucuuuaguaaugaagacacaacaauuugauauuaacuucaccuuuccaucagcaguccaaaaugcuauugaugaguuaugcuacaggaacaauaguagccuuaagccuaaagcuaguucugggaagaauaaaaacugaacugagaaauucuucauggaaauacuccauuuguauguggggagugggaaggaggggacaauugaaguuaguugaagguguccuccauuucucuguacaguauuaucucuguccaggcucuucuuauuuuaguaauuuuuuaugugcuauggcaacauuuuaaacuucaucccaaccuuccaauggaguaugccaguccagcugacuuggaacaagugucacggacaaaggaaaauguuucuaccaggccugugucuuguaagagacacuuaagggcugagaauuuuccacuguugcccuugcaucccuuuauccgccacagcuguuuuuccccaaucuucuuuugaacauaacuuuggccucuaaaugcuccucuccaacccucaugacaaaauccaaguuguccaaauaaugauugcuaauuugaaagaauaauucacccaucccccaaccaguugacuuuugcagacaucguuccucucuccuaaggaccauaaaaccucccuccugccucuuuucucuaauucagaugcuccuuuagaaacccugaagccagacauucuuaaauaaaggugcaaagcaugcucugguuaauuuucuccaacaucaauuuuguaggauuguauacaaccggaaggaacacgcaauacauuggugauuuuaaagguagacauguuuuaucuuugcaugcuuuuuaauucagaaaguuucccuaaagucuugaaaugauuaagaauacauuuuugguauauuaaucaaaugugucaguuucuuuauguuauaacaugucugaguguccuaauuaaaaucuauuaaacuaaccucuucaggcucaaucaguuuaaauuccaugccucgaccaguccaggcaauaaaaugagaauuugaagggucauccagaagagcuaccaaaaacugccagagcugaagugauccucgccguugguauguggguccuucccgauacauuccuggcucuuguuugaugucuccuaaauuaaaacauuuuuaaguuucuauuauuagcaauacuaugcuaucuuacauaaaauguacauuaaaucaaucacuaauaugguuaaaccacaaucaaccacuuuaugggcauuuaugaaauauauuauuaccauuaaagaggaauuuaaaauaguuaaaugguugaauauaaaugagcaagcuguacgaacuuacagauaacuauauauaacacaggugcagaauaaauccugugucaauaugaaugacacacaucauuuacuuacaaaaauauuguggaacuaucuuuuuuuuuaaauugauuucuuuaaaaaccaucguaucuaaucagacuucuuugcuuuuauuguuaaugcuauuacccacugcucuaggcaacacugaagagggaauaaucaaucuuaagcucugggcauuugauucauacaaauuaaauucugcaaacuauaauuuauaaauaucuuauugaccugcucaugaaaaacuauugaaaauuuuaaugcaaauauuucaaagcaaauuuaauaguauccuaaacugaguuaaguaaucuucacuuuauauaaauaaggaaaaucuuguggguaauucagggcauacugcauuaucguaguacuacccuuccuucaccgcaucauauaccuuccuauuaaagcuacuacuuuuucaacugguaacaaaaauucucucucauuuuucuuuaucucuugcuuguacuucacucacuugaauuuaacuugcuauuguuuuuucuaaaaguccaauuuaaaaaugcaugcacgagagauuucuguaaguauguauuuuuaagcacaaaaaguuuguguuauauuuauuugauauucauaucuaguguaaaaaucuguuaaauagagcacagcaauaaagguguucauguugcaaugcuucugguauaaaucuggucaguuauauuaauuuuacaaaaaaaaauacaaaguuucaugacuucugauuauuuacuuccaucuccagccacaugucucaaaaauagguggaacugcucacauuggggauugagugucuagggcccugcaaguaugucauuguuagugcauaaauugcucuucuccgcuaaagaaacaauccagacaaaauauaucuaagccuauguagucauacuaagugugcauuauaaaauagaccaaauugcacacuuucuaaaacuuaccuauggucaguagagagacauauaccucuuaaaauaauuacagaaagggcaacauuugaaaaaccuaaaccaaaauauaaaaugugugagucaauagcugcuaaaaucauuauguuguuuuggucuuaacaugauaauauagaaguguaucuucauaucgauuucaaugacaguuuuauuuaucucaguuuuuccuucugagauuuacaauguuuuuuuuaugggaguaacugaguaauuaugcagauagagugaaacacuguuacauuuuauagucucuauauugcuucugccuauaaaugugacugaucacacugaccauguacagugaaaaaauaacccccucauuuuucuuucuucuuguucuacauuacuuauaaaauacaaggcaaauacuaucuuccaaaaaauguuuuauuaguguaaaauugaagaguauuuaaaagucgaagggaauaaauaaucaaggcagcuuguucccuaaauauuagugugacuuuggccugucagauuauauuguaauucuguccauaauuuugagauauuuuucuuucuuauaugcccuuacuaauuuucaagaucucugcaaauaugaagcucaccaaacacgaaagaaacuaaugaaggucauuccaagaguaagaggcuuuauauacuuugucuaagagaaaaugcuauauuuuaagaaugcugaugcucugcuaauguugcuaaauaguacggcucaccccucugaaaugcaaagcuuaaagcuaacaucuguuguagaauaaaaccaaaaaugugauuccuauaauuuuuuuuuugaccuugaaugaauuuagaaaucuaaaggaggauaaagaagcagaucuucccuagacuuaccagcccuucugagaaggguaaggguagcacaaagcucgggaacaugggguagucuccaagcaacuaauuagaaauugaaaagcaaucugagcauguacauugcuguuuaaauaaugacaauuuaaaacuucagagagcacccaagucauuauagccaugacccccaaaguuugugcaaucagugaaucacagggccccugcugguuuccugucaaacgaucaaagcaggaaauaugaaaaccacucugaagaaccacuaaaucaauuaacuguuuacuuuuuacccaagcuuccucaagaugccaacuuuugucaccuuugucaaaaaaaaaauucaauuuaacuugacacccuuuucuaacaucugagaccucugcauugcaauagcaagugauauuaaaaagguaaugcuuuccuaacucccuuuuaagcaauuacaaagucaugcuacauuaguaacauacaucuuccccaguuaaaaaaaaaaaaaaaaagggacuaacaaucacuaacuaaaugggcaguuauguuguuccuguguuccauaaugcaucuuuccaugaacaaugaaagaagagaggccgcguuagucaucgguccauccacagcagcacguuuucugcucugcuuuguuaauuacaggaucagcuuucaauaaaucucgaauaacaagcugcaugugcucagcagggcaauggaaagcccccucuuacgcuacacaaagcucagcaagaaugaugcucuuugucuauuucuccaaaaaugaacucccuccuaacacaaaagaaaagguuuccuacuggggcaaggaagagauaaauuguaauaggucaacguuggcuaaaauuaagugcaugaugaauuaugugcauaggaaucuuuaaguagggauguccacuguuuucagaagaagcgaagguaaucacuccaucuuuaaaaaaaucagaacuugaggcaaaguguaaaaccuaccaucgaauuuuucugggacaacacaggugucaucauaaaacugccuggggcccuuuucaaacauacagccuguggaugaaaaaggaauacauuuauucaugauagaaaugaagcucacaaacacuuaaaauauaaccauuuaacauaaaaauugugauagaaaaugacucugccaccaccuuucaguuccuugagcccuggacacauuauuuaaccucugugccucaguuuccucaucuauuaaaugggaugacaguaacaccacuuaucauguuauaggguugcuguaguuuagagugaugccuaguacacagugaaauauaaaaguuaguuauuuacauuguuaacucaagccagagcucaccuaaacauuggcaaggauuuauaacguaucgucuccuuuuuuagauucaucuaaauuuuauuguucaaugaaaaagugagaaagcaaggugaauuacugguauucacauuauauuauuagucugaugcucugagacagauuuauuuuauccucuuacuuucuuguaaaaauauuuagauggguuaaccuuccuguacucaauuagcaagauaagaggaaaaaaaaaguuucccuuuuuuuuuuuuuuuuuuugcuguaagguaaguccacagaaaaaaaugcaaaauaaaucaacagcuuuucauaauaauguccucucucaaauauccuucacugugaacuuucguuguugcuaucugugauuaccaggaauaaauuucauagaguuuacuuuuauuucucaaauguauuggucuuuaugguggguauauaauacuaacaacagaagcaacaauaauuacauugcauuugugcaaaacuuuuaauuucaaauauuuuacauuuaccaucucauacuacccuuuaaaauucuacuaauaucauuuacacaaaauaaccaauauuagaccuagccuaaaagaaugcauccaagucaauccuauuaaagagauguagaguguuuagguuaggaaccaugcacauauuucagaaauccuuuauugaggauuauauccagacgaaaucauuuuuaccauuacuuuuuagguaucaaaguccuuuacaggcaaagcuuuccuaccacgguuaccacaagccugucuaugagaaaacucuuucucuaggccuccuaugugaaaucucauucauauaaauuauuuguccaaaaauauaaaauccagaacauuuaaaggugaaaaccuuuaaaucgauggcauuuuacuccaaaacuaugacuaggucuguaaaagcaaaaccaaauauuccucaaagauacauuucaguaguaguaaagugggcuaaucuauaaagcauauguucuauuuuaaaaggaugugguuguuggcaaaaaagaacacagaaauccacuuuucaguuguuucuacgcauaugacucauguuaacaacaagauaccacuacuugaaacaucuucuuuuuacuuuggagauagucuuaaaacaauugcuuagggaacauaaaugauuuuucccaaauaauauaaugauuaauuaaaugacgucauauuugggaugucugauuauucugaacgguauuuacacggaauuucagugguggacaacuuaacuucuguucugcugggaugagccaggaagccuucuugccucauauaaauggaguggcagcuaggcacuucugaaagaggaaacaauauuggucaaaaagagucuggagcugaaacgcugcgguuaucaauggacagggugcagacagagaagauacagaaacggacacagguuccaauguggggaacaugucaacauauaaucaacauuucaggcagggcccacacaugaaaugaaagaaugaagaguauauaucuuggugaaugcugauucucuugaauaggaaggugaauucaaaguuuuacccaaauaaaccuugcuaaaagucagcucaaacagcaacccacaugaaugagaugguguccuugaaacagggucacaaguuuuaaauaugcaucaggacauuuagcaaauaaauuuguauaaucccauagcauucuaugaauauagcaacauuggaaauauuuagaagcuuucaaguugaaaauacuguaaaauguauuaucaaaaguuuuauuaugcuauuauacuaugccuucuucauaugaaguauuaugaagcauauaauucugaccauauaaaagacagaguuaacacuguuuccugauaucugcauuuauaauaggguugcaguauaguuaaucuuuuggguuaccaaauaguuagcaauccauuuuagcccaacuucuuaaccaaugguacuucaaauuaauuuuuaaugcuauuuugauuuauucccagacguaaggucccuuaaagcagcugggacuggaagggacaguguuaauaacucugccaucagcucagcagcugcuuugaggcaagcauuuuguugaacuaauguugacacccugccacaaaauacuuuuauugacugcugcacaccuggauugcggcuauaaaaacagcuggcugacucuggaggcagccagaggaaaacagauaggcuaaacucuauuacauauaagugugacuaaaugcagucuuuccuucccagagugggagaaaaggagggagaaaggaagugcaaacauuucugagaaauucacuauuuaaugucaaagaacaccuuauaaaaguguuuuaacauaugacaaaauuagcauaacccuggaaaacuagauauuugacaucaaauuugagaucugauggauaauuucacuaauaccaucucuauucaaauggcugauuuguuuauugcuauauuuacuuuauaacauucuuaauaaauucuaaucuaugauauuuaagauauacugauuuaaaauucauaauaaauuaauaacauauaauaagguuaaugccagaaucuccauuacacuuccaaaggcccaacuugugaacucaaaaaagcaauggauggcaauuuagaaauauauggaauacgacuguguuuuugccaauugcuguuacuauuuauacucuaguguaaauaaaauuaacaucuagcucuuaaaauggauacacuuggcuagcauuguuuaaaucuggucuauacuuaaaauugguguccuuuauacaguccagagaagccugaaaaaauauggcuaaggggagauuauccccauaaaguaaguaaagucauguuauccuuaagugauaucaguuaauuuaugacuaucagagugggucagacucuaaucaaauuguagaaacauuuccaaagugauuauucaaucaaaugacuaacaugguuaauuaggagccauaaacauugcucugaaguucaucaaaguaaugacuugcccagaaaaauuacugcuaauuaaauugccugcugcuuucauuucuaccuuaucuaauaaaaaauccaaccaaugaaguuuggcauuacauuuuaacuuuuguuaaaugcuugacuaugauccaaacuagcuaagcggcgacuucaaaggcaaauguuuuguggcagaggaaggaggcauugcauaugcauucaguucuguuucuucacgaauaaaauguacaaaguucaacaaccguaacaagcuguaguuuaacucaugcaaaaauauuaagaugacagcauauucacacuguccuauuaugcauccacagauuauaguuuaaggaucauuaguacaaguacagcacaaugguuauaaacaggcaccuugucaucugauagaacugauuuugaaucucaguucugacauugcaugggaguaugacauuuuguuguuauuuaacaucucuaacucccaacuuccucaucuguaaagugggaauaauaauaauaaugacauccuuaaaaggguuguugggaggaccacguggaguaaguuaugugcaacauuucgcacaguaucugcacacuguaagaauucaccauaugggacuuauuauuaauaacacuauuuuuaagugauccucacaaguauuuaaacugaguacuuuaaccacaguacuuaaaacuaaaaauaauuauauaucuaaauaaguuacauuuguuaucuuacucugcuguucuuaaauuauaugagaugacugauuuguugauuauuaguguaucuauuuuggaauauuuuucacaaaucuaucuauuaaucuaugauaucuaaaauacaauaaaauucauuauaaacuuauaagguuuaagccagacucuccaguagaugcuuuaacuauuuggggguaccucuuuuuuuuuuuuuuuuuuuuuuuugagacagagucucgcucugucgcccaggcuggagugcagugccgugaucucagcucacugcaagcuccgccucccggcucaggccauucuccugccucagccuccugaguagcugggacuacaggcucccgccagcaugccuggcuaauuuuuuguauuuuuaguagagacgggguuucaccauguugaccaggcuggucucgaacuccugaccucaaguaauccacccgccucggccucccaaagugcugggauuacaggcaugagucaccgcgcccggccggggguaccucuuuugagcuucuuuuuacaguauuacccccucauguuagcuccuaaagcgcucugguuuuaaaaguuuuaaauuaaaucuaaaaauuaaauuauguaaauuuaauuuaggacaaagaauuuuauuuguuucaaaacuuguggaucaaaaugcucuaugacauauuaguacuggccaaaucagcuuacagaaauuaaacugccuauaauuuguuacagaugaguucauggugaugaaagcugaucuaauaugcuguaaaaauucaaagcaacaaagcccuguugucauuuuaaugcacuaaucaauguagcggaaguuaagaagaauaauaaacuaacaccccaaacuaucuaauuugauuaguuuucacguuuaguaacaucaguaaaguucucuucaaauuaaaauacgcagacaagaaacuaaaaaaaaaaaaaaaaaaaguuaccuucuucucugucucuugauuugcauuuucaagcuaugcugggaaacauaauauugauuugggaagcuuuaccaaagguuugaccacaaagugcaguauugaauuugcacauuuaaaauugcuaggcacucucugauuugcauauuugcugccucuauagcagaauggaggcucuccuuuagggcagaguuugcuuaaaauuucaaggaucuacaucaggccacggcaaagagaaaagauuugccacaguugccugaaauaucuguacagagcuggcugaaauugcucugcuaucaaauaguguguaaaucuggaauuauaacauauuauaaccucuaaauaagggagaaaaacaagucuuuuccauuugaugcuuuugguuaaauucuucuaccaauaacgacuguauaacuuaauuaagcauuugaaucucuuagaggaaaugagaaaucucaguaaaauauaaauauguuugauguuguauuuuaaugugguuuugcuuuccuauaaguauauagugcaaagcuggauugauuauacacuugacuaacuccuuguggaguugauaugacaaaaucaagugcacauaaacuugucuauuguauauugaugauuucuaaaacuuggugcauaaaauauccagagccaaaauguguauguaaacacauaucugaaauuaucauauacucaguaaaaaauguguguaucaaugcauaccuaggaguuucaacuaguuuuucaaaaacauuugucuauuauguaaaaaauacugaguuguauuaagaauuaauaucaccaaucucauucaagaaagaugagcauagugacagaucuugccaacauuuuaucucuuuuaaacuuaguacuucacuagauuuuuuguuugcuuacuucuucucauuugcugguaagcucauaguuuauguuuaaaauccaaagguuuacaaggaugcauagauuaccugaguuuuaugcagauguguuuaaaugcaaagccaucacguauaugccauacuuuuagccugcuuuuccaauugucacaugucaaauugagugcacucaauugagaaaacuuauuucauaaaguuuccuagaaugaaugauaauggaaauaauuuuuuuuuuuuuacuuuuaccauaugaccacucuauugcagaacaagucuaaaaguaauuaucuuccaaaauaaggacauauauaucugaauucaugugagaaugauagcaaaaaagucaaguuuuauaagaccuauuugcuguucauuaggaagcucaaugugaauauaacaucuuaguuacuaaacuugaugugaauguaacaucuuaguuacugaacuggaugugaauguaacaucuuaguuacugaacuggaugcgaauguaacaucuuaguuacugaacuucacaugaauguaacaucuuaguuacugaaccucaugugaagaaggcagcaaagcuggagaaauccugacaagggagugaugaauuuaguauuaccucacucacacuuagaugggaucuuucucuuuaggguuuuaaguaaacugugaauauaaauaauguaaaaucugcagagauacuuacuucacaauagcucggauguacugaaucuacuauugauugaguaugggggagaaauauguuaauuuuuagaugguuuuaauaugcuuguaauagcauuugcaaaaucuuaaaaaaaagagagaaaaguagaggucagacgugguggcucacgucuguaauccuagcacuuugggaggccaaggugggcggaucgccugaggucagggguucgagaccacccuagccaacauggugaaaaccugucucuacuaaaaauacaaaauuuagcugggcaugguggcgcgugccugucaucccagcuacucgggaggcugaggcaggagaaucgcuugaacccaggagccggagguuucaguaagccgagaucgcgccacugcacuccagcugugacagagugagacuccaucucaaaaaaagaguaggcugugcacaguagcucaugcauguaaucuuggcacuuugggaggccgaggugggaggauugauugagcccaggaguucaagaccagccugggcaauauggugaaaccccaucucuaccaaaaauacuugaaaaguuagcuggaugugguggcacacaccuguagugccagcuacucaagaggcuaagaugggaggaugguuugagcgcaggaggcagagguugcagugagcccagaucauacuacugcacuccaaccuaggcaacagagccagaccuuguccaaaaaaaaaaaaaaguaaaaguaaaguaaagaaagaaaaaguaaaaguagaauaaguaaauaaugcaguuaucgcaguuaucugaauuuacgugcuuuugaaaguuuaaggcuacauggcgaaaaauaacaguauagaauuuuaucuacacaauuauaaacuucucuuguaagcaccugggguuuucuuuuggacaauaccccacacaaauaaugaccagauccaaacaacauuagauuauaugaucuacuaggcucgcacuauuacaaguuuuacaagccugugauagucuuacuaagcugaaauuuuaaaauaaaguugaagugauagaaaacauagacacaacuguaacuuugaguauuuauuuauuuauuuauuuauuuauuuauuuauuuauuuauuuugagacggaguuucgcucuuguugcccaggcuggaguguaacggugcgaucucagcucacugcaaccucugccucccggguucaagugauucucccgccucagccucccuaguagcugggauuacaggcaugcaccaccaugcccugcuaauuuuguacuuuuaguagagacaggguuucacuaucuuaagucaggcugguuuugaacuccugaccucaggugaucugccgucuuggccucccaaaguacugggguuacaggggugagccaccgcgccugaccaacuuugaguauuuauuucauacuaccauacucugacaauuaacagagguuuaaaagaaaauaugaggccgggcgcgguggcucacgccuguaaucccagaacuuugggaggccaagguggguggaucaugaggucaggagaucgagaccauccuggcuaacacggugaaaccccgucucuacugaaaacacaaaaaauuagccgggcgugguggcgggcaccaguagucccagcuacucgggaggcugaggcaggaaaauggcgugaacccgggaggcggagcuugcagugagccgagaucaugccacugcacuccagccugggaggcugagugagacucugucucagaaaaaaaagaaaaagaaaaagaaaguaugauacaggaugccauuagcugccaaaaugggccacacaaaauucugaagagauagugguuuuaauguggaauuucaauuuuaaauuucucucuugcuggaaacuacaugauuugaaaaaaaacauaccaugaacagcuuuguccucuuguuuucaucucuccuuggaucaccacaauauucagauaacuuuuucuauuugcuuugcauaugaauaauacuaguaagaaguucauuuggguauauacccaguaaugggauggcugggucaaaugguauuucuaguucuagaucccugaggaauugccacacugacuuccacaaugguugaacuaguuuacagucccaccaacaguguaaaaguguuccuauuucuccacauccucuccagcaccuguuguuuccuauaaaucaugcugcuauaaagacacaugcacaaguauguuuauugcggcauuauucacaauagcaaagacuuggaaccaacccaaauguccaacaaugauagacuggauuaagaaaauguggcacauauacaucauggaauacuaugcagccauaaaaaaugaugaguucauguccuuuguagggacauggaugaaauuggaaaucaucauucucaguaaacaagaacaaaaaaccaaacaccgcauauucucacucauaggugggaacugaacaaugagaucacauggacgcaggaagaggaauaucacacucuggggacuguggugggguggggggacgggggagggauagcauugggagauauaccuaaugcuagaugacgaguuagugggugcagcgcaccagcauggcacauguauacauauguaacuaaccugcacaaugugcacauguacccuaaaacuuaaaguauaauaaaaaaaaaaaaaaagaaguucagcaagacuguuucucuugcuggacuagcacaauaugauuguuuuaagaguauugucucucuuauuuuaucuuauccucuagccccaaauacuguacuuuaaauuauuagaaauaauaauggcaucuuaauaaaggacuagcagucuuugaagaaguaucuagucaaaauaaaaucaugucaaugggaauccuuuauuauugccugcaccccuauuaugugcuagaaacgguaucagugacuuuauaaacauaaccauauuuacccguuacaaaaacacuaaaagaugagaguuauuugcccuuuuauaaaugaagaaacuggaggcauaagggguuacaaaacaugcucaauaugacacaaaucguaaauggaugucaggcccaggauuuacuauaauauuuccagugucauguuaagugagugguuuuauuuuuuaauacuaagaaaaacagauggagcagugaaauguacagacccacauacuaaaaaaaaaaauuaccagaacagagaguugaaaaauacuuuuaaagagaauaguuaaaugaaucacaauaacacaugcuuguuguucuuuugguuuuuuuuuuuugauacuuuucauauuuaucuuugaauuacucuccuguaaaauuuuccagauuguuagaaacaacuaaauagaaaccauacacacacacacacacacacacacacacacacacacaaaauaagaacaauaaccaucuauuuaaucugauaaaaauuccuugaaaauuuuuucaaguuguucauauccuaguugaaaauguuuuaugaaauaaaaugucucuuuuccucaaaccuauuaguuaacucauuuaaguauagaaaucauuuaaguguaaaaauucuaaaacuauauucgaaaccuaaaaacagauacuuaguuauguaaacacuuuaaaaaauguuauauguucccuucuuuuguucauauucaugaaacagacaaaaacacacaaagacacacacacagagagagagagagagagagaagagagauccaaacauguaucuuuaaacugucucauuuaauuucaaaucucaguuccacuuauaaaaacaguuguauguucacuuuacccacuugaaauaagcaguucugggccuaaauauccugguuguuuuauuaaaaaagaaacuaaaagucccacccuauaaaagcacacuccacccccuucuaauugccuuuuuccaagcuaguacaacucacaagcagauuauccaucccuucccccuuuccugccuguaaaauccaaguuagacaaacacuguggggcugaaaugacauauuugaauggaauucagacccaccaguuccuguuuauguuucugauuugagaauguugucuucucauucacuauacauuaggaacacugcaaggccauaaauagugucagguuacuugcaagcaggaccaaugagcauuaaucauuacuuccagucaacuggcauaagcagcagcugauggaacacuacacccuucagcucuguauaaauggacauuccagagagagugagugaguguguguguguguguguguguguguguuuccuuucagucuccauuuuaugaaugaaacuccaggcucuauagcguccauucauguaagagaaaugcuuacagggcucugccccuagggaucaaucagucauggguaaaacugguaugauugguuuaagacagccuucagccuuccauuacugccuuaaaaugcagucccuguccauuuggccuguguuaaugcauaaagaguaaauccagacuguagucucaacucucaaaucaaaucacuagagccaaugccacuuacuguaacuguagauuuagagcauauuuaaguauuucuuagaaaaacugauauagugggccagaguacugauuugggagauuugcaauuuuaacuccaaaagaaaugaggaaaacucauaugagacaugcuaagcaauaaaaggcaaagucaaauugugaggccaaucuaugaccucuauugcaauaacaaaaucaauuaggaagacaucacugucacuuuucacaauugaagcaccuaaaaaucagagauuaagugaucuacuaguccacaaaucacuggauguguaaaagaaaauuaucuuuggauauugagaaagagauaagauguuaacauuuucugaaaguucaauagcucauucuuuaaaguucccaagugauccuacacuugaauuucuuuaagcaauaguuuuagaguuaggagggaaaaaaugagcugccauguuucaggagaaaauguagccauaagcaagugauguuuuguaauggaauaaggccacgguuuagccuuuggaaguguuacauaucaagcacaaaaggccaaaguucauggaaucauaaucauugcugcccuggaaauuacuaaagauggcaauauuuaaaaauauccagaguuuuuauggagaggaagcaauauauaagcaauuauggaaauauuuuuugaagagucaauccuauccugaauaguauugaauauggaauggguuuuaucagccauuuguacuuuguuccuugacuccgaaggggaaaaaaacacuuuuuucuuucagugaccugaagccaugugagaaaaaaguugcaguaaacagucccuguguauaucucuaaaccacugaucaacagauccuugccaugccuacagaaaaggaagaggauaaacagaaaaacugcccagucuuugguuuuaaaccugggaaggauuauuuauuauggcauuaugacaaauauucaaccuccaauuucuaauaucugauuaauacagucauacagaauaaauaaauuuauggcaguauguuagagcucaaaacuaaaauacuuaacauaggcaggugggagaugaacccaccauucagaaaaaauaugggacagaggaaaaucaccaaagagugaacguauaccgaauuauuaauuuauugcuaacuuuuuuuccagggcuuuaaaaauauucaauauuuucuaaggaauuacuuuuuaaggugguucaaaaauauguaaauaaaaaugacaaacugaaaaugaauaucuucaaauguaauauuucauauuuaaaauaauuguaauauguugucuaacuuccauuauucaauauauuuaaagucugaucaauguaauacaugaauuauaaauuuauaauuauuaggggcuggauauaaaauucauaauagauugauuugagaaguauaugcauuaucuauauugaaauaauuuguuuagguguucagaguuuuagauauugugguuuuuauaauucuaggccuucuauaacuauauaagagggaggcgggccuugagauagacuguugugguugcugagaagagaagaaggcauacauucguaacaacuuggugacacuuccauacuuucaaagggaauaugaauagaaaaauacuauucuacuuccuuuccuccuuagcugccuaauuagaaucccagcaauaauacaauuuuuaaaaaauaacuaagauaaaauaaugucuucaaugugaaaacacugaauaguaagugacauuggaauguucagacagugguggcaugcaccuguaaucccaacuacagugaggcugaggagggagaauugcuugaggccaagaguuagcaacuuaccugggcaagacagcgagacccuaucucuuuaaaacacaucagccaaaacaaaacaagacacacacacauagaauguucaagagggagaaauuauugaucaugggcuuuccauuuuggaaauaaugaagccugcuaguuuaugguaagccuugaauauucaaaauaaauaucaguuaccuuuauuucuacucccuguguuccaucugacuuuaauuagugucuuucaacagcuuuccuuuuuguaaucacugcauacuuucuguuuccuggauaauauuuuugguugcuuaugugugccccaauuguucagaaaggaugaaagaaaaguguauuggaaaauauguaugagguuaguuucccuagaacacguaucucaucuuguaaguaaauagcaauaaauuguuuuuuaagguaaaauauccugaugacacaauuucugagauauugcuagaugaguaguaguaauaaaugcaauaguaauaguuuagaaauaaaugacugggauauuuuagcccucugaauguuguuauuuuuuucuuaaguuuugugcaaguuuagucaguugauugaggcucugacaugucaucuccaaaccuauaaaacacuacacauuuauauuuuuauauggaugcagaaaauaaccauguuguucuugcuccauuacccaauuauuuaauccuacaaguuucacuuucaaaccauauuauaaacucugcaaggggaagcccaagcaaugcuuacuacuacaggcagcauuaggaauuacuucacuacuuuuccuacuauuugauuaggaugaguauccaccaacacagcaaaacauagaauaacauuuacaauauaaaaacauuccucucuugccauuucagaaacccaagaguauuuaaauuucuugauuaaagugccagcuugggccuaugugaauagcagauagauuugucagcucugacagaugaaaguuaaacauauuccaguuuuaacguauuuaacauaagguaaauauuuuuucaguauuuauuucaucauuuuucugccuacacauaauuuuucgaugugcuaaggacagauaaccguucucuaaauuuacaggcuuuucuacuggcuuuuaucaaagcccuaauaggguaauaaggaaguauaugaggagccugggagggguuguuggggugaauaauggauggauuuuaaaugaagaaugggccagccacaguggcucacaccuguuaucccagcauucugggaggcugaggcgggcggaucaccuaaggucggaaguuugagaccagcaugaccaacacggagaaacuccgucucuacuaaaaauacaaaauuagccgggcauggugguggcgcacgccugugaucccagcuacucaggaggcugaggcaggagaaucauuugaaucagggaggcggagguuguggugagcugagaucgugccauuguacuccagccggggcaacaagagugaaacucugucucaaaaaaaaaauuaaaaaaauaaaauaaaauaaaaugaagaauggaaaaagcacccuauuccucaacaacagcuuucuuuacaucgauuugagauccuguagucccucauaagcuuacuugugaaaaauggauucagcugacaauggucugaaaagcacagcugaaggugaaguguaagccacugagccaucaagggcauuaagaaagaaagagcgagguccaaugagaagacucaaacucuauguucaugcaaucaaggacuuagagcuuggaagggccauuaauuagccacuuuuucuucucauuauuuuucagucuuuuucaaaagagcuauuauaaaagaucacuucuuugauaaucucaguucuuaagaaugcucgugguauauuuuuuaaaagaaagcagaaugcaucuucauaauuuauaucguugaauugcucuauuuugcuaccucacugcggugaacaccuaacauuuagaguaaaaugugggcacuauuuaaugugaaaugugcuccucccaaauuagugaaagcacaccucguaucuucaagcagaugcccuggaucaugaagauccuucgaaaaccauacaaaaacacucaguauuucccuuuaaucugaacaauuauguagaaagacaaaucaugaacucuucacuaaacuaagaauuagaaaauccuaauuuuaguuuuggcugcuucacaauauaucuguaacugaugguaaauuacuucauuuggaugaaccucagauauuuaucuguaaaauuuggguguggagaaguuugaaguaggugaacuucaagagcuuucaugauaacaggauuuagaauucuaugaaacauuuauuugugucaacuucccaguuuaaaauagcacgaacaacauuugcugucaaagaguuacgugccuccaaauugaaaaaaggccucaugaguagcagcaggaguggccuuaagaaacacaauuuaaaaaugcaaaaaccguuucuucggcaaacauaugauguugaguucucaccucuacccucugcuuuuauuuccugcucucucuaagcucaaaguaugcagcauuguccuuuauuuucuuauuuuagcuaucuuccucuugccuuugaaaguucuucuuucccucucuucauucccuacucugauuaaguugcuccaccacauggccgagaagcauuguuuaaaccuauuaggauaacagaauaggucuucagggcuaaaaacaccuuauuaauguacauuacuccuccaaccaacuacugaguuaagauuuuuaauacacugcaaugugcaaaggaauaaaacccuaaugguagcauugcaagcacugugcaaggugaacaugaaucccacuaaguaaggcaucauuuucccucccuccucuaaggcaguacuagacacaaaccaauagaaagucauuuacgcuuacaacgugugagacuauaacaucauuuacuuguuuucacuuauaggacugacgugaugaguuuggacacuucucuucuucaacuauacauuaauugauuuuuuuuuuuuuuuugagacagagucucgcucugcugcccaggcuggagugcgguggcgcgaucucagcucacugcaagcuacaccucccugguucacaccauucuccugccucagccuccagaguagcugggacuacagggacccgccacugcgcccggcuaauuuuuuguauuuuuuuuaguagagacgggguuucaccguggucuugaucuccugaccucgugauccgcccaccucgcccucccaaagugcugggauuacaggcaugagccaccgcgccuggcccgacugauuuuuuuuuuuaaauacucauucuguuugauuaggaaagcagcacauaagcauuguuaaaauauaaaauauuaauacuucacagauacaaaauaucaccuauaauaucaccaccuauauauagccaagguauuucuguacuggcucuuaauuugcaugaguuaugccuugcauacuuuuaaaaacucaguagucucauuucauuaaauauuuuucaaaaaucugacuucuaauggcugcauaauauuucuuuuacaaguacccauaacuuacuuuaccguucaccuauuauauauuuuuaauauuuugcuuucugucucucucaaacauucacuaugcaucuuucacuauuucuuagaauaaauuccugagagugaaauuaccaugugaacauugugugcugauauucucuaaagucaaaguuuaguuucaugugcucacuacucccuaaaaaaaucuacuguaagauaucaaaaaguaaaauaaaaugaaacaaaaaaagcaaaauaucaaccaaccaccuaacacuuucagcucuaauaaaauauauugcuauaaacaucuaaaauauuugcgucacuggacauucugaauuugcaaaaccucauauguggucaugaaaaugagaaaacagucuugacucuaagaaaauaggauacuuucuacgggaaucuccaugacgcacuccagaugaagcacucaauguguauuuaacacuucuuaugugggcauuugaccauaagggcaugaaaaaaaauaucauguuggauuuagacaaaaacaaccaaccaacaacaacaaaaaauguguacugcuuuaugcagcauaauaggcuagagaagagaaggaaagggacaauaauagauggauuggauuggaucuuuuagaaccuaguaucaugauacaaucaugaucauacuguacugguucauuaagcuagcccuaaauaucuauuucuuguuuccucacugucuucugauugaagucuuuuucuuuucuccugaauaaaaauuuauacucuacuaacauacuauuuugcauuuuuuaucuuaaauauuaggcaguugaaauugcauuccuguaauuauaauuauaacuaauagaccuuccauuucccaugucauaauuaaugucaggcuuuauuagagcacaaucauaagcuaccuuuucccuuacgaggcuucuuuuauuuucacaacauuuaugguguauagaauuaagcaauaaagaguucuaaaggucuuccguaagaauagccuuuggaucauagaugcugaguuaacugacuuagaaaaugcuuuuuacggcagggugcaguggcucaugccuguaaucccagcacuuugggaggcugaggcuggcggaucacuugaggucaggcguuugagaccagccuagccaacaugaugaaccccugucucuaauuaaaaauauagaaaaaucagcuggacaugguggcacacgccuguagucccaacuacucgggaggcugaggcaggagaacugcuugaaccugggagcuggagguugcagugagccgaaaucacaccacugcacuccagccugggcgacaggaugaaacuacaucucaaaauacaaauacaaauaaacaaaaugcuuuuuacauuguuuuuaaaccacauauaaaucuaugugcuuccuaaugugcuauuuguucaacaccaauaggugaaaaaagaaaucacugauucagugauaaaugcauuagauuuccucaaagguuauuaaguguacuuucagcaaggaugaaaaaauuaaugacaaccaaacaaaauaucuacgaaucauauuuguugauugccauguaugacauauacauaugugucaacuuaacugcagcaauuucauggcaaguaaaauacauuuugacacccacagauuaaguuuucauaggcccugguuaugggguuacuauauuuauuuuaaauccugucagaaagauacaauuuuaccauuuaacuauucaagcaaaacacaacuguauccuauuggcaauauugaaauuagaacucaaaggugguauacaacuuugguaauuuuaaauauaauuuaaaagggagaaugcaauauaaaauuaacagcuuuuuagguaagaauuuuacaaguaaucugcaagacauggcauacuuaacuuacaaaagagaugccauacauaccuucgacaaacgaugcuggacuauguuuugaagauuauauaugacucaaucugugcuuuugagggucaaauagugacuggcucugaaguccauauuauguaugaauguaauucuuacagcacaagaugcuguauuucgcccuuauuagaauuuuaaaaucucuuuuccauuagguucacaucuucuuaagaaaaguuauacauucucaauaccacacuacauauaacuguauauacaauauaaauaugaggagaagauauacauggagcaaucacagaaucaagaaaacaguuucaggcugggcgugguggcucacgcuuguaaucccagcacuuuggcaggccgaggcaggcagaucacgaggucaagagauugagaccagccugaccaacauggagaaauccugucucuacuaaaaauacaaaauuagccgggcaugguggcgcaugccuguaaucccagcuacuccggaggcugagggaggagaaucgcuugaaccuggcagacggagguugcggugagccgagaucgugccacugcacuccagccuggcaacagagcgagacuccaucucaaaaaaaaagagaagaguuucaguguggcucuuuuugguauuauacauauaaaaacauuucuaggcagggcaugguggcucacaccaguaaucccagcacuuugggaggccaagguggcccgaucaccagaggucaggaguuugagaccagccuggccaccauggugaaaccccgucucuacuaaaacuacaaaaaucagccgggugugguggugggugccuguaaucccaguuacucgggaggcugaggcaggagaauugcuuggacccgggggucggagguugcagugagcugagaauacaccacugcacucaagccugggcgacagagcgagacuccgucucaaaaaaaauucauuucuagagcacaaaaagaaauauuuuaagugcuaugcuauacauguucuuuggaaugauuauuugagauaauuuauaugauuuccacauaaaguuucuugaaaucauaaugaauuuuaaaaacuacaacaaauuaaaaugugguuuggggaauaaggauaauaucaauuaacaggauuugaaauuuacagagauaaauguguacuauuuauaauagagcccacuguauugcaggguucuuaauuagagacaccaguggacgauacaaaagguucuaaacugaaaccacaaugggaauuucaagauacuccccaaauuacagucccuggggcaaaaauucaaauaaagacucuuauacaaucuguuaaaauuucuuaaauuauaaaucggccaagcaaacugauaaauaaggugucuucucaucuuugcaacuguauaccauaacaaccucucagccaugucaaguuuaguagcugaggaaaucucuaaaaugagccuggaagaguaugugguauggagagagcuaguacccagucuucagauccugacacaccccacuuuuugucucucuuccuauccuugagcucaauauugggccacacugugagaguuucacacaucaagauccauccucaugccuucacgaacaacugcccuuuagccacccuugaaccuagcacuauauauaggagcaaugugcucugguuucagaaaacagggccugggaugcacuuacucaggcccuggaaguagacucaaggccacuugggcagagaauucauagguuuuggggagcuugcaugcuuucuagaaguugaggcaugccucaacggggccaauucccuucguccuuugaaccuauuggccaguguagaaggaugaccagagggagacuucuaagucacagggcucucuuuugcagagccuuaagggcaguucauuaucaaccagguaaucuuauacgcaaacugguaacucaagaccuggagguaguuuucuuuacucaaguagacugaugauagaaaaacucagcagaggacgcaauacucccuucauaaagaaugcccaaacuuuauauccagacaaaaggaaaugaaacuguucucaaauauuuccacauccacaaccaucuauugaccacagauacaauaauguuaacaauauuuuacagguacaugguaaccuuauaaacauuagcuuuuauuucauagauuaucuuucaaaauaccugagauguguuaaaaacagauguccugauuuggcagauuauagaaggaaaaacucagcaggguuaaguaauucuuuuaaagucucaagguucaaauauuggcaaaguuggugguacuauuuggaaaaaaaauuuuuuuuuugagacggagucuuacucugucacccaggcuagagugcaguggcgcaaucuuggcucacugcaaccuccaccuccuggguucaagcaacuuuccugccucagccuaccaaguagcugggacuacaggcacgugccagcaugcccgguuaauuuuuuguguuuuuaguacagacaggguuucaccguguuagccaggauggucucaaucuccugaccucguaauccgcccaccucggccucccaaagugcugggauuacaggcgugagccaccagacuggaaaagauuuuaaacccucccuccuuucaggaaaccccacucccccacuugacccgcugcuuuguacuacuuucuagcucacagagacaaagcuaaacucuacgaauaaucuguuauuccccucuuaauauguaagaauucuuacuuacgaacacuuagaaucuuugccaccaauauauauuuuuuuuuuuuugagauuuuugagacggagucucucucugucacccaggcuggagugcaguggugcgaucucggcucacugcaaccucugccucccggguucaagcgauucucuugccucagccucccgaguagcugggacuacaggcacgugccaccaugccuggcuaauuuuuuguacuuuuaguagagaugggguuucaccguguuagccaggguggccucgaucucggucucagccucccaaagugcugggauuacaggcgugauccacugcaccgggaccccaguaauuuuuucuuaaauguuauaagcaacaugugaccuaguucagaagaauauuacuuucuguaaacauuuuuauuaaguagcacuguaguagcaaaauaagaagaaaaaaaaguacagaauuaagaaaaaaaauugcaaugucccucucgagcugagacugugcauaauucuguaaaguguauuuuucuuuaaacugguuuuguuuccagacacuauuucaaccaucaccucaugucaaaaugaccugauaguucaaaucuuuacacguagaugaaguuucaaugaacggacaaaaucugaaagaucuuauuaaaaaauggucaggagcuaccuagucugauaccaacacuaaccaaugugacaagggaggugaaaaagugccuugaauguaauuugcgcagagcgcaggccuaccugagucauaugcaaaaucucuggguuccuguuuaaucaucagaggagggggaaagcuuuggcuggccgcacugccaaccaugguguuguguucauacacugggucgugguacuccugcuuaaagccuuguggugggaaggggauguuuggcucagacaucuggcguugguacauaggacguccuucccuuggcaucgucggcaaaggaggaaaggaguuacaggguucagaaagcuggcggcgaaaucuagggaauaagagaguguguuucagaugaaacgguaacauggaacauucuuuaaaauacggauacgguuuuccauuucuuagugaacgaacaugauaccagcugaccugaagcguaaaucuuuaacaagcauuacguuuuucuuuccuggauuaguagcucuauguuuuuuaaucauaugacuuauauucccuuucuaaucagucuuuugcagcacuguugcaguauaugaguuaaagauguacuuugaguaaggauuggagagcaaugaaaaacuuugaggauuuuacacacccacacacacacacacacacacacacaacgauuaauggcuaaaaugccuaguucuaaaucaauuggaucacggauaauuuccacacaagauucuuaaaucauuauauaccagaaaaagaucucaaacugcauccucuaucuuuuaauucuguuaccaaacugaucaauaaacaaaaaaccaaccaaccaaaaaccugcugagaaagcaagagaggaaugacuuuuuucucaaaucaggacuuucaauuccucaacaauguccuaauuaacauugcguucuaguaagaaacaaaacuagguauuauaaggacucaaacccaagccgguuguaaaaagacuaccucuuuacugucaaacagcaaugcagaccauauuggcuuccaauagauucaaauacaguaucagguugauaaaaauaagcauaaaugcacagcugaucuccaaaggugaaaauaacauauaguguuguauagguuuggggcaagucccgcuguuaggacaugaggaaguucugaggccucagcagaaggcuagaaaugaguccuaugccucuuuguucuugguuauacuuuauaacaauuggcuaaucacauaaucguucuguucuguguuucucauccauaauaucauugacccaccacaaagauguggauuaauuaaagauuuaaaagugcucuaaaaaugccccaggagugcuuaaaaauaaccuauaaaacauuucuaugagcaaauauaagccuaauaacccccccacuaaaagcauuccugagacuuuaauuuggaaaguuagcauuuaauuucgguaauguuaaauaaaaauaagguaaaagcuaaagaauggcaaagcgauugcuuuagcauuucuaagaacacuccauccugugauuuaacucuaggcucacugguggucauggaaagcacugaaauuccaccuacaccugcagaaaauaaacuuagaaacucggauauugcagagcaguuaggcugacuggcacugcauucauuucccuucucuugcuuauuucauuagccaaaaaaagaaacagaaauuaucauuaagaacugucaaggagugaaucagaaaauuguaacuugaaguuaaaauaagaaacuggcucacuugugaagccuuaaaaggaaguuaauaauacuuguaacugaaagcuuuguaaggaaucaagccauuuguuuuuacgagucgaccugauuccaguuggaaguugcuggggaacauguauauaucaaacacgcaugcuucucaggaauuugcaagguuuuggugcaauucuuaggagccacugaccaaugguaaagagaaagugauucaagaagcuucuggaaaggaguuaacagauaaggagaacaugcugaugaacucccagauaaagaaaaacaggguguaagugguggaaacacugagaaagagagacagggcuccugcacaguggguucaggaaaaagugccaaagggcuggccccaggagcagagugaggcugaggaaaggaagcagggugcaggccaguuggccguaaagcauucccagagugaaguggggugccuggcuggaggggguguuuuggggaaaggaucuguucccagagcaaauuugccauuuauaacugagggacugucauuuguuggccagagcccucuaagaaauccuccucagaaacauacggcuuuagagauuuuccugggacuggccagcugguacuguccucaaaacucagucaggggucagugggaaaagaccccgagcuucccucuuggaguuccgggccggcuguucucagucucaaauaucugacuucaaguagagaaacuaaaaugaauuuggcuaaagcauuucaaguuaggucaccuaaaaccaggcacacugcuuauucagcaggcaccuucccuaagaaauaaccaguuugcacaaaaagcgaauuauacaaucuauaauucuggcacugaucagaagagugagauucaguuaucaagaacucagaagucaccaguaguggagaaaauaaaacuugguuuguucauauuuuuuuguucccuuucagcucugcacaauguccaucuguuuaauggcccacccugcaauaagaauucuuucaucuguauuuacaaaacuguuuacacagaugcacauaccauugcacucugacaaagucucaaggcuacagggugagaagaaaaagauaauaggaagcauuuaauaacuaccccacaagaggacuuagugauggaaccaaggguggaaaagacaaggcuuuguaucacauuguaaagaacgcuuucaucuuacgcccuuuauagcaaaaugaguuucugaauuugagauugagucccaugaaaaaaccuauaaaaagcacauuugagugcucccuuauuuucagaaaguugccaguggcacaucuucugcuuuccucugcugaucuagaagauuccuuuggcugaguuauuuuuacaacggugucucagggccaguuugcacugacuuauugucaaacuugcaggaauuuuuugagccaguucuuaaacacagccacuauuaacaguuaaauuauauaacuucacaaucaaaaaauauguuaaaaacagaagauaaaaaugcaaaacucaucacuuucuaauuaucuuacuacauuucauuaccaauuauacaccugagguuacuuaugucucugguauccguaugcuagaaauacuacauuacgcugugcuauugcaucuuugcaacucggcauucaggguucucacagugauggcucguagugggccaugaaagcaauauguacaucacagacccagcaaaagcuacugaugagggcguuuuguuuuucucucaugcaggcuguugcuaaacauuuaccagcacgccacugcauacagaagcacagggcagaagagauaaagaaggagagaugcuguauauaagcaaccugauuuuaagcuguauauuaagguaguacaucucagaaccucuacagguuuuauuuaguauuuuacuuaaauaugaauuucuuaaucucaaggagucaugaauuaccuaacgcaguauucuccuuagaucuaugcuaugcuucuugccuugcuccuuucuaaguaauacuaauugagucucuaucucuuuaauuguauauucgcaguguccagagucaugcgucuacugauauuaaauauuaaucaccuggaaaagauggucaacaguuuuaaucaaauaaguuauauucugcaaaacuauguacagcugaaccauucaauauaagguagaaaaccuaauuccauaagcuaccuacuaaaauuagucuccuaacuuuacagaacaaguacacacauaugcucauaaaaaugggaugaucugauuuaaaguuuaagugaagcaauuuaauucaagcaaagcgaaagggaaaugcucaaaugucaguagauagauuaauuuuccauuuuagcaaccaauuuaaauguuuauaaaaggaauguuuauaaaugacuuucuccacaaauuauaaguauagauagagugagcucuuucuaaaaauauuuugcacagaugugcaaaauuaauaggcucaccuuaaaucuacucuaggccuucagaauuguuaauagaaauuuuuuccaagaacgcaaaaaacaguuucuagaaaacugguaucugcagguuaccugugguccaugggguagcugcuaucugguauggacugcgauggagggaggugagcugggaaggcccggucagguuucgguguaugaguugaguuuggagaugcaugaugcaguggggacacuggcgugcuggaugguguggggggguuggagggccucauucccacuuguggcuucugaucauaggcacuacccaggggacaaaagaagagagaacauuucuuucuuuggagcaauuuuuuaaaaaaguuucuaauccaaaggaagaaaagauauuuuagacuuaagucaaauggaaaugaaaacuuuguuguugcuauuguuguuuaaauccagaacagauaaacuucaaaaucacaacacccuuaaacagaaaauaggaugauuaaugcaaaaccuuguaacagaacaaauauuaaauguguauuuuuaaugcauauacaaacaacuuaguacagggaaaauuacguccaaaaaagcagugguauuuuuuccaucuauucuugauauaucuauuugagaaaguuugauagaucuuuccuaaaucauuaaauacuucugauauuauauucuucuuuuauauuauguaagauuuuaaaacaagaacuaacaucagcuuaauaaggcagagaccacaccuggcuugcuuuuauuuguggugggauuuuaagaaggcaaugcuuuuacuuuauuuucauuuuauuauauuaaauaaaugaugcuuggcauuaacuuccccacaugggauaaugaagauuaaugagguaaauuaaaaugucugauauauuuaaacuuucuuagagaauaaguaaaaaauaaugucauuaggaauaaaauccuauuauagucuaacuucuaaacacaguuacagaagaauaaaaugaguaagcuugauuuuacauuaugauuuuaaacugcuuuccuagguguaacuuucaggaaugugauuuagcuaauuuuggucaucuauaaaauauuuuacuaaaacuaaauuuucuuaaauuuuuuuuaacaacagggcauuucuaaguuagaaugcuguauuucauuuugcugggcgcaguggcucaugccccugauccuagcacuuugggaggcugaggugggaggaucgcuuaagcacgggaguuuaagaccagccugagcaacauggugaaaccccgucucuacuaaaaauacaaaaaauuagcugggcguggugaugcaugucuguaggcucagauauucacgagacugaggugagaggaucgcuugaacucgggaggcagagguugcagugagcccagauugugccacugcacuccagccuggcugacagagugagacccugucucaaaaaaaaauaaguaaaauaaaauaaaaagcaaucaucaguacacuuuuuucuuuagaaagaaauauuucuuuuugaauuaaauuauguaauaauuuauucuguugcuccaucaaugcaacggaauuauauccagcugcaaaaaucuuuuacaaggaguaaaggaauauaugcugcacaaggcagcucuugcuucaaagcaaagucaacaguguucauauaaugaauugcauguuugguuccaccuauguucuuuaccaguauuucugaagaaaaacccacuucuuuugugaaaugguucaccuaacucauucucaugaaugaagaaacaaaugauacuauucccccaugaaaugcuguacucaauaauauuuucuguauagcgauggaaguaccagaauuuauugcauaugccauauaucacuguggggacuuuucaucccccaaaagaaacacaaaauauucaggcaauuccuuuauuauugauuuguggaugucagauauggcauauaaaacagugaugauuucacagucacaauucugauuaaugcugaaaggcaaugacaauucuauaucuaacugccauugacuagaaauuccucaauauguuaaauaauuaugcuguggauacacaguacuuguaaggagaaaaugcaaaaacaaaacuaaacuauaaaauaaaacucagaucgaucaauacugucuuaucugaacucauuaugcuuuaauaguuaccuucuacaagagaccuuuuuuauaaaacuuugcaguuucaauugagcuagcucauaauuucaggcucuggugaaccucuuagaaaagcaaauauaaaagacaaguuugcaagaacaaaugguaauaaaauaucugagcauuggucagcugccauaauggcacaagucuauguuucucuuuuauuuuugagauggagucucgcucuuguugcccaggcuggagugcaauggcgcgaucucggcucacagcaaccuccaccucccagguucaagcgauucuccugccucagccucuguaguagcugggauuacaggcaugcgccaccaugcccagcuaauuuuguauuuucaguagagacgagguuucuccguguuggucaggcuggucuugaacucccgaccucaggugauccgcccaacucugccucccaaagugcugggauuauaggcaugagccacugcgucuggccuauguuucuagaaucuuacauaucuuggacauaaacagcguaugcaauaaauaucugaggaauuauuuaauagaagaccccuuugggucauaauguacaaugaaucugaauugauauaacuuauaaaacaguaugaauauuuggaauaauuuguguaaguuugcaaacuaacuucuuuuaagaacuaaguuucuacuguaauugagagugauaauacucaguagagacagccaacuuuuucuuuaugcaauuaaaggccaauaugaaaaguagcaucauacaauuuacuuugaaggguuuuuaaugaacauauaugugaucaaauuuucuaauaaaugaacaaugcacuuuuacugcaccacccuuuauuaucaucagaagaacaaccagcuuuuuaauagauaauagccucugcuaagccuuaugaaauuccaguuuuauugcaauuguccaugaacucaucuuacagaucaucugcaaagccuggcagauaacuaauguacugcucagaccugccaaauguuucauuuuuuucugcaaacucucuaucuaaaguguauaaugcauucauucuaaugggaacuuucaaaagcugcuugugccaaguaaaaccccuuuuucaaacccaagaugcaucacuacaguagaaaagcaacuaaugaucuggauaaaaauuauugcuuuaaaaugaauccaaagugugugauuggaugguaaaugguucuuuagaguucugcuaaaugcauuaccuaauuagcuuguuacauauuaaagacguuacucauaaaauaugacuugagauuucauauuauucuggacuuuuugauucaauaagaaccacuauccuacauacauacaccugguggcuuuaccugacauuguacaggcacuuuucuccauagcugaauuuaaagggcuguucuugacugcaggcagagcugauuucugaacauggacugugggguucuuucuugauuuucaguggcaggccaugaaaagccacuagaaaaaagaacaaaaauau

SEQ ID NO: 17396 - RNA, 567 nt, Homo sapiens
cuugcccuuucggccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccuacuccacccagagaagcacacuuugugagaaccaaugggaaggagccugagcugcuggaaccuauucccuaugaauucauggcauaauagguguuaaaaaaaaaaaauaaaggaccucugggcuac

SEQ ID NO: 17397 - RNA, 55096 nt, Homo sapiens
cggccccgccccaggggcggugcuggccagacccugccgccugagagagagcacagccugguggguucuggggucuacggccuaggggccggggaaguuugcgccgccgcgaccagugcugcgaucccgagccgggcuccagccccgaggaccaggggucgggcgggccugccuacggaaccccgcgggccagcagcagucgucucgcguccuccugcuugguaaggggcuucugucuggcaagggugcgccucccgccgcuccggaccggggcccgcaccggcacccgcugcacaccgggcagggccgaggcgaggccggguaccugagggaggacggaagggagggggagcucgaugcgcucuggggagaggaagggggagaagccuauuucccucuucucaccccuuuuccccccauucuguuuuuaccuucugcccuggggccuuauuuagugcuuaugaccccguggccuagaggcugacaucgccuuuaaaauaacuacacaaauaauaaacauuauagcggcggguaccacacccuggcuuugaauuagggaaccuggggagcagauggaugaugcgauuugguggaaaucagccaugaaugccgccuggcccugcgccacuguuuggaugcgauaguauuccaugugaaugaacaugaccgggagcuuccagcuuguccacgagagcacagccucugcagggagcgccggucggcuuguaguauccaucgacuugggcagcgauuuccugacaugucugcugauuaaauagaaaugccauuuuuauuaagaacgacacucaccacuugaauaaccuuucgcgaauguguuuccucaucaaauaacucucaaccuacaaaaguggguagaguguacauuauuaauacuuuuuuuagaucccaugaaaaagaggaagaugcuugguauacaucagcuuuuagucagcaguaugaaaugccucuuaacuuaguacugaggccuuuaggggauuucuguauggugagauaugcagugacagucuaagcuuaugcuguacauguuuugaagacauuuuuacuuauuccaagauuuaacauacucguauaccacuggguauuaaugaaaauauguaauaaauuaccuucacaauacuuugugcucuccugacucuuuacaaagagaaaagaugaaaggucauacaguuuuguguuuuguuuuuaccuuuaauacacuuuauaacccauaucaucuuuguaauuuaugacuuuccugacugauucuuuaaaauaacuuaguucaguguuuucauuuuucuuaucaaggaaaaguguuuaagcuucuaaaaugucaucuaucaagcaccugguuuaugcaguuauucguuucuuacgggaacaaagucagauggacacuuacaccucggaugaacaagaaaguuuggaagguaugcaucugcucuuuguguucauuuauauuauaauuauaaacgaagacuaaaauagcuguaagcccaacuugaugaucuauuguaacauaaucagaauuuuuuuugaucuuucaagaggagaggccugacuauaagguuaucguauuuccauuuucugaagcuuguuuuguuuguuuuaacaacaaauuaagaggacuauuguucauuuauugaacaaauacuauaugucagaaguaugcuguucauauuauaggcaauuuuuucuucacagcaacuguuauguuaguauuauccccauuuaacaagugagaaaauaaaaccagggccaggcuugguggcucaugccuguaaucccagcacuuugggaggccgaggcagguaggucauuugaggucaggaguucaagaccaggcugggcaacauggcaaaacccugucucuacuaaaaauacaaaaaguagccaggugugguggcacuugccuguagucccagcuacucaggaggcugagauaggaggguggcuuaaacccaggagguggagguugcagugagcugagaucacaccacugcacuccagccugggccaugagcgagacccuaucucaaaaaaaaaaaaaaaaaaagaaaaagaaaaugaaaccaaauagcguaagcagauaacacagcugauaugugauaaagcugagauuuaaauccugguuaauacucugaagaucuuguugucuccauuuccuaauaggaaagcauccaguuuagaaauaauauauaaaaauaccugagucauuuuaauagcacuauguaaaagucuaauaauuauaccacuagugagaucugaccagugccuaauuuggaacuugaaaugggagcauuucaccuguguuuuacguuaacuuuaauauuggauucgguaaucuguaaaguugaacaggaugugggugauagcaucauguguuuccucgacaccgucuuuguucuucauguuuauguguuauaaaauuuaaauucaguacaaccauaacaagguagaauucugcagaugggcuuguggagguucagugaaucuggugucccuguggccuaaagucuuuuauuuauuuauuuauuuuuugagacagggucugucuggcucugucacccaggcuggaguguaguggcacaaucucggcucacugcaaccuccaccuccugggcucaauugauccucccaccucggccuccugaguagcugggacuacaggaguacacuaccacacccggcuaaguuuuguauuuuuuuuuguagagacagaguuucgccauguugcccaggcuguucucaaacuccugggcucaagugauccacucgccuuggccucccaaaguacugagauuacaggcaugagccaccccucccagccccaaagucuuaauuauugcagugagagugcauuuggaagaacuuaauaaaugacaguauaguuauaaaucccaucuugaaacugcuucuauaauuucaacaagcauuucccugugaauaugcuuuuaggagguggagaugaaaauugggcauuugcucuaaaccuccuugcagucugguuaguugaugucuuuccagguggcagugagaggagcaggugaugcacaguuggagaacauugcaaucaguccauuuaauauuaaggucuuuuuguucuccuugaugauuagacuaugugaaaauaaaguugauugguuaucuaaggagaauguuaguuaugauugcucuguagcaaacagauaaaugcagucauuuaagaaaagauguuucuuuucuaaucaaaagcagcauaaaaguuuuaagggccagaaagaaaauugaggguuuuuuuuucaaaccaagauguuauguccuauuuuuaggaugguauucagccaaaaauaugugccuucagcuguuuguuauauauggcagucagaaagggugccaauuguuuuugacugaccccuauuuuugacucugugagucuaauuuaauugaacaugaaaucauguggaggugucugcccaccuucuagacauuuuuaaaagcccuaggaaagaagccucaguucuaauaccagcuuuaccacuacugugaagcugguauaucaucagcuuugucuugccaucagauuaugucacccacuccucuuaauuauugucaucuacugacauuugcuucauuccuugacuaauugugguuccugcucacugucacucucucuagcacuacuccuauuuaguucuuggcaauugcaauauacugauugaugauuauuuuaguucccuggcucucaguuauugaccucauccagugaucucaaacacuugaucauauucuagaucagugguucucaacuugggggugauuuugcaauaucuggauacauucugauugucacaacugggugaggcggguggcugguauuauuggcaucuagugaguagguagaggccauggaugcugcuaaugcacaggacagccccugacaagaagaaauuaccugauccaaaaugucaguaugcggagauugagaaagccuucccuagacuuaaucauuaccagaauugcauuccuucccuaaucucuaucccaaacauuucacuuccugaccacuauugccugucuuuccaagauuacucccucuagaaucccuacuccagcuauucuuugacccaaccaguaccuccaaucuguucaugccucaccuuuccccacaccucuucuuacucaucuuaaauuccaugguugauaauuauaauuauucccuuguaucuccuucccuuucuugcaaagcccaacuuuguuuaaauccaacucuccaccuacuuugugcccaacuacucacacccacucauguagccguaaauaaauggagcaaaacacacaacuuugcugacuagucccacuuuaaauucaugacugugaacuucaaguagaccuuuaaugcugucaggcaaucacaguaucuguucuaaguucauucauacauuuauuuuccuagaugaccauuuuaacacuuucucauaucuucucaaacccucaaaccuccuucacuguccucacuuuuaguugguuaccuugcuuucuacuccaccaagaaagcugaaauaauaagaaaauagcuggauaugauggcacccacauacucggccugccugccuguuugacuagcuauuaccauagauggacuauucauguuccuuucuaaauggaaccccucuacugguauacuagaucccauccugucucaccuacuccaggauaucacuuuaguuauuuuauuuuuuuaaucuuacaucauaaaauuuucauacccuacuggaucauuuccaucaucauauaaacuuaccauuauucucccuucuucaaaaaagcaaaaacaaacagcaaauaauuacugcuuaauuguaugucucccuuugcagcaaaaccauuugaaagaauggucuauacuugcuuucuccaacuccucuccuucuauucuucuuaaacccauucugauuaagccuuugccucaaucucucaaucuauaccacucucaucaaggacauuagugauuucuguguuguuuaauuuaauggucaguucucagcuuucaucugaguuauuagcugucauugauaauguugauggucauuuccucaugaaaugacccccaccacccccaguauauuuuauuuaguuuccaggauaccucauacuuucuuggcuuucuuaucucauuguuugcuucuuuucuguccccuuuucugguuccucuucuuuucccugaccugguguacccaggguccacugcuugauccucuucuuuucauuaucuauacccauuucuuuggugauaucauucggcuucuuagccuuaaauaccccuuauuuauaugcuauuucccaaauuuaugcccucagcccagaccuuucuucugaaggucuuauauauccaaguaccuacuagauaucuccacuugcaugucuaauaggcaucccaaauuuaacauggccaaaaccgaacuucugauucccccacccaaaaucuguucuguaugcaauuucccaaucucuguuuaugucagcgucaucuuuucuguugcucaggccagaaacuuggguaucauucuggacucuucucuuucucaaauacccuguaacuaaucauucaauaaauccuguuggcuacacuuucaaaauaugucuagauuugacaucucuuauaccaccucuggacugaacuauuucuugacuguuuuagugugauagccucuaacuggucucucugcuucuauucuugccccuccauuggcuguuccaaacacaggcaccagugaucuuuacaaacagaguaugugaguuucuaucauuuaucuacucaaaacauuguuuaaaggaucuauauaauuugacuucugugacauauuguucaccuacuccuccccuuucucauuuggcuucagccauuauuagcuuucucuuuauaaauguaccauauccucuugccuaagggcuuuugcucuggcugguuccucugccuggaauggucuucacagauaaugcuaacacccccgucuccuuuaagucuuugucaaaucucuuuucucaguaaggccuacccugaacucucuguuaaaccugcagcugugggccgggugcgguggcucacaccuguaaucccaguacuucgggaggccgaggcgggcggaucacuugaggucgggaauuugagaccagccuggccaacauggugaaacucccucucuacuaaaaauacaaaaauuagccaggcgugguggcacacgucuguaaucccagcuacucaggaggcugaggcaggagaauagcuuaaacucgggaggcacagguuacagugagccaagauuacgccacugcacuccagccugggcaauagagcgagacuccgucucaaaaacaacaacaacaacaacaaaaacccugcagcugcuuuucugcucagcugcccacacucuccauccuccuuacccuuuacuaccuguuuauuguuuaugguccaccucuccaucuccuacuaggaaggaaaucccaagagguuagggaucuuuucuguuuuauucacugauaugucaaaagugucuagaaaagugcuugacacauaguaggugcuuaauaaauauuuguugaauugaauccaauggucucgggcauuucccuuaguugguuuggaucuuaguuucuaagucuauuugguagagauacuugccuuccuugcagccaauauauuugugaagagaaucugaaucagcgaauggcagguacauagcaugugaaaacuuuugaauuaaguguuauacagauaggaugugguauuacugaauagaauucuucacucaucuuucucuaucaguaccagacuauuuuuguucgguguuacagugaaacaauaaguauauauaguauuuguuuagauuuugugacuuauuccugaaugucuauuauuuucauuaggaauaaauaggaauagauucuucuaaaaggaagaucaaauguaauaaucucuguuugauaaaugagaaucuugagguaaauguaaguuaaauuauuguacccagguuauuuaauuuuuucagccuggauuaauaaggauaacgagacaggccugaguuccaaggcugugguuagcuuuguucacuaaucccaacuucacuaaucccaaucaauuucucaaauccaacuuuucucucuaauucauucucaauguuccugccagacuuuuaguucuaaacauaauuuaguuacguuauucucccucacuaaauucuuuaaugguucuccauuugcucauuccuugaagucuaaaucuuuuuaaaaaugcaauuucaggugccuugucaucuaaugacagacuucuuuugguuuuugaagacagagucucgcucugucgcccaggcuagagugcaguggggugaucucggcucacugcaaccacugccuccuggguucaagcaauucccaugccucagccucccgaguagcugggauuacaggggcaugcaaucacaucuggcuaauuuuuacuuuuuuagcggagaugggguuucaccauguuggccaggcuggucuugaacuccugaccucaggugaucugccugccucagccucccaaagugcugggauuauaggcgugagccaccgaaccuggccuccaacgacagacuucaaacauaaucccucaccaugucuuuccacccacuguauacccuagccauaccaaccacuuauuuugccauacaauaaaaauagacaaggccccuaucagcauuuaacaugcuuuauauuuugcuuauuauauuuguugucuuccuuuauuaaaauauaagcuuuaucauguagacagugauuuuuuucuguuagguuuauuacuguuucucuaccaccuuagaccagugccuuacagauaguaggcacuuggcaaauuugcauagaugaaugaauuuuuaaaaucuaucuucacauaaguacaccaagauuaauauuuagugcuucuuccuaugugcugggggcuauguucuguuacuauuaauguuuuuaauuaauggagaauucuguuucucacauuuuuuaaaaaaauaauauuuuagguuuguagugagaguacuuuuuuuguuuuguuuuuguuuuuguuuuuucgagauggggucucaacccguacuggagugcaguagugagaucuuggcucacugcaaccuccuccucccaggcucaagcuauccuccuccucccaggcucaagcaauccucccaccucagccuccugaguagcugggaccauaggugugcgccaccacgccuggccaauuuuuuguauuuuugguaaagaugggguuucgccauguuacccaggcuggccuugaacuccugaguucaggcaauccacucuccuuggccucccaaacugcugggauuacaggcguaacccaccacacuuggcugaguaaguuguuauuaaugacuugcucuuucugguagccuucaacaagaauaugauguaauacauauauugagaaauuauauucuagacaacauuuuuccuuaagugaggaauaagaaauccaguuguugcuaggugugguggcucaugccuauaaucccagcacuuugggaggccgagguaggaggaucacuugagcccaggaguuugagaccagccugggcaaccuggcaagacccugucucugcaaaaaaauuuaaacaguuagcauguggcucaugccuauagucucaauuacuaagggagcugaggcagggggaucccuugagcccaggaagucaaggcaacagugagcuauaauugugccacugcacuccagccuggccacaaagugaaaccuugucucuaaaaaaaaauugggaagaaagaaagaaagggagggaaggggaaggagaagggaaagggagagugugagggggaggaaggaagaaggaaaaucaguguguuuuccuuggauagcuagucuauaaacagaaauuucuuugcagcugaaccaauguuuuccuuauguucugugaucauaaauacugaauuuccauacauugcaguucuaucagaaaaaaaaaacuuguuucuuuuuuaaaauugcuaauuguuuuuuacuauuaaaauuuauuucaaguugcaauucagugcuuggagacaguuuuuaagaucagcccagaagauacacaccuagcaguuucacagccuuugacagaaauguuuaccaguuccuucuguaagguauguugucauuauuuucucauuauuaacugauaugacuacaauuuuauguuaauagauuguuaauagcugaggggccagguauaugaguaauuaacuucauccuguauauaagguaaauagucugucuauauggauauaauuggguaucuaaaauauaacucauuuaaugugcuuuagauuuucauauugauaacuauuuucauccucucaccuuuuauauuuaaugguauguauuagucgacuuuuaaguucuuuacaguaucugaguauuuuuuuucuugaaugucauuucaaugaaucugaguauuuuuugguuuccagcaucugaauugauguuucccuaaaacguggaauacagguuuaaaaaguuuuaaugucuaggaagcagccaugcagaaauggauuccucuggaauugaaucgucauuucugaagcagaauucaucaaauuugcccauugauggggcuccuuaaaacagggaaggguuaagggucacugugcaaaacuaagacugaaauccaaguuuucugaucccugcuccuggggacuauuuauacauggucuuggguuucuggccuuuucaggaaacagaccauaagacugucugaaaaaugcuaaguuuagggaguuuagggcucccacaugugggugaacucccacuuguuucuuucuuuucuuuuuuucugaggcaggucucucucugucacccagccugcagucuaguggugugaucauggcucauugcagccucagccaccugggcucaagcaguccucaauucucccaccuuagacucgugaguagcugggacuacaaucacacaccacuacacccaguuaauuuuuguuuguuuguuuuuguuuuuuaguagcgacggggucuuuguuuguuuuguugccuaggcuggucuugaacuccugggcucaaaccaucguccugccuuggccuccaaaaagugcucggauuauagccuugaaccaccacaccuggcccacauguuucuuuaugacauuguggugccucgugggcuccuuuuguuuuucuaacuccguacuugagcuuuaguauauaaugaagaauucuggagugaagcugaaacauaucuuacacacuuaagucuggaguggacauugcugacaauaccacacuugacuggaucuuccaggcucuguuucuagaacuucuugggaagagguuguuagaguugcaaugaagauggcaacuuggcaguaaaucauccccuuuuauuacacuugggagaaaaauaaugcaguuauucauuaauucaucaaacggaugaauucuuauuguaugacaagauauaaggagauagugauguuuaucucuguuccucaucagggagcucccuuuuucuucccuuuggugauggugggcugugguucuuucauugucugggccuguggcccccucagggaacccuguuucaguggcuagauaugguuauggcuaaagcagaccuucuuugcugucagguaggugaggccugugcuugacacaguucuuagauuuucucacucuuuagcuacugucaccauugacuuaauacugaagauauuagaacuacuuuuuuuuuuuuuccuucucaggaaacucuaauugacuuuuacccucuguuugaauaaagcuuuuucuuucuuuugcuguaucucccugauugcauuuaauuauaagaaauuuguugcucacuaucguuaaaauacaguuuauugaaacuggcugccuaguauaucuucaguuguguuauauaugugguaucauauuucuuuuuuuuugagauggagucucgcccugucgcccaggcuggaaugcaguggugcgaucucagcucacuguagccucugccuccuggguucaagcgauucuucugccuuagccucccgaguagcugggacuccaggcacgugccaccacgccuggcuauuuuuuuuuuuuuuuuuuuuugagacagagucuuguccuguugcgcaggcuagaaugcaguggcaugaucucagcugacugcaacuucugccugccaguuucaagugauucuccugccucagccucccgaauagcugggauuacaggcacccgccaccacacccggcccuggcuaauuuuuguauuuuuaguagaggcgggguuuccccaucuugggcaggcugguguugaacuccugaccucaugauccgcccgccuuggcucccaaagugcugggauuacaggcgugagccaccaugccuggucucauaauucuuuaguaguccuauuuuacagcuauggcuucauuccauauauguuuauuaacagaauauggcagagaaaguguaaauucaccugaaauagcaugacgauuguuguaauuaaagaaauuauuuguuucaccaaguguacuugguuguuauauuggucauuuuaucuuuaggauacugcuuuucuauuuuuuuucuccaauuauguuuauauaucaaguggauucauucccuuuauuuagaauagguagcucuugcccccacauggugaacugcucaaauuuaugcaaugaauaugauaauuaguuuucaaaguauaaaacaguggcaauuuucgcaaauaauuuagaaggauugggaagacagaagagauuauaaucuauuuuuuaauaugcuauuuuucugacccccaaaucacuuuuucccauguauaaagugccuaggcuuauuggaaaauuuaaaauacaaggaacccuaaagccaagugcuguaggacaauaaugugucuuugaauuauauuuagauccugaguaacuacagucaguuuuaagcagugaccucuacuuaggaagguucucauguuguuucuauauuuuuauuccaauauuuuaugcuugggaaaacugauuaguagauaaugauuuaaaaaaaaauaaggacaagacccauauacuuugucaguaauuuuuuuuacuugugaaucuuuaugucuaauuugcaaaauauauuucugauguagagcuaucaauuuuguagaaacucuaaucaagacaaagguaaugauggauauauacuacaguacauagggcugggcaugguggcucaugccuauaaucccaacacuuugggaagccaacgugggaggauugcuuaagcuaggaguuugagaccauccugagcaacauagggagacccugucucuauacaauauaaaaaaauuacccaggugugguggcugcucaccacacuagccccaacuuuuuuaaagcaaugaacauauauuaauuuuacuacaauauaagaaaacacggccgggcgcaguggcucaugccuguaaucccagcacuuugggaggccgaggcggguggaucacgaggucaagagaucuagaccauuguggccaacaugguaaaaccccaucuuuacgaaaaauacaaaaauuagcugggugugguggcaugcaccuguagucccagcuacucgggaggcugaggcaugagaauuucuugaaccugggaggcgcagauugcagugagccgagaucaugccacugcacuucagccuggcaaaagagcgagacuccaucucaaaaaaaaaaaaaaacuggacaauaugcaaagauacaagaaauuaaaauuuuacuucugauacacaucuuuccaggcuguuuuuaaugugugugugaacauauuuauauaauaucauauuauaaaugauuuuuuguagauugugauuuugacuuaguaggguauaucuuagauaggauauuagacauuuuguuccaaaauuuucacuaauauaaacaaucccuugaucauauuucuauuccuauucuuuacauacuaauuccauuuuuuuuuaugaagcaggauugccagguaugggaaaugcacauuuuuuaaaacuuugauucacauauucuucauauucuuauuuuuuuuuuuugagacagggucuggcucuguugcccaggcuggaguacagugccaugaucucagcucacugcaaccucugccuccugggcucaagccauccuccuaccucagccucccaaguagcugggacuacaggcacaugccaccacaccuuguuaauuuuuguguuuucuauagagacgggguuucaccauauugcccaggcuggucucgaacuccugagcucaagcuguccacccaccuugaucucccaaagugcugggauuaaggcaugagccaccacgcccagucacagauauucauauuucuaauaaaaaauauaugagaggacuuuuccccuauuuuuguuaauacuauuauuuaggaaguuguuuucaugauguggaguuacagaugauuuaaaauguggguaauuuauuauuuauuuauaguacucuaggaugauucuuuauguagcuaaagggaagugcauugauuuuuauuuaauuucagaaugacguucugccccuuucaaacucagugccugaagaugugggaaaagcugaccaauuaaaagaugaaggugaauauuucauacaaaaaugacuuacuuaguaaagcuuucugaaacuggaggaaauuacugucaauugauauaguucugauuacaccaccaagacuagauugucauaagugcacauggcaauuacgaaacagaaaugaaugugauggguaagaagccuggaaguacagaauggcuugugggcaguacaguuacggcuugcuucaagagaagcagaucuguuguaaaaguugcagaacacauaacuuaagggcgaauugcuucgguuuuugcuacuuauacuguaggaucucaaauucuucuuuaacuuaaaaagaggaaaauaguuuucagcauuauuuuaucuuucauauguuuaguguuuuugaguucuuugaaauuuguuaagguaggcacaugguacuuguuuauuagcuagcacuuuugauuacuacauuauuaaauuuuauacuaguuggcuauugaagcauucuugguuuuaagaaauaagucacuguugaggauuuguguuccauuuuuccauuaugucagcuauguuaagcuauagacgggagccaggugaggccuguaagauuuguacuacaaagcuuuaggguauaguccuuaucuuuagcagugagugacagccaauaaauccucuguucuauauauagacagaggguuacuagggaauaugcuauguucagaaacauuuucuagccuuuucuuuauuucauaccuugaagaaggcaguugaguuaaaaaaauauauaucauggccgggcacgguggucuacaccuguaaucccagcacuuugggaggccgagguggguggaucacaaggucaggagaucaagaccauccuggccaacucggugaaaccccgucucuacuaaaaauacaaaaauuagcugggcauggugguaugugccuguaaucccagcuacucagaaggaugaggcaggagaauugcuugaacccggcaggcggagguugcagugagccgagaucacgccacuguacuccaaccuggcaacagagggagacuccaucucaaaaaaaaaaaaauauauguguguguguguguguguguguguguguguguguguguguauaaaaucagcugguaucuaaaaagguggauaugaaacaauuauacuguuccuauuccuugggcauggucauuucucuaggucuguaaauauauaccuauaucacugugguuuuugcuuuuguuuuguuuuuuuugagacagagucucucugccaccucggcuggagugcaguggcaggaucucggcucacugcaaccucugcuuccuggguucaugcaauucuccugccucagccucccgaguagcugggaucauaggcgcgugccaccacgccuggugaauuuuuuuguauuuuuaguagagaugagguuucaccauguuggccaggcugguuuugaacuacugaccucaugugauccgcccaccucagcuucccaaagugcugagauuacaggcuugagccaccacgccuggccuauaucacuguuuuuaauggcuguguaguguuacaugauacuguuugagcaugucuuacuuaccuagacagauaauuuuguaauccuaaauaacacugucuuugauauuuuugucaauauuuauuuuugcuacuuuguuccuuuuuugagauggagucuggcucugucgcccaggcuggagugcaguggugcaaucuuggcucacugcaaccucugccucccagguucaagugauuuuccugccucagccucccgaguagcugggacuacaggcaugugccaccacgcccagcuaauuuuuguauuuuuaauagagauggaguuucacuauguuggccaggcuggucucaaacuccugaccucaggugauccacccaccucggccucccaaagugccaggauuacagaugugcgccaccacacccaacccugaauuuuuauauguuaaguauuuuauauguuaaauauguuaagccuuuuaucauuaacuuauaguauauauguguauaauauuugugguauguauauauacauuaugauaucuacaccuuugaggugacacaggaaaagacauacaguacaguuuuauaauguaaucauaaaaugccaucaagacaaagagcccaacagcaacaucaaagucucaauaacccagaaaauuaaaauguuugacauggaaaucaaacuaucuuugcuaauauaaacuuuuuguuucuucauaaaaaacaauguuaaccucucaguuuccuuagaggcuuucuauugauuucuuuuuuggggaagauccaaauuaauuuuuuuaacuugaaaagauauuuguugcgauauaauucauaugucauacaauuuacuucuuuaaaggguacaaugcauuaguuucucauauauucacagaguugugcagccauuaccauaaucaauuauagaaauuuuuuuuuuucuugagacagggucucacucuuucgaccaggguggauugcaguggcaacaguacagaucacugcagccucaaccucuugggcucaagcaauccucccacuucagccuccugaguagcugggacuacaggcacacaccaccaccccagcuaauuuuuguguuuuuuuuuuuuuuuguagagauaggguuucaccauguugcccaggcugguuucuaauuucugggcucaagccauacuccugccuugcccucccaaagugcugggauuacaaggaugagccaucauacccggccuacagaacauuuuuauaaccccccaaacaaaaaccaugugcuuauuagcagucacccuuuauauucauuuuugauuccuaauuuacaguaauuugaauauucuguuuuuguuccuuggaaauuuaugccccacucuuccuguuaagcagcuaaugaucuauuaagaacaaggcuaaugugagaguuucugguuuaagaaaacuggaaagaaucacagauaccuuugagauguaaaucauuccuccuaaucuccauuguuucuaauauuuucuuuuucuuuuucuuuuuuuuuaaagacaggguuucacucugucacccaugcuggaaugcaguggcacaaucauggcucacugcagcuucaaccuccugaguuuaugugauauuccugcuucagccuccaaguagcugggacuacaaguguguaccacugcgccuggcuaauuuuuuuaauuauucuuuuuguugagaugagggggggucccacuauauugcccaggcuggacucgaacuccuggccucaagugauccucccaccuucacuucccaaaguguugggauuacaggcauaagccaccacgcccagacauauuuugaaccauugguucuuacaagugcagaggacacuacuuuuucauuuaaugguauacaaaaaauacccauaggaaaucucuuauuuugcugacauuuuauuaacuuagcuaaauuacugccagauguaucugcagaugcccuuccugaaaaucaguacuuugcaggcuagccaugguaucugaaauucucuuucuagaaauuaaucucuuuaaauccccuuuuaaaaagagucuaacucuggaagggauagcacauaaaaauauuaucugccacuaucaugauagcaugauuaguuuuaucagcuuauccucagcaguguucugagaacuugauuaucagcagauguguguuuuaacagggaaagaguggaagaccagguccagauugagauggugauuagggaggguguugcaucuggaacgggcuggggcagcucuaaaagggaggagagagaugaagauaaggaaggugagaagagauucacuuuugccaugagauagucauaauuguugcauuuacucuuuuaagucuggauuuuauaagguauauaaacauuaauuuuuuaaaagacuuugcauuguuaaaaugauucaaacacacugaaagcuaaauaauaucaacucuauaguacaauguaaaauuuuuuccagugugacugaaaaaucaugaggccgacuuucauauaauuauaguuuccacgauuaaaaugugucuauaagaguguauguuuuuaauguauauuauacuuacuguacauacugguuacuuuauuuuaggcaauaaccacaugaaagaagaaaauuaugcugcugcaguggauuguuacacacaggcaauagaauuggaucccaauaaugcaguuuacuauugcaacagguaaacuagcacuauuguggcagguuugcaauucuuaaacauuuagauuaauagcucugaaggaaaaugcaaaucuuaauuauuuagaaaauuuugaaaguucagaaaaauauaaagaaggaagaaaaaauaaacuuaaccaacuuaccacucagaggcaaccacuguuauuaaucuguuagcauauuuugucuuacauaaauuuauuuauuuauuuauuuauuuauuuuuuuuuuuuuuuuugagacggagucucacugucacccaggcuggagugcaguggcaugaucucggcucacugcaagcuccgcuucccggguucacgcccuucuccugccucagccucccaaguagccgggacuacaggcgccugucaccacgcccggcuaauuuuuuuguauuuuuaguagagaugggguuucaccguguuagccaggauggucucgauccccugaccucgugaucugccugccucagccucccaaagugcugggauuacaggcgugagccaccgcgcccggccuaaauuuauucauuuuuauuuuuauuuuuuuugagacguggucucacuuugucacccaggcuggagugcaguggcaugaucucagcucacugcaaccucugccuccugaguucaagucauucucccaccucagccucugcugggacaucagguggacuacaggugcacaccaccaugccuggcuaauuuuuguauuuuuguuuuuuuugguggagaugggguuucacuguucaaguuggccaggcugguccugaacuccugacuucaagugauccaccugccuuggccucccaaagugcuggaauuacaagcaugagccaccacacucguccaguuuauucauuuuuagauucaccuuuguucacugguuuuaccaaaaauauguccuuauuuuauugcagucuuucauaagcauuauuuaaaugguuacaaauuaaucucuauuacuacugcuuauucuuuuuuauauuuccagcaccuaucauuguggcuagcaaagaaguacucagcaaggguuauuuuugaauagggagauagacauaccuuaguuuacuuaccuauugaccuacugguggacauggagguugcuuccauuuuuuuucaauauuaucauauaaagcugcaaugaacaucuguuguuucuaaaauauuuuucaugcuuuagauuuucuggacuuuggauuuaucccuggaaaugcacuuaguagaucuagaagugcaaauuauuuuuaaaauuguugaugcaaauuacaaaacugucccaucuucuuugaaaauauuuugaaaauucucucccuaggaauguaucuguuuuggcuacacccuugaucagcacuaaguaugcaaaugauuaauuauugcuaauuuaauuuuguuuucauauuguucuaauuuauauuuaaauacuggugagguuggauauuuuucaaauguuggccauuuuuauuuguuuuuuccuaaauuuucuauuuauaccuucuauagacugaauguuucuauccccuuaaaauucauauacuaaugugaauuuuacacccaaucuccaaugugaugguauuuggagguggaaccuuuggaaggugauuagguuaugaggcgaggauuaguaccuuuaugaaagagacucuggagagcuccccugucccucuugccaugugaggacacagcaggaggaguaccccuaccaguucuuagcuuguuugaccccagacuucuuucuuccucuuucuuggcucuguccuuuuuaacacgggucugaacccuauaggcugcauuucccagucucuuuuaccaucuggcuuuuguauggguucagccauggagguacuggcaggagauuugaaggguagaaggaagagagaagucuagguauuucuuucugcuuuuuaauuuaauuuuauuuuuuaacaucaugguguauauucagcaggggcugcuucucauccuugucuuccuacuuccacccgagacacauacuguuguuuuggucuuugccaggggaccuucgguauuggacuuuguacuuuguccuucagucuuagggaugguaguggcuuccuguugugaauuucuggauugcuguacaacccuguuuggccucucagcucuucugccaccuuauguaauaaauucccugaauuaaauuauucuguuuuaaauuuugaaguuccaguagaacuuucuacagugaucgaaauguucuauaucuguacuguccaacucaguugccacuagccacaguggcuguugagcacuugaaauguggcuagagagcaauugaggaacuaaauuuuuaaugucuaaaucaauuuaaaauuaauuuaggccgggcgcaguggcccacgccuguaaucccagcacuuugggacgccgacgcgggcggaucacgaggucaggagaucgagaccauccuggcuaacacagugaaacccugucucuacuaaaaauucaaaggaauuagccgggcaugguggcaggcgccuguagucccagcuacucaggaggcugaggcaggagaauggugugaacccuggaggcggagcuuguagaaagccaagauggcgccacugcacuccagccugggcgacagagugagacucugucucaaaaaaaaaaaaaaaaaaaauuuaauuuaaauagccacauauggcuuauggcugcuauaucagacagcagagcccuauauuaaagauauagaacaaaaauccgugugucuuauuugccuuuuaauguuuuucauauguaaaaguuuuaaaaauuuauguaguccaauuuuucuuuuccuuugaauuuuauuccagugcuuuuagacuuaaagcucuccccauuuacagacuugacaaauaacuucuauuuucuuauuuuuccuuucauuuaaauuuuaucaucucaagucuguuuugguuacuggcauuacuauuuuaacccauucgaaacuuguuauaacggccuuaucaccuuuuauuuuauaguagguucuuagguuugaaagagaucuuuaaguuaacuugauccaauauuucauaaacucauuauuaucauauuuaggguagucacaccuuucugagauagcacucuccuccccuaccuuuucuuuugugguuagguuauaucuguuagaaaggucuuccuuauauugacacugaauuuguuuuccuauaacuccuguagcuucugucgguugguuuuaguuaaggguaauuccggaauaauuaugauucuuuuuuuuuuuuuuuuuuuuuuuuuugagacggagucuugcucuguugcccaggcuggagugcaguggcaggauauugguucacugcaaccuccgccucccagguucaagugauucuccugucucaguuucccagguagcugggacuacaggcaugugccaccacuccaggcuaauuuuuguauuuuuaguagagaugggguuucaccaucuugggcaggccagaguugaacuccugaccucaagugaucuaccugccucagccucccaaagugcugggauuagaggucugagcaaccacgcccagccaugauucuucuuuuucuuuucuuucuuucuuuuuuuuuuuuuuuugggagacagagucucacucugucgcccaggcuggagugcaguggcgcgaucuuggcucacugcaagcuccgccucccggguucacgccauucuccugccucagccucccaaguggcugggacuacaggcgcccaccaccacgcguggcuaauuuuuuuguauuuuuuuuaguagagaugggguuucaccacguuagccagguuagccaggauggucucgaucuccugaccucgugauccacccgccucggccucccaaagugcugggauuacaggcaugagccaccgcacccggcucauucuucuuuuucaugacaguaccuuacauuuuaaaauuugcuaccauguucacuuuucuuuucuccacauucaauguuugaaauuucuucuguuaaacuucagguaguacagcuuuaaguccuguaccuucacuugaaacuuguuccaguuuaccucugucuguuagauauaguucccagaagauaagacaguauaccuggcauuagucuaacuagaccaacagucuuguaagacucucauuuaaccuacuuucuagauagcauaacuauauaucagcauauucuagcauuauuuguuaaguucauauuuugcuuuugguauauuacaucccucuuuuuucauagauucuaucauauaacucaaucguauauauauuugacagguuuuuaccaaauaccugcuaugcacuagcacugccacuggaggaacaauugguugcuuauacucaaaugcaggcucuuaaguuuugccccuaucaaauucuaucuuguuauaaucuucuauuuauuugucuuuuaaagcuuuuuugauaaguaaucuguaaaguaaugaauuugcucuuacucccauuuucauguuauccacaaacuugagaagaguaccauaucuuauaucaauaacaaguuggcugggugcaguggcucacgccuauaaucccagcacuuuggaaggcugaggcggauggaucacuugagguucgcaguuccuggccaaugugaugaaauccugucucuacuaaaaagcaaaaacaaaaaccaaacaaaccagucaacuacuggaacuauaauagagaagugguuaagagcagggguucugaacccagacucuuuuaaaaauauauauguauuucaguagcuuuggggguacaugugguuuuugguuacacggaugaauuguauaguggugaagucugagauuuuagugaaacuaucacccgaguaguguacauuguacccaacauguaguuuuuuaucucucaucucccucccauccucccacuucugagucuccaaaguacauuauacuacucuguaugccuuuguguaccaauagcuuagcuccuacuuauaagugagaauacacaacauuugguuuuccauuccugaguuauuucacuuagaguuaugaucuccagcuccauccaacuugcugcaaaagacauuaucuuguucuuuuuuguggcugaguaguauuccauaguauauacauauauaccacaucuucuuuauccacucauuggccgaugagcccuuaguugguucuacaucuuugcacuugugaauuguccugcaauaaacacaugugugcaggugucuuuuggauauaaugauuuuuuuuucuuuggguggguacccaguaaugggauuccuggaucgaaugguaacucuacuuuuaguucuuuaagaaaucuccauacuguuuuccauauagguuguauuaauuuacauuuccacuagcaguguaugagcauucccuuuucaccacguccaugccaacaucuguuguuuuuugacuuucuaauaauggccauucuugcaagaguaaggugguaucucauugugguuucaauuugcauuucccugaaaauuagugauguugagcauuuuuucauauguuuguuggccauuuguauacuuugagaaaugucuauucaugucauuugcccacuuuuuggugggauaauuuguuuuuuucuugccgauuuguuugaguuucuuguagauucuggguauuaguccuuuguuggaugcacaguuugcaaauauuuucuccaauucuguggguugucuguuuacccugaugauuauuucuuuugcuguacagaaggcuuuuaguuuaauuaggucucacuuauuuauuuuugaugguuccagacucuguggauucuaauuucuggcucugacacuuacuaccuaugggaccuugagcaaauuuccuagugcaucuaugccuugguuucccuaucuguaaaauguggguaauacuaguauuuaccuuguaggguuguuauggagaucaagcaguauaguacauuugaugcauuucaagucaacuugcagccaucaauauacauccucccuaaauacuuagcaugcauaucauuaacuagaguuuaguauuuacuuuuuuggggguaaaauuugcuuacaaaaaaugcauaaaucuuaacuguacuuucauggaguuuugacaaauacauacaccuguauaaccuaaaauucuaucaagauauugaaaauuaccauccuagccaggcaugguggagggugccuguaaucccagcuaccaucagauguccaggaaguuccuuaaaccccuucacagucuguugccuacaacacucaccagagguaaccacuguuuugauagauuagauucauuuccucuagaguuucauaugaaagaaaucauacauauuuucugugcaagacuuuauuugcucagcguaacgguuuugagauucaaccauguuguggcauguauuaguucauucuuuuuuauugaucaauaauauucuauuguuugaauauaucaguuugcuuagcuauuuuuguaucuauggccaccugggcugcuucuaguuaaaacaauuuuuuuuaaauguuguccagauuuuauaguuauuauuugugggaggucauauccuuaagaaguuuaguuggccucacuagagaacuucauuuucuucuucacauacacaaaaauuccuuuauuaaucaucaauguagcuccccaaaauagaaaauccaaauaguuuguggagaaugaauccucuuagcugugguuugaugguuaaguuuuauucuguguaaucagauuaauuuauauaauguuuuaguguuuuaacauaugcagucuugaaauaaauacuugagugucaugaaauguuguaaccagauacaaauauuaucacaaaauuucuuauuuguacagcacaauaagccauguacuuuuaaguauaaauauggaaaaugugagccuacaaaguuuauuuuugaugagaauagucuuauauccaccaguacuguauuagaagaaauuuuuggcaauaccuaugcuugcuuuuuauuuaauuuuuguaaaacugaaaucaauaauuaugcuucucuuuugcacuuaaauuguaucuuuuucccugaaaagugcaguaaaagagcaugcuauuuaauauuaaauaaucagaaaacuuuauacauuuaauauaaguacuaaacaaagcuuuaggaucacuuugguuuuuuugagacucuaguagcuauaaauaucucaguagccuguaaucuugccaacuaccucugccauuuuucuuugccagcuggcugccaagaauugaaagcucagaauagccaaucuaaauauucauuuuaaauucauuuucacaauuuuauuacuaaucaaaauauuuuuuacauacucaacucacuaggaugaacuaauguuuacuuuuuauagaacugacuuuuuaauuuguuagaaaaugaucaucuggcacauuucuuaagcaugacucuuucuuuucugguacuugucuucuauuuuggccuuuuaggauccuacugaugcuuuaggcuccacuuugauaaaaggaaaaccugaauccuuccuuguaaacauaccauguaguuuugcuuuuugaauauacuucuagcacuugccacaauguguaacauuuauguagguuugucauauguuuuaucguaugcuuaucauacguucugccuuaucuuauaugcauauuuguuuuauuucuucaggugaagggcagagauuggcacuuguaucuauuuguauccccuauagcaccuuauacugugccuuguaggaauucagccaauuuuuguaggaugaaguguauaaaagauacugaagcaaccagccauucacauuaacacuuguguacauaaaacaacaacugauugaguauaggucuaaaacaccaccaaguucuccaugauaugaaaugaacaacaguuuuggaugucuucugucucuacacaaacacaauguucuuauuucuuuuguacuucagugcugaguacuuuacccauagucagcucaugcuucagggguggauggauaguugaaugacuuaaggcaauaaaagacaggagagagagagagcaugaugcagggaauuuggaaggccucuuaggugauggagaacuggagucggauuugaaggaccaguagaacuuggauaggcagaggagaggggaaggcauuucagauuggagagcuuaguauaaaaggcacaaucaagaagccucaggccauuguaauaagaaugcuagugacagcacguagccgugugagcucugagaaagaugggaacagaggccucauuauuucgcauuuuguuuccuccucuucugugagcagcauguggucagucaguccacugggauuugagcuuguuguugaaucucuguucugcacuuacuagcuacaugaccuugggcaguuacuguaucuuuuuaagccucaguuuccucacuuguaaaauaaggauauuauccacuucaaaggguaguuguaaggagugauaauauguacaaaguccccagcauaguccuagacuugcaacauuuguuucuuucaaaaacaagguaaggcuucuuuaauuguaggaauagauuuuugccauaauuuauuuaugcaugaugugagaaaugugaaguagcuuaauuuuuuuccgucucucuguaaaaauagaacauaaaucauauuugugcuuuuguuucuaauaaggugaagaaagcaagggugccuggaaacaugugacucugacuguacuguuccacugaaauuucauuaguuaugcccugauaaccagacaacagaggcagagagcacagaccacguuguuauucaguucagacauuggcauguuucgcuucaucuuccagaagauucaaauauagccugucuucucuuuccuuuccuggccucugaggcucagacgccucuccuguuccuuuugugagcugcacaaaucugcuuucacccuaacuugcaguuugugauccaaagcuguuaagauugaaacacagucccccuccuuccuuacacccacucuucucucugagucugauccucccugcuuauuucuuaucuuauugucagaaucugaagccagauuucagggugucuuucuguuucccuuuuccauacaccucccaaauagcuaauuuauuuccuacucccuuaguccagguucuuaacuuugguugaacuagugcaauagggacaucaaaauggcuuuccauuucuacuugcacuccccacuccugucuucugccaagacguuuuuuuucuaagaugugaaauugaucaucuaaugcuugcuuucaguaguuccaaaauaccuacaggauccaauuuaagcuccucaacaugacgcauaagaucuuuucuaaucuaggcucuuucuuuucucuuaacuucauuaucuucacuuuuccuccuacccuauuccucuucucucuacuaccuaugcacaugucauaugaaacuuacugauuucuuaaaaauaccauguugggacaucucucugugcuuuguaugugcuucccccugugccuagaauauuuccuaccuuaucuaauuggucaacuacuagucauccuucaaaacccauuaugcuuugggaggccgaggugggugaaucaccugaggucaggaguuugagaccagccuggccaacauggugaaaccccugucuccacuaaaaauacaaaaaauuagcugggugugguggugcgcaccuguauucccagcuacucuggaggcugaggcaggagaauugcuugaauccgggaggcggagguugcagugagccgaagucacgucacuacacuccagccugagcuacaagagcgaaacucugucucaaaaaacaaaagacaaaaaacccuguuagguguugcuucuuugggacgacuuucuuaauuucuuuucuuuuuuuuccuugucacccaggcuggagugcaguggcacgaucuuggcucacugcacccucugccucccagguucaggcaauucuucugucucagccuccugaguagcugggacuacaggcuccugccacuaugcccagcuaauuuuuuuguaguuuuaguagagacgggguuucacuauguuggccaggcuggucucaaacuccugaccucaggugauccacccgucucggccucccaaagugcugggauuacacgugugagccacugcgccuggucuucuuaaugucuuuuccucccaaccuccugaccaugccccuaugcccuuccccuccguguccuguggaguggugcuguccaauaugguagcucccagccacauguggugauuuaaauauaaauuaauuaaaauguaauacaauuaaauauugcauuagcaguuccucaguugcauuagcauauuucaaaugcucauuagucacauguggcuaggugcuacuguauuggauaguacagauacagaacuuuucuguugcagaaaguucuguuagacagcuuggcauaggguuagccacaccuuucucuguguugccucuuccuuuuauacuuccauuuuugcaauuuauuauaguauuuguuuauuugcauaucuauuucccuauuagacuaggaaagguugaagggcagggagauauucucuucaucuuuguauaguaguuucgaguucagugucuaggauauuauagguauuccacaaaagucagcugaauugguucagugaauuuuaggagggaaaguugucucuaccugaugacuucuaaugaugaaacagugacauggcagcguguaugugugucuauuuaaaaaaaaaauuaaaccuauuuaaacuucuugagagagaauaguaugaugaacaucucucucuauauguauguucaucacagaaucaaugguaguuaacauuuugccauguuuacuuccucuuuuccuuccuuccuucccucucucucuccuuccuuccuuccuucuuuccuucccucccucccuuucucuuucuuucuuuuucuccuuccuuccuuccuucccucccuucuccucuuucuuucucucuuuccuucuugauucaucccuuccuuccuugcucucucuccuucguuccuuccuuccuuccuuccuuccucucucucuuucucucuuucccuuccuucccuucccuucccuucccgucccauccuguccuguccuucucucacucugucacccagccuggagugcaaugggaugaucucacuguaaccucugccuuccagguucaagcaagucucaugccucagucuccugaguagcagggaccacgggacacccagcuaauuuuuguauuuuuaguauagacaggauuucaucauguugggcaggcuuucucaaacuccugaccugaagugauucacccaccucggccucccaaagugcugggauuacaggcaugagccaccgcaccuggccucucuuugucuuucuauugggguauauggggugggaggguguguauaugccuauauacaaauacauaaaauuuucuugcugaucccaaauacuucagcuauaucucccaagaauagggauauguuucauauaacuaucauaccauuuacauguaagaaaauuaguauuaauacugaaaucuuuccauuuguccccaaaacaucuuuuauagcuauguguuuuuauccagaauccaaccacauuucuugcauuguauuuuguuaugccacuuuugucucuuuuaaucuaaaaaguaucccugacuuuuuugauugauuguuuuucacgagauagacauuuuugaagaguucaggccaauugucuuauagaaugagccauauucuggauuuauguggugcuuccucaugauuaaauuuaaguuaaauuuuguuaugaagccuacaaaaauaauuauguguaccacuuauugcauuguguuaggagguacauauuuucagacugucccauuacuggugacucuaaguuugauaucuuaaggugaugaccaccagaucuauuguuccuuuuguaauuuauaaguaaucuguaggguuuggugaugugaauaaaaaauuauucccuaacaaacuucuauuaaauauuuuaucaucuguucaugaucuuucuccuuaucacauacguugauaguugcaaaauggugauuuuucuaauuuuaucguuuccuuuacauauauuuccucacauauuucuauaaagaagagcuuuccucucuuccuuuuucggcuuucucccucuuccucacugaagcuuuuuugagugucaaaaaagcuggacucguuaauuuuuuaaaaauucgcuauucaauauguuauaaucaguuaccuuaauaguuauuuuugguucuuaaauuaucccacauuuggcuaaugagagccccuuuaaacuggucguguauccuuuuauguaacuucauuuuuuuuuuuuuuuuucuuuaagacgaagucucggucugucacccaggcuggggugcaguggcgcgaucucggcucacugcaagcuccgccucccggguucacgccauucuccugcgucggccucccgaguagcugggacuacaggcgcccgccaccacgcccggcuaauuuuuuuuguauuuuuaguuucacuguguuagccaggauggucucgaucuccugaccuugugaucugccugccucggccucccaaagugcugggauuacaggcgugaggcacugcgcccggccuguaacuucauuuuuaaagaacacuuucuuagccaggcacaguggcucaccgccuguaaucccagcacuuugggaggccgaggccaguggaucacuugaggucaggaguuugagaccagccuggccaauauggugaaacaccugucucuacuaaaaauacaaaaaacagcugggugugccacugcacuccagccugggagacagagcaagacugucucaaaaaaaauaauaaaauaauaaaaaaaccaaccacuuucuugcuuucugagauaauaagacauuccauauuuccuuuguacuuucccuguuguagccuugagcucaacuauuucuccaaggaagcucuguccuuuucaguggaggauguauuuagaaaccaagauuggguugcaggacaugaucauugcuacuaaggucuuauugcuucuagguccuuucaguggacagagcuaggaaauugauuuuuugaaaaguaucaguuuauacagauaccuucaauucacuagcaucacagaauccucccuuaucuucccccauuuuauauuuguaucuuccuucucccauggugaaaacccuucuuccauuaccaccaguagcuuuacucauuugcuguaucuuucaguauccuucaguugguauuauaagccaauauuacaccacuagcacgccugcuauguaaacuucaggauuucuuugcaguuuuucauuugucuuugaaugcaucucacuaagcauauauacugagaauacugugcucaaaagugauuugaauuguuuuugauauacaauuaggaucaauuguuuguuuuauucaguuugaaguuuugcuuuuucaucuuucugaagucuuacucccauuucuaucccaucuaccccauucucacccauccccuauaggaugagagugagacuucuaauguagguuuaacuucugaacuuuguacguuuuuuacauaaaauuaaauuuaaaaggaugauuaguaaaaauaauaccucucucuauccuuaaugaucugauuugccuuguguuuaauauuaguguuucuacaucagcuuucuuuuuuguuguuucaguucuccuguuugucuuuugcuguccuuuuaacuucaaccuguguaugauuaugguuuaagugauaucuuuuguauccaaguugagaaucugaguuuugugugauaaauuugaauuguuuucugcuaccuuuuuuaggggggugaggaggacagacucuugcuuuguaacccaggcuaaaguacaguggcaugaacauggcucacugcagccucgaccuccugggcucaagugauccuccugucucagccucccgaguagcugaaacuacaggcguacaccacuacaccuggguaauuuuuaaauuuuucguagacacagggucacacuguguugcccaagguguucucaaacuccuggacucaagugauccucuuggccuugaccucccaaaguguugggauuacaggcaugagccacugcaccuggcucuuuuuaagcauccuuuuucuuggcugcuucuucucucccccacaucccccccuucuauuggauugauuuuuuuucuuucuuucuaauuauuuggaaguuacacauccuauaucucuucuucuaaugguuauucuuguccugcuguuacuuuguauugaguauuaaguuggagaaacccauaccacuuuuucacaugaacuaccaaaacugguuuguugaacccuauacuuucaaaucuuaauuuuuuuuaaacugaagcaaaggacuauguuuauuuuuaaauaaauauuaacauuuuuauaauuagucugaaaaguaagggccucagucaugcuguaugaagaaagauuggcagaaaacuagaccuaaaaccaccuuuucucuauagucugccagacuucuccucccacuccaugcccccacuagaaucuaagugcuauugaggacaggaauauuauuuugcuuauugcuguauccauuauucuuagaaaagugugcauucacuggcccucaauagauauauuaguugaaugaaucaaguagaaauauuuagagaagaacaaauggagugguguagcuuuacuccuucgcuguaucuuucaguauccuucaguuguuauuauaaaccaauauaauugguuuauaauuauaaauuacaauuauauugguuuauaauuaugagggcaggagacauuauggaaacuuugaguugaaagauuugcaugucagacaauaauuauacuuguauuguucccagucauuuuagaagaguuuuuuugguagaugugauauagcaaguguuaacaaaucagauaaaugguccuugauugcucugagauucugugcaaaguagauguaauaguugucauccuuaauuuacagccagauuuagguacacagauaaguguuuuuacuuuagauuugcuagauaaucuuaauauauuguaauguuauguguaccuguagaaugacuaguguuuugggaaggcaugaauaugcauuuauuaaagauaaauuuuaacuaaacaaagaaauacaauuaaaaggccaggcaugguggcucacgccuguaaucccagcacuuugggaggcugaggcagacagaucacgaggucaggagaucgagaccauccuggcuaacacggugaaacccccgucucuacuaaaaauacaaaaaauuagcugggcgugguggcgggcgccuguaaucccagcuacuugggaggcugaggcaggagaauggcuugaacccaggaggcggagcuugcagugagccaagaucacgccauugcacugcagccugggcgacagagcaagacuccaccuaaaaaaagaaaaauuaaaaauaguuaacauuaaauccugaauguagccauauaugaaacacuuaaaaugcaauccacaugguauuauuguucucuuugaaaacuuuugcuagguaacauuccagaugcucagaguaugcuaaguccuauguauuauguauagaggagucauuuucugauuguauuuuaaaaaucacaaagcagauaucuaaaggcaaguauugccuuucaguuuccugaagguguuuagcaaguguuuaggaacagauuuguuguuuuuucaaaaccacauaguucuuucucugaauucccuuuucaaaauuuucucucuccauccucccaugagcccuuuuacccuucuugcauguuucugugcauaugugcggacaaguaaacuguuuugaaggugagacucuuggcagaaaagagaugagauugaggcauuugcuguucuacaaaaucaccguuaucagauuuccagaaucagaugucagugauagaucagacacuaggccugugaauuugcagauaguauugccuugccuaaugaauuagauauaagaccuggacuuaguauauaucucaugcuccguuucuggacaagauuuuuuuucuuccaguggcucugcuuauuauauauaauaaaauuauuuuaaaaaucugucucaaaaaguccauuaacuccuuuucucucaauaaauguugugaauucuuagaugaaauuugguuuagcaguuuuguaaucccagauucaacuuccuggccaggugcaguggcucacaccuguaaucccagcacuuggggaggccgaggugggcggaucacuugaggucaggaguucaagaucagccuggccaacauggcgaaacccugucucuacuaaaaauacgaaaauuagccggguaugguggcacacaccuguaaucccagcuacuugggggguugaggcaggagaaucacuugaaccugggagacggagguugcagugagccgagaucgcgccacugcaguccagccugggcgacaaagcaagacuccgucucaaaaacacaaacacaacaacaauaacaaaaaacucccugaguugguaggauuccauugucauucaguuaauuccuugcauuacuucucucucugaacuguucuccuucaagcaaccaggcagaauagaccagaacaucugaggccucugagggaccuuccuggcucuauggacuaaaaucaccugucgacaagagcuuucuauagugguagaaaaaggagcuugcucugagacaaugucucauuccucccuuauuguuauugugacacaaaguuuuuguccugaaagcacuguggcuuagaaggccaagcauaaauaugaguuuucuugaaaucuccuuucugaguacguauguaucuaugugucacccauugaaguauauaaacuuuucaagguuggucucuuaaaauuuucucugaguuaagcuacucuaaaaggaagaucuguacuugucuggaagguugugcuccuuauacagcauaacuuuaaugaaugcuuauugaccuggaauccucacauuggauggggaaaagucagugauccagacucacauguuguuaaucugcuuuguggaaaccaggcuaugaugggaauuucucaucaucuuccuguuaauuagaacuaaacuccuauuucuucuccuuuucuucccacuaaaugugcugaauuuuuagugaaaauuuaguagguuuauauucccagguucagcuuccagaauuggcaguauuucuuuuagcuucuucuauccaggauugguuuuacauaacacaucuguucauggauaccuagcaaauaauugauuuauuacuauguacauccaguauuuguagaguauaauaauaagcuggaugugauauagaaguaguauuagauaacccuaaucuauaguuugauugacaggaggagauuagaacauacuuaagaaauauugaggauuagcaaggauccucacugauacuuggagcuaggugguguuuuaaucagcuuuauuguuuucgugugugcuuauuagauuccagcuagguccuugaaagacaugaccuuugacuaauuucaaggaagagagaugguuuacugggugguuaagcaaaaagauuguuuuuaaggacaauuaaaacaacauauauggggccaggugcgguggcucaugccuguaaucccagcucuuagggaggcagaggcgggaggauagcaugagcccaggaguucaggacuugccugggcaauauagcgagaccauguuugcuacaaaaaggaaaaaaaaaaaaaacaaauguggguaaagagagaauaaagguagcaaaaacaagaguagugcuucucagauugcagugggagaggaacaugaggucagagacuuggguuggcgugagacucuugucuguagacugaagaacaugaaggagccuaaguucauuucugggcuugcaagcaaaauuuucagggagugcuucuuuaccuuuauuaaugcaaaggguaccaggucuuggaguuacaguguuggaggcagaggugcugugcagcauagcauucuccuuugcaguugugagaaauugaagaaguggucagcacacccuggcccuccuugguccaagaaacuucuguuucuugguugcuggcaccccacuuugacuucugagcaucugucuuagagcuucucuucuuuccuguuucuccucugagcuauuucuuccuauuuggaaacguuauugaggagaguucacaacugcagggauuuugaucuaggcaaguguucuuuuuccaaaguuggcucuucaaccuuuugaugagggacaagauuaugagaacuucugggagccugaaagaaauaaaauacaguuggccuuagaaaugagugaaugagagaaagugccaggggacugggauaucacuuuuacuugucguuuaacccuaccauuaaagugauaauagcacaacccucuguguagccauucacagcaauaacucacucuuugugccuccauaguagccaagauguccuagcuuuuucacuuuucuguuuggacaaacuagaaaggguauaaauagguagaccaguuguaugacuuacauauuuguccuuucuauagcaaagcaaacagugaaaggcagccugcauacuuuuuucugcacagaaguuucugagcuuuuuuuuuucauuuuauuacauaauuaucuuagacaguuugacuuagaaauuuagugggagugaucuacaaauuggaacaagaaaaagguaguauuauuaguaccugaaaaucuaaauuagugccuugaaaacugccuuuaauaaaauucuguuuucuuucucuuagggcugcugcucagagcaaauuaggucacuacacagaugcgauaaaggauugugaaaaagcaauagcaauugauucaaaguacagcaaggccuaugggagaaugggguaaguucugggaggauguuccaaguaguaccauguagcaucagguaugcuguucuuaauggcuugguuuugaauuuccugcuuaauguuuuacccucugaacuaauaagaggauaaauaaaacauaagggaggaaaugacuacaauuucuuugacuaggaagugagaugauugaugacugauuugauuguuggagaaaauuauauaaccguaccacaaaucucagaugagcacucaauauugcagacaguuaggcagacaguucuauuauuuuuccuucuauagucaccuuuccacucgcugaugugacgauuucauaccucuuccucucccuucaaauuuccacuacccccucucuggugacucucaacugaugcuauugccuuacacuuaauugagaagcuagaugcuuuuugaaggaaaacaacucauuuuccuccuugcaaauccaucagucugccuacauuuguaucuacacagaaugcccuuuuuucuuguuaaaauggaagcauucuggcugggcguggugacucacgccuguaaucccagcacuuuggaaggccaaggugggcagaucacuugaggucaggaguuuaagaccagccugcccaacauggugaaaccccgucucuacuaaaaauacaaaaauuagccaggcauggugaugagcacccgcagacccagcuacucaggaggcuaaggcaggagaaucacuugaaccugggcggcagagguugcagugagcugagauagagccacugcacuccagucugggugacagauugagacucugucucaaaaaaaaagaagcauucuuaccuaagaccauugccuccacucaugcuuuaagaucccauucccuuguaccuucuccacaacuuugcaacuauuacaauccccuucauuuucuacaacauuagaucuuccaucucuaauagaugauaaugguuggcaugugaucaggucauaaaaagucauucacugagccaggugcaguggcuaacaccuguaaucccagcauuuugggaggccaaggugggagaaaugcuugagcccaggaguucaagaccagccugggcaacauagcaagaccccaucucuauaaaaauacaaaaauuauccaggaguggugggguacaccuguagucccagcuacuugggaggcugaggugagaagauugcuugagucugggaagucgaggcuguggugagccgugaucgugucacugcacuccagccugagugacagagugagacccugucucaaaaaaaagaaaaaaaaucauuaguuggacccaucccuuuacccagcguuccccucuagccaccaucccacuucucaguuccucguucucugccccugaugguuaucuguacuugcuguuucaucuuugucaucucuuuuuuucuuuuuuuuuuuuugagacagagucucgcucugucacccaggcugcagugcaguggcgcgaucucagcuuacugcaagcuuugccuccuggguucacgccauucuccugucucagccucccgaguagcugggacuacaggcacccgccaccaugcccagcuaauuuuuuguauuuuuaguagagacgggguuucacugcguuagccaggauggucucgaucuccugaccucacgauccacccaccucggccucccaaagugcugggauuacaggccacuauuaacuuauugucaaaauacaucacucucuaggauccugacacuacacuugcccuguuuccccuuccacuuuacuggaugcucuuuuccagucucccuugcuuguucuuccucucuaccaucucuaaacaaugcuguauuuuaggguugcauccucugcugcugcuguuucuuugucuucucucugcucaguuuauccugcuccaugcuuuuaaaauucaucuacaguugauacucauuauuugcagauucuguauuuaugaauuugccuacuugcuaaauuaauuuguaauccccaaaucaauauuuacacugcuucuguggucauucauguacaugcacaauuagugaaaaugugucuucugaugcucucgaucucaacugagggugaauaaggugaugcucuaucuuuuuguuucagcucucaugcugaaacagucuauuuagugcuacauuuuuuuuuguauuuuugugccuuuuauuugugauuuugcuguuuacaguggcccccaacuauaggcugaaguguuaucuaguauuccuaagugcaagaggacuguaaugugccuuauggagaaaauauauuuaugagacaagcuucauucaggcaugaguuagugccguuggcuaugaguucaaugcuaaugaauaaaauauauauauuaaauaaaguuucuuuaaucagaaacacacauaaaaacaagauuauauauugaucaguugaugaaaauaugacuauuuacaacaguugcaggaaccuaacucuguauuuucccuaggaacaauuguucaguauuugcuaauucauuguucauggugacuuuauagaacaggacuacugugaauaagaaucaacuauauauauuaucggaucuaauuuauauguuugaacuccguacucauauauucuacuacucuucaacucuauguuuggauguuuaauagguauuuaaacuuaacaugucccagacagaacucauguucccuuccaaaaucuuuccaaucucaauacauuguacaauuaguuaucuaucccaugcacaggucagaagccuaagagucauccuucauuguuauuacgccugacauaaguacugauacucugucaucaaguccugucaauucuaguuucuguauauaucuugaauccaaguguugaucgcuaucuuacauauagccccaguccaaacuacaucucuuaccuaagcuacugcaauagcuuccuaaccgaucucccugccuccauucuacccuucugcccauguagauccucuacguagaagccagagugagcuuucaaaagcacaaauuguaucaugugacuccauugcaaccagaauaaaguucaaacuccaagcaaugguccucuaucaucuggcacccaacuguucucugacaucaucucuccaugcuuuguuuucuguguucccuccucaucagcccuuguccuguuccuuaagaauaccaagcuugcaucuuucuugggaccuuucuguuuacugcuauuuccacuacaaugcuccucccucauuuucaugacugcuuucuuuacaucacucagaucuuuccaauguggcuacuuuuugagcagcucuccuauucauuccuuuaauauugcccuuuuuauuugcaugcuuguugccugucuuccccagguagaaugaaauuuucuuaaagacagaaaacuuuaucuuuuuuuuuuuuugagauggaauuucgcucuuguuuuccaggcuggagugcaauggcacaaucucggcccacugcaaccuccgccuccuggauucaagcaauucucaugccucagccuuccuaguagcugggauuacaggcgucugccaccaugcuuggcuaauuuuuguauuuuuaguagagacagggcuucaccauguuggccagacuggucucagacuccugaccucaagugauccacccacccuggccucccaaagugcugcugggauuagagacgugggccacugcgcccagccaggauccucaguaucuuuagauauuauuuuaauaauauucuuauacaucauagaguuucaguaaauaguuacugacuugacucuugauuaacuggggacucugauaaaguaucauacaugguugacugguagaaaaugaauuagguuccgauaaagagaaaaagagaaaagaaaacaguaauuuguuuaaaacaaaccuaaaacaaacagaaaccccuaauacuaugucaccauauauacaguuauuguuuaguucuauaauaauuuuucaauaaguaaauuauaacuagguaaauaugaacauuaaaauuuaauaccucuuugacuugugccugguauaauuuguuauuugaauuguaaaggaugcuaauuuuaucuaccucuuuugaucaggaauaguuaucuaauaacuacagccuguuuucuuaauggaaaauugauauuaauuguuccucuguuaggaagaagaaagcauguaggccauuuugaagcacaaauacaguuuagaguccuuaaaaaugguguuagcaucauggauuuaugugaccacaugauugucaacucacaucuuuuggaacuuagucuaggcauuuauaaagcaaauuauuuuacauauuaagcuuaaaaaugguagaguaaguaagauaaucucuaagcauuaaauucaugaucuauaggacaaccagguuaucagcaagcagaauggagugaguucagauauauagaaucuuaaguuggagggaauuuugcucccgugagccauaguacagugaauaaauuaaguguaaucuggauuagaacugaauaccaagacagacagacguuugacgauguuugugauguccugauguucuuuaaucauauaucugauauucuuauauucuauucccuucaggcuggcccucacugccuugaauaaauuugaagaagcaguuacaaguuaucaaaaggcauuagaucuugacccugaaaaugauuccuauaagucaaaucugaaaauagcagaacagaaguuaagagagguauccaguccuguaaguuguuaaugccaaaugagugaaguauuuucugucauucacaauuuauuguaauuguagauacuggacugauucucagauauaauuguuuuacagacaggaacuggacugagcuuugacauggcuagcuugauaaauaauccagccuucauuaguauggugaguauacuuucuuuucugccucuacuggcuauguuuuccauagacuauguagcuaugcaauuuuuuuuagaaacaagugaguuuuugugguggugguuguaguggaguauugauauaaggcuauagcaggguucuguuuuuuuauuuccaacuuuuauuucaagugcagggguaaaugugcaggaugugcagguuuguuacauagguaaaacgucugccaugguaguuugcugcacagauccucccauuacccagguauuaagcccagcaucuauuagcuguucuucgugauccuuccucuccucccauccucugcccuccaacaggccccaguguguguuguuccccuacaugugucauuguguucucaucauuuggcucccacuuguaagugagaacauguguuauuugguuuucuuuuccuguguuaguuuguuaaguaaaaugguaaaauggccuccagcuccauccaugucccugcgagggacauaaucuuauuucuuguuuuggcugcauagcauuccaugguguauauguaccgcauuuucuuuauccagucuaucauugauaggcauuugcauugauuccaugucuuugcuauugugaauagugcugcagugaacauacguacgaauguguauuuacaguagaaagauuucuauuccuucggguauauacccaguaaugggauugcugggucgaaugguauuucugcuucuaggucuuugaggaaucaccacacugucuuccacaaugguugaacuaauuuacauuuccaccaacaguguuaaaagcauuccuuuuucuccacaacuucgccagcaucuguugguuuuuguuuuuuuuguuguuguuguuguuuguuuguuuuuugagacagaguuucacucuugucacccagucuggagugcaauggugugaucuuggcucacugcaaccuccaccuccuggguucaagcgaaucuccugccucagccuccugaguagcugggauuauaggcacccacaaccaugccuggcuaauuauuguauugucaguagagaugggguuucaccaugcugaccaggcuagucaaaugaccucuggugauccgccugccucagccucccaaagugcugggauuacgggcaugagccaccacaccuggccuguuuuugaguuuuuaauuauaguuguucugacuugugugagaugguaucucauugugguuuugauuugcauuucucuaaugaucaaugauguugagcuguuuuuucauauguuuguuggccacauauaugucuucuuuugagaauugucuguucauuuccuuugcccacuuuauaaugggguuguuuuuuucuuguaaauuuguuuaaguucuuauagauguaggauauuagaccuuugucagauagauagauugcaaaaauguucucccauucuguagguugucuguuuacucuguugauuguuucuuuugguguggaaaagaaacucuuuaguuuaauuagaucccauuugucaauuuuuucuuuuguugcaauugcuuuuggcaucuucaucaugaaaucuuugccugugucuauguccugaaugauauugccucgguuuauagaguucuuauaguuuugaguugcacauuuaagucuuuaauccaucuugaguugauuuuuguauauauaugguauaacgaagggguccaguuucaauuuucuccauauggcuagccaauucucucagcaacacuuauuaaauagggaauccuuuccccauugcuuuugccagguuugucaaagaucagaugguugugagugugcagucuuauuucuggguucucuguucuguuccacuggucuaugugucuguucuuguaccaguaccaugcaguuuugguuauuguagcccuguaguacaguuugaaauuggguagcaugaugccucagcuuuguucuuuuuguuuaggauugccuuggauguuugggcucuuuuuugguuccauaugaauuuuaaaauaguuuuuucuaauucugugaagaaugucaaugguaguuuaaugggaauagcauugaaucuauaaauugcuuuaggcaauauggccauuuucacgauuuugauucuucuauccaugagcauggaguguuuuuccacuuguuucuguucucucuuauuuccuugagcagugguuuguaguucuccuugaagaguuccuucacuuugccuguuagcuguauuucuagauauuuuauucuuuuuauggcaauugugaaugcgaguucauuugugauuugacuuucgacuugccuguuguugguauguaggaaugcuagcaauuuuugcacauugauuuuguauccugagacugugcugaaguugcuuaucagcuuaauaaacuucucgacugagacaauaggguuuucuagauauaggauccugucaucugcauauagggauaauuugacuuccucucuuccuauuugaauaugcuuuauuucuuuauugugcuucauuucccuggccaaaacuuccaauacuauuaauuuguugaauaggagugaugagagaggguauuuugucuugugcugguuuucaaggggaacacuuccagcuuuugcccauucaguaugauauuggcuguagguuugucauauauggcuuuuauuauuuugagguauguuccuucaauaucuaguuuauuaagaguuucuuauaugaaaggauguugaauuuucuugaaggccucuucagcaucuauugagauaaucaugggguuuuugucuuuaguucuguuuaugagaugaaucacauuuauugauuugcauauguagaaacagccuugcaucuuggggaugaagccuccgugauugugauggguaagcuuuuugaugugcugcuuggauucaguuugccaguauuuugcugaggauuuuuguaucaauguucaucaaggauauuggccugaaguuuucuuuuuuguuauuguaucucugccagguuuugguaucaggaugauguuggccucauagaaugaauuagggaggagauccuccuuuucaauuuuuuagaauaguuucuguaggaacgguaccagcucuucuuuguaccucugguagaauucagcugugaauucgucugguccugggcuuuuuuuuuuuuuuuugguugguaggcuauuuauuagugccucaauuucagaacucauuauugguuuauucagggauucaauuucuuccugguucagucuugggaggauguauguguccaggaauuuaucaaguucuucuagaaauucauuaguaaaauuucuaguuuaugcgcauaggacuguuuauacuauucuuugaugguuguuuguauuucuguggggucagugguaauaucauuuuugauuguguuuguuugaaucuucucucuuuuuucuucauuaguauagcuagcggucuauuuuauuaauuuuaucaaaaaacuagcuccuguauucauuuuuuuuuuuuuugaaggguuuucugugucucuaucuccuucaguucagcucugaucuugguuauuucuugucuucugcuagcuucgggguuuguuugcucuuguuucucuaguucuuuuauuugugauauuagguugucaacuggagaucuuucuagcuuuuugauuugggcauuuagugcuauaaauuucuuucuuaacaagaaugaaauuuuagcugugucugagauucugguauguuguaucuuuguucucauucaaagaaguucauucuucucauucaagaaguucugccuuaauuuuauuauuuacccaaaagucauucaggagcagguuguucaauuuccauguaguugugugguuuugagugaauugagugccauguggugaugagaagaacguauauucuguuguuuuuggguggagaguucuguagauaucagguccacuugauccagagcugaggucagguuugaauaucuuuguuaguuuucugucuugaugaucugucuacuauugucagcagaguguuaaagucucccacuauuauugugugggagucuagucucuuugaagcucucgaaguacuugcuuuaugaaucuggguguuccuguauugggugcauauauauuuaagguaguuagcucuucuuguugaauugaacccuuuaccauuauguaaugcccuucuuugucuuuuuuuuuucucuugagacagagucuugcucugucacccaggcuggaguacaguggcgcaauuucagcucacugcaaccucugcuuccuucuuugucuuuuuugaucuucuuugguuuagagucuguuuugucagaaacuaggauugcgaccacugcuuuuuucuguuuuccauuugcuugguaaauuuuccuucaucccuguauuuugagccuaugugugucuuuguauguauagugggucucuugaauacagcucacugaugggucuuguuuuuuuaucugguuugccauucugugucuuuuaauuggggcauuuagcccauuuacauuuaagguuaguauuguuauguguaaauuugauccugucaucaugaugcuagcugguuauuuugcaaacuuaugugguugcuucacagugucacuggucuguauacuucaguguguuuuuguaguggcugguaacaauuuuuccuuuccauauuuagugcuuccuucaggaacucuuguaaggcaggucugguaguaaugaauucccucggcauuugcuugucugaaaaggaucuuauuucuccuuugcuuaugaagcuuaguuugaccagauaugaaauucuggguuggaaauucuuuuaaggauguugaauaugggcccccaaucucuucuggcuuauaggguuucugcugagagaucugcuguuagucugaugggcuucccuuuguagguggccuggccuuucucucuggcugaauggcaggguucuuaacguguccauguaccuccugugggaaagccauggauggacuuuaggaagcucauggauuuuuccaaaauuauauauaaaaaucuguguacauguguaugugugcauuuuuccagggagagcaucauauuuuucaugagauuggcacaggaaucugccaauauaugaaagguuaaaaacuacucucuuacauaaaagugguccuaggaagauaucuaacaucugcaguuugaguauuuggccauugugguucccuagcuugccccucagcauugucugccuuguuuucuaucuuuagaguuuauuugauauagauagauagauauagauauagauaucucauguguuugucuucuauucuuacaaaacaacaaaauaauguaugggccuuuuugagaacauacacgcucugguccaauaugugguaacuuugauuuaguggguuuaggauguuaccagggcauaucaagcuccuggggugacuguauacuuuggaugagaauuauucuauccaugauaugcccuuggaaggcaggaaucaguuuuuauucaucuuuuguuuccuucaaaaaaugugucuugcauccauuaaaucuucuguugaacugaaaugcacagaugacucauucccagugagauaagucuuuuuagcaacugguaguuuuuauuuuucccuuaucaaauuucagccuucuuaccaugcuagcaaauacauguuuuguagaucuugugacuucauuuuuuuuuuuaagaaugguuacccauucuaggacucagguuauggcauuguaacaagaugugaaaaauggaauucuuuuaguuucagauuuggcuuaggcuccaagcugcuauguaccaaaauaaggugugagaccaccauguaggaguugcaaaagauggggauaaaaaacauguuuugugacucauaaaaaaggccagguugauggaaauuaaaacaugauuuuuggagagagcuauuagaguuuuagggcucccuauaugaaggaauuagggaggcuugcucucaucucaagcccucacugagaaagggcuuuucugguacagagacuuucuaccugauaguucaacuggauagccaguggcagaauuagcugugugguuugggcaguuacuguacugaugagaguggagcagagguguuuccuguggaccaaggugagcacacacaauugugagagagugugucugaauauguucaagaggcuuuccuggaagugugacaggaucccaacacagagaaucucuggaggacugccaagaaccuaagacugaagggaaagucauagcauccauccagaggguaaauuacccuuuucaaagaauagguaagaaaucuccagggccuagggaaaggagaagugucugaagaacaugagaaaguaccccauaagagaaccacaguaguuuuugaauaccuugcaaacucaaaaagcaccaaugcaaaacuaguaagauaauaccagucaucaaauaagaacuuugcugcuccuuucaccuuucccuccauuuaacccucaaccuggagggccacaacucuuaaucagcaagcugagggaagaggacuggaaguacuacaggauaaagaagcacuauaggccuuggugugcuggcucacaccuguaaucccagcacuuugggaggcuaagaugggcggagcacuugaggucaggaguuccagaccagccuggccaaccuggcgaaaccccgucucuacuaaaaauacaaaaauuagcugggcaugguggugcaugccuguaaucccagcuacuuggguggcugaggcaggagaaucacuugacuccgggaggcagagguugcagugagcugaggucaugccauugcacuccagccugggugacagagugaaacuucaucucaaaaaaaaaaaauagcccuauaggacagcgguccccaaccuuuuuguaacagggacugguuucauggaagacaguuuuuccauggaccauaccggguguaggggguaggggcaggauggggagaggagcguuagauucucuugaggagcacucaaccuagguccuucacaugcgcaguucacaauaggguucuugcuccuaugagaaucuaaugcugcagcugaucugacaggagguggagcucaggcaguaaugcuugcucgcccaccgcuuaccugcugcugugcagccugguuccuaacagucuguggcccagggguuggggaccgcuacuauaggaaacaaagcagucaauggugccucuuuucuacuacaaccggucagucuguagcaggcccaugcuaggaagggagaaguuuuaccuguaaaugaagcuuuauguauuugauuguuacacugagacauuaauugcugaacuggaggucauuuuauagaacuuaaagugacaggaggauugcuuacugaaaagugacuggaaaagcauagaucuguucuaaauuuccucuagguccuagauugugggagaaggggaagaacuacugcugcagaacuaguuuaaagggauugcaaaacacagcauuucauguuuauagcucauacauccugcuuuuccuguguaaugccuuuagcacuuauggguuggcucagaggcaccaauccugacugggacuugaggaaaguuuugaauuacuuacgaaucagucagugaucuuucugguaauauaagcaagugguggcuuuucccaacaccucauagagagucugugaauauaaucuauugucuacaaagauuuagacuaaauucaaauuuuacauaaauauugucgacauuaccaauuugagggaaaaaaugugaugcuuucaaaauagaauguuuuaaaaguaugugugcacauaaauauaauuccuugugccacuguaagcaugggaaggauugaaauugcugggccccauggagcaaagucacaucucuuaaaagcucguuuggaauggaccuucucaaguguaggagaucccuuaaccauacuuuuaaaguuccuauuuuuccuuuuggcuuaauuggucugauagcaguaguaaguaaacugcugucaacauccucaguuuauaguguuguuuguaaucucuuuauccucaccaugucuucuuaaugccacuuuuucuaguaccuucucucuuuuuacauuccccuuuacuuugcauagcacacugaaacucuacaaaauguuagugcauacaugauuuagcuuucauucuucuaaaaaaaaaaucuuugcuaagaucccuacauauuaacugccuuuaaugggaggugcuguuuuucaauuccaggcggcaaguuuaaugcagaacccucaaguucaacagcuguaaguauauagaaagagcuuauuacacuuccccaacccuuccacuugccaggcuccuaauuugagcacaucagcucaaaaaugaugaaacuguucugaaugacagucaguuggagcuuaaagccacacacauuuggccuagccucugguauaacauggguauuuuauuaacuuuuccucguccaguuguccuauuuguuaagaauauauaccaaucccagugauguauuucuuguguacucuagaaugucaggaaugaugacaaaugccauugggggaccugcugcuggaguugggggccuaacugaccugucaagccucauccaagcguaaguauuauuuaaaacagaaauagugaagauguauuuuauguuuuacagccuaucucuauggugaggggucagggcuuucuuuuuaaauguuuaucuuuuaccguuaguaacuuuagccuccuuaauguuacuaaaucugaaagaaguucaugaauuacaaccacuuuuuagacugcagggcaggaauccauaccuagauagucuggccagcccugucuguugagaaaaagaaccauguuuauuaugcuuccccccacccccacccccgcccccgguucauuaugcuuuauuuuuugggacuuucaaguaccagcagaaucuuuuucuucuuuucuuuuuuggcaccaucucaauaaggcaggugagggacagauauuagaaaaguagauaauuuauaucccuacccaauggcuagagaaacugagguacagguuagugacuuacuaaggaacccauagcacauucagucuuuucauuugcagccuaauuuuacuugauuguguugucagcaugaaauuaggguccuugguuuuuaaguggggguaucaauacuguaucucugcuuacagagggucccaaggauuggugaccugguacuuugaggguauggagacaaacaguaaaaaucauauguccaaauaaauugugaucucauauauauauaaagcuauuaaucccccauuuuuucccaaugaagauccaggaaguuuuucagcagacuucaaacuacucagggacacagaugaaggucaaauauccucuuaaaauauauaucaauuuagguacacauacauaguuuaaaaucacuuguuacauacuuuaauguucaggcaauucaggaaauuuuuauucaaacuuuuucagugccugucaacacuuagaggaacuacuugcaucuucucauuacuugagcacauugccuucacuuauaucaaauuggcgaagacaacuuugcuuuuugaaucugugucugaugcucucgcuggacauuuuauaugaagccacaguaccacuuguuguuugucagcacaacuguguauccacuuagaauauugcauuuuuagaaugaccuuuaaauggcauauaaugacaucuaacacuggcaauagagggucacauacuacaauuuguguuaaacuucuuaguguuuuuaaaauuacuuguuaggugaccuccaaaagcaucccaaacuggguguuauaugagacuauuaagacuuggguauaaaagcauuguauuugagcacauacaauaaaaacauauacgucuuacccuuugcuucuuugucauuagcacuagagaaguagauuucacccaguugagguacuuauuuuuuuuagcauggguguuuuguuucuuauaaagaacacugcauuguaauaaugcuauauggaggcauugguaaacuuguagauucuaaagucauggcucugaaacuuguuuuuauagaaaaaagcccccuuuagguagcuccuacauuuucugcauuucuuuuugcguggguaaaugugacuggcaauucccuauucaaaccacauugccucuuuacuacaggggacagcaguuugcucagcagauacagcaacaaaauccugaacuuauagagcaacugagaaaucacauccggagcagaucauucagcagcagcgcugaagagcauuccugauuuaaccaggggcucaagcccaagauacaaaugguuuauggcuaugaaugaaguauuuguuguagauaguacccccucccuccuucaaaaaaccaaacaccauaucugaugugugaaaauaauggaggaaaaccucuuguguauauucuuaaagaauaaaucuguuuagacaauagguuuaucacaaacaaacucaaaacauaacaugacuccuuuugaaaugaucacuagccauguuacgugccaauauagcacugggauaagguuccauuuucaaacuucuaucauauuuguauauuagacuuaauagcaaagcauauuuauugaacucuaguagggcuauuuguugguaagcucuuuagcuccaauuucccuuaagcaaaguuuuuugagaagggaaaugacccaaaggaaagguuuccuaugcugguugagaagaaguguacuugccacugagcaguaugucaggaaagaaggaauauuaucuagguuuagcuuugauaagugcuauuaguaaugaauauauaacaugggaaccaauguuaucuuuaauguugcuuguucuggugaacagagaaucuuaagagcuguuagaaaguagcacuugaugcaagggauguuuugaaaagaaaaaauugguaaugcgaauguauagaaaguaaagguaggaugcucagguuuucugcauaguucuuaacuaaucuugucugcaguuugguauugauaauauuagcauggccacuuaugcuaaauacacaauaagauacauuuagaaauccuuaauguacugguuaggucagugguacaacuguuugacuuaauuaucacaauuuccccaaugguaaccuuaccuuggaaacuaucaaauauaaauauacuuuaacuaagccagugaccugguccuaaguuaaggauuuucuaaaugguauuuaauugugugcccauaaacacugauuuuuuuuaaaaagaaaacuuaguaauuauuugauggauaacaaaaagcaucuaucacuaacauugcuuguucauguaaucuucugugauaauuuggcuuggcaugccagucuuauaauuaacauaauuuaaauuugaugcaauuuaaauauaacaggagacuuaaaauauuuuauuauaaauuagaugccauauuaguuaguggagaaaaggggcauuagguauuaauugcaugggucuaacuacauugaugaugagaguuuaauuccaacuagaguauauuuuuuguuuauuaauaaugaaauuggugcugacauguaaugacuucacaaguuuuacgagggaaaacugaaaaaggaaguaauauaaauuuugugggguuuuuuugagauggagucuuacucuuuugccaggcuagagugguguugcaaugucagcucacugcaaccuccaccuccuggauucaagugauucucgagccuuaagcucccaaguagcugggauuacgggcgcccaccaccacgcccagcuaauuuuuuuuuuuuuuuucuugagauggagucucucucugucgccaggcuggagugcaguggcgcaaucgcggcucacugcaaccucugccucccggguucaagugauucuccugccucagccuccugaguagcugggauuacaggcacgugucaccaugcccagcuaauuuuuguauuuuuaguagagacgggguuucaccauguuugccaggauugucucaaucucuugaccucgugauccgccugccuuggccucccaaaugcugggauuacaggcgugagccaccgugccuggccgcuaauuuuuguuuuuaauggagagaguuccaccguaucggccaggcuggucucgaacuccugaccucaagugaucugcccaucuuggccccucaaagugcugggauuagaggugugagccacugugccuggccaggaaguaauauacaauuaaaugaguaauaaugcagaugauuaggccuuauagaacccuuaucaaaagacuaauuggccgggcgcuguggcucaugccuguaaucccagcacuuugggaggccaaggcaggggggaucaccugaggucaggaguuugagaccagccuggccaacauggugaaacccaccucuacugaaaauacaaaaauuagccuggcuugguggcgggcacccguagucccagcuacuugggaggcugaagcaugagaauugcucgaaccugagaggcagagguugcagugagccaagauugcgccacugcacuccagccugggugacagagcaagacuccauuucaaaaaaaaaaaaaaaaagaaaaagagacuaagagacuaauuauuuuguaucuugaaguuuaaaauccaacuuuucucuuucuccuuugugacauuagaacaguaguucuauaacuucauuguaagaaucaccuggauaauucauuaaagaugcagauucagggccacguguucaauucugauacaguagguccuguaauaaggccuaggaauggccauuuuuaaacaguacacuaggugguuuugauacagauccaaggacucuaauuuagaggaacacuagguuagagguuucucagaccugcaaacaccuaagcaccugggccaaacaaagcuacaacgaagaucuguaugaagauauauaguucugcagaauuuaaaaagagcacaauuuaagucuucggcccucagaaguuaaauucauauuccaucuaagccaacuuugauuuucauuaaguuagaaugaacuccuaguauuccaguauuacacagaacgaaguacuacuacuaacacauagaagucauuacugugauauaaaaagcaaaauagauccuuaauuaaaaauuagucacucauauucaguguugaauaagaaguuaaaguuucuagcauaacuaucuugagugcauuaaaaaugcuuuuagagcaauaagauaagcuucuagcugacugccuagaaaaacagaagauacaaauucagugucagaaaugaaagggaauacacuacagacacuauaguuauuaaaaggcuaacuagaaaacaccaugaccaacucaaggauuguauauuuaacaacuuagaugaaacagauucccuauaggauacaaacuagaaagcucacuguagaaacagauaaccuaaacagaaccauauuuauuaaggaaauugaguuugugguuaaguuaaaaaccuuccaguaaagaaaacu

SEQ ID NO: 17398 - RNA, 35420 nt, Homo sapiens
aguguccuacugcgccugugcgccgguggcgugcgcagaggccucuggguagguggcucaaccccgccucucaguugaggacucugaaggcuguuucuguggcgcuuccccugcgaggauggcuacccugguuguaaacaagcucggagcgggaguagacaguggccggcagggcagccgggggacagcuguagugaaggugagggaccuugcgugcucuauucuccaccaucggccucccuucgguucauccuggagaccuggcggcaucgccgcggcccaggcuucgauaggugggaugcgcggccucugggccccuuuuggcauuacaagucucguccuguccucugcauccuuucucuccuauggccugaaauugccuggucuucugcucaugacaugucaucaucgggacauuugugaaaaggagcuugcgggccaguggcagugaccuagaccggucuuuucuccagguccucugcuuuuaguuaaacucaacagacauuaauuagcuuaguauuauaaauugagucaucaucaucguaacuacguacuaaguuagguguuuuagcucguuaauaucuacuuaugaaguagaugugaauucccauuuuacagggaggaaacccagguuuagguaaacaguguguggcagagccccggguugaccggcuuuaaagucuguacuuuucgcucuuguacugcgucuguaaucagacaucuguuauugggugagcugcccccuccccuguuaguaguacagucuauuaacucuuugcacaagucugcagcaucgucauagcugggcauuaacgauagaguuuaugaauuuucuuaugcuugaaguuugagauucuaccauguauacaugcuccagaaucaauuugcuaaaaaaucauuugaaauauguggcacucauuuuucccuuccacuguugugcacggaaagauauggaggggagaacugaucccauugguuuauagaguaaccuucaggagcaucucuaaucuaagagauugauaauucucauuccuggcuacauauuaggaucacugaggaguuuuaguacacuacugaugcacuccuccuccaguucugaugagguugacaucaguauauuuuaggaauuaccagaaguuauuuuaaugugcaaccaggguuaugaauuacugaucaagguaauauaugaaguuuuuuucacaucuugaaaaguagacaccuaugauuauucagguaauguugguuuuauaugacagcaaaugagacauuucuucccacaauuuaguaucagugaauauuggugguuguugauucagaugaccuuuagguacuaaugaaguuauucuacagguacacggcauaucugauaugcaaaggagcccucauuauuaggcauguugugugacugagauuuuauuuauugaauugugcuuuugcuaaguagagaauacuugaagagcaguuugugaauuaacuugaaguuuaaguuuuauuucauaauuggaauggguaucauugcaguaucuauuuuuuuguuacccuguuugccuuacagucucaaaaguguaccaaagccugauguaacuccaguuucuuacagcacagaauuugauacauuggaggcucaccuuguucauuuucaucuuaacauguaaaauauuccugaacugugcaaugaaauaguccuuucugacaaaaucuucaugccauaauuuguaguagguauaguagcauaaacuaaaaaaaucucacugucauuucuauagaugaaagcaagaaguauuuauuggaagguaaaaguugaaguauauaaugcuaauacuguguaaaauggccuuuugcuugugaacaaguugauaaugacauggcuuuuaucauuagagaaaacaguaacauaaaaaucugauauuguggcuaggcgcgguggcacacgccuguaaagcacaaagugccugggaagcacuuugggaggccaaagugggcggaucacuugaggucaggaguuugagacuagccuggccaacauggcgaaaccccgucucuacuaauaauacaaaacguagccaggcauuguggugugggccuguuaaucccaguuacucaggaggcugagguaggagaaucacuugaacccaggaggcggagguugcagugagcugaguuugugccacugcauuccagccugggugacagagugagacuccaucugaaaaauaaaagauaaaaaaucugauauugugaaauaacugacauuuaaaaauguaucacagaaaguuucacaccuuuaaucucagcacuuugggaggcugaggugggaggauugcuugagccccagaguuugagaccagccugggcaacauggugagauccuaucucuacaaauaauaauaaaaaaaaauuagccaggcguaguggcacaugccugugguaccagcuacuugggagucugaggcaggaggauugucugagcuugggaggucaaggcugcagugaaccaugcucaggccacuacucuccagccuggcugacagagugagacccuuucucaaaaaaaaaauaauaauaauaauaaauaacaacauaaaauaaaauaucugauugauuacaguuugauuuacaaguaauaaguuugaagcuuuuuuggcauuuuuugaaguguaaaauuaagagcuuuuuccuaucuaggguuuuuugcuguuaaccacaauuccuauuuauagauacugaggaaauauuuucuugcuguauuauuuaccgaguugaugcaaaauagucuaguaacuuuauuuuuggaccuguguuugguuugcuaaucaauggaauuuuauuagugcuuuuugaaaaauacauuaacagcauaaggaaguucuuuuaaaucuuuguauagugaugggaucagagauacaggauugaaaugaacuaaacaauuuuaauaugguucuuuggaguuuauugucauaaauuuacuuuauuagaguaucauaauacagcauuuauaaaauguugcauuuauuuuauaucaaauucuauugugaauuuuugagacagagccucacucugucgcccaggcuggagggcaguggcacaaucuuggcucacugcaagcuccgccucuuagguucauaccauucuccugccucagccucccgaguagcugggacuacaggugcccgccaccgcgccuggcuaauuuuuuguauuuuugguagagaugggauuucaccacguuagccaggauggucucaaucuccugaccucgugaucugcccgccuuggccucccaaagugcugagauuacaggcgugagccaccgcacccagccuaugaauauuuuuucuauauuuaauugaauuuuuuuuuuuugaggcagguucucacucugucacccaggugggagugcaauggcacgaucauggcucauagcaaccucgaccuccugggcucaaaugauccucccaccucaguuuuugauuuuuuuuuguagagacagggucucgcuguguugcccaggcuggucuugaacuccuggccucaagcaguccucuugccuuggugucccaaagugcugugauuacaggugugagccacagugccuggccuaaagaauuugauaacgugaaacuuuccccuuuuuaaaaaauguaggauaaauugaaguauguguauauaugaauaauagacagaauuauacguggauagcuguuccccaguuguuugccuuuuucauggggaaccaguguuccaauguuacugguguccuauguauccuuccaggaagacaauacgcuuauacaacaauacaaaaaaaauuugcucuuuccccaccuuuaugcaaaaaugaauauauucuauuauuuuucuuuuuguuuuaaucauaugaaaucauucuguguauauaugaaaaacuucaucuuucucacuauccuauauaguuuuauaguauuaugaaugugccacaauuuauuuuccaagcugauauugauguauauuuacuuucuuuccaauuuuuugcuaaugcaaaugaugcuuuaaggaguaacauacagauuuugucacacgugucuaguaugcuuguaggauaaauuccugcaacuagaauuacugaguuauuuaaauuugguaaguauugucaaguugcccuccauagaagcuguauugcucaauaaacauuucauagcaauuaguaauguaugagagugucugcuuucccacaccuucacuaacaaaauguuaccaacauuuuugaucuaaucugaaaaaaguauuuugauguagcuuuaauuugcauuuuucuuucuuuauuuuuuugagaccgagugucauucugucaccuaggcuggagugcgguggcgugaucuuggcucacugcaaccuccgccucccaggcucaagcaauuauccugccucagccuccugaguaaacugggcuuacaggcgcccaccacuaugccuggcuaauuuuuuuguauuuuuaguagagaugggauuucaccauguuguccaggcuggucucgaacuccugaccucagaugauccacucgccucggccucccaaaguguugggauuacaggcaugaaccaccaugccuagcuuuaauuugcauuuuucuuauuaugaguuagauugaacaucuuuucacguaaagaauuuucaucuucuuuucucugaacaauguuauguuucuuauuuuuauucauuuuuaucuucccaaacccuuauuuacauugaaggacuaaauuuaaauuucuuuugaaccaugauaagaugcaaagcaauuaugaauuaucacuguauggugaaagauauuugcaucucaagcacuaaguccaaguuaauuguagaguuagguuuaaaaucauaguagauuuagucugauuucugccuuggguuuucuguuuuuuaccucguguuguguguuugaugauggugagcuuaauuguuuuuaaauuauuuuacuggacuuuauguaagcaguagguacuugguauuuaaaauacccaguuccugaggguucuuugguccaacagggaaagacgggcuaaaagaccaagguauuaaaguguuuuggguguuacgguagacgcuuauacagaguacaucggggcccaaaggacaaguauaguccuuuccucaguguuagcaugaagagacaugaaacaguuucucauguucugagaacuauaagcuguuggauauaguuggagcauagggucagaagaguauggcagugaagcaauaggacagggaccagauuguagcaggucuugaaugacaggaguuugagguaugauugaauaguacaguguggguauuuuuaaaaaauuaaugcaagguaugaaacacuacaaauauacuuagaaauaagugcugaaaaugcuuuauugcuauaaauacaauuuguugacuauuuguaaaacauaaacuuauggacuugagaaucagaauaugcugauaaauggccuuucuuuugacugacuguguagccuugugcaagucaugugucuguaacuagagcuagaaagacaaacuaguuucuaauucagagcuauauuuauugauagagaacaggaauugaaauuuaagaugauugcuuuuuuugccuuuguauuauuuaauguacauuagauaguagaagauacuugaaaguuacuugcagucuuuucuuaacaaguucuuuaucauuugcagggguaauuguuaucucaguacauauuuuagauuauuuuuguugaaauuaaugauaguuuauuuguguugaaauuaaugauggguuagguaguugcagagaaauugcuuaagaacccaccuucaguagaauuacauauuguuuguacagauucagauguaaugacugaaaucauaauuuucaaaagauaacaaagauguuaauuuacagcaucuuugccccaacacuuaguauuucaaagauauuucauuaugauauaauuuugacagggucggucaaauggaaugacuuaaaagugauucaagauuuuacaaccuacauaguuuuuuuuucauagaggaauaaaguaacaauguugauucaauauauuaggugaauuuucuuauauaccuaaaauauguaugcuuuuaaaauuguuuaaagagcacauccuuccuuuucaaauauuaggugcuagaguguggaguuugugaagaugucuuuucuuugcaaggagacaaaguuccccgucuuuugcuuuguggccauaccgucugucaugacugucucacucgccuaccucuucauggaagagcaauccguugcccauuugaucgacaaguaacagaccuagguaggaaaaguauuuguauggauuuaagauugaaaauuguucauguaaugcaaaugucauaggaaacaauguccuuccacuugauuuuuagaaugauaaaauucccagaaaguuucagaaagccuaaguuucuauuaaggucaauaaucuucaagcuauaaacuaucucacucuuaguuacuaauuuuauuuuaucuucugagauguuuauauucaauacuuaucuguaaagagcuuuaagacaccugagaaaaacgugcuacccugauucaaauaaauaagaauguguaucacagagugaaucauuugccugaagccauaaacccaauagaacaauguuuucuuuacaaauaaauaagccaauaaugaaaauacagauaagucauuugagucucaccauguuuuuauuuacuaauaucaaggacagaaguguuuguagcuugugauaauuacucuuuauuuucuguuaaaaugaguuugaaggguuuguggcuuuuuuuugcaguuuucuguauacuuuuaaaacuuuucuuuacguauuucaaacuaaguuauuuucagauaccagauuuggaaauaauagcauuuacuaacauuugaacaguuauuuuacaaacguaaguucuguaaguuuacucuuuuugauaagggaguuuucuccaaaagaguuuaagguugccauuuuuuuuccaggucaguugcacuaucuaagacaguuuuaauauauucauacuauuuuucaaguggaacacauucaaaauaauuuauccaccaaaaaaggaagcaagaguaccuauaauuuuaggcuggaagacuuugaaaugcuaagaaacaugguuuuaaaauauuuucuggagaaagaaaaggauuuuuaagguuuuggugaucuuugauguauauaaauagucuauuugccugacaacuaauagacaguaauaacauuauagauagcauuaacuuaccaguagccaagaaauaauagggauugggaaagucucuguacuuuuauuuggucuuuuauuaugugaaauaugcauauaucauacuauuucuuuauauaaaacuauacuuaggccaggugagguggcucauaccuguaauccagaacuuugcaaggcuaagauggguggaucaccugaagucaggaguucaaggccagccuggccaaaauggugagaccccuuuucuucuaaaaauguaaaaauuagcuaggcauggugguggaugccuguaaucccagcuacuugggaggcugaggcaggagaaucgcuugagccugggagauggagguugcagugagccuagaucacgccauugcccuccagccugggcaacaagagcaaaacuuggucucagacaaacaaacaaaaaaacuaugcuuaaagaaauaguaauguuuuucaaauagagaauagaaccuuucuucuacuuuuuuuuuuuuuuuuuuuuuuaaagcagaguguuacuccgucacccaggcuggagugcuguggcgcgaucucagcucacugcagccuucaccucugggguucaagcgauucuccugccucagccuccugaguagcugggauuacaggcaccugccaccacgccugacuaauuuguguauuuuuaguagagaugggguuucaccauguuggccuggcuggucucgaacuccugaccucaagugauccaccucagccucccaaagugcugggauuacaggcaugagccaccacaccuggcucuucuaccuuuuugaagagcacuuuaccuucucuacauuaauaccacaaugugaagaguuacuauccucaauguuuaacaaaacuagaaauuuaugacagggaacuagacugaauacauccauccuccucucugacuucucugaauccugaaucagaauuucucucuaguccaagaagaauaugaguaguuauuaauaccauucagcaauauuccugauuuucuucugcucauauggugaaauuacacuuccuugcccucuuacgcaucacugugugauguucauugaucagugaaauguaagcagaagugaaguguuagcauccagguagaaguuaauaagagaagguuuaugauuuucaaaguaaauucuucuccuugcugcagugaggugguccagaugguuggaggcucgguaggcugugucccuguuuguggucaguggggaacagagucucucuugucuucccuaaucccugagauguugcaugaugcaaaaaauaaaucuuuguuguguuaagccauugagauuauagaguuguuuugacacagaauuaagugauauaaauauuaggcacuaccuaguaauaaugcuagagguuuauuuguauauauucauuauauagugacuggauauuuagaaaauugucaagacuauauuuuuaaaugaucacuuaguguacuucuuaaccuuuauguaaauagauagaacucagcuuguuguagaauauguguuaaaaauuaaggagaaagccuucuaggggcaaggcugaggauagauauguucaguccaguuuuuuugggagaaccacaacacagaauggcuuuuuuuuuuuuaagagccaggaggaaggggggcccugcaggcaaugacuccaucaaccuuuuauauauuuauucauuuaaugaauauguauuagguggcagcuauaucagauguuauuuguugcauaggaguuuaccauaacaaauauuccuucugcuaaaggaucugacuuuuauucauagguucaggaagaguguguauguuguccuggguuacaauguuauauguauuucuuaagguagguugcugcaaaaaguauuugaaaaugcuuguuuuagcauguauaguaaaagucaaugacaaaauaggacuuguaaaauuaaaugauagagaaauaggcugggcacgguggcucacaccuguaaucccagcacuuugggaggcugaggcagucagaucacuuuaggccaggaguuuugagaccggccugaccagcauggcgaaaccccaucucuaccaaaauauacaaaaaaaucagcugggcauaguggcacacaccuguagucccagccacuugggaggcuggggcacgaggaucacuugaacccggaagguggagauugcaaugagcagagaucacgcuacugcacaccagccugggcaacauagcaagacucugucucaaaaaaaaaguaaaagagauuuaaauaauuuuuuuaaacuguggcaaaauauauguauaacauaaaauuugccguuuuaaccauuucuaaguuuagggacauuaaguacauucauauuguugugcagccuuuaccaccauaauuuuuuuuauguguauuuagauuuuuuuuuuuuuuuuuugagauagagucuugcucugucauccagauuggagugcaguggugugaucuuggcucacugcaaccuccaccucccggguucaagcaauucucgucccucagccuccugaguggcugggauuaugggcgccugacgccacaccuggcuaauuuuuguauuuuuaguagagacgggauuucaccauguugacugggcuggucuugaacuccuggccuuaagugaucuguccgccucagccucccaaacugcugggauuacaggcgugggccaaagcaccuggccaaaaaauaauaaauuuuaaaguguguuucuacuuggaaggcugaaggauucuucuguuuuuuaagagagcauuaacaaagcaauuauuuugguauuaaaaauggggaaaauuugaauuuuaaaaauuuagacauuaacuacugaacuauauuagaaauuacuuuugagguauggguaaaaugauuaauaguccauuuuguuagauuuaguuuuuguuuuuauauuuauucuaggugauucaggugucuggggauugaaaaaaaauuuugcuuuauuggagcuuuuggaacgacugcagaaugggccuauuggucaguauggagcugcagaagaauccauugggauaucuggagagguauugaucauacuuggugaaauauuuguuacgagcaugaauuuuucuuuuaauagaugccauuauuagcacaauauuacuucauuuauuucagcagguaaauuucuagaaacacaacuuuucauuacauuacaguucugaaggccaacacuauucccaagagaaaaaacuagaauuauuugaaaauccuaugccuaaacuaugcuuuaugugugaacuuuuuuuuccuuaucauaauucaguucuaccaagaauaaagugaaaagaggaagaagauuauggaauaguaagaaagauauguaagcaacaguagagaagaggaugcaaaaguagucaacaguaaaacucaaugagagaaagaaaaacucgauguaagaggccauuuaauacagaggggaaaaugccuuaaagauagcaguaacuucugagggaauuguuacuguuauagcuucaagaaaagguuaaacuuuguauagauguacugucuuuauccauacagguagaugucuaguaaauaucagaauccaugaacacuggauuuuaauaauguaaaaguauauuuuuagcacuuauguguuugcauagcugcacauauguacuauaggacauggcuuucguaggcuguuauggguaaaaauauauuuggaguaaauaucaguuaaugauuuuggugaucaacuugcaaaccacauauuuuguaugaaggaaaaaaaaugucggauugcuuucacuucucuuucauuagaugaugauuucuuuauacuaaagugaaucagugaaaugaauuucaaacugcaacacucuguuuucuaaaaguuaugcaguucuuucugugcuaaaucuuuaaucuuuauuucaaaagacauuacuguuagcuaauguugacauuauaguuuauaauuuauuuauuugucaggucugggaaacagaagaccugaauuuuuaugguacauguguuuauuucucauaauugcaaacaaaacucuuccacuuuggauucauuuuuuauuuaaugugauaaagaaugacaccauugauguauuuaaacauuuuuauuuuugaaaaaauuuauacuaaauuucuccccuuccaauuauggccuuuuaauauugaguaaaaguguucaaaacauucuugauuaucugacauguaauuuuuuaucuacuugaaauaaaaguaauuauuucauaauuaguuauuuuuuguaauuccugaaaacuagaaauaauauuuacaugcuuacauauagguuuuauuuauuuguuuauuguuauuuuuuaagacagagucucacucugucacccuugcuggagugcaguggcgugaucucaguucccugcagccuccacuuccuggcuucaagugauucucgugccucagcuaccugaguagcugguauuagaggcauguaccaccacaccugacuaauuuuuggauguuuaguagagauggacuuuccccauguuggccaggcuggucucuuacuccuggccucaagugaucaccugccucagccuucuuaaagugcugggauuacagauguuagccacugagccuggccuauuuuuuuuuuuauuugcuuaaaucagugguuuucugccgugauugugcaauagacucaccuguggagcuauuaaaauaacauggcguauaauuagaaaaauauauacaagucuaggguucauccacaaccuguugaaauaagaauuucucuuccagacagcuauguuuuuaaaagcuuacagcuaauucugaugcauacuccuacauuuucuaaauagcauuugugcuucuguccuuccuauacaucaucaugacaacuaauauuuaaagcuauggggauguauuuaauaucagauuuuuguaguuuuacagaaagacuuuugacuucucuaugguuuaguuucuuuuguguaaagugaggggauuugguggaagagaucuuugcaccgaauaugaaucuaugagaauaguucuauuuuuggcuucaaauucauaacauauauuggccaguuaaucuuggaaauagcuucuuaccccuagaaaugaaugcuucucagaugaguauugaaugaccuuuguucuuaaugaccaauauauuuucauauguaaauauuguucaguuaagcaaaaaggauuauggauucuauauuuaaaaauucgucauguuauacugauuggguucaauuuuaaggcauuaauuuuuuguuuaucagagcaucauucguugugaugaagaugaagcucaccuugccucuguauauugcacugugugugcaacucauuugugcucugaguguucucaaguuacucauucuacaaagacauuagcaaagcacaggcgaguuccucuagcugauaaaccucaugagaaaacuaugugcucucagcaccaggugcaugccauugaguuuguuugcuuggaagaagguugucaaacuagcccacucaugugcugugucugcaaagaauauggaaaacaccagggucacaagguaugaauuuaauuauuaaucaguuggaucacuguagcuacuuuaccagcucaguauucguuuucacugaccugguucuuuauucugaaaguagggauugaagaagaguuaagugaugagugauuggguuugguagcaugaaaauaaaugagagauuuaauuucugaauguuauaaaaaaaaaaaaacuucaaagaggcaucaugauucuucacaaaaaaauagcuuucgagcaggaaacaaacauucuguuugcuugcauguuuucauaaugcaccagauuguuuugacaauauuuaugucuguuagcucuuacuuaggauaugauuuuagagauagucucuugguuuuuuguuuagcaauaaacggacuuccaaauuuuaaauuacuucuuugcaguacaguuuucuuauaaaggagugaaaguaaauuaguauuuuucugugucauaaaagucacuuguggcugaugcuuuuuuguauuaauagggauuuaaauaguuuuuuauauuauuagucaauacuaugaguucuuuucucuaauuaugguacauuuuauagcauucaguauuggaaccagaagcuaaucagauccgagcaucaauuuuagauauggcucacugcauacggaccuucacagaggaaaucucagauuauuccagaaaauuaguuggaauugugcagcacauugaaggaggagaacaaaucguggaagauggaauuggaauggcucacacagaacauguauggauuuuuuuucuucuucacuuucucauucuuuuuuauuuuucauauuuucaccuucuacuaaguaauuaaugggcaauuacaauuugccaguauugcaccaaucauuagaaaguuuuuuaaaagucccugucuuucaggaacucauucaucauggaaaagagagaguuugaaauaugguaacuauuuuauggaggagaaguacagggugcuuuggcaucacaaaacagggacaaugauuuauggaggucagagaaguccuuauagaagaaaugguguuuaaacugagauuugaagaauuucagucagggaaaagagcagaacggggaaugaguugucccaagaagggaacaauauguuaaaauguuuguaagugaggauuguacauauuguagagacuuaaagaagcucacuguaguuagagcuuuaaguauugaaugggacaugacaagaaaagaggauauggagaguucaaagccaaaucaugcaggaucuugucagccauguuaaagaguucagaacuuaguuuaaggacagugaugagccauugaagaauugacuuaggaaugauauaaucagauuuuccucaagaaagguuguuuuaaauguagaaaaugaauuggaggagcaacaaaauuggaagcaggcagaccuauuaggauguuguuaaaguuuucuaguuaaaauacuagagauguuuauggccuauaauacacuaggguagugagaguggacacaagucaauggauuugagauuuuaaauaaguagaauagauaggucuuagugauuaauuguuaauauugauuggauagguaacuuagaggugaugaggcaugaucagauuuuggguguauuuugaagucagcagaauuugcugagggacuagugggcuaugaaagagagcugauaaugaugacuccgguuguuuuugcuucaacauccugaaggauggaguugccauuuaccaagacagaggcaauuagguuugggaauaggggagacuggagauuaggcauuccauuuugcuugagaugucauuuauaaacaguugaauuuccaaugucugugcauuaggggaaagaucuagcauggagauuuauauuuuggaauuuaauauagaugguauuuaaacaaugucucgcucggucacccaggcuggcaugcaguguugugaucaccacucacugcagccuugacuucuggggcucaaucaauccucccgccucagccuccugaguagcugggacuacaggcacaugccaccacggcuggcuaauuuuuuccauuuuuuguagagacagaguuuugccauguugccuaggcugaaauuuuaaauauuucacagguaaaaucuuuauuaacauuacaguugcuuaaaauuuauuuucauuuucuuagguaccagggacugcagagaaugcccggucauguauucgagcuuauuuuuaugaucuacaugaaacucugugucgucaagaagaaauggcucuaaguguuguugaugcucauguucgugaaaaauugauuuggcucaggcagcaacaagaagauaugacuauuuuguugucagagguuucugcagccugccuccacugugaaaagacuuugcagcagguagguaguuuaaaugugguuagggacuuaguuguaaguuuaaguagauaauuaccagagguauacauuaguguguuuuauuaauauuuugugucugcuguaugcaguaacuuugugcuuaggaaauggucugcaaccuugaauuauuucacuaguauggaauuaucagugucguucacgugccuuucccaccauaagccauggguucuugaggccuucuaacuucuugccauucuucaguuaugccaaauccuuuuacucuucuuugccaagcauauauguaguuuuuuuuuuuuuucugcuuggagugcauauaucucucuuuucuaauaguggaaaucuuccuucuccuucaagguccagcuuaaauauuugccuuucuuugaagcuuucuauuuguuggucuuuuuuugagugccucucuaccauguacugccuacgucugcuauaauucagugguucuucacuguuagagcaaacguauguuuugugaugguugagauaccauaagaaauuuguuacccaguuugcagaugacuuacuuuuuuaaauaaaugagauucaguuauucuaacacaaaugucagcuuuacccauuuguguuuuggaucuguuuucauaagugugagguauaagaauaacuauugcccuaggaauuucagaaaagcugcagucuguguuaucuucacugauauauugcuaauaauuguguugauuucaaaucauuguaggcuaagccuuguaccauuguagagcuuuuucucuuaaauaugugauuacacuuacaugagaguggccagucuauagccucaucagucuuggguuaucauuuaguccuuaccacacugaauuguaacaguugauauguaugcuauuuauuaaguugauuuucagcuccaaaccuacucuucuauccucuauuuugugauacuagggcuagaacucuacagaccucauaauuguguugccagcugggcccauguuagguacugucaagagggggcauaguuacucaugugaggagaccacccuucucggagguuugaguuucagcuccaugagccacuccugcaaguuucuaaguuuuaauaauucuaacuucuuccuuuuauuccuuuagcacuggaagugguagcuauguuauuucauacaauugcuaccuccuuaauaccucagaguuccuuuuaaccuuuuagcuaccuaguuaauaacuacaccuaguuaacaguuuuuauuuuaaguucuuucuauucaaguaauggugugauuugugucuuccgauuugaccuugaaugacacaauaugccuauguguuuuagaugcugaccuuguucaucuuugaugcaucuuguucaucuuugugucacuaaauucuuugcaucuagauagaaagagcuuaauaaauacauguuuaacucauggcggauaaugaagcuacauagcaaaaucagaguggagucauguccuaaaucauauuuacuugaacacuuaaaaguauuuucauauuuauuuuaugaaaaaguuuguucauaguuacugaaauauuuaaguauuuuagaguuucugaaguguugugccaaaaugacugguauauuaguccauuuucacacugcuuuacagauacuaccugagacuggguaauuuauaaaggaaaggggcuuaauuuacagguuugcauggcuggggaggcuucaggaaaguuagacaaucaugggggaaggcgaaggggaagcaagcaccuuguuuacaggacggcaggagagaaagagagagcaaaggagaggugccacacuuuaaaaccaucagaugucaugauuaaucacuaucaugagaacagcaugagggaaacugccccaauaauccaaucaugucccucccuugacauguggggauuacaauucgagaugagauuugggugaggacacggagccaaaccauaucaacugguaauuuuuaaugauacaguauuaucuauguuaaugcaaaaaaaucaaggucuuggauucauuuuucauauggaccuauuaguuuuguucuauuuuauaacuacagaauacuaaccaauguucuuuaaaguucccacuacagagaaaauugaacagaggaauggauggaacaucacaaauugaucuucacuucugagaacauaauuuaaucauccauccacucuaaacaaauuaugcaucaucuaaaguucuuggcaugauacuggaugcugaauauuuauucauuuagcaaauauguauugaguagcuaacauaugccauguauuuaaaauauaucagugaacacaauaagcaaaaagccauaaucuugugaaauuagcauucuagcaagaagacaggcaauaaaccauaaccauaucuaaguaaguuaauuauacuauauguuagaaaguucugagagcuaaucaaaaaagaauucugcaacuacauguuuauguuuguacagcagauugcauuaauaaguagaguagucaggguaagcauuauugagggaaggugagauuugagcaaagauucaaguaaaaaguugaaggaauucguucaggccguaacugggagaagaacauuguaguugaggaaauguuauagcaaaaacccuagggcagcaugccugguauguuugaggaacaggaaaauaggccucuugacuggaguagaauaagcgaaggacagaguaauaggagcugaaaucagagguuaauagagaauuauauguaaggaaggcccugugaggcauuauaaggacuucaauuguuuuuuuuuuuuuuuuggccgggggcgggaggaguggguuggggacagggucuugcucccaggcuagcuagagugcagugauacagucucgucucacuauaccuucugccuccugggcucaaguguuccuccugcuucagccuccugaguagccuggacuacaggggcaagccaccacauccagcuacuuuuuuuguauuuuucguagagacagaguuucgccauguugcccagacuggucuaaaacuccugggcucgagugauccaucugccuuggccucccaaagugcugggacuacaggugugagccaccauccuuggguggacuucaacuuuuacugauugggauaggaccauuguagaguuuugaguagaagagugacuuaaucuuauauguuaaaaggauuuuucuggccuaugugucuaaaauagauugaaagaaggcaaaaauggaaggaaggaauucaacaguuaagcagcaguuguagaauuccaggugagagguaauaguggcuuggauaauggggauuagaagugcccagauucuggauguucaaaaggauuuguuaacagauuguacguagggcaugcgggaaagagaaagcaauaaugacuucagcguuuguccugaacaacugaaacaguggaauugcugucaacuaacaugaguaucuaacagugagcaaaaacagauaauacuaccguucucauggagcuugcauauuauugggagaucucuuucauauaaagacuauguugguauauguauagauagucuggaauaauauucaagaaacuggaaaguucuugacuuugaggaguggaccuguauucuuuauuuuuuuuaacgaauacauguauaucugaaauuaauuuuuaaacuuuuuauagacauagaacauagauauagaaauguaugcauaaguauucaguuggcugaauuuucagacugaucauuaauguguaacuagcacucagaucaaguaccagaacauugucaguaccccaguaguucccucauacucacuucuggccacuaccugccuuucccaccaugauaaaccacuaucuugacuucuaauguauaucuuaauuuugguuguuuugguaauuaaaugaaaucauacaguaugaauucuccaugccaugucuucuuauacuccacauuauguuugugaaauuucuaucaucacguguagcuaugguuuauucucacugugauguaguguuccauuuaucuauaugcuacaauuuauccauucuuucguugcuaaguccuuaaauuauuuauuaaugcucaauuauuauuuuugucaaauuuacauuuaacuuugacuacuauaauguuaaaacugcuuuuauugugaguugguaauauaagucucuuuuccuuauuucuuauaaaaaguuuauaagaaauauuguuuugccucuuauaggaugauuguagaguugucuuggcaaaacaggaaauuacaagguuacuggaaacauugcagaaacagcagcagcaguuuacagaaguugcagaucacauucaguuggaugccagcaucccugucacuuuuacaaagguaauguacuguacuuuauuuuuagguauuuuuucugacaaaucauaauugauuuacguuucaugauaaucaccuuaaagagacaaccaugaaauucaugaauuaggggcuuuuuaagaaaacuuuuaucaguggaaaauagaaauggugugcucacuucggcagcacauauacuaaaauuggaauaagaagauuagcauggccccugugcaaggaugacacacaaauuugugaagugugccauauuuuuaaauuuaaaaaaguaaaaauaagaaaauauaaaugguauauauaugguauauauaaugaaucuuccuguauccaucacccacuugagcaauuauaaacuuauuucaucuccccuuuuaccuacuccuuuuccuaccugcaaucucccaggguauuuugaagcaaauccuaauaucauauuauuucaucccaauaucuuauuucaucuaugaaauauuuuaggguguaucuccaaaagauaaggacucuuuuuaaaaacauaauuggggccgggugcgguggcucacaccuguaauaacagcacuuugggaggccgaggcggguggaucaccugaguucaggaguuugagaccagccugaccaacauggagaaaccccaucucuacuaaaaguacaaaaauuuuuggcauaguggugcaugccuauaaucccagcuacuugggaggcugaggcaggauaaucacuugaaaccaggaggcagagguuacagugagcugagaucacgccacugcacuucagccuggguaacaagagcaaaacccugccucaaaaacaaaacaaaacaaacauaauugggcaugguggcauaccuuauagucccaguuacucaggaggcugaggugagaggauggcuugagcccaagacuucaagaccagccugggaaauacagugaaauucccgucacuuaaaaaaaaaaagccaaaauaucauuauuacaccaaaaaaguuuaauaaugaaucucuaauauuuucacuaauauuaucaacuuguuaguauucaaauuucucagauuguuuucaaaacaauuuuuuuaaugguugcuuuauuuuagauacaauccaagcaaaguuucauacuugggauuugguugauauauuuaaaccucuuuuaaaguggguucucccugauuaaaaaguguucauguguaccauuuugcuuuccauuuuuaggggcugguuuuuuuuuaauuuaauuauguuuucacaauuaugugaaauguuuaugugauccagagucaaauguucaaagcaagguuuauucagagaaaucuagcuuuuaugccugguccuucuacccuuuuuacuucauuccccauagaaaaucauuuagaauuuuuucuuaguuuuagucaucauuuuaaaaaguauagagacauauguuuauauauuuguaugcacaccacuuggauuuaaaagguggaauaccuuacacacuuuuuuuuuccugcucuuuuuacuuagcuguacauccuaaacaucacucuguagcaguagaaagugacauuuuuuguuccuuuuuccagcugcaagguacuucauugugaggauaugccacauuuauuuaucguaguaaaaaacacauaauaaaaaauuugcuaucucaaccauuuaaaaauguacaauucaguacuguuaaguauauucacauuguuaaacagauauccagaaauuuuucauuuuguagaacugaaacucuauacccuuuaaacaguuccccucugcccccucucaucggucccugguaaccacuauuguauuuuucccuuaugaauuugacuagauaccucauauaaguggaaucauacaguauuugccuuuuuguggcuggcuuauuccacuuggccugucaucaaaauucauccauauuguagcaugugaaaggauuuucuuccauuuuaaagcugaauaauauuccauugcaugugugauaugguuuggcuguguccccacccaaaucucaauuugaauuguaucucccagaauucccacguuuugggagggacccagggggagguaauugaauaaugggggccggucugucccaugcuauucuugugauagugaauaagucucaugagagcuaaugggcuuauuagggguuucugcuuuugcuucuuccucauuuuucucuugccaccaccauguaagaaguaccuuuugcccccugccaugauucugaggccucccuagccauguggaacuguaaguccaauuaaaccucuuuuuguucccaguuucggguauguccuuaucagcagcgugaaaauggacuaauacaguaaauugguaccaguagagugaggcgaugcugaaaggauacccaaaaaugugcaggcaacuuuggaacuggguaacagguagaggguggaacaguuuggagggcuaagaagaagacaggaaagugugagaaaguuuggaacuuccuagagacucguugaaugacuuugacaaaaauacugauaaugauauggauggcgaaauccaggcugagguggucucagagggagacgaggaacuuuuugggaacuggaacgaaggugacucuuguuacuguuuuagcaaagagacugguggcauuugccuagacauuuguggaacuucaaacuugagagaggugauuuaggguaucugguggaagaaauugcuaagcagcaaagcauucaagaggugacuuggguucuguuaaaggccuucaguuuuauaagggaagcagagcguaaaaguuugaaaaauuugcauccugauugugcaauggagaagaaaaacccaucuucuggggaaaaauucaagcuggcugcagaaauuugcauaaguagcaaggaaccuaauguuaauaccuaagaccaaggggaaaaugucucuaggccaugucagagaccuucauggcagccccucccaucacaggccuggagguccaggaggaaaaagugguuucaugggcugggcccaggguccccaugcugugugcagccuggggacuugaugcccugagucccagcugcuccagcuguggcugaaaggggccaauguagagcucgggcuguggcuucagaggguggaauccccaagccuuggcagcuuccaugugguguugagccugugggugcacagaagucaagaauagagguuugggaaccucugcuuagauuucagaagauguauggaaacaccuggaagccuaggcagaaguuugcuguaagggcaggguuuggaggggcgaggggcagaaugauaugcuugagauuuugggugugcccccacccaaaucucaacuugaauuguaucucucagaauucccauguguuagggagggacccagggugagguaauugaaucaugggagcuggucuuuccugugcuauucuugugauagugauuaagucucacgagaucugauggguuuaucagggguuuccgcuuuugcuucuuccucauuuuucucuugcugcugccauguaagaagugcuuuuugccuccugucaugauucugaggcuuccccagccauguggaacuguaagucuaauuaaaccucuuuuucuucccagucuuggguaugucuuuaucagcagcaugaaaauggacuaauacaauguguauaccacauuuuguuuguucauucaucuguugauggaaacuuggguagcuuccaccucuugguuuacugggaauagugcugcuguguacgugaguguacaaauaucucuucaagacccugcuuucauggucuuuuggauauauacccagaagugaaguugguagaucauauaguaguucuguuuuuaauuuuuugaggaauccccauacuguuuuccauaaugguugcaccauauuacaguuccaccaguggugcacaagggugcaguuucuccacauuuucaccaacacuuguuauuuucuguuuuuggauaguagccauccugauugguuugaaaugauaccuuauuuguuuugauauccauaucucugaugacuagugccauuaaccaucuuuucauauaauuguuggccaucuguauauugccuugaauaugucuauuucuguccuucgcucacuuuuugauuggguugacuauuuuuguuguugaauuguaggaguucuuuguauauucuggauauuaauucccuaucagaucugugacuuucaaauauuuucucccauuucauaggucaauuuuucacucuguugauuuugucauuuuaugcacaaaaauuguaaauuugauguagucuauuuuugcuuuuuuuuuuuuuuuuuuacugugcuuuucguguaucccugaagucacucucaaaugcaaugucaugaggcuuuuccucuguuuuuucuucuaggaguuuuaugguuuggggucuuaaguuuauggccauuuugaguuaauuuuuuuaggugguguaagauacauaacauccuuuugcauguagauauccaguuuccccagcaucauuuauugaagagacugucuuuucauugagugguccugcacccuuguugaagaucaugugacccuauuccugaggguuuauuucugggcucucucuucuguucuguugguuuguaugucucaucuuuaugccaguaccacauaguuuucauuauuguagcugauauggcuuggaucuauguuccugcccaaaucucauuuccaguuguaauccccaauguugaaauggggccugguuggaggugacuggaucaugggggcaguuucucaugaaugguuuaguaucaucccccuugguacugucuuugccauaauaggugaguucucaugagaucuggucguuuaaaaguguguggcaccucccccacccucucucuugcuccugcuccugccaugugaaaugccucacucccucuuugcuuuccaccaugauuguaaguuuccugaggcuuucccugaagccaagcugaugccagcaucaugcuuccuguacugccuguggaacugugagccaauuaaacuuuucuuuauaaauuacccagucucagguauuucuuuauagcagugcaaaaacagaacaauacauuagcuuuguaauauauuuugaaguaaggaagugugaguccuccaacuuuuuucuuuuucaaaauuguuuuggcuauucagggucacuugagcuuccuuauaaauuuuagcuuaauuuuuucuaucuccacaaaaaacaugauugggauuuugauagggauugcauugaaucuauauaaauuaccugggcuguuauucauaucuuaauauuuuaugucuuucaauccauggacauggaaugucuauuuaugucuuaauuuauuuuagcaauauuuguaguuuuuaguguacaagucuuucaccaucuugguuagguguacgccuacauauuagguuggugcaaaaguaauagugguuuuugccauuaaaaguacuggcaaaagccgcaguugcuuuugcaccaacauaguaucuuaagucuuucaccaucuugguugaguuuauuccuaaguaucuuaaacuuuuuuuucuguacauguucagagaaacuucuuuagucauaaacuauaaaaaugaucccugaaaguauaauuuugaugcuauuuuaaguagaauuguuuccuuaauuuccuuuugggauuuuuaucauuaauguauagaaaugcaacugauuuucauguugauuuuauauccugaaacuuuguugacuuuauucuaauaggucuuuuuguguggacucuucaggguuuucuacauacaagaucaugucaucugugaagagauauaauuuuacaucuuccuuuacaauuuggaugucuuuuauuauucuucuugccuaauugcucugugggcaucuucuuguucuuuaucuuagagaaaaagcuuucaguuuuuugaguaugauguuagcugugggcauuucuuauaugguguauguuaacugaggcaguuuccugcuacuccuaguuuguugaauguuuuuauuaugaaaggguauugaauuuuguuaaaugcuuuuucugcaacuauugagaugauuacgugcuuuuuuucucucauucuguguauuaugcugauugaugaugaauaauucuugccuuccaguuauaaagcccauuuggucauggcguacaaucccuuuaauauguguuuuuuuuuuuuuugaggcggaguuucgcucuuguugcccaggcuggagugcaauggcgcgaucucggcucacugcauucuccaccuuccggguucaagcgauucuucugccucagccuccuuguagcugagauuacaggcgugcgccaccaugccuggguaauuuuguauuuuuaguagagacgggguuucucuauguuggucaggcuggucucgaacuccuaaccucaggugauccacccccaaccucggccucccgaagugcugggauuacaggcaugagccaccacgcccggccuaauguguuguugaauucaguuugcuaguauuuuguaguuuccuccugguugcaccucauccucacuauguuggauauggggaagggcagggaugagugcacagaaugccccaaauuuuauuaccccuuucacuggaaugccuucuugguuuuauggccugggugcuguaguuucuuaacuguucucuagaguucucacagaaguaguucuguuccauauauuguuuuauuucugagguguauaacuggacuuaaguauagauuuggagccauaauauacaugguaauuaaagcucaugaagagaaugaaaauauguagaaugagaaggaggccucauauagacccucaagaauaccaacauuuaagagcuggauuaaagaaaaauuagaaggaacauccaaaaaugggauaaaaccaaaccaggaaaaguuuguaucauaaaauccaagcaaagagugcucaaaggaguaagcaaaaauaacacauauauuuugggaacuguuguaaggacuuuuauauguauucuuaaaaauuaauccuuucaagaauccuauguaaauuuuguacuauuuuaauccuccuuuuaugagaugaaagaagugaagcagagaaaucaugcagcuaguaauauauaaaaauguucauuauagcauuauuuguaauaucauaaaaucagaaauuaccuaaaaucuaucaguuggggguuuaguuaaauugugguuuaugaaauguaaagaagccauuaaaagaaaaagguuggucaauauguauugacaggauuccauaauauacuguugagugaaacacauuaguuucaauguguggguaauacuuuuuuaaaaaaaaauuuguuuuguuuguguauguuggccaguaugugcauggaaagugucuggagggauauacaucagauucauaguagaaauuucugggaauugagcagcacuuuuucauuuuaauugauuuacccuuauugugauuuuuuuaguauagcauaaaaacauguuuaagauuuagaggauucauuugaguuagaaaaucugagaaaauuaaguggguauguauauucuguuauacaaagacaaaguggucaguuuuacuaaggcaagauuuagccauggggaaggauuucaucuucuugagaucagacucaguauuuugaggaauacaauucagauugcaaugguugaggaaugaauaggagauguagaaauaauaaaggugcuaaaugcuauuacuuucuaacugcaugucaaacauauuuaaaaauauuuaaauuguaggauaaucgaguucacauuggaccaaaaauggaaauucgggucguuacguuaggauuggauggugcuggaaaaacuacuaucuuguuuaaguuaaaacaggaugaauucaugcagcccauuccaacaauugguaaguaugaauauugguuuuuaccuuaauagacaaacccuagcuuacagccaaguucuuggggucuuauuugauacugaucugucaugguggugggcucuuuucuggcucuaagauaucagcaucucagagaaaaaaugcaagauuguaugacuaugggauugaaauguggauggggauaaaaagaagaaacagaguauuggugggacaguuggaaggaauagaggauuggugauccuggcugaggguguggggugggggguaguuguggaacagagcuggaagguacauggaucccaagguccuaaggaccuugguggagguuuagagggcuaggagcuguuacagguauacauucaccacguaggaguaggaaugggguugauuaggcuucaguagauauugcugcauguagauaauuugauaagucacaguuauaaacuggggguugucuguguuugauaugucauucauuguaaauacaaauauaguauaaaaguaacuuuuuuuuuaaaacagguuuuaacguggaaacuguagaauauaaaaaucuaaaauucacuauuugggauguagguggaaaacacaaauuaagaccauuguggaaacauuauuaccucaauacucaaggugagaguuaaaaaugacauuuaauuuuucacauuuuuaggaugacaguuuucaguguacugauuuaacuagcaaagcugauacuuaugauuaagucguugacuguauacuuaaguaccuguggccaguuucuuaacuuguaaaaaaugaaaguagaaagauuaggauauauacuuuuaguuuauuccugauauaccauuauuacagaauaaaaaccauacguagcuuagauauguagucaguuaagaguacucuugcuucucuuaacagagaguguauauuaccaguauuauaugggugugacugcugguagcguagugguauagaguugaauuuauguuguaugauucugcugaauucaguuaaacucaacauuuaucccauuauaaucucacuauagccccacucccacauuucuuucacaaauaguuauuaccugcagaagaacuuacaguagcuugcuuuugaccaaaccguauuauaucauaucuauacucuacauagguuuuagucacauuugggucuuacucuacacuucugccucauagaccccaacauaaugcuuacgcucaugccgcuuauucuguauguuauucugcuuuccaccaagaugagagacugaauaauuauuuuuacuuugggauuuuugauauuauuaugagccauaauuaauagaaaaaauguauuuuuuuuuugagacagaaucuugcuuuguugcccaggcaggaguacaguggcaugauugcauuucauggucaccucugucuccugggcucaagcaaucuucccaccuuaacuucccaaguaguuaggacuagguauaugccaccacauucagcuaauuuuuuuuuuuuuuuuuuuuugagaucgagucuugcucugucgcccaggauggagugcaguggugcgaucucggcucacugcaagcuccgccucccagguucacgccauucuccugccucagccuccugaguagcugggacuacaggugcccaccaccaugccuggcuaauuuuuuuguauuuuuaguagagacgggguuucaccauguuagccaggauggucuccaucuccugaccucgugauccgcccgucuuggccucccaaagugcugggauuagaggcacgagccaccgcgcccggccacauucagcuaauuuuuaauuuuuuuuuaauagagauaaggucucacuauauugcccaggggucucgaacuccugggcucaagugauccucucaccucagccucccaaagugcugggauuauaggugugagccacugugcccuacaaaaaugaaauuuugaauaugaggaaugguugaaagucuggagauaguuaacuuagacauaauacuuuggagaaauaaaaauggugaugguuuuuaucuuuuagucuuuuauucaaagacuaaauauuagaaaaguaguauucgaagaacaaguagcauccauagguagaggaucaugaggcauauuuugaaauucguuauguaaaaaguuauuugauauacagaccaauuugcauuugauagagcaaguguuguaaauccuuuccuagauggggaaacuaaaccugagaaguuauguaaacuacuugaaaucauacuguuaauuauuuguaggugccccugccauacuaggcacccucugugugaaaauaaugaugguagacaaacucuaaccauaacauaauaaugauaucauuaaauauuugguucauuuacugaacuuuagcaagugacuauuuuuguuuuuuuuauuuuuuuuuggguagcuguuguguuuguuguagauagcagucauagagacagaauuagugaagcacacagcgaacuugcaaaguuguuaacggaaaaagaacuccgagaugcucugcuccugauuuuugcuaacaaacagguaaugcauuuuuauauuggaauauuuauuuuaguaguuuugugcaugucaaaaggcaacuggaaauauuucagaagacaaucaguucaauagauauuuauaguuucuucuguguauuuugaguacaaucuaugugaaaaugcugugcuggguaccugggaguauacaaaauagaaauaagguaguuaaugcucaccagaaacuccuguguaugcauaugaacacauaagagaucugaauacgaagaagacugauaaguaacuuaaguaacacaguguuacgggaauuaggaaaguaguucuaaauguggcauguuguaagauuguaaaauguagaauuugaguugaaauuaugcaugaggcugagucaguaugugaaaggaagaacauuauagacagagaagauaauagcaugaauguuuuuaguuuagggaacaucaagcagaucuauaugucaggucucaguagaggaugaagagaauuuagaauaacagacaaggccaugcuguaaaggucugacagugcuagacugagaaauuuagguuuuauucuaugagcaaggaggagucaucaaaauguuggauuaguggguaauaagaucauaucaguguuucaauacuauaauucuagggguagaaugaaucagggcaaaggacuggagacagggagaugcaguaaauugcuuaaauaauucaagugagcauuaacaagagccugaauuagaggaauagaaaggcggaggcagauggaaaagacuuugaggcagaacuggugacugaauggggaggaugaaggacugggaguagcugaagauuccuagaccuugagccuuucuaggaggaugagaugcuuuuaaguagaggcagaaggagaguagaaguggagcagaggagaugucaugggaggggaagaguaggaugaagaauaaagaauuuuccccuuaauaaaaaaggcaaacuauuaagaacugguauauuuaagacaugcaaauaagucagugaaauaccauuuucugcucaucagauaguuaaagaugaaaguguuuuauaauccucagacuuauauacaacuguuacuauuauuauuuugagacugagucuugcucugucaccaggcuggagugcaguggcacaaccucugcucacugcaaccucccccuccuagguucaagcgauucuucugccucagccucccaaguagcugggauuacaggugcuugcuaccacacccggcuaacuuuuguauuuuuaguagauucaggguuucaucguguuggucaggcuggucucaaacuccugaccucaagugaucugcccgccucauccucccaaagugcugggauuacaggugugagucacugcgccuggucaacacuguucguggguuauuaaacugagacauuuucuuggaggacaauuuggcaauacucaucaaagucccuuacccugcaauucuaccuuuauauaucugguagacagauauccaaagguuauccuacagauaauuuugcaaauauacauaaauguaugucaacuuuuguguauguauguuuauguauguauguguauauauauggauuuauaauagcacauaagcauaaaacuucaaucugaacauucaguauaggacugguuaaauuauguugcagccacacaauggaagggaauucugauauuaaaaauaaugcagaccaucugugcugauaauggaaagauacucaucuucaacauguuuacguaaaaaacaaacagaaaacccugcaaguuauagaaagucuaaacuauguuccuguuugugucucuuugcaugagugugcauggaaauuuucuggaaaaauauguuguaacuggugguugcuccugggaaguuggggcaauggguguucagagugggaauguagugaacucuucaauauauaacccuauauauaaaccauuuauuaagguuucuauguguuaauuuuuuuuuuuuaaguugaugccuuacacuuaggcaggccaggcgugguggcucaugccugcaauccuugcauuuugggaggcugagguugguggaucacuugaggucaggaguucgagaccagccugacuaacauggugaaaccucaucucuacuaaaaauacaaaaaaauuagccgggcaugguagcacaugccuguaaucccagcuacuugggaggccaaagcaggagaaucgcuugaaccaggaggcagaaguugcagugagccaagaucaugucacugcacuccagucugggugacagagugagacucugucucaaaagauaaaaaaauuacuuaggcaguauguuuccuuuuagguugcaaggacuuuauugauuucauuguuaagcuagccuuacaaaguauauacauacacacacauauaaauuaguuaaaccaaacuaauuuuuucuauucuuauuaaucucagaauaauuacugaaagaugaaucuagguuuuuuguuuaggcuucuguuagaacacugucaacaaauuucucuauaaauggugauaauuagaaaaauuauaauuuggauggacugauaaaaaauauguguauauaucuuucaggauguugcuggagcacugucaguagaagaaaucacugaacuacucagucuccauaaauuaugcuguggccguagcugguauauucagggcugugaugcucgaagugguaugggacuguaugaaggguuggacuggcucucacggcaacuuguagcugcuggaguauuggauguugcuugauuuuaaaggcagcaguuguuugaaguuuugugguuaaaaguaacuuugcacauaguauguuuuaagaaauuauacaucucaaaagaugguaauuuaggaugcauauauauauauauauauauaaaggaaucuuggauugggaauucaguacuuugcuuuaaaaaaauuuuguggcagaauuaaauuucuaauugagcagauuagauugaauuaaauagaaacuuauugaauauacauucuuuuaaaaaguauauuuguuauuuaaguuuuucagauaauaugugaccaauauacugggaaagagguagucacagagaaaggguaagugaagguuuauucuuucagugaaaaaagaauagccaauugagugccuaaugagaccucugugugaagcaagugaaguauagcugcuucuuuuaaccugccuuuucacugaauguuggcagcauuuaguaguagaaaugacaguugcuuaaugaaauagaauccaaacuacauauuuggauaauaggauuacuuuauguuuauguucagaguuaacagaacaccuuuaaugcuaagaacuauaagguacagaaaauuaauacuuuauauaguguuuuauuaacuuucuccuacagcauuuuguauaaaacacaaugagggagugaaauguuacccaauuaggcuugucagguuaguaauaaacugaacaguaauaaaacuguggaaguaauuggaucugaauuuaugaaagacccauuuccaggacugaaccuaggucagagcucuaaauugguccuucuauuuuucaacaaauuuaaaguaauauuucuuucuaauauaauauugcauccuuugugggaaugacuauagguaaaauguaguaaguaacgcagaaccaggguuggcuuuauuuaaaagcuagugaccuaaauagaaagcgaacuucaagagaaguuguaaguacaguggcaaaugcuuauuacuuacuucaaacuguuucccaaaauaagugcauuuauuuugacaauaaaacuuaaggcuguucaugagaaggccuugaaaaguuacucuagaggaaaaaugucuaaagaaaaaaaaaauucaaaaaguuuacauuaauuauucaguguugugaguaaauaaaaaugugugcucuuuacuguuuuucauuuuuaaagaauauuauuauggaagcacgauuuauuuaaauagguacauugagacuuuuuuuuuuuuaauguucugauacauuaggaugaaguuaaaucuuaaaucuuauuaguugaauuguuguaaggacagugaugucugguaacaagaugugacuuuuugguagcacuguugugguucauucuuuucaaaucuauuuuuguuuaaaaacaauacaaguuuuagaaaacaaagcauuaaaaaaaaagccuaucaguauuaugggcaauauguaaauaaauaaauguaauauuucauccuuuauuuuucagguaaaaggucaugcuguuacagguguaguuugugugcauaaauaauacuuccgaauuaaauuauuuaauauuugacugauuucaauaacugugaaaaauaaaaaagguguuguauugcuugugagaacuugaacuguuuacuaguuaauugaagaaaaaguguaacacuaaggugaacuugcuucccuuuucacuaauuuugcuaaacuuuguaaugcacauucuuagcauauaacugaacacaguugaaaaauugugccugauuauaauguauguauaaugguagguguuugugugugauucauuuuuaaagaaauauuuuucucaagcuccuauuacuauuugugguuguauuauuucacuaaucauuaguuaagacugugcuagucuucccugggaaacuaagaagagagcuuuuuuauauacaguauauuagaauuuuccuaguagcugaauuucuguauuaggucuaaauauuacuguauguuauauaaagcagguaugucaaguguauagccguagucuauaauucaggaaugcuuuauaaccaucagaagccauuauuugcacuacauauaugauaaguauagacagcaauaaaauguuaagaucauuuuuaagaagucccaucauuauucuugaaagucucuuucuugaaccaucuaccuaauauuauugcuaguuguaaccaauuuaagaagucauuauuugugcugugguuaggagagaaaauaaaacaaaauggguauggguuggcaugccugucaaauuugagauguaguuuauuugauacagcaaaauuuuagaaauaacguuuugaauuugcaacauaggccacauuuacugaugagaacagauacuaaacuugaucuuaacuacaccugaucuuagccaaaaggccgagaaguaaugugcaggccacauuuaaauaaguaauauaaccauaguguuuugaaggcggagcuaaaguuuuacauugaacgaagugaaacuuuguuacugccuuuuaaauuuuaaauguaaacuuguuucauaagaaaacauaguauuuuaaaugaccauuuuagaaaauggcuugcaaaacuuagugguagcucaugaacuaauacugcuaagagaaaggcuuuuuauguaacacugggauacuucucaauuggcaaagugcuaacaaagaagaagacagcuguauucuucccuaaaagaauaaaggaugaaaaggacuaaugaauaaggaugaaauuauauccugauaacuuaaaacaugcuuuuaaaaagacaugggcaauguauguuuuuaggucugccgauuaaguuuuugauauuaaucgaa

SEQ ID NO: 17399 - RNA, 25596 nt, Homo sapiens
agacugcgccgcugcuuugggauugguagcugaguuuugugucgcgccuuuucugacgaugcgaacaacauggcggcggaaagugguagcgauuuucagcagagacguagaaggcgccgggacccggaggaaccggaaaaaacagaacucagcgaaagagagcuggcaguagcaguggcggugucccaggagaacgaugaggagaacgaagagcgcuggguuggaccuuuaccuguggaggcaacacuggccaagaagaggaaagguagcugcagacauaguaccgggacgaauuggagugcugcguccgcugaguaggaggguucaagccagauccgaagagggaugauguguggaguuuugugcccucagaacagagggccguccucucacuucuggcuacuccauacuugcaugucuuaacgaaauagugauuuaagcguaguacaacgucuuuuugauaauaucuaacacuuuugaucauugauuuguuaugacagaugcuaaaacuaacauuuuccuauucuuauguguuuggcuccucucauuuacuccccacagcagccacaugaaguuggaauuucgaacucuuauuuagguaugcaaaaggguaccaguucucuuuaaggcuuuaguucaggagugguguuaauguauuaauguguuggggcgcgagaggaaggcggugcuuauuucgaaucaugguagguaaagauaauuucaacucugacacuuccacuaauaaauuuucgcaucuagggaaaaugacguaagcuuccuagaucacagauuuguuuucauccaaaacccgaagucugugguuuugaaaucacgcucuugauacgaugggcugagucuuuuugucacuaacgaggaauaaucacaaauuauuaucaaauaaaaggggugggaaaagggguagauuaaguuuucuugucuuuguuguuuuguuaucuuguuuuucugugaaauguuuuccuuaaguauuuaagacauuuuaaauguggucuaagcucaaaucguacuuuagcaccuucccuuaaaaaacuucaaugauuugucauuauuuucucucucuuuuuuuuuuuuuuuuuuuuuuuugagacggagucucgcucugucgcccaggcuggagcgcaugcaguggcgcuaucucggcucaccgcaaccuccgucuccgggguucaagcgauucuccugccucagccucccgaguagcuggggcuacaggcgcacgcccagcuaauuuuuguauuuuuaguagggacgggguuucaccauguuggccaggauggucuugauuucuugaccucguaaucugccugccucggccucucaaaagugcugggauuacaggcaugagccacggcgcccagcucauuauuuucauuaaagcccaaacucccucacauggcauauaaagcccuuuaugaugugaucucuccuuaccuucuuagugcaucuuccauuaccuuccucucccaaccccuuacuuuguacuccacccauucuaaaaucacucgagaaucggucuuguacuuuuuuuuccucuggauuccuacccagauaugguguuucuaccgggaauaauuucccucaacucuuccacugaacugacuuuuggucaaccuuuagcacuuagcuaucaucuucucugggaagccugugacuucuccagucuggacuggauuucugaagcacuuugaucauaacucugagguaguuauauaucaauacugaauuuacagguagccuucaaauuuuauguauccaaauuuugaagaagcuguuuuuuugaacguuguauauugacacccuuacagugcauuaucauuuuuacuuccugguccucuuauuaaauguuuccauaguaaccauuuuauuuauggcacuugccgcaguuucuaauuauauauuuauucaugugauugaugaauguuucucuccacugcuaagacuguaaacaaguaagaaccagaaucacgccuuuuuuguuucauugcuugguguacagugcuuugccuaaguauuuaaugacugcauauuaaagcuuuuaugcuggucuuuagcuauuuuguugcauaugaauauuuuugcaaguucuuuuuuaauuaaacgaguaaggagaaauguaaaaauccagaaauaucgaaaugcugauauuaguguuaccggacaagugucuuauaaacuuaauauaacggagacagauauaaauuaguaggugugaaaaucuuuccucuuaaucaguuauuuauuguuuuaagacagccaauaguuggccgggugugguggcugaugccuguaauccuggcacuuugggaggcugaggcgggcagaucaucaggucaggaguucuagaccagccugaccaacauggugaaaccccgccagucucuacuaaaaauacaaaaaaauuagccgggcgugguggcgcacaccuauaaucucagcuauucaggaggcugaggcaggagaaucacuugaacccaggaggcagagguugcagugagcugagauugugccacuguacuucagcaugggcaacagagcaagacuccgucucaaaaaaaaaaaaaaaaaaagccaauaguuuauucaguuugaagaaaaaaauugaaacuaaaaaacauacauagaauguuacaaaaauauuuaaaauuuugucuaaauggacaaguauuuaacaauuucagcuuucuagaaauggagucacccccuuuaacauguucuuuggacauuggacuguuguauauauuuucagaaagacaugauuauauagcacuauaucucuucaggacaggaacuguguuuuacucuucuuuaugcccaugugaccuagaacguauuguguucuuaguaaguauuuguccacaagugaacuaucacacagaaaaaggaaucuggaucagauaggauuaaguuuaucuacauacuacagaaaaacccaaaauaacgauguugaagagauagagcuguacuuuuauguguagaaguaccaagacaggcaggcaguccaggauugguguggaggcuccagaaguuccuaggcucucuccagcuuucugcccaacauaacuaagguacagcccucaucuucauuucucugaaugauuauuaagauuacagcaguuauaucccaguuccaagcuauaggauugaggaaaggaagaaggguacacuuuuucaagacuuccugugacaaaacauuuccacuuuuacucauuagcauaugguuaaaccucacuccaggggaaagugagaaaggucauguuauaucuggacaucaguaugcccauauauaaauggggguucuguuccuaaaaaugaagggaaaaguaguuuaucagacacaagccugaaacagcucgucauguuuaauuuagcaacuuuuuuuaggcacguuuggucaucguucaguuauuuuauuugggauacauauaauucuccccuccccucguucccuccuuccuucccuucuuucucuuccuucuucucucccucccucccuucgucuuucuuucccucccuucuuuccuuccuuacuucccucccucauucucuccaucccuuucuuucuuuuuuuuuuuuugcuaguaaaauuguucauaccucauauaauaaaucaguauuuccugacauuccucagauuacuacucuuucagguggauuuuuuccagguuuugccguuggaaaaaauuugagauacauucaacuggauacucccuaggauguucucaggcauaaaaaucuaagaauuuuaccauguuuaaauguuucaaacacagugucaauaacuugaaagagaaucagugcuuuaaauauuaacugagacaucuuacagauggccacuggacucuuuuaaguuagcacuaaauuaugucuacaauguuaggaagaugguugugauauuuucauggaacuuuuuaauuuuuuuuccuuuuucuuucuuuuuucuuuucuuuuuuuuuaauagaacauucacauuaagccagaagcacucauuucuuaaguccuggggacaguuagcauguauauaguaccugggaaccuguuguaacugacuaaauaaugacgcuauucagugcucugaaauaauagacguuaaaacugagauaacauacuggauuuuuuaauugugaauugagaaaaacuaaaauccaggagaaaauaccaaguagaguguagacaauuuuaaauaaagaaaauacaaaauaguauuugguuuauuuguuaaaaauagaucuuauacuuuacuuuuuuuucuucagucuuagaguuugaaagagucuaucuugauaaucuccccagugcauccauguaugagcgcaguuacaugcauagagauguuaucacccaugugguaugcaccaaguaagucuaucacaucuuuuuuacuuuguucugaguuuauuuaaaaaaaaaaaaagcuucaauuuugagguagauuuauagagauaauuuuaagauuuuguagauuuuuaauuucuuaaguucugaaauaaaggccuacauguucuuuccuauaucguacaaauaaugcauucucuaagauagaaccccugaguuuauauguaugucuuuggagauaaaugccaagaggggagugaaccagguagugucugagcuucccugaagaagaggguacauuaguuaagauaugaguaacugguaccuggccucuuuggcacuaguggagaaaaugugggcuaacauacccuaggaauagcaaaggaccuucaaaacagaugaguagguucguguagaaggauaauaauaguacaaguugagcaccccaaauauaaaaugcuccaaaauccaauaguuuuugagugcugaacaugauacucaaaaaaugcucuuuggagcauuugagauuuucugauuagggauguucaaccagcaaguauaauguaaauauucuaaaaucugagaaauugaaacuccaaaacacuucugguccgauacauuuuggauaagggauacucaaacuguaguaauauucuacuguuuguugagcuuauaguaugucccagguacuaugcuaaggcuuuuucuuuuuuuaucuaucaaguuaaggcuuuuucauaaauuuucuuauuuaucauaaggauaaucuugugaguuaguacaugcucuucauuuuagagaugacgaaacugaaguuuagagagguuagauagcauauuaggcugcuauuuaaaaggcaagggcuaaauccuagaagacuuuuuauuucuuguacggguuuugaaccugugagcaggagaguaacaucaucagauuuauuuuuauuaaaggaccacccuggcuguggugagaugaauggauucaaacagggcaagaauggauacagggagauaaguuaggaagcugguauagaaaucuggaugagauaugguggcuuggaugauacuagcagugaguaugggaaguagguggauuacuuuacacuuuuuuagaucagucuauucuugaugucuugaagacaaauuuaauuucauauauaaaucuaaauaaaauauuuauauuucauguaaaauaggauaauucugaccaaauauuagcaccuuuucuagucucaaguuaucagugugguaaaacaguauauauauacauauuagcauugcugucacucucuucucaaauauuuuuguuuuguuuuuuuaacccaagacaauggaagguaauacagagaauauagguuuuguggugugguagauugaaagccacucuagcuauauggaccugaggcaaguacauuuaacauuuuaaaacuauuuccuacuuauaaaaugaugauaaaaauacguagaguugcuguaaaauuaacuaagguaauauguacaaaguaccugacauauacuggguuuccauaaaugauuucuauuuuuacauaccuaauaggaaagauucuucuguacaaaaucuuuuugauacuuaaguaaccaaaauaccuuguauaggauauaaaaaaaacuuuuguugaauuuuguugcguaugaaaguaguauguuuagauuuacuuaucagcuacugacaaauaguuuauuuucuugugaaaagacugucuguaggguaauuuuagcaauaaggaauccaaaguguagugauuccuagugagauuuuuauuuuaaugucaaauucuaguucaauucugauccuagcucuugagguuaaaauuaguacagcuguaacuguuuugacauccagaaaggaguuucaaaauuugcaguguucuguaauauaguggucugcuuaaagaaggguuuuuuuuaaaaaaaaaccuauuaugcacaagucagauucuuagugaaugauugcuuugggaauacuaagugauucauagaucugucuuagaaauuaacuuuuaacauuucauauaugcagaacagauuuuauuauuacugccagucaugauggacaugucaaguucuggaaaaaaauagaagagggaauugaauuuguuaaacauuuucguagucaccuggguaagaauugcaccucauuuucuuguagcucuuuccuaaacuauacuaauuaaaguuuaaauuuuuuaaauuuuuuuucuuugaaucaugcacacuuauuuuacuguuauuuacuagaauguuuuaauuucauuuauugaaauaggaguuauugagaguauugcaguuagcucugagggagcauuguucuguucugugggugaugauaaagcaaugaagguguuugauguagugaacuuugacaugaucaacaugcugaaacuugggugagucuuuuuaaaaguauauauauuuuaacuuauugaaguaauuuguaaaucagacuuuaccauuuaauagguuauuucuaaauaguauauuaccauaucuuuaaauaaaaugugcuguuggguuuugcuuggaaaauuagauacagcgaagccuuauaauguuuggaagcaucugcuaugauuuguuaucaaucacagaaauuucuaaacagcaucauaacaaggauuccuuauauccaaauugacauuacuuaguaauauuacuggagcucugucauaucuaauuacugguaguuacaguuaacuuccuugcuuuacuuauuucaguaauauagaauugaguuccuauaagauuuauucacauuuuuggaauuaaagcuauuuauuggugacuuuaaacuuuggaauauauugauacuaaaacuaugguuagauuguacaguauuaagacugauacuuuguuuuaagcaugucuuuuuuaagauaacauagaauuuauacacaucuaaaugaaugucagcuugaaagucauaacagugucagaaaguuuugggacucgccuuagucugcuuggaugccauaacaaaaaaaccauagacuaggugacuuaaauacagaaaucuauuuucucacaguucuggaggcuggaaaguccaagaucaagguuccaucaggguuugauuucugaugagggcugucuuucuuacuucucccuauguucucccaugguuggaggaagaaggaagggagagggaagaaggaaagggagaucuuuuuuucuucuuauaaggcuacaagcccaucagauuaggaccccacccugacucuuaugagcucauuaaccuuaauuaccuccugaagaccaugucucuagaaauuccaacugauggaauuccaacugugggcugaauuaugcccacaauucaaauaauuucacaucuuagaauuuccuucaaaaucaguuuaugacuuuaugagccacuaaaggaaauaaaucucauuauuuaugguuagaauggcacaaacauaccugucuugaucaccuguccuacuccccagguuuguuuccucaaagcuuuccauucacagauauugaauguuugcccuuugagaauacuuggaagaguauauuucagacuuugauagaaauucuugaagaagaggucuggaagguuuugaacaucagcaccgugguuagaauaauagugucacuucuccgaaucucuacuuugaaggaaacaacauucauuuuugaguguuuuaguacaauugauuagaucagucugaauucuguuaugccuuguucaucagguagaauguuuaaagcuuugaguuuuaauaucaagauuuaguuaguaaugagaguguuuuaggacaguguuuuucuuugacguauugucauaauaaaauauuugauuuaaauauuucaagaaaggauuuauaaaauacacuauuacaugcuaaucuauuuuaaaguaaguuauacauagacuguuguacagagauccaaaaagcaaugucccagaagaucuuaagguccagaucugauuagguuuccuuaucugcccaagagaaauaagugugcugcuauaugcaguucuuuucuuauguuuugacagauccuuagaacuaucauuauacugaugaggucagaaagagaaaaaauaaguaacuauucuuagcuguuccuccccauucugugucucugcuacuuuugagcaaggaauccaaaacugucuaaaucaccagccaagacauuuuugguagugggauagggagggaugcuugcuuguugugcugaccuuuuuuuuucccucucaauucuuuacgauuuuagcuauuuuccuggacagugugaguggaucuauugcccaggggaugcaauuucuucaguugcugcuuccgaaaagaguacaggaaaaauuuucauuuaugauggccgaggagauaaccagccacuucauauuuuugacaaacuccauacaucaccucuuacucagauacggcuaaacccaguuuacaaagcaguagugucuucugacaaaucugggaugauugaauacuggacugggccuccucaugaauauaaauuccccaaaaaugugaacugggaauauaaaacugacacugauuuauaugaauuugccaaguguaaggcuuauccaaccagcguauguuuuucaccagaugggaagaaaauagcuacuauugguucugauagaaaaguuagaauuuucagauuuguaacuggaaaacucaugagagucuuugaugaaucacuaagcguaaguguaauuuaaauuuaaccguacuuuacuuuucuaaaaaugcuuuauuuuaugccuuuucuugaaagaucuuuuuucuacagauagacauuuagauagacuuauuuuuuucuuagcacauuagagauauucaacuguuucugucuuguaguguugcucuuugaaagucucuucucuagggguuuaugaugugcguuuuucaagucaauuauugucuuauuuuugugguuauuuuguuuuuuacaauuuuguuuuguuugcaagcuguuaagauccucaaaacucauucuaggaccccuuaucuucucacucuuuauucacuccugucccuaugacuacuucuaaauuuacuucucuaaccuucuauuacaagcaaaccuggugcuaucucuuguccugucuucauaaauggugccaguauccaucuaguugcucaaaccagaaaucuaagaguuauccuuaacucuuuuacccuucuguguaauucacuggaguccugccaauuuugcuuuccaaauauacuuuaaauucaccaauuucuuuucagcacagcugucacuaaccauaguucaugcucuuuugccugaccuauuacauggccuacuaccuguauuuauucuggcuucuuccuaauauccacucugcacccagggccaucuuuuacaagcauauaucuggucaugucauuccuuugccuagaacuuuucaguuaauuccuucuguucuugggaucaagaccagagucauggcuuaccauguugugauaccauaagucaccuuucucccugccuuuuauucugccauuugggucuucuuuuuauuucuugaaccugccucccaccacaggaccuuuuuauaaguuguuuccuccaccuggagugaggcccucccuccucauauuccuccauuaccuauugaacugguacuucaaauuucaaaugaagagucacuuccccuggaaggcuuucacuagucauccugucuugcacaguuuuuuuauuuuuuauuauuuauuuauuuaauuaauuuauuuucugagacagaguugcacuugagugcaguggcaugauccagcucacugcaaccuccgcccccuggguucaagcgauucuccugucucagcuucccaaguagcugggacuauaggcgugugccaccacacuuagcuaauauauauauauauauauuuuuuuuuuauuagagauggguuuuuuuuaguacagaugguuuuuuuuuuuuuuuuuuuuuuuuuuuuuuuuuuuuuaaguacagacggguuucaccguguuagccaggcuggucuugaacuccuggccucaagugaucugccugccuuggcgucccaaagugcugggauuacaggugugaggcacggugccaagccagcagaguuuuuuuuaaugugacuguagaucacuguuucuuuuagagcauuugauauggucauauuauuugauuaauguguaucaccuccaguagacuaagcccuaugugaucuguuuuaacuuaugauucuaucuccagcagugagaacaguaccucacacaagaguuacucaaauauuuugaaagagugacucuagccaucacuuguuagacugcuaacaagaauuuguuacagcauguagucguggaauaagaguuuuuaauccaugcaguuaagcgguuucugugauugcaacuauugccaucaagugguucucugaauccucugagucuggauugaaccuuuguagcaaaguuuauuguaugacagugucaguucuuuuguccuuggcagugaccaauuugcauuggauucccugcuguaagcucuucauaaauucugucaacucuuucuaguggcgaucuugauuugguggcacgugguaauaaaugaguugguugucugucugucugaaguaauauauuuccagacaaaugugaagaucuguuugccagccaaauuauccuuaugacaaauuuucuuguuggaagaagauagcuuuccacucugcuuuuaaggagaaacauuuaucgguaauacuuucuuuaaugguggcagauaacuaaauaugacuugcaauuuaaauauaauuuuaaaauucuauuaacuugcagcucuuccaagaucccuuaggcaaagaaauauucagaaucuagucucuggacacaaaucucuuuuuuuuuuuuuuuuuuuuuuuuuugagacggagucucgcccuguugcccaggccggacugcggacuguaguggcucaaucgcggcucacugcaagcuccgcuucccggguucacgccauucuccugccucagccucccgaguagcugggacuacaggcgcccgccacugcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccggcacaaaucucuuaacacacauacucugagcugcucaauccacucuauuugcucauuguugucuucaacauuugcuuaaaugauuagccugaggugacaagaagucaguaguagaacuuaagacagaaguggagauucagaaugagaguuugccaaaaaagccaaccaucaguuaaauuacuuacagugcuagugacuaguaaaugacuggaaucucaaggaggugguaguggaggaggguaguuucuaaccagucggaauccuaguuuaacagaaaagaaauugaaugggaugguguaaauuaucuuuuaguauuuauuaaccagggucacuauauauggcugugcaguugaauaucacagaagcccugcuaugaagucuagagcacucugaaaaagauucugaucagguacuuaccagguuggauaacauuuauggaauacuuauauagggacagaugaccaccuacagaccuuaugccuuaaaaacugagucuucucuccggcagaaaugaucauuagcccuucccugcaaaauguguaguccagcauccuaggcuauuccuggcacaugaauaagcagcguaauauguaucagucucccugucuuugagacuagagacaagaaaaccuaacaacuaggcuuuuuaacuguucuguaagaccuugaccuugugcuuauacccuaacacacauaccucauuuugauuuuuugaguuuuguauauaguucuaaccuuaucuagaaaacacaagauuaugguuaauauaagcaugaaauaaggauagaauuagaugggacagaagucuggcuuauuuucaucugcaauggagagcuauuuuugaaugcuacuguuugaugcccugauuguguagaaaagaauguaaagaucguuacucuuuuggaagguucauaauauguuaauacaguuauugagaugugaugccuaucuugaaauuuguguaauaucaaaagaaaaguaaaccaaauuuccaaacuauaaaggacacuuauagaaauagucaugucuacuaaauaacauguaccuaaugguaaucucacugcccugugucagaauaacuugagacauuuucugaaauauuaugaauuuguuauaaauuagugagaugaauucauucagcaaaaauugagugcuuguuaugucaggcacguaaccuugcucaaggaccucauagucuauagcugcauuauccaguauaaacagucacuagccacgugucuacugagcauuugauagauggcuaguccaaacugagauaugcugaaaguguaaaauacaagauuucaaagacuuaauuuuuuuuaaaagaauguaaguuaucucaauuuuuuauauuguugagaugauauucuggauauuuugaguuuaaucaaacauuaaaaugaaauucaccuguuuucuuuauacuuuguuuaauguuacuagacacuuuaaaauuaccuauguggcuuguguuauauuucauuggaaagugcuacucugugacuuuuaaaaggcagcagauguauucuguagagaaagcaguaguucuauuaaccaaccggguuuuguuuuaaauuagaagaaccaguuaccauuuugaaauacaauuuuuuuuuuuuuuuuuuuuugagacggagucucacucugucccccaggccagagugcaguggcgcaauuucggcucacugcagcgucugccuccuagguucaagcgauucucuugccccagccucccgaguagcugggauuacaggcacacaucaccaugcccggcuaaguuuuuauguuuuuaguggagacgggguuucaccauguuggccaggcuguucuugaacugaugucaggugauccaccugccuuggccucccaaaaugcugggauuagaggcauaagccaccaugcccagccugaaauacuauuuuuuagugauuggacuuacuaaugucuauuucauauuguuuagaaucccucuuaagaaguacaaacaguuaguggcucuuaauauguauucugcuucuauuuaaauucucauugcauauauagauagauggguugauauagauauagguauauguauauagaguuuuuguuacuaaaugguuuauuuccuagauguuuacugaacugcaacagaugaggcaacaguuaccagacauggaauuuggccgacgaauggcuguagaacgugaguuggagaagguugaugcuguaagauuaauuaauauaguuuuugaugaaacuggacacuucgugcuguauggaacaaugcugggcauuaaaguuauaaauguagagacaaaccgguaagcuuuaauaugagguauguuuuuuaaaaauguguuugugggggaccauuuccuccaucaugggaacagugggaguauuguuuguuccaagaaaaguggaauggccccaaaugucuaaacuuaaccaaauguuuugacuggauuuuucuguggucucuugguuguuuauaaucuuauguagaaaguuuccacucauguuuguaaaagaaauggaaagaagauaugcauaguuucaaguuguuguguguuuuuuuuaacaaguuugucugucuuuugcuuauugauuuaaauuagccugguucauguuaaauguugccaaagauuuuaaccacagaauucagcauuacuuccugcuagacauaaaaucaaaaguuaaaaugcaugaaaccacaguaagccuuuuuugugaaaacaguccauuuggucuuaguacaaaauagcuacaaucagauacucucacugaauguaaaugaacagaacuuaauauuuuaaggagaaaaaaauguccuguacauuuccauguauaaacauauuuauauuguaguucuuggcaauacaaaaucuuugaaguuuugcagaacaguuaacagacauggaauuuuaauaagaauagguuaaaacuguauaaacaaaugauugauuguuuuuaauagaccuuacuuuuuugaacaguuuuagguucacagcaaaauuaagaggaagauacagagauuuuccauauacccucugccccaacacaugcauagccuccccauuaucaacgucccccaccagagugguccauuuguuccauugaugaaccuacauugacacccagaguccauaguuuacauuaggguucacccuugguguuguauauucuauagguuuggagaaauguauaauggcauguauccaccaucauauuaucauauagaguaguuuuacugccuucaaaauccucugcucugacuguucaaccacugaucuuuucaccaucuccauaguuuugccucuuccagaaugugauauagcuaaaaucauacaguauguagucuguccagauuggcuccuuucgguaauaugcauuuaaguuuccuccaugccucaccacagcuugauagcucauuucuuuuuagcacugaauaauacuccauugucuggauguaccacaguugauccauucacguacugaaagacaucuugguugcuuccaaguuuuggcaguuauguauaaaagcugcuauaaucaucuguguacagguguuuguguagucauuucagcuccuuuugguaaauaccaaggagcacaauugcuggaucauaugguaacagaauguuuaguuuuguaacagccaaacugccuuucgaaguggcuauacucuuuuugcauucccaccagcaaugaaugaguguuccugucacuccacaucugugccaccauuugguauugucaguguuccagauuugggccauuuuaauagauguguaaugguaucuuguuuuaguguggauuucccuggcaacauaugagguggaguaucuuuucauaugcuauuuaccauuuguauaucucuuugaugaaguauaugugaagguccuugggacauuuuuuaauuggguuguguucuuauuguuguguuuuaagaguucuuuauauauauguauauacauauauauauacauauauauauacacacauauauguguauauauauauacauauauauguguauauauauauacauauauauguguauauauauacuuuuuuuuaaaaaaagaguuuuuuauauauuuuggauaacaguccuuuaugagccguucuccuagucugugacuuuucauucucuugauugguuuuuuguuguuguuguuuuuuauugagauggagucuuguucugucacccaggcuggagagcaguggcacgaucucggcucacaaccucugccuccugaguucaagugauucuugugucucagccucccuaguaguugggauuacaggugccugccaccaugcuugaccaauuucuuguauuuuuaauggcgaugggguuucaccacguuggccaggcuggucucgaacuccugaccucaagugaucugccugccucggccucccaaagugcugggauuacaggugugagccaccgugccuggccucauuucuguuuuuuaaccugaaaauuauagcugccuaccaguuuaaauugauaccuuuugggggguagagaaacacuuuuaaaaaucuuucacuaguuauuuuguacauagauaagauaguugauucccagcuuuuaucuguaaaguugucauaauuggaauuaacuucggugauucuguuguauaaaacauuguuauauuuuuaggugugugcggauuuuaggcaaacaagaaaauauuagagugaugcaauuggcuuuguuccaggggauagccaaaaagcaucgugcugcaacuacuauagaaaugaaagcuucugaaaauccuguucuucagaauauucaagcugacccaacaauagucuguacaucauucaaaaagaauagauuuuauaugguauguguaaguacuaggagauuagacgguaauguuccuuccaguuugguuugacuuuucuuuguuuguaccuucaacugaagagaauguuggcacuaauagcagacuuccuaaacaaccagaauaccaucuuacauuaauauuguagaauuuuaaaguagaaguugauuuuaaguauuucuguacuguuuuccaucauguuuugaaauuuuucaaccucguuuccacaacuauuuguguuguuuuagauaguaggaaguuagugguuauagucauaauuacauccaaaauaguuucacugugggauuuuaaaaguguuuuuauuuuuucagccuuuacucuugaauauaauuuaucuuccccaaauuagcacagcuuccuucucuaaaugcauuuccuuuuuuaccuuuugacuuuuauuuuaauggugcuaccuuggaauuauauauuccuguggaauuuuuuuuuucucuucuggagaacuaaaaguacuuugcauguuaacuaagacugagauaguuaaaaucaaacuaccgugccaugaaggaguagcacaauuuuauuuguucauccaagcaggaaaaucaaaaguauagagaccuaugcccuugcauucuauccuucacaauggaaucagagaacuuuuuaagacccaaacgugacucuuauuuucugccuaauacccuuuaauggugccccagcuaucuaugcuggcuggcccuccucacuucuguagcuuuaucuuucuucauuuuucauucauuugcuacacgaaccauacugaaaguucacauguaguugagugugcuuuuuaaacucugggccuuugcacaggcuauucauucuaccagccacacaccucucuccaacuccuaacucauacuucaaguuucaguuuggaagccccucuguuuuuuggagauggcaucuugcucuguugcccaggcuagagugcagugacgugacuucagcucacugcagccucugccuccuggguuccagcaauucgccugccucagucuccuggguagcugggauuauaggugcaugccaccauacccagcuaauuuuuguauuuuuaguagugacaggguuucaccauguuggccaggcuggucucgaacucuugaccucagguaauccaccugacucagccucccaaagugcuggaauuacaggcgugagccaccgcacccagccuggaagcccuuuuuaacaucaagucugaguuagaugugccugcuauguuucucuuaugcuuccccugucauaugaugugucacacuuuuugugugaacaucaauaauuuauuuuuuuggccucugacgcugugcucuucuucugaagauaaaauccauaaauacaggcacuaugucuucuucacuguuaaauccagaaaguuaggaaaugacuacagcauuacaguauauucauucauuccuccaaaacauuguaaacugauguaaugcuauuaagguuaacagcauuugauaaauguaugaaauagcaguuucccuaccccaaccaaccuuccaucuaaauggguaaauacuuuuaagaugagaauuucauuuacaccuuucaaaauuauuacuaaaaauuuauuaguauaugaaggaaaaaaauuaaucguuuuaccuuuaauuuaacuuuguuaggaaguaaaaauuacccauaaaagauaauucuuggccaggaaugguggcuuaucccuguaaaaacagcacuuugcgggggcccaagcagaaagaucauuugagcccaggaccaagaccugccugggcaacauagcaagaccucaucucuacaaaaaauuuaagaagcuaaccaggcaugguggugugcacauguggucucagccaugcuggaagcugaugugguaggaucucuugagccaacgaauucaagguugcagugagcuaugaucacaccacugcacuucagccuaggugacagagcaagacccuauugcuaaacaaaaacaggcaaaaaaggauauuucuugauauacacucaaaacacauacacuaauuuuccauccacuuuauucaaaaaacuuauauuuuuucuuuuccaaguuuacuuguguguugaucaaaguauauauauucauuauaaaguuugaaaaaauagagaaacaaaauaagucauucacuguagcuuuauacagcuaacauuguuacgaauuuucuuugagucuuacuaguacauauucuuaagcaaaacuaaaaugguaugcauauauaugaauuuugugucccauuuuucagauccaacaugaaauaaaaguauaauuuuacaaauccauauaugagcuaaaucauaauuuuucagauccaacaucaugaaauaaaaguaugauuuuacaaauccauauaucagcuaagucauaacuuuaaaaaauucauauaaacaaauaguacaacagacaugccauuccuuugaaaacuggagaauaggauguuaaggugauagcauccuaacuugguuguuuauuuggaaucuauccaagcagaucaaggaaugacauuaggcaagauagggauggaggcacuagcuuuacguucccauaauuaaguuacaucagauagagguugcuuaggagagagcauuucuacuuaaagaaacaggccuugagaaguccagaguuuuaacaacugaaagguuuuucucaauucuuccuagaccccaaggaucugagauuucuacaacuucacugaaaauuugcauucuuucuccuaugcuucaggguuuagauucuaggucaguugggacugugaaaaaaaauuaaggauccauuucagauucauuuuugugaauccuuauucuaccuagcaugggguccugcucauaguaguaauaacaacuguuaauauguauauaguacccucuauguauuaggcacuguucuccaaggacuuaauaucuauucguuuaaucuucacaacuaccuucauugcaagguauguacuguuaucaucauauaugagugagggaagagaagaaaugaauucacauccccaaagucgcagaacuggaauucaaauccaaacaaucuaaauaaugaacugagcaacaaacagguggcauguuaggccuuacuagaaggcauaagucgagagcuaccacaaaugaaacaauuauucuuguuaaauguuugcccaagaaaauuucuaaccaaagaaauuaaauuccauuugaaaucaauguguucaguauguuauguggauccuuuucauauuagacaauguaaaaauaauuuaauugccugacacauccuguaugggaagugauuccugaaauaaggauucugaugugaauucuuacauuucuuaaguacuucauuagaaauucuauuguucauaaaauuuuuaccagaugaaaacuuuaauucguugacucacuuuuuacuuuccuccuugaguuuaccaaacgagaaccagaagauacgaaaagugcagauucugaucgagauguuuuuaaugagaaaccuucuaaagaagaagucauggcagcuacucaagcugaaggaccuaaacgaguuucggacagugccauuauccacaccagcaugggagacauucacaccaaacuuuuuccuguugaguauguauaacaacuguuuuuauuggcuuauguaauuaagaauguaaauguguauaucugaagaaaccaugcaacuuaaaauucccguuacuuugacuuaaggaauuuugaagaaacguuugauaaaaaacaucuauuccugagcuuucugauaaguguuacgguagaaaaugggaaauuuuuaugcauauauacuuuauagguucauuacgaggacaaaauguauuggcuaugaaagugcugaguguaaacuguaaagugauacacaaauguguaucacuguuacuguuaacagcacaucugaacucuagguuuuguggauugcuuugcuuuccucucaaagcaaauccuuaagagaaagauaauuauguuuccuuaccaacaguugcuagauaccuacuaucucuuuauaguuucaguagcucuguguuuuaaaagugaacuacaagcugggugcaguggcacgcacuuguaaucccagcuauucaggagguuaagacaggaagaucaguggaggccagcaguuugagacuagcccgagcaacacggcaagacucuaucucuuaaaaaaaauuuuuuuuuauuagcugggcaugguggcacgcaccuguauuccuggcuaugcuagaggcugaggucaaaagaugucuugagcucaggaguuugaggcugcaguuagcuauggucaaaccacugcacuccaaccugggcaacagagugagacccuguuucuacaaaaacaaauuacaacaaaaccguaagggcuucaauugaaaaaaaggugaacaguuuucuggacaguuuaaaagacuguaaaauuaacauacaaugucaaauacaguagaguaucucuggccauucuugacccaaaaaaugacaucuuuuacaacacuuuuacuuaaaaguucuuauuuauuaacauuuugaauaugaacguuuuauaccauaucuugguacucaacaaauaacuaggcagcucuagacucuuggacagucucacuuuaagugcucaaaacccauguacucuucggccuuguuugcugauguacuuggguacaagauucucuugguucguccauuuccagcucuuagaaguauuacaugguaaugaaccguaugaaauaauugcauaauuuucaguuaauauuauugagaaagcuucguacucugagugugauugucauuuaaaguugaauaaauuuagaugucauuucuaugauuaagguuuuggccaagaguaugucgcuguagcauaacaaugcuuuuguaagaaaaugaccuuucccaggaacuuaaccuauacuacuacaugcagaccuauaauacuauauggaguaaacuaacuuaagauauugggccagguacaguggcucaggccuguaaucucagcacuuuaggaggcugaggcaggaggaugucuugaguccagaaagucaagaucagccuaggcaauauagugagaccuugucucuuaagaaaaaaacauauuuuuaaggugcuauggcuguauuuuuuuugacugcuaaaugaccuugaaauuuuaauacugucaaacucaaauauuaguuaagcagucauguucuaaagauaacuaaguugaacaauaagaauauacuacuuacaugacccuccgugcuuguccugagauuagagauuaugaaaaaaaaaaacaacuguccuucugaaacauucagaagacauggaaaggaaacaucauuaggaagcagaacugcaaagaaaacuguuuuaagaugcucugaauagguuucauauuuguaacauaugucuuaauaggugcccuaagacaguggaaaacuucuguguucacagcagaaaugguuauuauaaugggcauacauuucaccguauaauuaagguaaguuacauaaauuucaugucauauaagaaauacuguauuauuacauagcaagagauuuaagcgcaaggaaucuucuucucucacacuuaaucaguuuaguggaaaggaacaggaaaaauacacuauggaagccaaaggaggaguggauggucauaaauaucaacaucuagaaucaacaggaauaguggcaugauuagaaacacugaagcaauauuuugucagcagcuaaaguaaaggguaagauaaugaauaaagggucaugcugagauuacaucaguaaccuagguaaccucuuugucguggcuagauagggucuagaucuagaagauaugauuuuucaaucauagaggagccacagugccaucugaucugugagaaccuguaauauaccagaggaggagagagaacucagccccuggauuuuguugagcagcuuuccauaaaguggauggggcacugauacagugcuugguuucuggcaggucagaaacggcaggaugaaaagucagaucucaggguccuaaaggaauuagcgaaaaggcuuuccaggaaauccagaguauuuggggaaagggagagggagaagaggagggcaauuauauaaaacauaacauacagauccuaaaauugauaguauuaacuggcuuuauuuggguuauugagaaagacagaacaugucuauaaaugagaagacgaccuuugcauuuauguuucaaucaagguggugguugggcaauggaaauacaucauccaaauuuaaguguuaaggguuuaaucaaaucacuuuauagugacaguuaauauuacacugaauacaaagcacucuuggcagaaauaaaacuucaaagcguacauauaucgaaaaggacaauguaauguuuuuguguacuuucuguuaagggcuuuaugauucagacuggagauccaacagguacugguaugggaggagaaagcauauggggaggagaauuugaagaugaauuucauucaacauuacgacaugacaggccauacacacucagcauggcuaacgcgggaucaaauacuaauggaucccaguuuuucauaacgguaguaccaacgguaaguacaguaucauuguuuauaaacuacagauugauagguuaugauguaagagagugaacucaguagaagagcugcauuauucuguauuuucugcauuauuuauaucaucuagcagaauacaaauaugaaaaugaucaagaauauaaaauuaugugacuaaucaguuuagaauugguaaaacaauacugccacuguaguaagaaauacaauggacuacgauucaagauacuugaguuucaaucucaacucugccucuacugaugauguaaccuaaaauaaauuauuucacuucugugagccuauuuccuugucuuuagaauacaaagauuagaguauaugaauucacaauuuugagacaauuucccccacauuuuaguaucucugaaaucagaauacauuagauuugaugaaauacaguauaagguaaccuagcucuauugcuaugccauaacacaaaauuauaaaaauuaccuaguuuuuguuuuggaauuaagcacuaagugaugaagaagggaaaaauguaacuaccaucugccaggcacauaguuuuauguaguauucacaguacuucuacuaucaguauccccaguuuucaauaauagaugaagaaacagugagacaugauuaacuugccaaaaggucaaguagccaagcuagcauuugaacucccaccugucuaaugccaaaguaugugcugcauaaacuauuucaaacugccucugaauaaacuguucagguaagaguccuccagagaccuuuuaaagccuuagccacaauucuguaagccaugugaaguaacuuaccuuuagggaagaucuuccaguucccuuuggucugaaagaugcagauauuuaauuaaacauuauacuaugcuucuauuuuuuuuaacacacuggaaauaacuuuuaaaagcugcuacauuuuuauugcugagaaauuauuguacuucuuuuuaaauauaugcuaaaggggagcguaaacuuaaauucucuuuaauuugcucaaccagaggauauaauuuaaagaaauugggguuuaccaagauuuuccauuuguccuccaacacagccuuggcuugauaauaagcauacaguauuuggacgagugacuaaaggaauggaaguuguacagaggaucuccaacgucaaagucaaucccaaaacagauaagcccuaugaggaugucagcaucauaaauauuacugucaaguaaaauaagauuuguuuuaauguacuugcaaauaaaaauacaauauuaaacagauuauuuuacauuaggaagcuuaggacuugcugaauauacagaucauguuucaaagauacaguauuuuuguauuuuuuauuaaaggcuauuuuuuaaaaauuaccuuugacuuuucucgcaauauuucuaauccugggaggugauaaauugaaauggacuaaacucaggcaaauagcacucauuauagguaauuucuaaucagccucaaauuaaauauuaaauaauuacaguacucuccuccacccccuuucccaugguuuucuuucuacugucaaccaugauccaaaaauaggugaguacaauacagugagauauuuucagacagcaagaccacauucacuaacuuuuauuacaguauacugcuauaguuguucuauuuuauuguuguuaaucucuuacugugccuaauuuauaaauuaaacuuuaucauagauauauauauaugaaaacacaauauauaugggguuuaguaucaucugaaguuucaggcauccacuggaggucuuagaagguaucccgugcgaugacaacucuauuaaauaaugacagugguacacaacugugcuuuaauuuugaauaccugccagauauuccgcccuuauguuuagaagagugcagaucccuccuauaagaaaaaaauacuaggauaugauauuauaugucauuuccuuuguuuuacaagguuucaaugccaaauauuuuagucuuuugauaacuguuuaguaaguaguggugaguaaagccucaauaaacaggaaguuacuuuggucaaaguguuauauuccuuaauaauuaugaaauauucuuucaaaugaaagauucagaauaagugaauaccugaguccuuaguuuauuauaugcagguugauuuucagauuauuuuucuaacauagguaaacaauuuuuucuguccucaaguuauaguauaucuuuagaaaauauaccauuaagaaguauacauaaaaauuuugguaucuaacaauggagagauuaguagaaauuggagcaguaaaacaauaugagcacaaauucuuauauugaucuucuucacuuacacuuauaacuaacuucauaacuauuaagacucacugcuucguuuccagaaagaaagacucuuucuuucagaaacuuacaggaagaacauucucaacagaccuguguagggaauuuauauucuuaaguuuuaaaucggcuuaaacuuuuccuucuauugaucagcaggauucuuuauuuauuucgugcuacaaaguugugagauagauaggagauuaugccagauugugcuccuguaauguaugcuccuuuuuaaaaguagaacuuaaaguuagacaugaaaaugacuuuucaaugugacauuuacuguuucuaauuuuaguuguuuagucuuacc

SEQ ID NO: 17400 - RNA, 529 nt, Homo sapiens
gcucucuuccucggcgcugccuacggagguggcagccaucuccuccucggcaucauggccgcccucagaccccuugugaagcccaagaucgucaaaaagagaaccaagaaguucauccagcaccagucagaccaauaugucaaaauuaagcguaacuggcggaaacccagaggcacugacaacaggguucguagaagauucaagggccagaucuugaugcccaacauugguuaugggagcaacaaaaaaacaaagcacaugcugcccaguggcuuccggaaguuccugguccacaacaucaaggagcuggaagugcugcugaugugcaacaaaucuuacugugccgagaucgcucacaauguuuccuccaagaaccgcaaagccaucguggaaacagcugcccaacuggccaucagagucaccaaccccaaugccaggcugcgcagcgaagaaaaugaguagacagcucgugugcacguuuucuguuuaaauaaauguaaaaacugcaaaaaaaaaaaaaaaaaaaaag

SEQ ID NO: 17401 - RNA, 16505 nt, Homo sapiens
ccccuccggcgcuugggccagaguggugcgggcggcgcguggcggcgauccccacgugguggcuuucucacgcuagcccucuuugguccuccuugacgucccgggccugugggcccgcuuucugccgagaugccgaaggucaagucgggggccaucggccgccgccgcgggcggcaggagcagcgccgggagcugaagagcgcuggaggugcggauccccgcgaggaagcuggggucggucgggucaggucuuccggcaggaccuagccuggggugcggaccaagaccugaucggcagaggccggucaggacgcgcucccgugagcgcggaaggcagggguggguccccgacucggccgcaggcccugcgcgucgccgcugacuuccuuuccagcuggaggaugaacuuauaaagaguuugucaguccuggcgugacguuucguggcccugguuggcgcagaaaucuuccccauacccaugcagcuuucuucucugguacugccuaauaucuaaucucaguaggaaaauuaaugcuguuucguauuuucuuacaggacucauguucaacacggggauugggcagcacauuuugaaaaauccucucauuauuaacagcauuaucgauaagguggguguggaagaggaaagggagagaguuguugguuuauuaauuuuauuccuaugaauacauaagcgcagaaagucugccugccguaaauuagaugcucuguaaauauuuguugaaugaaucaaauaauugucuaggauucuugggcugucuucugcaugauaagcuucauuuugugggucugaguuucuccugguucccaauucugugucuuuuuguggauuaucuacuuuauagcuggaccuuuguauuuguucaagauaauuauucuucuauuucuaaucaccuuuuugaucacuuaguuuuuauguacuccaucuauuuaugucuaaacuacacauuagaaaguuuguuccccagaaaaacauauaguacuacauauaaauuauuugguguaugcuaguaccacauauaaauugcuuggaguauuacugcuuucugaguuauugauguucucuuaugguuauggaugauuggguguuaggaagugaaauacacacggugcagauuacacuuaugguuaaaagcaaggaaagcauccuggagcuguagaaagagcauuacauaguuaaaggaucuugucaggcuucgugucauuugaaaacugagaaaaaaagaaagaagggucauguacuauuuuaaccuuuuuagcucauaguuuccuuugagcaucugaugaaagcuauggccguagaauauuagagcugugugcagacauucaauuuuguguacaguuucugcucuucugcauccuugaaaccauacauggguugaaaauugaaaaaucuucgcccaacacguacaguccuuucccauuugaacuuguugauacgaacagagaagguaacaagaggcuauuggaauauuuccagauagaaagcagaaugccaaucccagaaaugcuguugcugcuuuucugacuccuaaaguugaacaguauuccuccaaguuaggagaggucuuagauuuucauuugcaccaaauguuauugagguaauuuuguuaaccacguagaucaugaagaaaucuaaaaauggagucagauuaagagcucuuaucggagcacauaugaguaaagauguucagguguaaauuaacuucuguguucugauguugccagaagagcuaaaguguuugugcuugcuuuuaggcugccuuaagaccaacugauguagugcuggaaguuggaccuggaacuggcaacaugacuguaaaguuguuagaaaaggcaaaaaagguagaaaggggauuuaauguuugguaucacaaaugacuauguuagcaagcucaguugguuuacaaucuaaauauguuuuaacuaauugcuauuauuuuaguaguaacuccugaucccuuguuggaaauuuugucuuagaaaauaugagauauuucagccaggcgcgguggcucacgccuguaaucccagcacuuugggaggccgaggcagguggaucaugaggucaagagauugagaccauccugggcaauauggugaaaccccaucucaacuaaaaauacaaaaauuagccgagugugguggcaggugccuguagucccagcuacuugggaggcuggggcaggagaaucacuugaacccggaaggcagagguugcagugagccaggauugcaccacugcacuccagccuggugacagagugagacucugucucaaaaaaaaaaaaaaaaaaaaaggaaaauaugagauauuucagugaggaaaacagaaaccacauuagguauuucaacagggaauuuuuuuuuuuuuuuuuuuuuuuuggagagggaauuucacacuguuccccaggcuggagugcagagaugcaguccuggcucacagcaaccucugccuccuggguucaagagauucuccugccucagccuccccaguagcugagauuauaggcaccugcccccacaccagcuaauuuuuguauuuuuaguagagaugcgguuucaccauguuggccacacuggucuuaaacuccugaccucaggugauccgccaacuuuggcuucccaaagugcugggauuacaggcaugaaccaccaugcccagccucaacagggaguuuaauuaggaaggaaauacccaacgccuccccuuuguacccuauaaugcuggugccuuucacuggccaauuccaaccagaaguugaaagguaagggagcugaacugcauuaucuguaggaugcagagaaaagcggauaauagaucugggagggccuuucaugguggcucacaccuguaaucccagcacuuugggaggcuaaggcggguggauggcuugagccuaggaguugaagaccagccugggcaacauggugaaaccccaucucuacaaaaaauuggcugggcaugguggugccugacuguagcccuggcuagcagggaggcugaggugggagguuuaccugagccugggaaguugaggcuccagugagccaugauccugccacuucacuacagccugggugacacagugagacccugucucaaaaaauaaaaauaaaacuaaagauagaucugggagccaaacagaguaagaaacacauuguuuaccauguaaacagggucuauauagaaguagggccaggagcuguggcccacaucuguaaucccagcacuuugggaggcugaggcaggaagauugcuuaaagcuaugagcuugagaccagccugggcaacaaagcgagacccaaucucuauaaaaaauaaaaaggcugggcauggugccucccgccuauaaucccagcacuuugggaggccaaggugggaggauuguuugagcccaggaguuuugagaccagcccgggcaacauagagagacccgucucuauuaaaaauaaagaaaggaaauuagccuggugugcugguacacaccuguggucccagcugcacaggaaggugaggugggaggaucccaugagcccaagacuucgaggcagcagugagcuaugauagcgccacuucacuccagccugggcaacagagugagaccccaucucuuaaaaaaaauuauuuuuuaauaaaaauaaagucagugaaaccucagcugaaauugcaauaaaauuucaauuucggccuuauuugacauccauuuucauuuacuugagaaguuaucuaugccauguauuguguaucucaguagaugugacauacuaacaguaagagcaauugcauuguacgcucuucucuaacaacacugacugcagagacauguaguguauuuuuuucaucaucuguugaauuacaaagcauggagacagaugaaacaugauucuauugauuauaugaguagaacucucacauaaucugguugucuacuuuucuggguggugguguuuguuuguuuguuuguuuguuuuugagauggagucucgcucuguugccaggcuggagugcuguggcgcgaucucggcucacugcaaccucugacucccugguucaaacaauucuccugcuucagccuccugaguagcugggauuacaggcacgugccgccacgcccagauaauuuuugaauuuguuaguagagacagaguuuuaccauguuggccaggcuggucucagucuccugaacucaugauccgcccaccucagccucacacccggcuuuuuuuuuuuuuugagauggagucucacuuugucacccaggcuggaaugcaguggcacagucuuggcucauggcaaccuccgccuccaggguucaagcaauucuccugccucagccuccugaguagcugggauuacaggcgcccaccacuaggcccagcuaauauuuuguguuguuuuuguuuuuguuuugagacaagagucucugucucuugcccaagcuggagugcaauggugcgaucucgacucacugcaaccucugccucccaguuucaagcaauucuccugccucagccucccgaguagcugggauuacagaugcccaucacuguacccagcuaaauuuguauuuuuaguagagacgggguuucgccauguuggccaggcugguuucgaacuccugaccucaggugaucugccugucucagccucccaaaguguugggauuacaggcgugagccacugcaccuggccuaauauuuuguauuuuuaguagagaugggguuucaccauguuggccaggcuggccuuuaacuccugaccucaugauucgcccaccccagccuuccaaagugcugggauuacaggcgugagccacugcacccggcccauuuuuguuuguuguuugaaguaugcgaguauaauuaaaggaauauugaugguagaaaugggagaagaaguuugucacauaaaucauguaagaguuccuguugggauaacaauaaaagauuuauauuccauaauuaaccuaaauaauuuuuauuuuuuuuaaauuagguuguugcuugugaacuugacccaaggcuaguagcugaacuucacaaaagaguucagggcacgugaguauacauaauagaauuaaagugcauuucaaucucaugaaacaacauucuuuuuacauuucuucuuuucucaucaggccuguggccagcaaacuucaaguacuggugggugaugugcugaaaacagauuugccauucuuugauacuuguguggcaaauuugccuuaucagguauguccucacauuuucaggaacaucauacuaacuguuccucugaugugucuuucccggaaauaacuaguuaauucucuuacagaucucuucaccuuuugucuucaagcuguugcuacaucgaccuuuuuucagguuugugacaaaagacuagaguuacugccaaauuuugaaagacuuacaguucagguggugaacauagccaaaaaugagucaggucaguugaaaaacuacugaagaauuuuuguagaaaauguugauuuguauggaggucuuucucucuuuaauugagagguuauuuggggguagugugcuggaaguccugcuucugagaccagacagccuuucccuauuuuugaaucuuccugccguuaagucuagguuagaauuuuuauuaccuuaugucuagacaauugcagugguuuccuaacuggucucuaguauaagaggucuucaaaaaguucauggaaaauguguauuaugaaaaaaacuugcauggauuucaaaauuuuuuugcaccaaaauaaacucuguacuaacugagcaggaucuagugugaggcacugagaaggauaagacaucaguuugaaaagagccccuaucagagcaacaugaacucugcuaaaauucaaguaagaacaaacauccaauuuauggugaaaccugguuggaagaauggugaaaucauugaugcuuuacaaaaaguuuauggagucacaccuguaaucccagcacuuugggaggccaaggcaggcggaucaugaggucaggagaucgagaccauccuggcuaacauggugaaaccccacaucuacuaaaaauacaaaaaacuagccgggcguaguggcgggcgccuguagucccagccacucgggaggcugaggcaggagaauggcgugaacccgggaggcggagcuugcagugagccgagaucgcgccacugcacuccagccuuggcgacugagcgagacuccgucucaaaaaaaaaaaaaaguuuauggggacaauaucccaaagaaaucagcaguuuacuaauggauaacucauuuuaagaagggcugagacaauguugaagaugaagccuacaguggcacacuggccauaucaauuugugggaaaacauucaucuuguuuguucccuaagugacgaggaacaacauucaacagcacaaacaauagccaacaccauagacaucacaguugguuuagcuuacacaauucugacugcaaaaucaaaguuaaacaaacuuuguacuugauagaugccaaaacugucauacccucuuuucugaaagauuuuaugaaaaaacaaaacaaaaaacauuguacucaaaucagcugcagauaaaagcagagcuuccaguggaaauuuuacauaacugggaucaagauccugaaacauggcuggguggaguggcucacaccuauaauccuagcacucugggaggccgaggcgggcagaucacuugaggucaggagaccagccuggcuaacauggugaaaccccaucucuacuaaaaauaaaaaaauuagcugggcauuguggugggcaccuauaaucccagcuacucgggaggcugaggcaggggaaucgcuugaacucaggaggcggagguuguagugagccaagauugugccacugcacuccacacuccagccugggcaacagagcgagauugucaaaaaagaaaacaagauccugaaacauuucuucaaagaauuacaaagaauuguaauggagaugaaauauggcuuuaccagugugauccuaaagacaaagcagagugaaagugaugccuaccaagaaacggaguggcuccagucaaagcaaaagcagaccagucaagagcaaaggucauagcaacaguuuuuuuuugaaugcucagggcauuuugcuugcugacuuucuuuaggaccaaagaaugaaaacaucugcuuauuacaagaguguuuugagaaaguuagcuaagauguagcagaguaacuccugggaaagcuuccccagagauuccuccaccauaauacuucuacuccuuccucucaucagacgagggcaauuuuucgagaguuucaaugggaaaugguuagguauccaccuuacaguccugauugggccccuucugacuucuuuuuauuuuaugagacagucuugcucuggugcccgggcuggagagcagugguaugaucugcacucacugcagccuccacuuccugggcucaagcauuccucccaccucagccucccaaguagcugcgauuacgggcaugugccaccacacccagcuaauuguuguauuuuuuuuagagaugggucuugccauguugcccaggcugucucccccuccugagcucaagugaucugcccaccucagccuccccaaaugcugggauuauuacaggcaugaaccauggugcccagcccuucugauuuauuuucguuucccagucuuaaaaaaucuugaaagggcacucuuuuuucuucaguuaauaauguaaaaaaaaaaaaccugcagugacauggcuaaauuccccagagccucaguuuuuuugauauagacuaaaaugcugguaucaucacuuacaaaagugucuugaacuugauggagcuuauguugaauaauaaaguuuauguuuuuucuuuuuuuucuuuuucugagacaggcuggaguacaguggugacaucucaggucacugcaaccucagccucccugggcugggcucagaugauucuccuaccucagccucuugaguagcugggacuauggggguguaccagcaugccuagcuaauuuuuguguuuuuuuuagagaaggggucucaccauguucagcccaggcuggucuugaacuccugagcucaagcgaucuguccgccuuggccuccuaaagugcuguggauuauaggugugugccgccacaccagccuuauuuuaucuuuuaauucaauauuuccaugaacuuugaagucacuuucuauauuauauacuaguggcuuucaaacugcaagucaaaaacuagugguuauaaaauuaaugagucaugaccauucuuuuuuuuuguaaucacauggaauagaauauaucacagggcauugcauguaguccaggugauuaugguuucaugaaacuuuuguuuugaaauacaauauaaacacauauacauacagacauuuguggcuuggcuugcaaugccaaauguauuuuuagugugacucauugucaaaaguuugaaugucaaaguguagcuuugaagauacucuucuguucguuaaccccuacaaagucuuccccauugccugcugaauaaaaagucuacaucuuuuggcuggguguggugacucaugccuguaaucccagcacuuugggaggcugaggugggcggaucaccugaggucaggaguuccagaccagccuggccaacauggugaaacacugucucuacuaaaaauagaaaaauuggccaggggugguagugugcgccuguaaucccagcuacucgggaggcugaggaacgaggaucacuugaaccugggagacggaaguuguagugagccgagauugcgccauugcacuccagccugggcgacaagagcgaaacuccgucucaaaaaaaaaaaaaaagucuacaucuuuuaacccgucaaaucaaggaaacauugaacgucacaaucugccucuucagucucaccucuuccuuaaagguguuugcuaccccauaaauauauuacugcuacugaaacaauuuuauuucacuuuguuuucauagaagaggugauggacuagugcugauuugaaacaucucauccagucauuaaaggcuuauauuugcaagcuaucuugccaugaggaguacagcaauuauaaaaacaaagccagcucucucauucuguggcaauaaaaaaaaggcugaauguguucuccuaccuuauaaucagcugccaaugcuuugcuauuucucucccaagaaaauucauugcaguuaaaauucauuuauaguugacaaugaccauuuuccuuauuccuuucugcuuucuuuucaggugugcuauacuuauguuucaaagagaauuugcccuccgacugguugcaaaaccuggagauaaguuauacugcagacucucaauuaauacacagcuguuggcacguguggaccaucuaaugaaaguaagugaauuuuguuuucuuucucuuuuuucugagauagaaucucacucugucacccaggcugcagugcaguggcucacugcgaucucugccucccauacucaagcaaucuucucgagucccgaguagcugggacuagaggugugcgucaccacgccugacuaauuuuuugguauuuuuuguagacacagaguuuugcuauguugcccagguuggucuugaacuccugggcucaaugauccaucugccuuggccucccaaaguguugggauuacaggugugagccaaagcacccagccagugauuuuuauuauugaaauaaucuagcuuaauucauccuugagcauccaguugugccuucugugaggauagcauaucugguuacuaaauaaaaguugccuuugugaguacuacuuaaauacuuuuucauuaacaggugggaaagaauaacuucagaccaccgcccaagguggaauccaguguuguaaggauagaaccuaagaauccaccaccacccaucaauuuucaggugagguuaaaauacuagcucauucaauaaaggaaaaaaaaguccaggcgggaagaugugugccuauaacagcagaaaaauauugaaucaaccuaaauauucaaacauaggaaaauguuaauuaggacacaucccugugcugaaguagauggaauaauuugaugcaagguaguuuugaagugagacccagucucaaaaaaaaaaaagaaaaaauggaauaaaacuaggaaaacaagguaaaaugaaaauaguuguuuuaaaguaguauuauggguaacaucuuuucauuguaauuguuuuuugagauuuaaaaacaagaaagaagaccacuugauauaaaaccuuacuacagccacauuagagaaaaacgugauuguguguguggucaacuggugguaaauggagugguuugucaauaacuccuucaaggagguuuagguguguuacacaggaaguaucugaagucaugucuguuuugaaucuuauuuuugaaaaugauacuuagauuuaaauaaacgccauguucuuuguucagaugugggaccauuuuguuuuuccuucccuuucuuuuuuuaagaugggguuucacuauguugccuaggcuggacuugaacuuuuggucucaagcgauccucccaccucagccuccugaguagcugguacuacaggcaugcagcacugugccuggcuuuauuuuuucaaauuaaaaaaaaaaauugucaugcuuugucaaaaaaaaauucugaggaaaagacauauucagugaaaugcgccaaagugcaaaaaucaaauguaugucuuacuuuugcaugugugugccagccagaucaagauuacagaacauuuucuucacuucagaaaguuuccuucaauuguauauauuaaaagacaaaauaauaccuagugggcauagacaagaacaagaaguuuguaauuugaagaaaaugucuaucuucuauuucaggaaugggauggucuaguaaggauaaccuuuguuaggaaaaacaagacacucucugcugcauuuaaguaaguauuacacuaauuucuaauguauaaagggccagugcuccagauacuaugcuagaauuugguccuuuuccugagcagcuacccuaaagcauaaagauuauggguccagacaaacuucaccuuuuaaacuaucuuuagagcuugggaggcucuaaagcaaacuuaaugaagaaaguuugcuggaguugagagucagaucacauuuuuuggcaaaacaggaaaacacucccaaacucugaccauauaucugcucuaguuuuuuguuggaaaaaugaggugaugauggaccccuuccacacuugugaaggauaugugucauguaauuaaccugggaaaaugcagcucaucaauuugggguucaaggguaaaagagaggugagacacaguuuuacagggcuuggagauuuuuuuuuaggggauuuuuuguggagagucuagaacuucucuaagaauuuaagagguauuaggauuuugcacuuuaaauauauuuaguguuugcuucauaaguuuaaauauucaacaacuuuuaaaauuccuuaauuucaccauacagaauauagauuuaauuucaucuaaaaugaaauuauugcuuaaauggcuuauguauuaguuaaaaaaaaguuuaaaaaaguaagaaauuacucugacuuuggaauaauaacaguggcaucacuucuuuaugcuauagaucaagugcagugcaacaacucuuggaaaaaaacuacagaauucacuguucaguccauaauauuguaaguuagaaaauguuccugcaguuucauugauuuguuuucuuuuaaaauguccauuuuuauucuuguugaucuagcaugagauuauuuuguacauuccauaagauccuuaaaagacaauauauaauguauaacuagcacaauuuugacuugaauucugacaggucagugcugcuguguauccugugaaacagauaugagcaacuuugauuacuccacccuguccucuaacuacugacaguuguuuuuagccauaacaagaaucagauucagcaguuacagguuccucaaagcuguagauauguguagcuugcacaacuuaaaauaauuguguaguuuacuguccucugaauugugaccacgucuuguuucuugcucacauagcaguuacaaauauaguuauuacuuucuuuguauagaaauugaaauaaaguucauauggcucaauagcagauuucugguugugagccucaugcguaucauuuguguaacagugugugcgaugugauguuugcuaucuuuuuagcuuccaguuuaauuagaacagagagagaaaggccaauuuucuuuuuauuuuuuaugacucagaaccuauaugguuuaauguaucacaauacuaucuccauuuucucuuuuaugggcaaaaagucauuagauaaucugccuaaguauaauagaaaaauauuaagcuagauuaagaaaaauauuuggauaaaauaugugaauuaaguguaaaauccuuuuggauaaaauaugugaauuaaguguaaaauccuuaauauucccaaggcuugggcaggucaccucuuugagaaaaaugaggugguuaaggucaaaucuguaggaagaaaaugcauuauuuugaaaggaguaacaauugcuuuaaaauuuaauuuacaguuguaauuauuugugaagucugaaacuaauaacuauuucagaauuuuaaagaagaaaauggcuaauauagacaggauuacuaauucaagguauuccaaguuuuuguuaauaaagaucagccacuuuuaauuagagauccaagucuuaauguaaaaaucaggcuuuccaaagucucauuaacagauauauuaaaggugacuauuuuaugacuuacugaacuaaaaaaaagagucaaggugaccucauuaaagauaugucguucauuuauucugaaucuuauauugauagauaauaccagaagauuucagcauagcagauaaaauacagcaaauccuaaccagcacagguuuuagugacaaacgggcccguuccauggacauagaugacuucaucagguaauuacauuuuuguuuuccuaaguguuuacauuucuuuacugugacaccuucagauuggagauuuuaaaggcuuuuaagcgguauaaggugcuaccugggagaguuauugcauagcacuuccauggcauggaauaguauuugguguagaagauggaggcuaguuagcugcagcagaaugaacauuuucuuuaagaacaguaguaaagaacaguccgagccagaagauugccuuuguguuaauguggugugcagguuccaauguggugugcagguuccucccuuccugcuccuuccccaacucucauucauagucuuagucuuaauagcuuaucccuccaaaauaguccauaagguagaaaaaucauaauacauguaacuggaucugauuuuuaaaauuuccuuacugggaauagcuguuguuaaaucaaucuuaagcauacaauaaugccaguuagaauccuaccugguuauccauuuaggaauaauacaguuuuguagccugaagcaaguucuacacuucucaaguaaaaagcugucauaauuaucuagguaauuuagaccaaaauuuguuuugcuugaauuaagcaaguaagucuuaugaaaacagaauaaggcuucaauuaauuacccagguaauuacuaaccuguacuuacuguuuuuaaucauuaagauguuaacuuucagaaggucuugccuauuuagccaauucacuuuuaaagcuuccauguucuagaggcugaauaaaaaaugagaguagauuguucuaaaagucauugguuugacuuuuucuaagcuggaaacacaguucuauauaacuaagacaaauggaguuuauauuuuauuggcuggcuagcaguacuacugagucauuuuagauguuaauccuaggcauugaauacuauucauaaauaucuacuuugcuuuuuuagaaauuuaucuggaccuguuucuaugggccagccuaaacauaaccucaggucuaaagagaaauauuuucucuuuuucuucauuuucacuaaauuuccucaaaguuauugggcaugugcaguuuacuaacuagaaucuauuaaguacauagguaucuacagagagaaacaauguguauuuaauuugaauauaaacaacagcucaagagaggaagaaggggcauguaagauugguuuuucaucugacuucugccaauuccaaacagcuucuuguucaguuaccuugaaacaaaugccagugaguucuuaggccugggauaaugaaagucuaagauaauuuuagucaaauucauuacgacauaaaggcucuaaugaaagaggcaccaacauggcaugguuuuaaccaauacauaucuuauaaauuuagucagacaauaacauuucuuuuuuuuuuuuuuuugagacagagucuugcucugucacccaggcuggacuccaguggcacaaucucagcucacugcaaccuccgccuccuggguucaggcaaaucuccugccucaaccacccgaguagcugggauuacaggcaugugccaccaugccaggcuaauuuuuguauuuuuaguagagacgggguuucaccauguuggccagacuguucucgaacuacugaccucagguaauccacccgccucagccucccaaagugcugggauuacaggcauaagccacugcgcccagccaguaacguuucuuuaauaacuaguauuaggagugggugggcucuguaagcaugcuguauucauguuuuaguauuaaugguauagaacuauauaccguuaugugcuacaaauuagcuuuucaguaccauuccauuuugauuucuuuuuucagauugcuacauggauucaacgcagaagguauucauuuuuccuagguauuuggaaaacagaaauuuucaaggucaagaaaagaaaugaauuuuguauuuuuuguauuugagaagauaaugcuuuugcuuuacugagacauuauuuacuugacuauuuuugguucaauacuacuacuguugucaccauuuaugauucugaauuuuaaaguuggaaaguucuaaguaucaaaguuuuuaauauauaaugcugguccaaucuauucauaauaaucuucaaguucaggagccgcagagacgcacaacuuuacacuuaucauuucuaacaguuuauuguauaaagauguuacucuucuauuuacuguuauauacuguaaggccuucuuuaggccuuuagcucuguuccuccaguaauaaaaaaguuaaaauaugcuucacuagucacacauuccccauaccauuucguguuauucacauuccccguaccauuucuuguuauucacauguacaguaaaacaauuguuucuuaaauuauuuuuauuuugguucucucauucucuucccuauuuauccuauacagugucuguuacgauugccuaccucuuucgcuauccuauagcgucagagacuuaggguucuggguaagcccaagucugcuacugccaccgugcagugccaggcauauuaaagggcaugacucccaacauguaaaaugaggaagcuaaacuggaaugaaauuaacaauaaaauuaucuuuuuuuaugguucuuagggagauaacuauaggcuuagcaaaauuucagaggguuuuguaauugaaacugguuucaacuucagaaaaacagccauuucccauaacuacagguucccaguauuccuaugauuucuggacaauuaaaauuuccaguuccuuuuucauauaccuggugcuuaguuuuaagcuauuuuaaaacugucagacugagaauuucaauagaugucauaaacuaguuuuauuagcuacuauguuuaagucaauauaauacuaagugcuguuaauauacuauaauagaguuauaguagcuauuuuguuucuauaaaaaauuaauaaaaauaucuuuauugauauuuggcuuuuuuuaauaccuaacuuaauagaagaguguuuccaauuaauuuaacaaagccagauuuugaaaucuggcuucaaagucauaguaaauguuacuacauaauuaaaauaaugcuuguucuuaauguauaauccagaacaaaggcaucaagcugcuuuuguuaaacaaauaugaaauaauauacauuaagaguagauuuuuuuguuuaauuucacaaaacuauuuugcagaguucacuuguaucaucucuauccuuauaguaaaaauuuuaagauuuaacucggcuuucucagguuauuucccucuaccccuaugaacugcugaguuuuaguuccuuuucuggccuucaguuuucacuaucuguaaagcugaaggacuguauuauauuaccuccaguaucuuuucugguacuaauuuuuaaaauaccugaucagaaugaagccaucauaguguaaggcagcauauuugucuauaaggagacuuuccaaagacaguacccauccaaugcaaauaauaaauuugaagcuaaucaucuguugugcuuuaaaa

SEQ ID NO: 17402 - RNA, 928 nt, Homo sapiens
gagccugccggagcugcaguugccagcgacauguucaagguaauucagaaggguccguggggccagccagccggagcuuguucaccuucagagucugugcagcaccgaaaaaggacucaccucccaaaacuuccgugaagguugacgagcuuucgcgagggcaaaucgcaguguguggaggagucaaggaaccagcuugaagaaagcuucucacagcuccgacacuuauugcgagccauacacaagcuggugucaggacacguacucccaaaguaagcccaagaugcaaaguuugguucaguggggguuagacagcuaugacuaucuccaaaaugcaccuccuggauuuuuuccgagacuugguguuauugguuuugcuggccuuauuggacuccuuuugacuagagguucaaaaaugaagaagcuaguguaucugccugguuucaugagauuagcugccucccuguauuauccacaacaaaccaucguguuugcccaggucaguggggagagauuauaugacuggaguuuaagauuuguggaaggagaacuuucaaaagccaggaaaugugaagaauucaccuggaacuaaguagaaaacuccaugaucugcccaucuuaacuuauuuaaguuaccuauauuaaguuaccuacaacuuaaucaguuauagguacacauuggaaacuccacagaguaaaucaguauuucuacagaaaaaugucagagaagucaguauugaauguauuaaauuggcuuucuucuucaggaaauacuagaucagaccucuguuaucuugggugguaccauccuacacgcaaacuaaucugaaauccuuucaccuagggauaauguacaaaccuuagaacuccucguuuucauguugcuauuuauuuacauaauuaaaacccaaauuaaaaaaaaaaaaaa

SEQ ID NO: 17403 - RNA, 7826 nt, Homo sapiens
ucuuaggugucucugugugaucauaccuguacaauuuaggaagaagauugugcuuuuguuuugcuuuuacaauuaacagaagauccaacuauaagguauuuaaaugaugaguuggacuuuauuuuccucaaauaacaagaaguguggagguggacagcccaagacugaucccgcugcucugagaugcuaucaguugcuuuggaucauccuguuccaucauucuuagcaugcagcuucaagcuuccuguuugcaagacugcuccagacaggaagaagggggaaugccagucuuuuccuugagacccuuugucuuuuuacuuggaaagggaaguguuucccugugacguccacugaccagaacauggccauugcuggcuggaacguggcuaggaaaacugaguacugauguuccuugaauuaggaugggaucacacccccaguaaacccaucguguguuggaaauaccaugaguugacaaugcauuuaauagacuuaaacuaccaaacaucauagcuuagccuagccucucuuaaacauguucagaauaccuacaucauccuacaauugggcaauaucaucuaacacaaagccuauauuuuaauaaaauguuaaaugucucauguaauuuauugaauauuguacugaaagugaaagaacagaaugauuguauggguacuugaaguacgguuuccacugaauaucuuucacuuuugcaccaucauaaaauuaaaaaauuguacauccaaccauaguaauucagggaccaccuguauuuagcuuuagccucuauguuagagaaagguaaggaaaaaugugguugaaauuggauaaguaagccauccuauaguagucagagaaacauucuggcauuuuugaaguacaagaacucauuacaggcuggcuguaguuguucacaccuggaauuucagggcuuugggaggcugagauggaagaauugcuugaggccaggaguucaagaccaucuggagcaacauagugagauccgaucucuaugaaaaaaaaaauuaggugggcauggugguacauaccuuuauucccagcuacuuggggauacuugggaggcugaggcaggaagaucccuugagcccagaaguucaaggcugcagugagcuaugauugugccacugcacuacaaccugggcaacagagcaagacccugucuccaagacaaaaacaaaaacaaaaaacccaaaaccaaaaacucauauauacuuccucuuuuuaaugaaucagugaauuaaaccuaaugauuaauagauggccccaaaguagcuaugcuuggcaaacaauuguaucucaacagaguuuucauaacaauuuuauuaagaagcacaauguuucauaauguuuuaguucaacugagagcuagggagugaagaacauggugggaaaagggaaaaaguagaaucucuucuuuucccugagcaaauggagcaggcuugacuucagcucacugggcaauaacccuugggcuaagggagagacagauaagccacuuagggugauuugguaugagccucugauaaaaaucuaaaagaagcucuccugaaaguguauuccaauucaaguccucucugggaauucuacaugugcuuauggugacaugugccauggaaauagaguggccaauuugguugccaagacauuugccgcccugcucugaagguuucggcaacaggugccaugcuaucuucccugucugcugggaucuaaauugaguguuggguaaacuuggucauauggcugggccucacagcuucaauuuuggauuaggugguuaauucaucacaucccagcaaucuaaugguuaaaauaugaguuuccucuaccccacaugaccagaucugcucucuucccuccuucccucucccuaccugcccagugggcucaggauggagcaagaaggaauuucuaagcauccuuccugggcucccaaaggcuauccuaucaaguuagccagacucccuuuagcuggacuuguguuugccuuauggaaauaacuucuaggagauaauguugaauagaccuuucacagacaggaggaaagagaauauucaggcaguauaaaccccaucauaaggcugaggauagcagaacuucaggacaugugacgcuggggccaggauagagaugaagauguuaguuaucuuuaggauaagauuguuuacggaccauuuuaugaaauccugaaaacaguggauuauaaaacaaagguucuuuuuuguaucuguuuguucauuuuuagagagagagucuuguucugucacccaagcugacgugcaguggcacgaucauagcucacugcagccuugaacuccuuaguucaaaggauccucccaccucagccucccuaguagcugggacuacaggcaugugccaccaugccagucuaauuuuuuuauuuuuuguauagaugggaucuugcuauguugcccaagcuggucucaaacuccuggcauaaaccucccaccuuggucucccaaagcacugggauuauaggcaugaaccaccaugcguggcccaaagauucuuuaaaugaagcagccucucaggauuuauuuuaauuguguuauggguagcuucucucugaggaaaaaagaugaaaaauaagaaaaaaagaagaaaucaauaucaugcacaaaccauauuuuuuuuguuuguuuguuuguuugucuuuugagacagggucuugcucuauaacccaggcaggaguguaguugugcaaucuuggcucacuguagccucaaccuccccagcucaagugaucuucucacccaccuucugaguagcugggaccacaggugcauaccaacacacccagcuaauuuuuguauuuuuaguaaagacuggguuuugccauguugcccaggcuagucuugaacuccuagacucaagcaaucugccugccucagccucccaaagugcugggauuacaggcaugagccaccacacccagccaaccauaugauuuaaucuucacaauaauccuaugaagagaaaucuacugagaaaaguggugcucagagagguuaugcacuaccuaguguuacacagcugcuguggggcaggucagcaucuguaaaaucccacaugccuuugcacgggaccgccuuucagaguccuuaucuagcugacuuguuagagaaucccuaaacuuagaaguucccuaaccuauucaggaaagacaucgcuaagcaacauuuggaaggagagauggugaagaagugcccuuuguccuucagaccgaaagcaccaggcugacagccccuuuaggggaaaacauucuuauauggaccaaaauggcuguggaguucagcuaaagucacuuuccuaguuccaucuggaagcucuucaccagcauaauuucauuccagccaaauguaauuaagaauuugauuugauuaaaaaacaaaucgaaggagagaaaugagguuucuccucauucccucccuuucuucacaaauagggcacucauuaacaagucacgugcaggugaccaguucaagggagcugcccuccccacuuggccacacuuccuaaagaacaauggcuggaggggggcgaaaggggggcaagggggggcaauuccugccagaggucaagaaacucagcaaauaaacgcgaaggauuuuuaaguuucuaauuuggcuucaagauacuagcaaaacacagcagcugcacaaccucuccaggaacaagauguccacuuaauuaaagcauggccaggcggugggugucucccagggagugagacucagcaauacuggguacugaucaaacuagaccugcugccaagagaaacaguggucagcagggauccucagcucaccucuuuggaaaaacggggcuccaaagccaauuuuggaaaaaaaaaaaaaaaaagaagaggaaaaaaguagagugagaggaaaggauuugugauauuguauuauuggccacgacucaaauaaucugccucugaccuacuccaucuuaucucagaggcucuaaugagaauuguguggugagcuuuuuauaaagggcaauuuaaaaugagaacagggagguuagauacuaugugggaugcuccugucggauuucugcccagacacacccucucgucagcuccccugcucgugggaauacuccuuuauucauuucugaaucugccucuuucccccucuuugaagaagccccuguaguauaagucuacaugaaaacuaagcugagcagaagcugggaccacuuuccaaugcuccuauguaaucaaauuaagacagcaguuacugaaaagagguggaacuuauaagaaaagcuccagaauguaggacgauuacagaaugggacugaagcaggacuccuacggcuaagguggugguuuagcugcucagcaaugccacgauggacgcaggcuuucuauucuuccauuacaucauugcuagagcauugccuuuugucuucauguuuggugacucagaugcaagacgguuacugcagguccaaaugccauguguacgcucaaggcagagaacaggguaaaagagaugguguuaguccugucuguuucaucuuaucaggaaagcaaaaaccuuuccugagaucccagaaaacuacuuauauuuuauugaccaaaaaccaccacauggucaccccuggcugcaaaggagacugggaaagugaguauuuaucuggaaaccuggcugaucuggucaaaacuggaauuccauuuacaagaaagacggggggaugaauauuaaguagggaauaaacagugucuucuguaggagcuuagacuacugcguaauagcaaggucuaguaaaggaaauaaaaaccacucuagguguaucaaacagagagaauucaaugcagggauuuugcugugguuguugggcaaaaagugucagaagggccaaaggcagguggucgggggaggggggaagaaaaaugaaguuacccaggcauuaggaaucacaggaagcaggaagucccuaccaaccuuaggcugaagggaauauagaaauaaauuguuuuauugugcuucacuuuauuacacauugcagauguuguauuuuuuacaaauugaagguuuguggcaauccugucuccagcaagucggcagcauuuuuccaacggcauguucuccuucaugucucugugucauauuuuggcaauucccucaacauuucaaacuuuuaaauuaucauuauaucuguuauggugaccugugaucagugaucuuugauauuacuauuguauuuguuuuggggugccaugaaaccugcccauauaagacggcaaacuuaauuguuaaauguuguguguguucugacugcuccucugacuggcuauuccccauuucucuauucccugagauacaacaauauggaaauuaggccaauuaauaagccuacacuagucucuaaguguucaagugaaagaaagauuuguacaucuuucacuuuaaaucaaaagcuagaaaugauuaagcuuagugaagaaggcacgcugaaagcugagacaggccaaaagcugggccucuugggacaaacaguuugccaagcugcaaaugcaaaggaaaaguucuugaaggaaauucaaagugcuauuccaaugaacucaugaaugauaagaaggugaaauagcguuauuguugauauggagaagguuuuaguagucugguuagaagaucaaacuagccacaacauuuccuuaagccaaacucuauuccagagccaggcccuaacacucuuuaauucagaagggugagacaggugaggaagcugcagaagaaaaguuggaagccuagcagaaguugguguauaagguuuaaagaaaaaaucugucuucauaacagaagugcaaggugaacaagcaagugcugauggagaagcugcagcaaguuauccagaagaucuagcuaagaucauugaugacaguggcuacauuacagaguuuucaaaguagaugaagcagccuuguauuggaagaauaugccaucuaggacuuucauagcuaaggaagagaagucaaugccuggcaucaaagcuucaaagaacaggcugacucuuuuguuauggacuaacauagcuggggacuuuaaaucaaagccaaugcucauuuaccaaauuucaaauauccugaggccuuuaagaauuacgagauaucuacgcugccuaugcucuauaaauggaagaacaaagccuggaugacagcacaucuguuuacagcaugguuuaccgaauauuuuaagccugcuauugagaacuacugcacagaaaaaacauucauuucaaaguauuauugacaauguaccuggucagagacaguguaccucuaucagagcucugauagagauguucaaagugauaaaucuuguuuucaugccugcuaacacaacacucauucuguagcucaugaaucaagaaguaauuuugacugucaagucuuauuauuuaagaaguaaauuuugcaagacuauagcugccauagguagugauuccucugaugaaucuggguaaaucaaaaaccuuccagaaaggauuuaccauucucgauaccauuaagaauauucauuguucaugcgagggacuaaaauaaccaacauuaacaggaguuuggagcauugauuuggaguugauuccaacccucauggaugacuuugugggguucaugacuuccauggaggaaauaauugcagauguuguggaaauagcaagagaauuagaauuggaagugcagccugagggugugacugaauugcugcaaucucaugaucaaguuugaauggaugagguguugcuucuuauggaugggcaaagaaaaugauuucuugagauggaauauacgccucaugaagaugccaugaacauuguuaaaaugacaagauauuuaaaauauuacauaaauuuaguuguuuauguaaguuguuuauguaagcuguuuauggaagcaguggcaggguuggagaagacugacuccaauuuugaaagaaguucuguugugggcaaaaugcuaucaaacagcuucacaugcuacagagaaaucuuucaugaaaaaaaaagagucaauugaugcaacaaacuucacugcaguuuuauuuucauaaauugccacggccacucuaaccuucagcaacuacaacccugaucacucagaggccacccacauugaggcaagacccuccaccagcaaaaagauuaugacucacugauggcucagaugauuguuagcauuuuuuagcaauaaaguguuuuuaaguuaggguauauacuuuuauuuagacauaaugcuacuaccgcacacuuaauagucugccacguaguguaaacauaacuuuuauaagcacuggaaaacaaaaaauuucaugugacuugcuuuauugugauauucauuuuauugcgguggucuggaaccaaaccugcaauaugugugagguaugcuugcauaauguuacacaaaacucaggauuacugaacuccugaacugcugggguauaccugcugcugcugcuguugcuccugcugcugccaccuuagggaagccagaagccugugcucucauugacauugcagggacccugggauccuguggcaagagacagagaccauaagcacuaagcugccaaagcugcugccacuacuguccaggaacccaagagugucccccuggccugcuacugcugcugccacugaugauaccagaaagaacaaaaagaugccuucucacuucaucccuguuuccagucuccugacagugcugacauuggcagaagcuaacuggaagccagcuggugcgggaauugaccagggaaauguuugcagccuuc

SEQ ID NO: 17404 - RNA, 268180 nt, Homo sapiens
cuggagcauuaccccuacugcgggucccgcugcuggcagcgcuggaaacuggguggacggcauggguuggucucaggauuuguuccgcgccuuguggagaucgcugucaagggaagugaaggagcacgugggcacggaccaauucgggaacaaauacuacuacaucccgcaguacaagaacuggagaggugagguggcggcgugggcagcgauugcguggucagugauugcgaggucaguaaaggagggaaaagugagagccccuagucaacuaacgcaucaugcgacacuuagggugucaccggagagaauuucccgaguucguucuccccugucgaccccuucacucuggcaucggagcccuacccggcccggcucugggcgccuuggcccggccucgugcguccgcggucccuacuacccagcgccuucccccggcgugccccgggcugcuugcgcuguuaaggcgcaccaccacuuuccucccagccacgccuguagaggagccucaguuuuagcccuggacuggcgacggaggcagggaaaaguccacggaaaucuuucaccaaaggggcuagaagggccaggggagggguuuuucguacgcuguuccccgccuugugacccagagcugagugguguaauugaagaggaguaucuucagcgccucggcugucuucuuucuugguguuuacccuuuucgguggcacccuggcuccggcgcuggccccaugcgccuuccuuacuaccaagacuugucagaaguagguccauauccccacaaggcucgcugauuccuuucucgggaguugacauuccaagaccccguugagcucaauuuaagaaacguggcaauaaucaugguguuacuguguaggauucgugccaaguaguugagcggguuguuuggggaguaaggaggcguugcuguccauugaaaucacacuguguagccgccgucguaaccucuucuguguuguuccaucgccgcaugcagaaaaugucagguuuugggcgaagaggcguggguuagaaucucagcuuugacaccugauagcucgggaaucacggaaaaaguacuuguccucuccaagucucaacauccucacuugaaaguuagagauaauauaagaucagcaauguugagaagcacuaagaccuuuccaagauuaugugccauucauuucccacacauauaaaauguauucugugauuuaucacucaauuaauuuauuuuugccuggccuuuuucuguaacuuauuuuaauauuuagacuuguuucccuaaugagcuccucugucaggcagggaauaugucucacaaaaaaagaaaaaagccugcaaagaacauagcaugguguuaaguauuucuugacagguugcaagcagagagauguuucuuuuccauaaguugucaguaaaauuaaaaauaugcaaacugucagacugaguuuuuuuaaauugaaauauaauuuacauacaguaacauucacccuuuaugguguacaguuuuauuguuuuugacaaaugaguagaguaaccucacuggauucaaguaauagaauaauuccaucaccaucagaauuuccuccaacuccuuaguaguucauucccacacccuuuggcaacuacugauguguuuuaugggccuauaguuuugucuuuucuagaauaucauauaaauggaauuauacaggauuuagacuuuugagucuggcuugcuucacauagcauaauguagcugagauucauccaugugucaguaguuguuccuuuuuauugcucaguaguauuccauuguauggguuugccaguuuaucuguucacaagcugaaggacauuaggauguuuccaguuucugugauugugacaaaagcucuacaaacauucccauacaggauuugugugaacguaaguuuucauaucucuuggguaaauaucuaguagugggauuacuaaguugugugaucaauguguguuuaacuuuaugagaaacuaccaaacuguuuuucaaaguggcuguaccauuuuguauuccugccagcaaugcauuaaaauucuaguuguuuccacacccucaccagcacuuaguauuaucugauuuuuggguguguuuuuauuuuuauuuuagccauuuugauagguauauagugguaucucauugugauuuuaaguuucauuuuccuaaugccugaggauguugacagucuuuucaugugcuuauuuacuaucuacagaucuucggugaaguauuguucaaaccuuuugcccauuaaaaaauccauuuauggcuggguccgguggcucaugccuguaaucccaccacuuugggaggccgagguggguggaucaccugagaucaggaguuccagaccagccuggccaacauggugaaaccccaucucuacuaaaaauacaaaaauuagcugggcaugguggcacgcgccuguaaucccagcuagucgggaggcuaaggcaggaaaaucacuugaaccugggaggcggauguugcagugagccgagaucacaccacugcacuccagccugggugacagagugagacuccaccucaaaaaaaaaaaaaaaaaacaagcccaaaaaacaacaaacaaauauauuuauaccaguuuuuguaucauucauuuauauagagauacaauaccauuaaaguuucaaauuaacagucaugucuauucuacaauaacaugaauauuuuauuuuuacauauucucacuaauuuguauauuuucuuacauaauuguaauugcauuuugagaguuuuauugaaguauaauugacaaaaaaaauugcccaugcuuaaaauguauaauuugguaaguuuugacauauguauauaucugugaaaccaucaacacagucaagaaaauuaacauauucaauauccacaacaauuuguugugcuccuuucuagucuugccuuaugcuucugcuuccauggauaggcacucaucugauuucugacacuauacauuaguuuguauuuuuuauaauuuuuauuuaguuauuuuuauuuguuuauuuugagauggagucucgcccugucgcccaggcuggagugcaguggcgcuaucucggcuuacugcaaccucugccucccagguucaagugauucuccugcgucagccucccaaguaacugagaugugugccacccugcccaguuaacuuuuuguaucuuuaguagagacgggguuucaccauguugguuaggcuggucuugaacuccuggcuuugugaucugccugccucggccucccaaagugcugggauuacagaugugagacagugcgccuggcuagaauuuuauuuaaguggaagcauacagcacauauucugcuuuuuuuuuuuuuuguuuuuuagguucuucacucagcauaauuauuuugagauucauccauguuuuuguguuuaucaguaguuuauuucuuuuuaaugcugaguaauauuccauuguauguauauaccauaauuuguuuauccauucaccuguucauagauauuuggguuguuucuaguuagggguuauuacaaauaaauuaugaacauucauguguaagucuuuguauggacuuauguuuuuauuucucuugauguaauauuuagaaauggaauggcugagucaacuuguuagguguauguuuaacuucuuaagaaacugccuaaguggugguaccguuuuaccuucccaccaggaguguaugagauuuccaguuguccuauauccuuaucaacacuugguauggucagucuuuuuaauuuuagcucuucuaguagguguguugugguaucucauuuuuuuucuuuaguuuucuguuugcuauuaguugguuuuuuuagauucuauuuuuaaaauacaguaaaauuaacuuuuaaaauugguguauaguucuauaaauuugaacacaugugauucauguaaccaacaccaaaaucaggauacagaacaguuccgucacccugaauaacucccucaugcuaccuuuuuguaguuacaaucucuccucaucccuaaccucagcaaccacugauuuguucucugccauuauacuuuuuuccauuugagacugucccacauguauacuuauaccauauguaaccuuuugaaccuggcuucuucuauucagcauaaugccuuugagauucauuacguauaucaguaguuugcuccuuuuuacugcugauuaguauuccauguuaauggauguaccaguuuguucauuuacucauuaaagggcauuugaguuuaguuacuugcaguuuuuggugauuaugaauacagcugcaagaaacauucacauauggguuucgugugaacauaaguuuucauuuuccaugaguacauaccuaagagugugagugcuuggccauagcagcuccagcuuacucuguaaaacggaaauaacaguaccuacuuagccucacaaaguauuuuugcuacucaagagagacaaauuggauaacguagcauuuaagagaaugggauuuaaugucgaaaucaguuugacuuaauucacagagaccuuuuacuuggucauuuuuaaaaauuuaucacugauuuguaguuuucagcauagagaucaugauauguuuuguuaaauuuauuauaaaguauauuauauuguauuguuauuauaaaugaugcuuuaaaaaacguaauuucuaauucuuuguuacuauuauauugaaguacaauagauuuuuccauguugagcauguaucuugcaaccuguuuuacucaccuacuaguucuugaaugaagccuuuugcagauccuuuggacauucucuguagguaauuauaucaacuguggauagagacaguuuuguuuuuauccuuucuaacuuauuugcauucuauuuccuucucuugccuggcugcacuagaugagccuccaguauaauguugaauaagaguggugagcauagguaucuuuuucuuguuccauaucuuagaagaaaaacauuuaaucuuucauuuuuuuuuuccccaaagguggaauuucgcucucguugcccaggcuggagugcaauagcgugaucuuggcucauugcaaccuccaccuccugguuucaagcgauuuuucugccucagccuccugaguaucugggauuacaggcaugugccacuaugccuggcuaauuuuuuauuuuuaggagagaugggguucgccauguuggacaggcuggucucgaacuccugaccucagaugaucugcccaccuuggccuccuaaagugcugggauuacaggcaugagccaccacgccuggccacuacucuuucauuguuaagugugguguuagcuauaauuuuuuagauaccuuuuauuaaauuaacaaaguucccugucuguaccucguuugcugagcgcuuucucuuaugaaucgauguugaauuuugucaauuuugucacaugcuugcuugcuggguuuuuuuuuuuuuuuugguucuguuggaaugaucauguggugaauuuauacugauugacuuuuaaaaauuaauagacuuuauuuuuuagagcaauuuuagguuuacagaaaaauugaauggaaacuacucagauauuccugcucccccaaugcaguuucucccauuguuaauaucuugcauuaauguguccucacuuccucccuuccugcuaccaaaccccuagcaaccacugaucuuuuuacugucucuguaguuuugccuuuuccagaaugucauguaguugcugucauauaguaugugaucuuuucagacuggcuucuuucacuuaguaauaugcacuuaaguuuccuccauguuuuuuuguggcauaauagcuccuuucuuuuuauuuauuuauuuauuuuugagacagagucucacucugucgcccaggcuggagugcaguagugcgauauuggcucggugcaaccucugccucucagguucaagugauucuccugccucagccucucgaguagcugggauuacaggugcccaccaccaugcccagcuaauuuuuguaauuuuaguaagagacaggguuucgccauauuggccaggaugguuuugaacuccuuaccucagaugaucugccugccucagcgucccaaagugcugggauuacaggaguaaaccagaugccuggccaucuacuuucuuuuuauugcuaaauaauauucuguuguaugguuagaaccacuguuuauucguuugcauauugaaggacaucuugguugcuuccaaguuuuggcgauuaugaauaaagcugcuauaaauauuccugugcaguuuuuugaguggacauaagcuuuuaacucauuuggcauugauugauuguugaaugucuugaauauugcauuugucagguaaacuccacuuggucaugaugcauuauccuuuuuauauauuauuggauugaugugcuuucauuuuauugaagaauuuuguuuucuguucuucaggaucuuaauuucuuccuuuuaauguguuuucuagguuuguuuuuagguuaaugcuggccuuauaaagugaguuaaauuuuguuuccuucuuuugaauuuucuggaagcguuugugaagaauuuguauuacuuauuucuuacauguuggauauaaauugccugugaagccaucugguccuggaguuuuccuuguuggaaggcuggaauuaaaaauucaaagauaauaaauuuuuaaccuacaaauuuaauaucuuuggcagguauaagacuacucaggcuaucuauuuugucuuaggugaguuuugguaguuuuuaucuuuugaguaguuugcccuuuuuaucuaguauguugaauuuacagucauaaaguuguaauaccucuucauuaucuuuuuaauguuuguacaauuuguagugauauccucucuuuccugaauugauaauuuguggcuauuguuuucuuggccuaucugaugagugguuuguuaauuuuauugaucauuuuagagaauuagcuuugaguuucacugauuuuucucuguaaguuuuuuccauugguuucagaacuuaucgcuuucucuuauaucgucaucguuuucuucugcuuucaauugguuuuauauguucuucuaguuucuuaagguggccacugagaucauaauuugaucuguuuauuuuuuaauauacauuuuuaauguuaaaauuucuuguaggcacuguuuuggccacauuucacaaauuuuuaucuuaaaauuuucauguaacgaauauauuuucuuauuuauuuuuuccuauaugaccuauguauuuauuuagaaguauguucuuuacaaauauuuggagauuuucuagauggagauuuucauugacuucuaguuuaauucuauuauauucagagaacauauuuuauaugauuucaguuauuuuaaauguauuguaaauuguuuuauggccuagaguauggugcaauuugguaaaucuucuguuugugcuugagaaaaauguauuaucuauuuugcuauuugggguugaauguucuguaaaugucaguuagcccaagcugguugauagaguuguucaagcuuuguauauucacacugauuuuuuuuguacuuauucuaucaauuauugaaaaaaguauguuacagucucugaauacaaguuuacauuugucuuuuacucuuuccaguucuaucaguuuuugcuucauguauuuucaauaccuauuguuagguccuuacacauuuauaauugaaagauaauaauacaaauuacccaaaauaaaacacagagagaaaaaagaccagaaaaaaaagagcaauuagcaagcugugggauacccccaaguggccuaauauauguaauuggauaccaugagggguaaaggucauuuugcaggucaaaaauauuugaagaaauaauggccaaaaauauuccaaauuugaugaaaacuauaaacccacagaccccaaaucaucaacaaauuccaaaaacaaaaaguguagaaaaccacaccaaggcauauuauuaucaaauugcucaaagccauugauaaagagaaaaucuuuauagagcuagagaaaaagauacauuacuuacagaggaagaaagacgaaaaugaguucaggguuuuuuuuaaaacaaacaauauaagcuggaagacaguggaacaauaucuuuaaaguaccaaaagagaaagucugccaaccuauaauuuuguacacaacaaaaauaccuuguuaaaacaaaggcaaaugaagguuuuuucagacauacuguaccugaaagaauucauuacacagagaccauaauucccuuuccucuucccucuacuggauaucuuauucccuggauucugggccuuucaccacaguuuuguagcauauaugcuucaguagccuccugagaagagguucaaggcggauaaaguuuuugagucuuugaaugucugaaaagauuuuuauucuguccucauuugguugauguauuuguuggguguaguuucuacugcagucauagugaguaaaugucuagagaaaagcaagcaguaaauucuauacgagcuuaaaaggaguagccuaugaauugaggaagaguauaugcauaauguaggcuuugguaaauguuuuuaauguaaccuaaugcuaugguuuacuguauuuaugaauauauauuuuaaaaugcaugauuacauugaauaacaguguuuuggcuuuaauaguaaagcuuuuuuucaaauuuagucgguauaaaauuauuugagauagucacacauacuuuguaugugcccuauugacaacaaccaaaggaauuucuccuuuccaugcaaaugaggaacacauagacacagauguaaauguucuaaaucauuauuucuagugauauaaguuaggauuguuuuacuggaagauuguggugcuuuuugaguguuggcuguguauuuuagacaaaguagcugguaacuaggacuaguuccagcuuuacaggucaccaugauacccauauccaugucucuggucccaagucauuagcuguaagauagccaaagaccuaugauguggcuaggugugagaauucugccccauauaggcauucuguauagguugguaacagaccaaacauggucaaauuuuuuucuguugaaauuugaacucauagauauauagagagaggaaaauaugagaauaauuagggaucaguagauguccauuucuaagaaguuaggguggcaagcauguugaaagguuccuauuagagcacaauagguauuguuguguccuaaaucacauuccaguugucucuauuuugcaaauguugaguuuuucgucuuucuuccuguaucuuuacaguauucccugguuaccugagauaacuugagcguaacuguucuuugaaaucugagacuagcuaacauauauacuauguacuagauuuuagaaaauuuuagguaucugaaaauacaacuuuuuccuuucauguguuaauuuugucucuuagaaauucuuccuguuaaauaucaaggaacucaugaccucaagugaucugcccgccucagccucccaaagugcuaggauuacaggcaugagccaccgugcucugcuguccuuuuuuuuuuuuuuaaauaguagccauccuaacaaguauaaggugauagcuuauugugguuuuaacuugauuuccuuguuggcuagugauauugagaaccuuuucauauacuuguuggcuauuuuguauguuuucuuuggagaaaugccuguuaguuccuuugcccauuuuaaaaucaauuuauuugguuuuuugcuauuaagucauagaagucacugauacauuuugguuuuuaaucauuuaugagauaugguuugcaaauauuuguccuauuccauagguugccuuuguauccuuugcuuugcagaaguauuuugguuugacguaaucagacuuaucuauuuuugcuuuuguuguuuugugcuuuuggugucauauccaagaaaucauugccaaagccaaugucaagaagcuuuuucccuguuuucuucuaagaguuuuguaguuuaaggacuuacauugaaaucuuuaauucauauugaguugauuuuuauauacagugugagauaagcguccaauuucauuccucugcauguggauaucuaguuuucccaauaccauuuauuugaagagauuaucuuuucuucacuguguguucuuggcauaauugucaaaacucacuuguccucauguguggguuuauuacuagguucugucuucuguuccaauaguuuauaugucugguuuuauacugguaccauacuguuuugauuacuguagcuuuuaaacguauuuugaaaucagacagugugaugcguccagauuuguucuuccugcuuaaaauuguuuuggcuacucagugucuucuuguaauuccauaugaauuuuaggauuguuguuucuauuucuggaaaaaaaaagucauuggaguuuuguuagagauuguguugaaucuguagauugcuuuggguaguaugagcacuuuaacaauauuaauucuuccaguccaugaacauaucagaugucauugcauuuauuccugucugcuugaaagcauuucuuucauccauguuuuauaguuuucagugaauaagucuuucacuuccuuaguuuguugcuaaauauuuuacuuuauugauguuauuguaaguagguuguuuucuuaauuuccuuuucagauaauuuguugauaguaccuagacaugcaauagauuuuuguauguugacuuuguuuuuuuuuuuuugagauagagucucgcucugucacucaggcuggagggcacuggcgcgaucucagcucacugcaaccucugccccuggggccuaagugauccuccuaaguacugggacuacagauaugugccaccaugcccagcuaauuuuuguauuuuuuguagagaugagauuucaccauguugcccaggcugguuuuaaacuccugggcucaagugauccaccugccucggccucccaaaguguugggauuauaggcaugagccaccaugccuggccucuauguugacuuuguauccugcaacuuugcugaauucauucauuagucugaacagcuuuuuuuguguguggaaucuuuggggauuucuauauguaaggucaucaucuguggcuucuuccgcucuaauuuggaugccauuuauuuguuuuucuugccuaguugcucuugcuagaacuucuguuuuugaauaggaguggugagaguaggcauccuugucucauuccuaaccuuagaggaaaagcugucuguuuuucacucuugaauauaauauuaacuguggauuugucauauauggccuucauuauguugaggugcaucccuucuauaccugacacuaagaauuuuuaucuuaaaaaggacugaauuuuguuaaaugcguuuccugcaucuauugagauggucauacaguuuuuguccuucauuuuguugauuugguauaucacauugauuuguauauguuaucucaauuuuuugaaguguuacuuauacguuuauaaaaguugugagccaagaaaaauuugugcugagguuuuuaugaaaacauuuacugccaaacuauauuuucuauacuuucuguauuucugugugaguauauuuagacacacguauauuuggauuaucagugugccaaacauuauuuauaauaucaucuccugaauuuuauauuuuauuuuuuuuaguuaaaaagaaaauacugccuuuugaauaugaaguucucaaacacuuuugagaaaccagaucaaaagagguauuaaccaaacuuugagaaaccggaucaaaagagguauuaaccaauuuuaaaguugauaauuuaaaauugagguuugcuaaucagaaauagaauuuugcuuauaacugaaggguguuuuauaccuuuugugcuuccuuuuuaagaauauuaguuggauuuuaccuuuuguucuaacuugagaaucacuguuuuauuuauuuuuaauuauugaauuaaaauauaguagagagaaugagaaagcaaaccuccacauaccugaagcuuacuuuuuacaguuauacuugugguuaaauauaauuuucuuccuaacccccaguuaucuuuccuauuuuauuuugaagcagguaacaaacaucuugucaauuuaccuauaaacauuucaguauguaucuuuuaaacacaagcacuccuguuuuuaaauguaacaauaacaccaucaucauauauagaaauaaaucccuuaauaucaucagauauccagccauucacauuuucuugguuaucguauaauguuauaauguucuuguuuauuggcugaucuguuuacuuuuuuuuuuuuuaacaguuuaugucucuauagauucucccuuuaucuuuuuaaaagcuguucuucugauuccugauuacccuccuuagaugucuuuugcagcauagcccucaauuuacuugaaauuagcugucugcacccagacagaccccagugaauauuacaggccaguagcuccucauugugcucugguagaauuacuuugguagaacuguauucaauacagaguuccuucacuuucagccccugcuagugggaaucugaagacugucaguaucaggugaaaguuguaguugccugugagaaauagggaaggggcucauugggacacugaccauguguuauuguuuggguuuguucuuuugguguuuucuuuuugcuguuuuuugaaaaaccuguauuuuguguauaaccuguauuagugauaaccaggacucccuguaguagcacuaguggcauuuuugaauuuuuuggacuugacuguuaacauuugccacuugcucuuagccuugcuccuccaauuuugggguuuucucagaaccuauuuuuggaaaacuauauugauucuuucuaagcaagucuguucacuugugcuaauucacaggccagucagcacugcuaaguuugcuuuucaucucauccugugucauuuguuaauuuucucaugugacagauaguuauugacuacugcucuaagcaaaacaucuguuuuauguauuucagaacuuuuggccuuagugucugaccuuuuaaugguaccuuuguuuucuagcauagcuguaucuccucucauauauucuuuaauaaauucaauuggguuuugggagauaaaggaaguaaacaugaaucauaggcuauuuuaaucugaaguuuucauauuuaauuuguaacaaauugaaaacacauuuuuuucauucauuuuguucucagcuacuuauaaucuuccaaucuuuuuagugauacuuaaaguaaugauaacuauuauuuauuaggugcuaacucugauuacuuaacauuuuuauaacaaccauguaaccagggauuauuauccucauuuuaaauaugaagugauuguuauguuucugaauacuuaaauguacuuuauaugcaugugccuggauauaaaguagaugcugaaaaagcagcuauucagugaauucagauguuuacggacccagaggcauaaagacaaaaacaaaacaaaauauaagaaaaccacagaaaaugguuuuucuguuaacuaguuuuacaaaaucuugagacagaugcuuaagauauacuuuucuuuuuauuaugguaaauuggccaaauuauucuucagggacuaaaauauucucauuagaaauaggaguaucuuuucauaaugucacgacgccucuagugugguucagguuuggauuugguuuagucaguguccuaaauauaguuucauugccagccucaaacuuguuaagauacccagucauaaggaugaauauaucaaaaccuauguuauccacuauuauauguaauuguaauccugcauuguuuuaaauuaucucaccucaucauauuuguauuuaggauuuaaaauauacuaaaaauuauaaugaauuaguaugcaguuaaguaguuauuaaggaucaaaacaaaugaaauggucagaauuauaagucaagucucuuguuuuuaguagcuauuggaagaucaugauauauagcucuuuucaaugugauauuuucucuuuaacauuugggaaauuaugaagacauuucagauuuuuccaguagauggcagaauuguuuuaaacauuuuagauucacuguuaaauuuuuuuugaauugauuugaaggaguaaucauuucucuaaaauaacuggauguauuuuuucuuccaaauaagcccugcacuacuguuuuauaaacuaacuuuuaagauaaagauuuuuaaaugauaauauggaucauuccuaaucaguaaugcacaaugauagaaguggcaauuauauuuugaagaauggauaaaaaaauuuuaaaucaaacauuuaguuuuuucaauaguaaguaacauucuuucuuuaguuaucagagauccagaggucacaugauguaaucaucaccaugggcaucaucagauugauagaauauccuaaaauauuuugauuuuagcuaaaacaugccuucgguuuagugauaucuauaaaaaguugaacuuacuuuaaaauacuuuguugacuauaaaauaguaauuuaaaaguuuuuauacagguugucucagaguuguuugaagguuggauuuuuaauuuucugaucuucauuuugaaauuucaugucuuauguuuucuucugagacuauuucaaauacuuacugaauucccuuaguucguguguauauguguucauguacuuaaauauuuaauuguauuuuguugaggggaaacaaaaacccuucucccuuacuuauacaaauaguaccacaucugugucacacuuucaaacagaaaaacaggaggaugaaauguguucacagucguaccugucaguucuuuaugcuuuaugcuuaugaaguuaaggaaccuuaaucuugaauucuaguuuucccugccauagaaauaugaaacauuuuaacagaaauggaacuaauaauggaugagugacuaagcuggguuauguuucuaagugagguugaaaauauuucauguaagagaaaaagaguuauuugucuccuuuuguuuugaggguuuuguaauugcuuuauauuaagaauaguagugucaauaauaacaauaaugagaauuaguauuucuuaaauacuguguauaggcacuaugccuagcauuuguugugacucgcuguauuuguugaagaauauaauaaaugagggaaaauaauaugucuaguguugauuugucaauaucacguagcuaugaaacucaauuugcauucuuuuuguguaaaacccaguuucucugcaucaguguaaaucacaugaaacuauuacuuuucauacucccucacuuuucaaaguacuacucaguucagcaguuccuuucugcugcuguuugaagacuuuguaagugugacuuacucugcaagaguuguaaaagugaguugacaagguugcuuuugagauuuuucaauugaauuggguuugguagagauaguaucuucagaacuauaugucagacuucacuguuugauuguuugaauaaauuuccauucuuauaaaaugaauuggaaauguaccugauuuuuuuuaaaauuagguuuguuauuuuuacacuuaaaaggcuguuuuuuugcuuuuaucuuuauuuccguuuaggugacuggugccuccaucuugugguccaacucacaaauugcauccuuugcuagagauuguguuuacacuuuuuuuccccucagcugaauaaaugacagaaaauuauuuucuguuuuauuuauuaaaaauauaacuccgauuaagcauacauuaccuucaaagaggacagaaagugcucaaaagggaccaccuaaagcaaccuguucaaggaugaagucuuguaaaauaaauuauuauuguugaugguaguggugauggaugaugguggugguaguggugguggugguggugaaugagagagaggaugaaguucgauuugcucuuuauguugaaaaaugaaacuuaaagucuucagcaaaauuuacuguauaacuuggucaggcauggugguucacgccuguaauccuagcacuuugggaggccaaggcgggugcaucaccugaggucaggaguucaagaucagccaggccaacauggugaaacccuaucucuauuaaaaauacaaaaauuaggccgggcacgguggcucacgccuguaaucccagcacuuugggaggccaaggcgggugggucacgaggucaggagaucgagaccauccuggcuaacacagugaaacccugucucuacuaaaaauacaaaaaauuagccgggcaugguggcgggugccuguagucccagcuacuccggaggcugaggcaggagaauggcgugaacacgggaggcggaacuugcagugagccgagauugugccacugcacuccagccugggcgacagagcaagacucugucucaaaaaaaaaaaaaaaaaaaaaauuagccagacaugguggcaaaugccuguaauuccagcuacucaggaggcugagacaggagaaucgcuugaacccaggaggcagagguugcagugagccgagauugugccaccacacucuagccugggcaacagaaggagacucugucucaaaaaaaaaaaaaaaaaaauuuacuauguaauugcaaccuuagcuaauuauuagaauuaagaaugaaucaguaucugugguccuacuuaggaagcuuugguagcaggaucgcuugagcucaggaguuugagguuacaguuaacuaugauugcaucacugcacuccagccugagugacacagcaagacucuuucucuaaaaaaaaaaaaaucuuaaaaaagaaugaauuaaguacuauuuuuuccuccagcuuuauugaaguucaauuuauaaauacaaauuguauauauuuauauuguugaguaugcuugaacaccauaaauauauguauacauugauauauacuucgugauuaccacaaucaagcuuaggcaacauaucuuucaccucacauaguuaucuugguuuuuuuuuuuuguagugaacaaguacugauuuuuuuaacauagguuuucugacaaaacuaugauagcacaauaugacauucuucuuuucacauuugucuccauggaauuaacaaaagugacuuuuuuugcaaaaguugaaagcaucaucaaguuuucuaaagauuuuuauuacucagugauuaauacuguauucacuguccuuuaaacaccuuucauguuccaauucuuauuggucuaacuaccuuggccacguuuucaauuagaaaguaauaauuuucucaugaagcuauauuauuuucauagacuucaugaaacuuuaucuuuuugagauuugcaauuuuacuuugcauucaccuugugcuacauucauaaacauuagaaaauugcgugguggcucacgccuguaaucccaacacuuugggaggccgaggugggcagaucacgaggucaggagaucgagaccauccuggcuaacacggugaaaccccaucucuacuaaaaaauacaaaaaauuagccaggccugguggcacgcgccuguagucccagcuacuuuggagucugaggcaggagaauugcuugaacccgggaggcggagguugcagugagccaagaucacaccgcugcacuccagccaagugacagagugagacugcaucuuaaaaaaaaaaaaauggagagacugacuuauaaacaaagagauugucauuuauuuauuuauuuauuuauuuuugagacagaguccugcucuauagcccaggcuggagugcaguggcgcgaucucggcucacugcaaccugcgccuuccagguucaagucauucuccugccucagcuucccgaguaguuggaacuacaggcacgugccaccaugccuggcuaauuuuuguauuuuuaguagaggcaggguuucaccauguuggugaagcugggcucaaacuccugaccucgugauccaccugcccuggccucccaaagugcugagauuacaggugugagccacugcacccagccaagauugccuuuuaaagaugagguagagauucuaauauugaguagauaucuaaauguccccugauauaaguuacauagugaagauuuuuauuuaccuugaaacuauuguuuuccuacacguacuaggaacuucaguuacucuguuaaugaguacacagucagugaggaauucuuggauguaaauaagucugcaacuugccuuccccucacuggcaagauuuuugaaaagggagucaaccuacugacuucaucucucaucuagaauucaucuuuccauaaguguuguacauuguacugcauuucccauuuggauuauaggcgauugcuuguauagcuaggucccugacucuguguucuucuggacauuuucuagauuguagcagguauucagcaaaacuuguucauccaucugacugauauuuauuguauaccuuguaggccaggcacaguucuaggcauuugagauacuauauuaauaagcagaauacugaaaaauccguggcuuuacugagcuuacauugaagcugaaggaaucagaugguuuuaaaaacugucauaguuguuacagugugguaagugucaagagaaaagaaaaacuagguuagaguugagaucagaaguguuggcuguagagaguggguugaaaucuuaaaugugaugguuaggguagauucauugagaaggugauauuugaacaaagacuugaagggagugaggaaguuagcuaagugaauaucuggaguaagagcacaccaaucagagggaauagcaguauacauuuugcuuucacugugaauaaaauggagaauuauuccaggguuuuuagcaaaggaguuacauaaucuaauuuaugauuuuaaaaggauugcugaauuuuuuuuuaauugagaauagacuguagcaggcagagauugaagcagggagaucauuuaagaggcuuuuuugauguuguuuuuguuuuaacucuucaacaauuuuagacuuacagaaaaguugcaagaauaauacaaagaauucucacauacuuuccccaaaucaaccaaauguuacuguuauaccacauuugguucaucuuuccaauuuuuaagauuuauuuuuuaaauuaacaaauaagauguauauauuuaugauguauagcauaauguuuugauauauguauauauuguggaauggcuaacucaagcuaauuaacauauguauuaccucauaauuuuuuuuuguggugagaacacuuaaaaucucucuuagcacuuacaaaguguacaacacuuuuuuuuuuuuuuuggagaccgagucucacucuguugccccggcuggaauacaguggugcuaucuuggcucaccgcaaccucugcgucccagguucaagcgauucuccugcuucagccuccuaaguaccugggauugcaggcgugcaccaccaugccuggcuaacuuuuauauucuuugguagagacaggguuucaccauguuggucaggcuggucuugaacuccugaccucaagugaucugccugccuuggccuaccaaagcgcugggauuacaggugugaacuaccgcgcccggccacauaacguugauuaccauuaccauguuguacaauggaacucuugaacuuacuccguccugucaaagaauguucauauccuuugaccaacauuuccccaauaccuaccacccaccagacucugguaacuccuccuguuccugcccuuuuuugacccaggugccuuaccauuuucagaugaccuucaucaacuaaauccuuugucacguauuuucuguccguuccucauguuaugguuguugcuaugucugagaauaguuuaaugcaguacuaggaagagguucccaaaccuggccaauugucagaauuuccccaaacacacuaacauaauuagaaucuccccagguuuuuccgauuuuucaacuaggucuaggaaccacuaacaugacagauacagaagacagaaaaauuguacugaccugagcccauaccuaaaguaaaugauuucaaaucugacuugacauagcugagaacauaauuuuccuccgacuuuauuaagguauaauugacaaaaauuguauauauuuacaguguacaaugugauguuuucauauauguauacauugugaaaugauuaaaucaagcugaugaacauaucuacaccucacaggcuuauuuuuuuguggugagaacacuuaagaucuaccuuagcaauuuucaaguauauaauacauuacuauuaaauauagucaccaugcuguacaauagaucucuuuaacuuauucauccuguuuaagucaaacuuuguacucuuugaccagcgucuccccauuuccccaccccagccccuggcaaccaccauucuacccuuuguuucuaugaguucagcuuuauaaagauuccacauauaagugaaaucaugugguauauuugucuuuuugugccugucuuauuucacuuagcguaguaucuuccagguucauucauguugucauaaauggcagauuucccucuuuuuaaauguuuaauagaguuccauuguguauauauaccacauuuuccuuaucuguucaucugucaauagacacuuaaguuaauucccuaucuugauuauucuaaauaauauuacagugaacaugggagugcagauaucucuuuggcauacugauuucauuuccuguggauauauacccaguagugggauugcuagaucauaugguaguucuauuuuuaguuuuuugagaaaucuccauacuguuuuuccauaauggcuauacuaauuuacauucccaccaagagugugcaagguuuuccuuuucucuacauugucgacaacacuuguuaccuuuugucuuuuugauacuagccauucgaauaggugcgaagguaugucuuguugugguuuuaauuugcguuuuccugaugaugauugauguugaauauuuucuucacaugccugauggccauuuauaugucuucuuuugagaaaugucuucuuagaucuuuugcccaauuaugaaucaguuauuaguuuuuuuuccuguugaauuguuuaaguuccuuguauauuuuggauauuaacccuuuaucagguguacaguuugcagauacuuucuuucauuccaaagguugugucuuuacucuguugauuauuuuguugugcagaagcuuuuuaauuagagguaaucccacuuguuuauuuuugcuuuucuugccuguguguuuggugucauauccaagaaauuauugccaaggccaaaaagcauuccccucuguuuucuucuaguuuuacaguacaaguccuguguuuuaagucuuuaaucuauuucaaguugauuuuugaauauagugugagaugagggucuaauuucauucuuuugcauguggauauccaguuuuccaaacauuauuuauugaagagacuuuccucuucccaucuguguucuuggcaucuuuguaaaaaaucuauugaugguaaaugcauggcuuuauuucuggacauccuauucugucccaguggucuuugcgcuaauaccauguuguuuagcuacuuuagccuuauaguagauuuugaaaucaaguaguguggugccucagccuuguuccuucugcucaagauugcuuuggcuauuuagagucuuugguggcuucacugaaauuuuaggauuguuuuucacuauuucuguaaaaaguguuauuggaauuuugauagggauugcagugaaucuguagauugcauaggguaguaugaauauuuagccaauauuaauucuuccaaugcaugaaacagaguauguuuccauucaguuguguacacugcaguuucuuuugucaguguuuuauaaucuucaguguauggauuuuucaccuccuuggcgaaauuuauuccuaaauauuguauuaauauuauuuuguagcuauaguaaauggaauugauuuuuuuauucuuuuauuggauaguuuaucaguguauagaaacacugauuuuuugugucuugauuuuuguacccugcaacuucacuaaauguauuaguaacaguuuuuuaguggcauuuuuagaauuuuuuaagaauauaacaucuuguugucuguuaacagauacaguguaacaucuuccuuucugauucagaugucuuuuauuuauuuuucuugcuuaauugcucuugcuaguauuucugguacuauguugaauacaaguggugagaggugagcauccuugucuugauucggaucuuagaggaagagcuuucaacuuuuuacuguugaguauguuaacuauauguuuaucauauauggccuuuauugcauugagauauauuccuuuuauaccuaauuuguuggaaguuuuuuuuuuaucaugaaagaguguugaauuuuguugaauuccuuuucuacaucuauugagaugaucauaugguuuuuguccuucauucuguuauuauaguuuaucacauuuauugguguacauuggcaaaccauucuugcuuuccagggauaaaucucacuugaucauggugaaugaucuuuuuaauguacccuugaauuagguuugccaauauuuuguugagagauuuuauaucuaugcuuaucaggaauauuggcauauaauuuucuuuucuuguaaugucccuuucuggccuugguaucuaguaaugcuggcauuaugaaaugagcuuggauguuucccuucucuucaguuguuuuggaagaguuugagaaggauugguauuaggucuucuuuaaauguuugguagaauucagcaguaaagccaucagguuaugggcuuuucuuuaaugagagacuuuauuacugauccagucuccuuacuuguuacuggucuguucagauuuuauauuucuucaugauuaaguucuguuaauuguauguuucuagaaauuuauauauuuauucuagguuauacaauuuguugggaaauaaguguucauaguagucuuuuaugauccuuuguguuucuuucuguaguauccguuguugcuuccccuuucauuucugauauuauuuguauauucucucuuuuuucuuagucuaucuaaagguuugaccauuuuuaaaaaaucuuuuagaaaaccaauuucuuaguuucacugaucauaucuauuggguuucuagucuccauuuccuuuuuaucugcucugauauuuuuuauuucuuuucuucuauuaacuuugagcuaaguuuaguuuguucuuuucuacuuccugaggcauaguguuagauuguauauuugagauuuuuuuaauguaaguguucauugccuuaaauuuucgucauagaacuacuuuuguuacacgcuauaaguuuugguauguuauguuuccauuuuuguuuuuugaaaaauuuuuuuauuuaaaaauauuuuuaguuuuuaauuuuuguggguacauaguaaauguauauauguauagguuacaugagauauuuugauauagcugugcaauaaauaauaaucaaaucagggguauucaucaccucaagcauucaucuguacugugaacaauucaauuacacucuucuaguuauuuuaaaauguaaaauuaauuuauuuuugacaauugucacccuguugugcuaucaaauaccaagucuuauucauucuuucuauuuuuuuuguaccacuuaaccaucuccacuuccccaccaccccucuacuacccucccuagccucugguaaccauccuuuucugcucucuaucuucaugaauucaguuguuuuaauuuuuagcuuccacaaauaagugagaacaugugaaauuugucuuucugugcugggcuuauuccacuuugcauaaugaccucugggcccauucauauuguugcaaaugacaggauugcauucuuuuuuguggcugaaugguacuccacuguguauguguaccacauuuucuuuauucauuugucuguuaacggacauuuagguugcuuccaaaucuucauuauugugaauaguacuacaguaaacaugggaguggagauaucucuuugauauacuguuuuccugucuuuuggguauguaccugguaggggauugccagaugguauguuagcucaauuuuuagcuuucugaggaaacuccaaacuguuauccacagugauuguacuaauuuacauuucuaccaagaguauacaaggguucuuuuuucuccacaucguugccaacauuuguuacugccugccuuuuguauauaagccauuuuaaccagagugagaugauaucucauuauaguuuugauuugcauuucucugaugaugaacgauguugugcaccuuuucauauaccuguuugcaauuuguaugucuucuuuugaaaauguguauucagauguuuugcccauuuuuauauuggauuaucagguuuuuuuuuaccauagaguugaaaacaauauagagcuccuucuauauucugguuauuaaucccuugucagauggguagugugcaaauauuuuucacccauucuguggauugucucuucauuuuguugauuguuuucuuugcuguggagaagcuuuuuaacuuaaugugaucccauuuauccauuuuugcuuugguugccugcaccuguaggguauuacucaagaaaucuuuccaagaccaauguccuggaaaguuucccuacuguuuucuuucaguaguuucauagcuugagguuguagauuuaagucuuuaguccauuuugauuugauuuuuguauauauugagagauaggggucuaauuucauuuuucugcauauggauauccaguuuuuccagcaccauuuauugaagagaaugucauuuccccacuguguguucuuggcacuuuuguugaaaaugaguucacuguagguguauggauuuauuuauggguucucuauucuguuccacugaccuauguaucuguuguuaugccaguaccaugccauuuugguuauuauaucucuguaguauaauuugaaaucaaguaacaugauuccuccaguuuuguucaucuugcuuagaauagcuuuggcuauucaggguauuuuaugguucuauauacauuuuaggauuguuuuucugauuucugugaagaaugucauugguauuuugauagggauugcauuaaaucuguagauugcuuuggauaguauggacaguuuaacagaauugauucuucccaucuaugaacauggaauaucauucuauuuuuuugcauguguguccucuucaauuuguuucaucaguguuuuauaguuuucauuguagacaucuuucacuuuuuugguuaagguaauuuuuagguauuuuaguuguacuuauuaaugggauuucuugauuucucuugaagauuguuugcuacugauuuuuguauguugauucuguaucucacaacuuaauuuauuuaucaauuucaauaguuuuuuaguggaguauuuagguuauuccaaauauaagaucauauccucugcaaacaagaauaauuugacgucuuccuuuucaauuuggaugcccuuucuuucucuugccugauugcuuuagcuaggacuuccaguacguguuaaauaacaguggugacagugggcauccuuguuguauuccagaucuuagaggaaaggcuuuuaguuuuucuccauucucuccauuauugagauguaaaguucaauauguaggcuguuaaacucuucaucauugauuauguuauuugguuguuuauauccuuauauauauauuuuugucuacauaauuugucucauauuaaggaggauuauuuuaaaguuuucuuuuuuuacuguauuuuuaucuguguucuaccaauaucauuuguguuugcuucauugaguggugguucuguuauuuauugaauaguuauuuauaauuugucuuuauugugaacuguggcugaaaauuuugggucaugcuuaaugcucucuaauucuauuuuaauauuugaaucacaaccucuauuucuuuuuucguuuuuuuuuuaaauuguacuuuaaguucuaggguacaugugcacaaugugcagguuuguuacauauguauacaugugccauguuggugugcugcacccauuaacuugucauuuacauuagauauaucuuuuuucuuucuuucuuuuuuuuuuuucuuuuuugagacagagucuggcucuuucgcccaggcuggagugcaguggcugaucucagcucacugcaagcuccgccucccggguucacgccauucuccugccucagccucucgaguagcugggacugcaggcacccgccaccgugcccggcuaauuuuuuuguauuuuuaguagaaacaggguuucaccguguuagccaggauggucucgaucuccugaccucgugauccgcccgccucggccucccaaagugcugggauuacaggcgugagccaccgcgcccggcauauccccuaaugcuaucccuccccccucccccaaccccaugacaggccccggugugugguguuccccacccuguguccaaguguucucauuguucaguucccaccuaugagugagaacaugcgguguuugguuuucuguccuuguguuaguuugcugacaaugaugguuuccagcuucauccaugucccuacaaaggacaugaacucauccuuuuuuauggcugcauaguauuccaugguguguaugugccacauuuucuuaauccagucuaucauugauggacauuuggcacaaccucuauuucuuaauauuuggcugauacaacuuugcccauucuuuuugccccccucccuuuuuuuuuuuuuuuuuuucugagacggagucgugcucugucacccaggcuggagugcaguggugugaucuaagcucacugcaacugccaccucccgaguucaagcaauucuccugccucagccuccugaguagcuaggauuacaggcauacgccaccgagccuggcuaauuuuuguauuuuuaguagagaugggguuucaccauguuggucaggcugguuucaaacuccugaccucgugaucugccugccucggccucccaaagugcugagauuacaggcaugagccacugugccuggcccauuuuuuuuuuuuuuuaauucuuagcauuugauaugguuuggcucuguguccccacucaaaucucaccuuuaguuguaaucucuaaauccccacuugucaagggcgggaucaaguggagauaguugaaucacgggggugguuuccccaauccugcucuuguggugaugagugaguucucaugagaucugacaguuuuguaagggacuucccccucuucacucaccacucauucucucucuugccacccugugaagaggugccuucugccaugauuauaucuuuucugaggccucccagguaugcggaacugugagucaauucaaccucuuuucuuuauaaauuacccagucuuggguauuccuucauagcagugugagaacagacuaauacagcauuuuuaaaucacuuguuuuagguguguuucuuguguacagguuauauuagagucuugauuugucagccaaguuuuuaaucucuuuuuuuaaaguagaaaaacuaagcacauucucauuuacugauauguguauucuguuuuuuuuuuuuuugguuuucuuuuuuuuuuuugcuauguuuuaaaauuucucaugguauauaggaagguuuguaguuuuguauuuaccucuguauuucuaccuuuuuuaaugcccguauuucuugguuucuuauucuauuacuaucucauuuguuaguuucuaaugauauccuuuaauucucacccauuuuuuuuaccauaaccaaagagcuuauaccccuuuucuuucuccuuuuaacuuugucuccuaauguuuaguugcauuuuugacuucuuuuaaaauauauuuaauacauaguauauaacauauaauuagguugucuugcacucugauccuugccuuuguuuuagacuuagaucucuaauuaaagguauugaaugcucaccauuagucuuuuugcuaaaguugccccaguuaacacuugguuggaugcagcuuacuuuuugguagauuccucaagaaguguuccugaguauagaguucccugaguucauucaugucuguagucuugaaucuucaugcuuggauguaacauccuugucucauacuuuuuuucuugaguuuuuuguuugcuugcuuguuuguuuguuuaggaagcuuacuguugccuugcuuucuauguuguuguugagacauuugccaacauaauuuuuuccuuuucacaaagggaaaaaaauauaacacaaagauguuauauucaaucacaaagauucaaggcuacaaacaugcgugaacugagggaaauucuauacucagaagcacuucuugaugaaucuaccagaaagugagcuuugcgaaccaagggaugccuggggaaacuuuagcaaaaggaguaacguaaguuaugcaguaguuuuguuuggaggccuugaguauuuuuguuuuuggagucuuauaauuuuaguagaauaugucuuggaguugaucuuucuagguguuaaaucacaugcauucuuaaguucuuuauuaaguccucugguuuuucaagauccuuuuuaauacuuuuuacaaaaggaugaacuuuuucuucccggagguuauuuuauugagacaaggucucacucugucacccuaguuggaguagaguggcaugauccuggcucacugcaaccuuugccucccaggcucagugauucucccaccucagccuccugaguagcugugacuacaggcacaugccauuuugccugucuaauuuuugauauuuuggguagagacagggugugaugguuaauauugaguguugacuugauugaaggaugcaagguauuguucuucaguaugucugugaggacauaagccaaaggagauuaacauuugagucaguggacugggagggacagacccacucucaguccaggugggcaccaucuaaucagcugccagugcugcuagauuaaagcaggcagaagaaaguggaaugagcagacuugcugagucuuccaggcuucaucuuucuccuaugccggacgcuuccugcccucaaacauuagacuccaaguucuuaagcuuuuggauucuuggacuuacaccagugguuugccaggggcuuuugggccuuugccacagacugaaggcuacacugucaguuuuucugcuuuuaaaguuuugggacucgacuggcuuccuugcuccucagcuuacaguuggcuuauugugggacuuuacccugugauugugugagucaguacucuuuaacaaacuuucuuuuauauauaccuccauccuauuaguucuguuccucuagaggacccugacaaauucacaggguuucaccauuuuggccaggcugcucucaaacuccugagcucagguaauccacccuccucgcaucccaaagugcugggauuacaggcaugagccacugcccucugcccugaugguaauuuuagaucaaucuuaagccugcugcuagcuccuucucucuucugggaauuuucucaguuuuucuuggaauguccuuguuuuucaugaaugauugugacaagagccaguaggauagcuuacugagauuuguguuuguuuguuuguuuauuuguuuauuuauuuauuuauuuugagacagggucucacuguguugcccaggcuagagugcaguggugugaucuuggcucauugcaacuuccuccucccggguucaagcauuucuccugccucagccucccaaguaacugagauuacaggugcacaccaccacauccagcuuauuuuuuaguagagacgagguuucaccauguuggccaggcuggucuugaacucuugaccucaagugaucuaucugccuuggccucccaaagugcugggauuauagguguaagucaccaugcccagccuuuuuuucuauuugcagauaauuugaaguuuauuuuccaauuauguugagggcaugaguuuuauuuguucuuuuugguuuuguguauguauguauaauuuauuuuuuuaaggauauuguguuacgacacuccaauuuauuuggccgucauuaccuaggcuugcuguuauuuugaagucucaagugagcgaaagaaaggauuuaagaaugauucuaaggauuuuuaccuaaguaauuggaaggauagaauuguaucagcugaaauggggaaggcugcaggagcaacuagauauaaagguaagaucagauauucagucucggguuguguuuaagauuucuguuugauaucuaaacagagagauucagaaggucaguuggauaaaugagccuggaauuuaggagagacaucugauuuggaaggaaaauuugugaguuauuaacaauagaugguauuuaaaagcauggaacuagaugagaucuccuacagucaguauagacaacagaaccagaccaaacacagaacacuggugucuucugcauuaauugguuugggauaugagaaggaaucagcaaggggugacugaucagcugcugauuucuuggucaaucaguagcugacuccuuggucaaaaaagaaugagccauaaaguagaaggaaaacuaugaaagucaggugcccuggaagccaaauaauuuuuuuuuuaacaagaagggagggagaauguuacugaugcuacugauaguucaaguacgauaugccguuagaauuaagaauuggauuuagcaacauguaggucauugauaacauugacaggagcaguuuguggaauuaaauuauaaucagcguugcaauacuuuuaaauuagucuugucaauuuggugcccuuggcauaugagcaggaugaagaugauccaaguagcuuggccucuggccuucacuuguuuuaaaagaacugcuaaucuuuguucuaauuuuguauacuggguuuccauguaauauuuucuuugggauugguaguuauaagggucuacuauaaaguaaauaaauacacuaacaguuucaaaaauaauaaagaacuuuuuaaagaacacauuacuagauguaaauuuuuaaaaaaauuuaaugggaauuuuuuguuuuaauacgucucuaauucuaguaucaaaugaaguagacuuugauuagaauguaugugcuuuuuuuuuuuucuuagcuucucuuaaugcguaagcuuaaagcuuuuuuaggcuuuauguaugcccucagacucauucauuucuuuaaauuucucagacucuucuaagcuaauauucacauauuauagucuuucuguccuccgcacuuauguugauccuuaacauauagcugauauuuugucaguguuuuuuaaauugaaggaaauggaccccaaggggguagacuuuggcuuacuuugucucauuucuuuucuugcagugcuucugcuggccugucucuuaagcaguagaauaauaaaaaguaguuucuuugaggauauaaaagcccuugagauaguuucacuuuaagcuuaaaagauuuucuugucauuuuaccucuaaaauuugauuuucauguuucuuuuuaguauguauuuucugaacccuccucuugugcauuuuaaaugaaccuauauuugguaacuguucccagcaaugccuuuuucuuuuucauaaggaaccugauacguuauucuaugccuaugugguauuuagggaggcagaugguauaauagaaggagaaaugagcaguacaucaaaaccagggccagcuucugccacuugcauucaucuuuuuaguaaauaauuauugaauaucuaucuucugugugcuagguauuuacuagaaguuugugcuuguguuuuaauuaauagacuuuauuuucuuagaaaugccauuuucacaaauuacuuucucuuagauacuaagaucuagucuguaauaaaguauuaaguacuaaaugagcaauauuaaaaauuaauauaauauuaaaauauagguguuauaaaaauugaaaacacugguggagugugguggcucacagcuauaaucccaacacuuugggaagccgagccaagaggauuacuugaggccaggagauugagaccagucuggaaaacagagugagaccccaucucuacaaaaaauacaaaacauuagcugggcagaguggcauacaucugcaguccuggcuacucuggaggcugggguguugggauuguuugagcccaggaguucgagauuacaaugagcuaugauugugccauugcaguccagccuggguuauggagcugucuccaaaaaaaaagaaaaaauugaaacaaacgacuuuuccuugguuguuggagauugguauauauugucauggaagaucaaaaguaaaauuaugagcagagaggaggcagagcaaaauggcugaauagaagccaccaggccaggugugguggcucacaccaguaaucagcacuuuggaaggccgaggugagcagaucaccugaggccaggaguuaaaagaucagacuggucaauauggugaaaccccguuucuacuaaaaauacaaaaauuagccaggcaugguggcacacgccuguaaucccagcuacuggggagucagaggcaggagaaucgcuugaaccugggagguggagguugcagugagccaagaucgugacacugcacuccagucugggcuacagaacaagacucugucucaaaaaaaaaaaaaaaagaaaagaagccaccagcagucauccagucaccuccuucugggaacaccagauugaacaacuaugcacaugaaaaagcaccuuuaugagaaccagaagcagagaugagugaucauaguaccuaguuuuaaaaucauaauaaggaaagagguacugaagagaguaggaaagacucgucccccauucccugguagcagcugugggccacugagaucauaucugugugcuuggggaagggagagugccgggauuaucagacauugcguuagaacucagugcccugucacaguggaaugcaacacaggguggaacucagcuggugcccauugagggagcauuaagaccagcccuagucagaagugaaucgucuaucucagcagugggaaccugaguuguggcaagccuugauacugcggguuaaaguccucugggguccuugauaaacuugacagacaguuguauuagucuguucucacacugcuauaaagaaauaccugagacuggguaauuuauggagaaaagagguuuaacuggcucacgguucugcaggcuguacaggaagcauaguggcuucuacuucuggggaggccucaggaaacuuacaaccauggcggaaggcaaaugggaaacagaaacaucuuacauguccagagcaggagcaagcaguugggggaggugccauacacuuguaaacaagcaaaucucaugagaacucacuauugcgaugauagcaccaagggggauggcguuaaaccaugagaaacugcuuccauuauguaaccaccuuccaccaggucccaucuccaacauuggggauuacaauucaacaucauauuugagugaggacacagacccaaaucauaucagcagucuaggacacaaggacuacaauuccuggccuaguuuuggugcuguacuaugcugggcucggagaugguggacuugcggugccuaugaccuagugagacaccagcugggaugcccaagugagugccugugucaccccuccuuuaacccuagggagugcagcucgcaauucuaagaaaaccucuuucucccugcuugaagaaaggagaagggagcguaaacacgacuuuguucuuccaacuuggauaccaacucagccacaguagauagaggaccaggcagaguucugagaccuccauuucagguuuuagcuccuggaugacauuucuagacacauccuaggccagaaggaaauccaguuuugaagggaaauaccuggucccugcaggauuuauuacuugcugacaaaagugccuugggcccugaauaaucagcaguaguagcuaagcaguacucacugcuggcuucagauaagauucagagcuauucuggcuucaggugugacccagcacauuccagcugugguggcuacggguaaugacuuuuucuacuugaaaggagagaggagacuaaggggauuuuguuuugcagcuuguguaacagcucagccacagcaggguagagcacuaagugggcucauggggcccccacuuuuaggcccuggcuccuggguggcauuucuggaucugcccugggccagagggaagcccagcauccuaaaaggagagagacucaggacuggcaguauucagcauaagcuggccgaaaagcccuugggccuugagugaacaauggugguagccagaccauacucccuucaggguucgggcagugguggccauagggugagacuucucuacuugaggaaaagggagagaagacugggaagaacuuugucuuguggcucaggugccggcucagccacaguggaauagagcagcagguagauuccuaaggucccuaauucccaacccuggcuccugaauggcaucucuggaccugcccaaggccaggagcaacuugcuccccugaagcaaacaggacauaagccuggcuggauuugucaccugcugauuguagagcccuuggacuugagagaacauagaugggguagccaggcauuggucacuguaguccuuagugagaccucgugugugcuggcuuucaaucuaauccaaagcaauacaacuaguggugaccacagggaugcuuguuuuaccucucccccagcuccaggcagcucugcacacagagacucuguuaagggaagaggacgaaaaugucugccagggaauccagggaauucugcauauuacccaagaccaccaacguguaccucaauaagccagcaagcacuacagcauuacugggcuugggguacuuccuaaugcagauauuaccgcaaugaccaaagaccaaagaucauaacacccuuugaauacuuggaaagccuucccaagaaugaugaguacaaacaagucuagacugugaagacuacaauaaaugcuuaauucuucaaugcccaggcagcagcgaauauccauaagcaugaaaaccauccaggaauacaugaucucaccaaacaaacuaaauaaagcaccagugaccaguacuggagaggcagagauauguaaccuuucagagaauucaaaauaacuguauugagaaaacccaaagacaugauguaauccuauuccuauuccagagaaggaauucaguauucuaugagauaauuuuaacaaagaaauacaaauaauuaaaaagaucaagcagggcaggugcaguagcucaugccuauaaucccagcacuuugggaggcuaagacagguggauugcuugaggucagaaguucgagaccauccugggcaacaugguaaaacccugucucuacuaaaaauacaaaaaauuagcugggugcaguggcacaugcccauagucccagcuacucagaaggcugagguggguggaucacuugagucugggagacagauguugcagugagcugagauugcaccacugcacucaaaauauuuuuugaaaagcagaaauucuggaguugacaaaugcaguugacacacugaacaaugcaucagagucuauuaacagcaaaaaugaucaagcagaagaauuagugagcuugaagaugggcuauuuaaaaauauacggucaaaggagacaaaagaaaugagaauaaagaagaaugaaguauguuuacaagaucuagaauguagccucauaagggcaaaucugagacucugaacucaaaaaggagauaaagagagagaugggguagaaaguuuauucaaagagguaauagagaacuucccaaagcuuagagaaaguuaucaguauuuaaguacaauaagguuauacaacaacuaagcagguuuaacccaaauaagacuaccugaagacauuuaauaaucaaacucccaaaggucaaggauaaagaaaggauccuaaaagcagcaagagaaaagaaacaaauaacauacaauggagcucaauacaucuggcagccaacuuuucaguaaaaaccuuacaggucaggagacaguggcaugacauauuuaacaugcugaaagaaaaaauacauauauuagaauaguauaucuggcaaaaauguccuucaaacauaaaggagaaauacuuucccaggcaaaauaccugagggacuucauugaucucagaccuguuguaugaaaaaugcuaaagggaguuuuuaagugugaaagaaaaggacauuaaugaacaauaagaaaucaucugaagauacagaacuuacugguaauaauauguacacaggaaaacaaagaauacugucacacugaaguuaugguguguaaacuacuuauaucuuaaguagaaagacaaaaagaugaacugaucaagaauaauaacuaaaacaauuuuuuaagacauaguacaauaagauauaaauagaaacaacacaaaguuaaaaaguggggagacaguguaaaguuuuuauuagcagagcuauauuaaccaaaacagcaucauaguggcauaaaaauagacacacagaccaaugaacacaauagagaauccagaaguaaaucuguacauccacagugaacucauuuucagcagagaugccaagaacauacagugaggaaaagacagucucuuuaauaaauggugcugggaaaacuggauauccauauguagaaaaaugaaacuggacccgucucucaccauauacaaaaaugaaauaaaaauagacugaagacuuaaauauaagaauucagacuguaaguacuaaaggacaucuuuggagaaacacuucaguacuuugaacugggcaaaaauuuccccacaagcacaaacagccaaagcaaaaauggacaaauaggauuacaucauguugaaaagcuugugugugacaacaaaagaaggcacacaaacagcaaagaaguaaaugaaaagguacucacgaucacugauuauauuagucuguucucaugcugcugauaaagacauaccugagacagggcaauuuucaaaagaaagagguuuaauggacuuaacaguuccacauggcugcagaggccucacaaucaugguggaaggcaaggaggagcaagucauaucuuacauggauggcagcaggcaaaaaagagagagcuugugcagggaaacucccguuuuuauuuuuuaauuuuuuaaauuuuuuguuauacuuuaaguuuuaggguacauguacacaacguacagguuuguuacauauguauauaugugccauguuggugugcugcacccauuaacucaucauuuaacauuagguauaucuccuaaugcuaucccuccccccuccccccaccccacaucaggcccuggugugugauguuccccuuccuguguccauguguucucauuguucaguucccaccuaugagugggaacaugcgguguuuggucuuuuguccuugcgauaguuuacugagaaugaugguuuccagcuucguccaugucccuacaaaggacaugaacucaucaauuuuuauggcugcauaguauuccaugguguauaugugccacauuuucuuaauccagucuaucauuguuggacauuuggguuggucccaagucuuugcuauugugaauagugccgcaauaaacauacgugugcaugugucuuuagagaagcaugauucguaaaccuuuggguauauacccaguaaugggauggcugggucaaaugguauuucuaguucuagauuccugaggaaucgccacacugacuuccacaaugguugaacuaguuuacggucccaccaacaguguaaaaguguuccuauuucuccacauccucuccaacaccuguuguuuccugauuuuuuaaugauugccauucuaacuggugugagaugguaucucauugugguuuugauuugcauuucucugauggccagugaugaugagcauuuuuucaugugucuuuuggcugcauaaaugucuucucuugagaagugucuguucauauccuuugcccacuuguugaugggguuguuuguuuuuuucuuguaaauuuguuugaguucauuguagauuguggauauuagcccuuugucagaugaguggguugcaaaaauuuucucccauucaguagguugccuguugacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucugggguuuuuaugguuuuaggucuaacauuuaagucuuuaauccaucuugaauuaauuuuuguauaagguguaaggaagggauccaguuucagcuuucuacguauggcuagccaguuuucccagcaccauuuauuaaauagggaauccuuuccccauuucuuguuuuugucagguuugucaaagaucagauaguuguagauaugcggcauuauuucugagggcucuguucuguuccauuggucuauaucucuguuuugguaccaguaccaugcuguuuugguuacuguagccuuguaguauaguuugaagucagguagcaugaugccuccagcuuuguucuuuuggcuuaggauugucuuggcaauguggcucuuuuuugguuccauaugaacuuuaaaguaguuuuuuccaauucuguaaagaaagucauugguagcuugauggggauggcauugaaucuauaaauuaccuugggcaguauggccauuuucacgauacugauucuuccuacccaugagcauggaauguucuuccauuuguuuguauccucuuuuauuucauugagcagugguuuguaguucuccuugaagagguccuucacgucccuuuguaaguuggauuccuagguauuuuauucucuuuuaagcaauugugaaugggaguucauucaugauuuggcuguuugucuguuauugguguauaagaaugccugugauuuuugcccauugauuuuguauccugagacuuugcugaaguugccuaucagcuuaaggagauuuugagcugagacgaugggguuuucuagauauacaaucaugucaucugcaaacagggacaauuugacuuccucuuuuccuaauugaaugcccuuuauuuccuucuccugccugauugcccuggccagaacuuccaacacuauguugaauaggaguggugagagagggcaucccugucuugugccaguuuucaaagggaauguuuccaguuuuuguccauucaguaugauauuggcugugggugugucauagauagcucuuauuauuuugagauacgucccaucaauaccuaauuuauugagaguuuuuagcaugaagguuguugaauguugucaaaggccuuuucugcaucuauugagauaaugugguuuuuguuguugguucuguuuauaugcuggauuacguguauuguuuuuuguauguugaaccagccuugcaucccagggaugaagcccacuugaucaugguggauaagcuuuuugaugugcugcuggauucgguuugccaguauuuuauugagguuuuuugcaucgauguucaucagggauguugguguaaaauucucuuuuuuuguugugucucugccaggcuuuguuaucaggaugaugcuggccucaucaaaugaguuagggaggauucccucauuuucuauugauuggaauaguuucagaggaaaugguaccagcuccuccuuguaccucugguagaauucggcugugaauucgucugguccuggacuguuuuugguugguaagcuguuaauuauugccucaauuucagagccuguuauuggucuauucagagauucagcuucuucaucguuuagucuuggaaggauguaugugucaaggaauuuauccauuucuuguagauuuucuaguuuauuuucguagagguguuuauaguauucuaugaugguaguuuguauuucugugggauugguggugauauccccuuuaucauuuuuuguugugucuguuuuauucuucuuuguuuucuucuuuguuagucuugcuaguggucuaucaauuuuguugaucuuuucagaaaaccaacuccuggauucauugauuuuuugaaggcuuuuuugugucucuaucuccuucaguucugcucugaucuuaguuauuucuuaccuucugcuagcuuuugaauguguuugcucuugcuucucuaguucuuuuaauugugauguuagggugucaauuuuagaucuuucuugcuuucucuugugggcaucuagugcuauaaauuuccgucuacacacugcuuuaaauguguccuggagauucugguauguugugucuuuguucucuuugguuugaaagaacauuuuuauuucugccuucauuucguuauguacccaguagucauucaggagcagguuguucaguuuccauguaguugagugguuuugaaugaguuucuuaauccuggaaacucccauuuuuaaaaccaucagaucucaggagacucauucacuaucaugagaucggcucaggaaggacccgccccuauaauucaaucaccuccccacuggguuccucccaccacaugugggaauugugguaguuacaauucaagaugagauuuggguggggacacagccaaacaguaucacugauuaugagaaacauuaaaaucagaacuacaaggagauaucucauuccagcuaaauggcuuguguccaaaagacaggcaacaacacacuggugaggaugugaagaaaagggaccccauguaccaugcugaugggauuguaaaguaguauaaucacuauggaggaugguuuggagguucuucaaaaaacuaaaaauagggcuaccaugugcuccagcaauauuacugcuauguguauacccaaaaggaaggaaaucaguauaucaaagagaugucuacacucuuguguucauuguagcacuauucacaauagcuaagauuuggaagcaagcuaaguguccaucaagagaugacuggauaaaaugugguacauuguacaauaaaaauggaauuuaauuuggagaaaaucagucaaaacuauacaguuauauggcaauuaaacaugcuccugaaugacuucuuaguaaauaaugaaauuaaggcagaaaacaagaaguuauuugaaacuaaugagaacaaagauacaacauacuagaaucucuggggcacagauauggcagcauuaagagggaaauuucuggcacuauacacucacaucaaaaauuagaaaguucucaaccuaaugucacaacuagaaaaacuagacagguaagggcaaaccaaccucaaagcuagcagaagacaaaaaaaauaaccaaagucagagcugaacugaaggagauugaaacaugaaaaacuggccaggcaugguggcucaugccuauaaucccagcgcuuugggaggcugaggugggcagaucacagggucaggaguuuaagaccagccuggccaacauagugaaaccccaucuguacuaaaaaaauacaaaaaauaagccaggcgugguggcgggugccugcaaucccagcuauucaggaggcugaggcaggagaaucgccugauuccaggagguggagguugcagugagcugagauuaugccauugcacucuagcccgggcaauaauagugugagacucuuuugucucaaaaaaaaaaaaaaaaaagaaacauggaaaaccauacaaggaccaaugaauccaggagauaguuuuuuugaaagaauuaauaauauagacuguuaaguacacaaagaagaaaagagagaagauccaaauaaacaaaauuagaauugagaaagagaauguuaccgcugaccccacagaaauacagauaaccaucagagacuacuaugaguaccucuauauauacaaacuagaaacuccagaagaaauggcuaaauuccuggacacauacauucucccaagacugagccaggaagaaauugaaucccugaacagaccgauaaugagcucuaaaacugaaucaguaauaaauagccuaccaaucccccauaaaagcccaggaugagaaagauucuuggcugaauuccaccagauguauaaagaagagcugguaccauuccuacugaagauauuccaaaaaauugagaagggauuucuucccaacucauucuaugaaaccaguguuauucugauaccaaaauuggcagagauacaacaacaacaauagcaauaagaguucaggccaauaucuuucaugaacauaaaugcaaaaauccucagcaaaauacuagcaaauccaauccagcagcauaucaaaaugguaauccaccaugaucaaguaggcucuaucccugggaugcaaaguuggcucaaaauacacaaaucaauaaaugugauucauuacauaauagaacuaaagacaaaaaccaugugauuaucucaauagaugcagaaaaagcuuuugauaaaaauugaacauccuuucauguuaaaaacucaauaaauuaggcauugaaggaaugcaaauaauaagagccaacuaugacaaacccucagccaacaucauacugaaugggcaaagcuggaagcauucuucuugaaaacuggcaaaagaccagaaugcccucuccuaccacuccuauuaaacauaauacuggaaguuccagccagggcaaucaggcaagaaaaagaaauaaaaggcacccaaauaggcaaagaggaagucagacuauccguuugcagaaaacaugguucuauauuuagaaaaccccauacuccuggccaaaaagcagcuuaagcaacuugagcugauaaacaacuuuagcaaaguuucaggauacaaaaucaauguacaaaaauuaguagcauuucuuuacaccaacaugcaagugaagagccguaucaggaaugcaaucccauucacaauugccagaaaaagaauaaaauaccuaggaguacagcuaacuagggagguaaaagaucucuacaaugagaauuacaaacacugcucaaagaaauuagagaugauacaaagaaaugagaaaacauuucguguucacugauaggaagaacccaauauuuuuuaaaauggccauacuccucaacacaauuugcgauucagugugauucuaaucaaacuaccaauagcauuauucacagaacuagaaaaaaacuuuuaaaauucauauggaaccaaaaaagagcucaaguugccaaagcaauccuaagcuuaaagaacaaaccuggaggcauaauguuacccgacuucaaacuacacccacagggcuguaguaaccaaaacaguaugguacugguacaaaaacaggcacauaaaccaauggaacagaauagagagcccagaaauaaugccacacaccuacaaccaucugaucuuugacacagcuggcaaaaacaagcaauggggaaaggacucccuauucuacaaaugaugcugggauaacuggcuagguauauguggaagacugaaacuggaccccuuucuuacaucauauauaaaagccaacucaagaauauaacgcuguaaaugcaaaaucuaaaacuauaauacccuggaagaugaccuaggcaauaccauucuggacauaggaacuggcaaauauuuuaugacaaagacaccaaaagcaauuucaaccaaagcaaaaauugagaaaugggaucuaauuaaacuaaagagcuucugcacagcaagagaaacuaucaacagaguaaacagacaaucuacaaaauaugagaaaauauuugcaaacugugcuucugacaaaggucuacuauccagaaucuguaaggaaaauuaaaauuaaacaaauuuuauaagcaaaacccaaacacaugaacagauguuuuucaaaagaagacauacaugcagccaacaagcauaugaaaaaaugcuguacgucaguaauaauuagagaaaugcaaaucagaaccacagcgugauaucuuauauuagucagaauggcuauuauuuuaaaaaucaaaaaauuacagaugcuggagggguuauagagaagagggaacaccuauacacugcugguaggaguguaaauuaguucacccauuguggaaaucaguguggcaauuccucaaagaacuuagaacuacuuuuaaacccagccaucacauuauuggguauauacaccaaggaauauaaaucguucuaccauaaaacauaugcacauguauguucauugcagcacuauucacaauagcaaagacauggagucaagcacccaugaauggcagacuggguaaagaaaauggaguguauauacaccaugaaauauuaugcagucauaaaaaacaagaucauguccuuuucagcaacauggauggaacugaagaccauuauucuuagcaaacuagcacaggaacagaaaaccaaauacugcauguguucucucuuaugagugggagcuaaguaacaacgcacguggacacaacaaagggaacaacagacacugggacaaacuugaggucagagggugggaggaggaacaggaucagaaaaaauaccuaucggguacuaugcuuaauaucugggugacaaaauaaucuguacaccaaacccccaugagcugaguuuaccuguauuccaaacguguauaugcauuccugaaccuaaagugaaaguuaaaagagaaauuuuuuuaaaaaagaaaaugugguacauauauaaaauggaguacuauuaagccauaaaaaagaaugagauccugucauuugcaacaacguagauggaacuagaggacauuuauuaagugaaauaagccaggcacagaaagacaaacuucauauauucucacuuauuugugggagcuaaaaauuaaacaauugaacucaugaagauagagaguagagugaugguuaccagagguuaggaaggguuccggggaggaguggaguuguuaaugguugcaaaaauauacagaaugacuaggaccuaguauuugauagcaaaauagcaugacuacagucaacuauaauuuauuguacuuuucacaauaacuaaaagaguauaacuggauuguuuauaacacaaaggauaaauggucaggugauggauauccuauuuauugugaugugauuguuacauauuauaugccuguaucaaaauauguaccccauaaauauauacacuuacuauguaccccuaaaauuaaaaauuaaaaagugaaauuaugagcaauucauaagguauuaaauguagaaguagaauauauaaauguuauguacauuuuuaaauuauuuuauguauuuauuaaaauagcauuuagcuauguugcccaggcuggucuugaauuacuuggcucaaguaauccuccugccuuuaucuuuaauguuuucacaugagaggauugacuuuguacuuguaguuuucuauauagcaaauuuuuacaaaaagucuaagcauaauuuguauuaaaaaguauuucuaauuuaaauauguuuuaacuccaauuuuauuucagaaaucacguaaccaccuugaagaugaaagauaaaucauuaucauuaaaauuuuuaauuuuguguauuucuagguguguguguguaacuuuaagacgcuauuauuuccucccagauauggauugucaaugcagagccuuuuggaucuguccuuuucuucauuuauggaugaggcagcugagauuuggagaguuugugacuagcccaaagcuccuacgaacucaggcuguauuuuccugguauaguugaacaaaaaauuuucaaagugauuuuuuuacuaugcuacuuuuuauuagugcauaccacaaaauagaccaauuaacacuuuugaacuaauugaaaauuuucuuaaugccauuaauauguguugcagucugaugcauuuauaaaguuucaccuguuuuucuuuuauuuauuuauuuuaaauuaaaaaaauguuuuuaaaaauguuuguggguacauaguagguguauauauuuaugggguacaugagauuauguauacaggcaugcaaugugaaauaagcacaucauggagaaugggguauccauuuucuuauacauuuauacuuugagucacaaucaaucaauuacauucuuuaaguuauuuaaaaauuauuauugacuauaguugcccuguuguccugucaauaguaggucuuauuuauucuuuuuaacucuuuuuuguaccuauuaacuaucccuacuuacccuacuacccuucccagccucugguaacuauccuucuacugucuagcuccaugaguucaauuguuuugauuuugagaucccacaaauaagugagaauaugugauauuuguuuuucugugucuggcuuauuucacuuaacauagcaaucuccaguuccauucauguuguugcaaaugacaguaucaccuuuuuuuauggcugaauguauccauuguguauauguaccaccuuuuuuuauucauucaucuguuaauguacauuuaggugacuuccaaaucuuggcuauuguaaauaaugcugcaauaaacauggcagauaucuguucgauacacugguuucauuucuuugggguauguaccuaggggagggauugccaggucguaugguggcucaauuuuuaguuuuuuugaggaaucuccagacuguucuccauagugguucugcuaauucacauucccaccaacaguauacaaggguucauucuucuccacauccuugccagcguuuguuauugccugucuuggauauaagccauuuuaacuggggugacaugaugucuuauuguaguuuugauuuagauuucuuuaaugaucagugauguugagcacucuuucauaugccuauuuaccauuuguaugucuucuuuugagaaaugucuauucaaaucuuugcccauuuuuugaucuaauuauuggauuuuccccuguagagcuguuugagcucuucauauauacucugguuauuaaucccuugucagauggguaguuggcaaauauuuucucuuacucuguggguugucucuucucuuuguugaguguauccuuugcugugcagaagcauuuugacacuugacgugaucccauuuguccauuuuugcuuuggaugucugugcuugugggguauuacucaagaaaucuuugcccaguccaauguccuggagaguuucccuacuguuuucuuuuaguauaauaguuucauagcuugagguuuagauguaaguuuuuuuaauccauuuugauuugauuuuuauauauggugagacauuauuauuuuugauuaauucaucauuuagucuuucuacuuauuuaauucauuuaucguuuugucuuucuacaccacaguuacaguguuauaauauucuguguuuuucuguggacuuacuauauccagugaguuuuguaccuucuggugauuauuuauugcucauuaauguccuuuuugauagaaguauucccuuuagcauuucuuguaggaagcucugguauugaugaaaccccucagcuuuuuuuuugucugggaaauuauuucuucuucauguuugaaggaucuuuucacuagauaugcuauucaaguuuaaaaauuuuuuccuuuagugcuuuaaauauaucaggccacucucuccuguccuguaagguuuucacugaaaaguuggcugccagacaucuucuugcaggauccuuaaggugucacuuuucuggccagaaaccucuuuggccuguggcaccuuugccugaguuuuucuugggacuguuggucucguuccacacacuggaccugcaggccgugcuuggcucaggcuacuggucuggaucccaugccugccaagggugaaccagacauggagcggcaagagguaugugagcuagugagugugaggugcagccacugcacacagucaggcacaccagcugcugcagcagggcgggcagcuccaggugcagcaugggcacuggcucuuugugaggcugcagcuagaccacacugcaggcagcuuccauagcugucacuggggaacguggugucgccuagcagcuuagauacuccaggaaccucaggccccaaagagggagucacagcccuggcuuggggcacucccaagucugggcucccugaagaguugcagcucuucuguucacccacaauguggugagcaugggguuuguuucagcccuguuuguguuacagcuguuucaguccugccauuuggcaggucccaaguucuccugaguccaggaagaaugagguauguggacaaguggagggugagcaaggugaagaggagcaucacugagugacagaaaagcucagaugagacccuggaguggguagcuccucucugcaaccuggucaucauguuaaguguuuagcccucagcagauaggaggcccuggaguggguaguuccucucugcggguggucaucccaacaucugcagcugucaacagagaggaggcccuggaauggauagcuccucucugcagcugaucaccccgaugucuguagcucucagcagagaggaguuccuggaguggguaguuccucuuugcagcuuguuguccuggugucugcucagcucuggcugagcccagggcuuuuaugggccucagaggggaggaagugccuaccaauuuguccaugagcagguccugaaaaggcaccauaaauucccucucuggucugcaagacuggcagccuggccuccugccuuuaggcccugccugaccugaagguggggccucaguggggaccugcucccuucugcccaggcuauucaugccaaggggcgccugcaggccagugcugagcugcccucagucccccacggcuucccucccaugcucauuggugcccaaaauccagagggggcugagguggcgggggcuggcaugucagcacugcccugaucauggcacacacccagcuaggcuaugacagugccuggacucagucccaaacuugcuucaagauaggagcaggcacuaggagcgggagcagacacuucugagccuguuggggcaggaggagccuucucagucucccgagagugcacagaugcccggcucuguaacuguggcuuggguggcuguagcugcaccuggcaggguguggcuccugccugcuccaggagugggaggcccggguccacagccacaacucugucacuugggcagcugcagcugcaccuggggaacucccgcuccaccaacguggaaagagcagggcucccacuuuuucccagcuucugcagggucuguggaguguguagcccuggccgugcuucccugcuguggacugggugauggcagcaaccacuccagauggccgcugcuaccauuaauauuggagcuccauuguuguuuauuuucuuuugcugcuuuuaggauccuuucuuuaucccugaccuuugcaaguuuuauuauuaaaugucuugaaguagucuucuuuggguuaaaucagcuugguguucuauaaccuucuuguacuuggauacugauaccuuucucuagguuugaguaguucucuguuguuaucccuuugaauaaacuuuccacuuuuaucucuuucugccuccucauuaaggccaguaacucuuaaauuugcccuuuucaggcuauuuucuagauccuguaggcauacuucauuguuuuuuauuuuuuuucuuuugucuccucugauuguguauuuucaaguagccugacuucaagcucacugauucuuucuucugcuugaucaguucugcugucaagggacucugcugcauucuucaguaugcccauugcauuuuucaucuccagaauuuuuauucuuuuuaauuauuucacucucuuugugaacuauaucugauagaauuucuucucugaguuaucuugcauuucuuugaguuuccucaauacagcaauuuugaauucuucgucugaaaggucacgugucucuguuucucccaaauaguuaccuagugccucauuuaguucauuuagugagaucauguuuuccuggaugguguugaugcaaauagauguucuucagugucugggcauugaaagguuagguauuauagucaucacuguuuagacuuacuuuagcuguccuuuuugggaaggcuuucuagauauuugaaaggacuugguguuguguucuaagcuguaucugcuuuaaggggcaccccaaguucaguaacgcugugguucuugcagacucauagagguacugccuugauggucuuggacaugaucugggagaauucucuagauuaccaggcagagacucuuguacucuucucuuucucccaaacauacagaaccucucugucucucuguucuaagccaucuaaagccaggggugaagugcaacaagcaucccuauggccaugaacacuaugacuacacuaugucagaccugaagccaacacagcacuugaucuugcccaaggccugcuguaaccacucccuggcuacacuacugccuauauguacucaaggcccuggggcucuucaaucagcaggugaaagccagccaaggcuguguccuucccuucagaguggcaagguccagaaguaccgucugggagucagggaauagagugaaaaaccuuagaagucucccugggguucuuuuguauuguggcugagcuggcacucaaaccacaagauucaguccuucccaaugucccuccccauuucaaaggccaccgccaccccaggccacaaggaaguacuacaagacuaccccugauguuucuuuuaggcccaaggucucuuaagucugcuuuuguuaaaugcugccuggccuaggacucacccuucaggacagugggcuccccucugguccaggguaggucuaaaaaugccauccaagagccaagucauagaacuggggacucuaagaaccugcuuggugcuguaccccacuguggcugugcugguaucugaaaccagcaagucuccaaggcugacccaagguccucgauguaguaccuggguguuucugcugguuacucagggcucaagugcucuucaauuagcagauuaugaaugcugccaggaugugucauugucuucaaggcaggggguuuccuucuggaccaggguguaucuagaaaugucaucugggagcuaggcccugaaacaggugccugacaacucugaccauugcgcagucuugccuugggugaacugauaccuuagauguaagacagaguccucccgacucuucccucuccucuccuuaaacagaaggaaggggucuauuuuggagcagggagcuguguagcaugggguuaggagagaggugaugccaacacucccuuggcagccccacaguggacugugcccuuccaguccacugucgcugagccuaguucaacaccaggauucauccaagaguugcaauccuuauggccuagacugccuucaagcuuacuuggagacaagagugcuacaggccuugguggugagguuugcaaguacuuaaguucaaacugcugggauuagugauuccccucuggcuagggcugauuuugauguucccucuguaggcgggcuuagcucaauuuggucuggcuuucugguucuaacagaaaagcacugaguucugugccuuacaauugcugaggucagggagggguggcacuggcaauucaggacugauuuuuugucucuucagugccucuuuccgggauaugaaguucaaaccaaguacuaugaaagcucaccugauuuuugguucucaugaagguauccuuuucauguguguagaagguuguuaaauugcuguucuuguuggggggacaauugguggagcuuucuauuucuccaucaugcucuacccucugucucaccuguuuuucuucuaaaaacaaucuucuauuuaucagaauaauaucaagcucuauagcuaguucaccaaacugaaaacagaugguuuuuauaauagaggcauugaugcauauuaacagcaguagcccaaauaguguguuauaaauguggcuuauguuuaucaacauaaagguuuggugauuucauuauaguuucuagucagucccuuuuguaacucauuaaaaaggucugucugaccccauuguggaguauucuuacaacuguauaugacuucacuaagauguuuucauuaguaaaauaacugagacauuggaaauauuguaaaaauaauaaguuagcuagaagaaaggaaaaugagucaaagccaaugugagaauuuagucacccauauaagggauuguuuagaucaaacagguaugauaaagaugcugcuaacgauggaauuuaaaaacuuuauugagcucucuuuguauaacauaccuuugauucauaaacuggaagguuagucuugacaacauuuugauaugacauuagauuuuaacuagaaaauaaaagaauugagcauaauuauucauaacuaauaaaauuauauuuuuccuuuuucaaauuaguuuaaggacugccauuuuacacccauaaacaaauaaaaguuuucaggaucugcuuuuccguucuucacuucacugugcuuggauucccuccauugugcuuggauucccucccucuuauauucuuucuuuauaugcuuaugagagaacaaaaauucuaaguguguaaaauagcugacuguaaaugagguauuaccaucuuggggaaaggcuuaucauccuagauuuugguucauuggccaccuuccaggcuuccuacuaaauuauuggcagcaaagcacuaaugugccucccagccaacaagugauaccaaccuaugucuuuucuuuuagggguagaaaauagucaaaauuuuaaacucuagaauucucaaacuauaaaucugggucagguuuguagccagcaaaaugaaauuuguagguacuguuuaaauugucuaaaagcuaacauguucaggaacauuuugggcaauguaaacuuaaaugaaugaauaaauaaaccaacaaauuuagaucuuuaauuuuaguaaggcuaauuguuauugguaacauuugauaguguccuuugagaaacugauacugaagaaacaaaaaaaauuuaaugauuacuuucuucuuucuagaauguauuauuauagaugauuuuaaaugauauuugguuuuugaaaauuaugaaauaagguaugugaaaccuccaaauaaauuguuguagcaacaagaaauuaaugcuauuuuggaacuauaguagcuugauaaccuuuuauaauguauuuuaaaaaaauuaauauguggaguaggcuuauaaaauuguauuuuuucccaacaugaugaaaaccuauuuuuaucccauuaauaggcaugaauguuggaaucagagacuuauuuaacagaagucuuuggcuauuaaugaauaaacuauaaaaugugaugggguucgagucaugugcucucuucagagugaaaaaugcuaugacuuaacccuaaucucugugaucauccuguuuuuccuguaaaaauuccauuuuuuuuuucuccuuccaacaguauuccacaaaguaggugaaaccuuucucuggcuuccuucucaauguaugaccuaacugcauaaaaauuuuuaucaauuguucauaacuuuuaaauuuauuuuuuggcuagcuaacuuguuguuaaggugagauuuuuuuccauauaggagacccauuauauucagagauuuauuuuuuuuaauuuuugagaauuugaggacacuguaccaacuuacacuuuuaguaugcuaugaaguaugaagcuacuuccuaugguagagaaaauggaauuggaggcuuucaggguaaauguuuucaauguaguagauuguguauauuucaaauccuagaagaccaaugaaaguugagugaaaauaaugacacauuaccccagaugcauaaggagcauaaaaguucucaaauacguuuuccacagagcagucuucccacuagauauugauuguuugauuguuccucaaguuaaacauugaauuaccaugggaacuagcaauuccacuccuagguauauacaaaaauucaaacagauacuuaaaugccuguacacaaauguucguagcuucacuauuuacaauagccaaaaggcaaaaaacaacccaaucaucuaucaauggaugaaugaguaaacaaaauaugguauauacauacaauggaacauuguucagccauaaaaaggaugaaguacuaauuuauacuugcugccacauggaugaaccugugaacauguuauccuaaguaaagaagccagacacaaaaggggacguauuguaugauuccauuuauaugaaauauccagaucaaguaaauucacugauagagaagcaaauugccaggguuaggggagggaagaaaacaguguggcugcuuaauaguuauagguuuuucuguugggguggugagaauguuuuggaacuagauagagggauuaguucugaacaugcuaaaugccacugaauuguacacuucaaaaugguaaauuuuauguuauguggauuuucccucaaguuuuuaagaaagaauaacuaguuacacuaguuuguaggaugaaugcugucaauaucagugucuuuacauacaguauauuuuugaaaauguuugcuauggagucagaguaccuuauuccagaauuagagaaaguucuccaaaaauuagaucucuuacuauuuugcuuuguugcaugauuugguuuuuguuguuuguguuuguuuuucacuguuugcaaaucagaaaaacuaacaauguuuagaauuccagauugagagaaauuuuuuuuggucuggaauuugcauaaugacuuuugauggacaaaauaaaaaaguuuuagaagaccauaugauaaaagaaaaaauuaaacuuguuaucauugauugcugaggaguuuaauaaaaucuucauaguguuuaaggaucagugguugacagacuauggaauuugucaguauuaaaaauguacuaaucaucugcccaacaaaaaagaugaacaagggaauuaaaagagcuuuaguauuuggugcucuuuuuugauagaaaaugaguagauuuaguguucauuugccacauaugguuucauuaauagcaauucagcuuuucucugucccauuucaggcuuuacacuuagagagguaaaaccagcccccaucagauuuaccaugagauuucuguguguacuguuuguucagagguuaccuuucaacacuuucuaagcuguauuaucuguguuaagaaaugcuuuauuuagaauuaauuuauuucauguuuaugguaaguaaaugacauguuaauauuauguuuguuaagaaaguauacuauauccaaauaaggcuguuaauuaucuaucucuaacaacaaugaaauuaacuuagagucagacuuaaccugaagugaaaacacacugcauucuucagguuaacccuuuuggcucucuuucgguucucauuuaagaagaccuggaacuccuaccugccuuuugcccuguagaugaggaauuuucaccuggcuccuuugucuaucagccacuuuuguuagucuuaugaccagugacugcuggagauagagcaccugguauauguagcauguuuucugaaauauuuugcuuuagguuaucaauuaaugaaaucuccacucauguuaguauaagacuaauuacagaauaacauugagagauacuaauagagaauggguauaugccuagaaaccauagaacagcuuaaguuuaaauaagagagagcauuggaaugaggcagauacacaaaauaugauuucugcuccacuucuuucucuuauucaucugugaaucauuaccauauuauaccauggccuuuuucuagcagcacucucuuugggaguccagccaccauaugauacuauuccugaagguucuauucuuauucucuuucuuuggcagaaacaccccagggagggagccaacuugaguuccccuuucccaauuaccuucuaacuauuuccccuaucccacauccacagcaauuccccucaaggcuuuucucugacuaauaaguccagaugggcccaaccuccuuauacuuuuacuuuuagguuauauuugucuucuauaucuuuaaugagcucuucacuauuucacauuugccuguguuuaaaaaugauugggagaacgcaaugaauaauuucccuguacaacuuuuauuucugaagggaaaaccauugugaagauugugcaccaauguauauagacucauaguucaucacgcuuaugugcugucugcucuccaucaguauuuuucuuaggguugcccugaaaguauuuuccccaccuaugcuauucuaauagucgagacauacagaguuugucuuuaagauacugaauccuuauuaaauguaguuugauuagaaaucaugucucggaaaauauuuuaugacuuuagauauuuaguaaaaucuuauuaccuugugauggauaacuuaauaaauaaaaagucagaauuuuuauuauuaaacuauaaaauauuuuuauauugaagacauuuguucucuugcuccuuucucuuuuagguacuaaccucaggguuuggcaucucaggcaucauccacaucccgugaucaaaccuucuuauauggucaccuuauauaacacagcaaugcugcuggcccaaugccaacaaauacuacaccuuaaaaaugaaacaaaaugauaaauccuucuuauuugacgugcccucuaaaacuaguaucgucauauuuccuuagcagcuggacuaaggauuuaaugaguugagaaagagaggaaaggguugguaggaaaacugaguggcaguguaggguggugcaagcugccuacauggaucagcuccaucaauaagcaagagaugacgaugagagcagugcaaaaggaccaaccaggacagcauugucagaaaguauagguggaacuucagagaaucaaaaggagcucaacucaacucuuuccuuaguucacaacucauaggauugcuuauuaacuuuaaaucaucaaacaggucuccuuucaguuaccuauucugugaguccucucuaauacuagcuuaagauaagaauuguaguuuuacuuuaauguaucacuuacuucucugucagaucaagcaaggaggguauucagccuuaacuccuuuaggaucuuaaguagucauauuuuuucuuauucauucugauuuaagauuaugaaaauccugaaaacgugauuuuauauuucagaauagacuacauguaauucaaucuguaaguucaaggacauuggaaucaauauaauuuaugguucuuucuucuccucaacaugaauaacuucaaauucagugaaguguucagcuuuucuuacccaaaugguauacuuauccgauucacuucaauaguugccuauuuucccuuucagaaaugucuguucucucaccaggagacuaaaacauugugcagauguacaguuggauacaaugaugccaauauaauauaugcacuguucaauaauuuauuuuguaucuggagugaugcaucuguuuccuucuugugggaggggguuugagcuucauuucaaugucauuuuagguacugguccaauucuuccauccaguuaaccaaaaaugaaaauuuccaucuguucaauuggcauucggaggaauguuuuaucucugaagcacauuaugacaacuaaaauugacagcauaaucugucugacuuuuuucucuuuuauucccucuucagauucucuugagauuuaacaagagaggauucuuuuuuacagcuccuaagauuauaggacuuacucuuucuucugucuaguaacuguagaccaauagaacaugaauggcuguccacuauucacugcuuuauuauauauuuuuuucuguccauuugugacucuacaggaaauauacuuguuagcaugcuauuaacagaacaaugcaaacauagcauucucuuuccauaaaugucugccaguacuauuuggcauucuguugaaugcacagauucucugcaaucaacguuuggaagguacaguuacaggcugauuuuuauugaucguuccguacuuuagaaaacuggcuaagaaggccuuuggaauauacugcuucugaaguuuuuuaacucuuauaauucuaagaauauugucucaaguuuuguugcugaaauggcaaaaauguuucuuuuuuauuacuaucaauauuccaauuuaaaauuuaaauaaggagaacucuuuuuauuuaugagccagguaaaauuuuucugguacgcugaauaaaacaagguacuauccaucaaauaaaggguuauauccuuggggcaucaugauuaggauaagauaacuaauuuuuauggcaguccccuaugugaaauguaaauagcaauacaccagaacuucagauauguugaaucccagaaaaauauccuggauggcuggguuucuuugaaaaaaaaucuauacuuuuuuuuuuuuuuuuuuuuuaagagacaggaucuugcucugucacccaggcuggagugcaguggcaugaucguagcucacugcaaccucaaacuccuggucucaagugauucuuccuucucccauuucagccuccugaguaguuaggacuacaggcaugugccaccaugccuggcuauuuuuuauuuauuuauuuuuuauuaggagauugaggucuuacucuguugcccagguugguccugaagcucuguccucaagugauccuuccaccuuggccucccaaagugcugagauuacaagcacgagcuacugugcccagcccuaaaaucuguacuuuuaguaaacaucuccgaugccuguauccuuucuuuuuuuucuugaaaacauugcaugauaguuuacacuguaauaacgaccacugcuuacuugccuauccuguaaaauauuugugccuuuauaguccuuugaaguuuauuaggcuauuugcaucuauguuauuuauuuauccuauguggcuguguucacuaaguuuucugucuuauuuguuuuuauuuuuucucuuuucccgugcuauuggcuuacagauaucccuucuauguucauauaucucauguacuuucuuauagcaaacaugauuuccugugaauuaaaucaaugaguuaguaccauauuccaauuauauuaugcuacccaauguaaaggauaacacuuaaaaaacugaaauugauuuuuuuaauaauacaagagucugauauaauggauaaccaacuguaaacuacuauugaggaguauuucaaaagcuuuaauugugaaaucuacuggaguaucauauaagggaauaaaagagcauucuugagauuguuaaacauuagaacugaaggauuuuagauguuucagacauuuuuuagcuggaauaacaugaaaauauguauauuuguauauuuuaugggaggcugaguaaauuuaagucuacuauuuuaggucuuugggaucucacugagaaauucuccagacuagcaugguaacuggcacuuuuacagguaaauaaacauugugacucuaccagucauagagagagacauggaaggagcuguuucagauccaagacacauacaaaagaaguuaaaacuuuucugagauaaagugaauuacucauagcauugacccaaaauaguccauuuaagccccuagaacucuuaauccagcaacuggaauacuaaauccuauauggcuauaaaauguacuuucacuucaacagggcuuguaaauuuauucuuuuuuauuuauuuauuuauuuuucuuauuauuauaguuuaaguucuaggguacgugugcacaauaugcagguuuguuacauguguauacaugugccauguugguuugcugcacccauuaacuugucauuuacauuagguaauucuccuaaugcuaucccucccugcuccccucaccccaugacagaccccggugugcgauguuccccacccuguguccaaguguucuuauuguucaguucccaccuaugaguaagaaaaugcagugauugguuuucuguccuugugauaguuggcuuagaaugaugguuucuagcuucauccaugucccuacaaaggacaugaaaucauccuuuuuuauggcugcauaguguuccaugguguauaugugccacauuuucuuaauccagucuaucauuguuggacauuuggguugguuccaagucuuugcuauugugaauggugccgcaguaaacauacgugugcaugugucuuuauagcagcaugauuuacaguccuuuggguuuaugcccaguaaugggauggcugggucaaaugguauuucuaguucuagauccgugaggaauugccacacugucuuccacaaugguugaacuaguucacagucccaccaacaguguaaaagcguuccuauuucuccacauccucugcagcaccuguuguuuccugauuuuuuaaugaucaccauucuaacuggugugagaugguaucucauugagguuuugauuugcauuugucugauggcccucaaugaugaugagcauuuuuucaugugucuguuggcugcauaaaugucuucuuuugagaagugucuguucauaucguuugcccacuuguugaugggguuguuugauuuuuucuuguaaauuuguuuaaguucuuuguagauucuggauauuagugcuuugugagauggguagauuguaaaaauuuucucccauucuguagguugccuguucacucugaugguaguuucuuuugcugugcagaagcucuuuaguuuaacuagaucccauuugucaauuuuggcuuuuguugccauugcuuuugguguuucagacaugaaguccuugcccauaccuauguccugaaugguauugccuagguuuucuuguaggguuuuuaugguuuuaggucuaacauuuaagucuuuaauccaucuugaauuaauuuuuguauaagguguaaggaaggaauccaguuucagcuuucuacauauggcuagccaguuuucccagcaccauuuauuaaauagggaauccuuuccccauuucuuguuuuuaucagguuugucaaagaucagaugguuguagaugugugguauuauuuccgagggcucuauucuguuccauuggucuauaugucuguuuugguaccaguaccauucuguuuugguuacuguagccuuguaguauaguuugaagucagguagcgugaugccuccagcuuuguucuuuuggcuuaggauugacuuggcaaugcgaucucuuuuuugguuccauaugaacuuuaaaguaguuuuuuccaauucuguaaagaaagucauugguagcuugauggggauggcauugaaucuauaaauuaccuugggcaguguggccauuuucacgauauugauucuuccuacccaugagcauggaauguucuuccauuuguuuguauccucuuuuauuucauugagcacugauuuguaguucuccuugaagagguccuucacaucccuuguaaguuggauuccuagcuauuuuauucuuuuuaagcaauugugaauuagaaaacuguguuuaaaacauagcguauuguuaccagggaugugucuagagaauguauugcaguacagguauuaccaucuaguuaguuaauauuguaaugaaaacuugagcuuuuauuuacuuaaaauuaaugaucauuuuggucaaggcguuugaauaaccagagcuuccaaaaauacuaguggcacuaagucucugguuuuggaacaauauaguagaaagaagcugucaauauuuaucucuuaaagaacggauuuuuuuucuuguaaauuuguuugaguucauuguagauuccggauauuagcccuuuaucagauggguagguugcaaaaauuuucucccauuuuguagauugccuguucauucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcaccauuuauuaaauagggaauccuuuccccaucucuuguuuuugucagguuucucaaagaucagauaguuguagauauguggcguuauuucucagggcucugugaaaacaaacaaccccauuaaaaagugggcaaaggauaugaacagacacuucucaaaagaagaccuuuaugcagccaaaaaacauaugaaaaaaugaucgccaucacuggcuaucagagaaaugcaaaucaaaaccacaacgagauaccaucucacaccaguuagaauggcagucauuaaaaagucaggaaacaacaggugcuggagaggauguggagaaauaggaacacuuuuacacuguuggugggacuguaaacuaguucaaccauuguggaagucaguguggcaauuccucaaggaucuagaacuagaaauaccauuugacccagucaucccauuacuggguauauacccaaaggacuauaagucaugcugcuauaaagacacaugcacacguauguuuauugcggcacuauucacaauagcaaagaguuggaacgaagccaaagguccaacaaugauagacuggauuaagaaaauguggcacauauacaccauggaauacuaugcagccauaaaaaaugaugauuucauguccuuuguagggacaugcaugaaauuggaaaucaucauucucaguaaacuaucgcaagaacaaaaaaccaaacaccgcaucuucucacucacaggugggaauugaacaaugagaacacauggacagaggaaggggaacaucacacucuggggacuguugugggguggggggaggggggagggauagcuuuaggagauauaccuaaugcuaauugacgaguuaaugggugcagcgcaccagcauggcacauguauacauauguaacuaaccugcacauugugcacauguacccuaaaacuuaaaguauaauaaaaaaaaagaauggauuuucacaucucucaaaccuugauaauugauguuacuacaaagaauagucuuuguaagaaagauuaacaagcaaguguauacagauagcaaaggcauuuauucacauucuuaguuaauaacauccaaaauuuguauggagcuuuacagccuuuagaauaguucauccacaccuuauuucucucaauguucaaaacaaucucaaggucuuaggaaaauugcuuaaaugcacugagcuucaauuucauucccuauaaaaugcggaugauuucaccuaucuugaugcauugugaguaguaaaugaguauguaaagggcuugguguaucaguauuauuauuaccaccuuuaucuuuacuuucaucaaccauuuguggcacauauuggcugguuaauuuaguuaauaagugacagaacccgaauguaaacauagauccuucucauuccaaaucuuauguuuguuucuuucuauuaucucuuccauagaggcagaucauuuuaagcucuguagaagaaauauugacuagggccuugaaggaugagguuugcuuuuguagcauccaaggcuuuuuaugaacuaaccgccuuccuugucugucuuaucaguuuuucuucuuuuauuauuuauuuucccaagugugucuucuauuugagguucuuaauuccugccguuuuugucuuuguacauuaucauuucuagggggcauguaaaucuuuuacuguggucuuuucuacuaauccguaucuauuauuguuaucuucauaguuuacagugauuuccuacauuuuuuuaaaaaauugaaaaucgaaagacaacauucugauauuuucuacauuuuguaaaaacucuuuaacagcguuuucagaucacagaauauuuuagguguuauaaguuaaauguauucugaagccaaauaaguugagggaacaauuuguugaacagaguuaaauagguuaucuaacaaaaugcagaaccuauuggagcauuuaauuugcuauugugcacuggaauucuccaagagggaaaguagagguauagggguauaguaggcaggauaugguauguaacaucuccuaaucucaccaaggaaucaacccccucccucaagagcaucucaagagauuaauucauuggacugcccagauuuauagcaaugauacuuagaauacucuugaccugugacaucagaauuaaacuaaaucaauuaaauuuaaaguuacuuuuuaaauuucaagauuccuuggaccuaccaguccuacuaaaacagaaucuuugagaagugaaauaaaaugucuuguaguuuuucuuuuucuaucucuuuaguaauugggcuaauuagagcucuguucucagcuaauuacuagucguacuguacuucuucaagucauggaauucacucucauggcuccagugcugauugcccuaaagcaaaucagauccauucucccuauguucugauuccagacacuuaaagacaacagcuuacaaucagauauuuaauggggccucagaaucaucagcauguuaaaacugaaacuaauuauucccuuccucuaaaaaaacaaagcaaagcaaaacaaaaaacuccacaucuccucuaguauuucuugucuuaauaaaugaugccacuuccagcuagauguccaagucagaaaccugagagucagacuuaacucuuucugacuuacucccaauguuccuucaauugucugucaauuagacuuuguaacaggcucuugaauccuuccacuucucucuauccucaguaccucuacccuggucuagucaucugucacuuucuccugaacuauaacuaccucuugauuuucuaccuccaaccuuguucuccuguaauccaggcuucacacucuggucuuggugagauuucugaguuucaaaucugauuauaugacuguagcuuuaauucagugacuuuguaccauccuuaggaucaagucuaagcugcugaauuuaggaggcauuauuacaaggugucuggucucugccuuucugacaaguauuaucucacucuacucuucccuuugcucucuauccuucagcccgcuacagcuucuucaauucguuuucuguguaucauaggucuuuacacauguuuugcuugccucuagcuaccuucuccuccuucucuccuuucugcauucaacucuuccauuuagcuaaccucucauccuuuaucucucauuuaaauacaucuucccuggggaggccuucccuauuuucuagacuggguuagaauccugugcuauauguucucauaguucuuuuuuguacuugucuuaccacucucuguuauuacauauuuuagugguugcuuuucacugugggcuugcuguggcuuaugcagcuauuugccuugcauuauauauucaucccuucuucuuucaguaauaagaacucuaauuuuuagcuggacauauugccauauagcaaaucacuacauucgcucuuuucuguuacagcuagguuggcuuuaguauuaaauuuugggcaauaagauauauguugaguaugacuucuguaacguaucacuaaagggaaagggcauuuucuucuuuuccccuucccuuuucuccugcuggcuagaaugugaaugugcuggcuggccuuuuggcuggccuuuuaguagccauccugggucaugagauggcgcuguaaggacagcagaguagccagauagaaggagccugaaucccuuaugauuauggaucugucaccauuugagcccuggagucuuguccuccauaucugcuuuaugugagagaaaaauaaauaucucucuuaaguuaguguuacauaguuacuuccuuauguauuuuuacuugcugauauagcuguucuucauaugagguuuuuccuguguuuucguaauucugugccuuaugaguauuuuuguuaggaggcagagcucuccccgcugccuccccagaggaagaacuguguacucaugccuccagcuucccuuguagccaggccauggacauaugaucuagacucaaccaaugagaagugucugccccacuuuugaguucaugaguuagugauacaaauaaauaaaugggagcagcagauaauucuuccuggcagugguuuuaguuggguagaacauuuaggggaagagggaaggacgagcacucaagcuuaggcaucaccuguuguuuagugccagggagauuaguggugcaaauuguaauaucuguugcugcgugguggcugccauaagguaggucuucacugaacuaguucuguggcaucauuuucagugguuuccuuuuucauuucauagcuucugaaccuguuucuucagccucccaacaauuaugugagccauccaacaucuccuuuuagguuuaaacuaagcaaacguuucuauugcaugcaguuaaaauccucuacugauaacguuaucauuggucuucccuggcagguuguagaugcugugagggcugucuuacucaucaguauauccucagugccuagcaucucguuauacccgaacucaaugccuggcacauuaaauagguguuuaguauguucucuuuuuuaaaaaaaauaaauuagcaguccaugccuccaauaugaacuuucuuaccugcucuagcaugcuucuagcuccauuaaucuacucauacugcuuuugauaagauuacuacugguaaccuguuugcugaauucagugaauauuuuucacaacucaauuaacgucuuuaaagcuuugauaaugcuauuucuuccuuauucucauuuuaccauucacacuguuuuguuuuguuuuguuuuuuagguuucucaaacuauuccuuauuaucugucagcucucacaucuuuauguuccuccagauuucuuucuucagcucacccaucccucuggcuucaguugcuguauaugaugaugauuuucagaccuuaucuccacccagaccucucucuugagcuuuaaaucaguguauccaacugccuacucaguauuuccaccaagaucuucuacagaacucucaaauucaacauuuuuuacauguuuaaaauuaaaugaauuuuguuguuucuucccaacagacaaauauugaagacauagcuauuaccuaaaucauauggcuuacucuaauuuucagccgauucacugaaauuaaguaaauaugcauguguaaauucacaauuaaaauuuauucuguuauuuuuuccuuuuccaaucuaguacuuuaugauuuuuuaauuaguguacaauuaaaacugcuuauaauuuccaaaauucugcuuagugucaagacuuuacuauugaauauagacauguugaauaauaauauauauuaguauuucauguugaguaaauguaaauuguagaauacauuuggaucuauauuucucuacuuugaaaaaucauuuaauuaaauuuuaaacaauuuuauuauuuuuguuuaauagaauuuuuagcuuuuucuaacuagaaugaauauuuuagcuuucagaaaaauauaaaacauuuuacaaagaaauggggcaaaguaaaugaaaaaauagucaaacaaagucacauuuauuucuucuauaguaguuucaccuauaaucucauuuauucacuuugacauuuucaauuaauuguuuugaaaauuguaacaauaauuugguuuaaucaaauuuguaucuugcuugaacucucuaaguagcaauugugugaauagcaugacagggcaauuucaguuaaaaacuucuccaacaguuugguuaccuuggaauaaaaaaaaauuaucuucauauugggguacuauuaagucacauaaacaaauaaaaaugauuguuaguguugcaagcauucaaagagagaaguugagaaaauuauugaaacuuggagaguagcuuuuuuaaaaaaaauuaaucagccccagggaacagcugauaaauaaaaaauaugguaguacaauuuuguucauuugaaacccucaagcuuaauuaaauuuuuuuuucaacacuuaauuuauggaagagcaauuggagcuuuuggauuuuaauuuuguuuaaugucuuuuguucaaagguacauaaaaagaaauuuuucccuuuauaauaauuucuuucaacucucuuaagguauuuuaagauuuuuucuguguuauauugauuuaaugcuuugugccuuauuuggauuauauuaaagcuaauggauuuauuucuaacuaguuauucuuuuuuauuggacaucugccugaauguuugaagauuuugaauaaagccaguuuuaaaaaauucacugcucugaauuauauaacauugaaugugcuucucuagucauguauucucuguacuguugguugugcaucacuggagacucagccaagauaucuuuugguccuaauguuccuaacuuuaucuccuuuuuuuuuuuuugguagaguuaggaauuccuaguuuaggugaaaaagaaugugugauaauaaaauaagcauucaacauaguaguuuagagaaaacaaagauagaaauuuggaaauauacuaggaaauuccugagaaguaauuuauguguaggucaugugcaaagcaccuuuauagacacgcuaacuuauauaccugaccuuggaguaauuccuauuggagauuauugaauuugauuguaggugugguaccaugggaaauacauauuuaauuuuugucuccaguuucuggcacacagcuccuaaaacccuuggaaucucuggagugaugagaguguuucuuguaugcucaugagauggcugguggcaaguguccccuagauaguuuaagaauggggcugguccccagaaagaccaagacaugauuaagaugguugagauuuacagccuuacccccucaaucucuggagaggggagaggggcuggacguugagcuaaucaccaaggccagugauuuaagcaaucaugccuauuuaaugagaccuccgugaaaaccccuaaauggcagaguuuggagagcuuucagguuuugacaauagccacaaguuggugaacacaucuacaugccaggaggguggcacaccucagcuccauggggacagaaguucuugugcuuggaaccuuuccagauuucacccuauauauaccucuucaucuggcuguucauuuguauccuuuauuguaaguaggugguagugaauaaauugucuuccugaguucugugagcugugcuaggaaauuaucagacuugaggagggaguccugggaaccccuaauuuauaacugguugguaggaaguacagauggcaaccugggacuugugaccugugucugaaguaccaauagucuugggacguaaccuauggagucugcacuaacuccuaggacuuagugucauaauugaauuaaauucaauuuuaggacacccagguggugucuggagaguugaauaauugguuggugugaagaaaacccccacauauuugauuccagaaguuuaaguaaaaauaacucagaguaggccauucuaacauuuuuguuuuggcauaauuguuacccuuauuugcagcuuuuuuugaaacacuaagacugauaaacuuucuauugucaguuauccauauaacagaucuuugguuuuauaaguuuuagaaaguuguuaaacucuuaacuauauauagggagaagagaauaucuuuugcauauguuuaauauuuauucaacacccaugauauaggcauuaaauaauaaugcagaauuuuuguuucuccuuuuucuuguuuguuaccucuugagacuaaauugaagucaaagaacuaucacaagcaaggcugacuuuugggacauuggcuucguuuugaaguaggcaugcuuaggcaugaacuccuauuaacucugaaaguaggucauaucuaaugguagagucuuuuaaaaauuucagugacuaaaacaauauauacuuaucugacacacuauuuuuaauuacuuaaaaauguuacuaaauauaacacccaauuuuuuaaauuaauuuuuuuaauuuuucagacagggucuugcucuguugcccaggcugaagugcaguggcaugaucuuggcucacugcaaccucugccuccuggguucaagcaauucuccugccucagccuccugaguagcugggacuacaggugcaugccaccacauccagcuaauuuuuguauuuuuaguagagauggaguuucacuauguuggccaggcuggucuugaacuccugaccucaagugauccucucaccucggccucccaaagugcugggauuacaggccugagccaccucaccuggcccaauuucuuauauuucuguauuuaauaugaaagucaugaaaacuuaaugauuguugaaauauuucuggauguccuuuaguacuaagaaaucuuuccacauuagugcacagaaaauucugcaugucagaauagcaaucaguacuguaaauuuccaaguuucuauuuaaaaaugauuaaaaaaucugaagcaaaaagguuaaaaaccaacaaaaauaauuacagauuauauauaguuuccuugcccugucuuaugguggugauuauggauuauauuuuaacaauuagauguguggcuaacagauuuguguuuuaaaaaagacuuauggcugggugcgguggcucacgccuguaaucccagcacuuucagaggcugaggcaggcagaucacaaggucaagagaucgagaccauccuggccaacauggugaaacccugucucuacaaaaaauacaaaaauuagcugggcgugguggugcacgccuucaaucccagcuacucaggaggcugaggcaggagaaucgcuugaacccaggaggcagagguugcaguaagccaagaucacgccauugcauuccagccuggcaacagagcaagacucuaucuaaaaaaaaaauauauauauacagagguaaaaugauuuaccuuugggauuuaaaaguauuauagacacauauauauuuggcacccuuuuuauauaaaauucaaaaaggaccaaaggcggcagaggaagggagugguauguuauauaagaugaaaaagcaaaagacugaaauuacaaaacuauauauugggggacauaaggcuaguuucaaagaaauccuguuggaugauugcuuucauuguaugcguauugaaauuauaaugcauuucugguagguggcagccauguagcaugaaagcugguaaauaacuaugugguuggaaaacuaugagauaacugucaauagggaauuugaagcuuucuucuuuuuucacuaauuuugccuucuaccacacuaauauauugucuugacagaguauauuucuuaagguggagauaaaugcuugaguaauuacuaugcuguccuccgcuauugugguaggagucugugaaacaguucucuccccaaagccugaggaucccagaucaagugccucuguuuuuuaaucaucugaaugucauguaaaguggucaaagcuuguaguuuuaggcaucaacauggcuuauaaaucucgauaauaauugagucucaguuuaaaggauugguagguuguucgugccuguguaaccuugaccucucauuguacccuugauguaucugggauauccagcaccuggugccuggccacacuugguaagaucaggccuaucccgaagaaaguagucauccuuaguauucucaggggauugguuccaggcuucacaaggauuccaaaaucugaggaugcucaagucccuuacuguacucguuuucucuucuucauuuuuaaacucaacauuugccucaaaucaaaagcauauuccuuucucuacuuuucacucuugcuuuuuucuauucgaaugagauagagguaggcgucaaacagcuuacaauagguaguaaguucuaaaauaacugauuauguccuaauaagaugauuuuggaauaagacaaauucauacugauguuauguugacaggguauauuagggcaaaauaaacaccucagacucagagaauuaagcaugggaguccuuucuguauuaaucuaaauuuaaaaaucuuuguagaagcuuugaacuaaaaauguaaacaaauagauuauugauucggguuuucuuugggcacacuuuuuuuuuuaauuaauugacuuuugcuaaauuagauaacuuuguagaauguuugagacaaaaaaaugaauguaugauuuuaugugaaauuucauuauguaaaauuucagaaagcaaaaguguggguuuucaguggugugguggagccagcuugcaccagcccguuagaacugauuggaaauuuuguaaacuaguuguuaaauauaaacauuaguaaaaauugaaguagcugggcagggugguaugugccuauagucucaacucugugaaacacacaggcaggaguagaggauugcuugagcgcaggaguuugaguuuagccugggcaacacaggggagacccugucucuuuguauuuauuuauuuauguuuuuuuuugcgauggagucucacucuguugcccaggcuggaauacaguggcuugaccucggcucacugcaaccuccaccucccagguucaagagauucuugugccucagccucccgaguaacugggaugacaggcaugcgucaccacacccagcuaauuuuuuuguauuuuuaguagagaugggguuuugccauguuggccaggcugaucuugaacuccugaccucaagugauucgcccaccucggccucccagagugcugggauuacaggcgugagccacugcauccucauauuaacuuauuuaauuauaaguacauacaaagguaguaaauacuuaaaacucaguacuuucuaauuagcuuacuacauuuuacuguuaucuaugcucuugagguuauuuaugccuaucauauuuauaugguaaaauaauauauaauggcuggcuaccgggugugucuuccuaacuucacauuuagugacaucauguuagagccugaacuuagccauaaaagaguauuuauuuaaaccacaggaauuggcaaaugcuacaaaucagggcuuaauuuauucuuuuguugauugugcuuaaggaagugauagagaaaauguuaaugcaugucgugucuauagucauuauauucugaauuucacaaaaauuaaggaaacagucuuccaauauucaaauaaguuuaauccaaucaguauuuauguuggaacugugcccagaagauuauuaaacauuuaucauuauaccacugguuuaaguucaucaaauuuuauuaauguuuuaauuaacaaauuagaauuuaacauaaguauuuuaagcuauauaaauggcaauaaaauguauuuuuauuuauucaauaccaguuuaccacuuagaacaugagauguauuuaugcauuuauaauaaaauguaguuuguaguguucuuaaauuuguauauucucauucaccucuauauggagguucccuaagugacugauaaaaguaauggaaacuuuaaauaaaaacagugacagcaaaacugaauuuuauacuagagauuaugauuccauaggcuuauggaugguuuaagagccugcauuuuauugcauaucuuauauggauguuauuagaauaccauuagcaauauagugaaaaacuuuuuaguuccuaagaaaauuguuuccaaauaaaauaucaauaugcacacacaaaaaauaagucuuaagauuuguuuucuuguacugacugucauuuuagaguucuauuaccuuauguggguaauucucauucucuuuaaaagccuguauuuccucaucuguaaaauaaagacauuaugcuagauaaucuuugagguagaaaugaugauuaucaaaacguuaccuuucauuuauagggauuaauuuuuagugcugcuucugaauccacugaguaucuuaucccacaagaaaauugaaggauuguaauuuuuuucacuuguuucuuuaguuguauuauggggauaacaauaguacccaucaucauaguguuauuuuggagauuaggcaaguaaaccuguuaguguuuagaagaaugucuggcacauaguaagugcuguauaaguauuagcugcuauucuaccuucuucuuguuuucccucuucucuccuuuucccuaucuucacuccccucccucauuuuacucuuccccuuuccuuggaggguugauacuaaacuacaacucuuuuucuuuuguacaaguagaauauuaauaaauauucuuuuaaaaaaugcaguacacuucaauaaguucauaacaaauuaagaaaaauuuuaaaguuucuuagaaagacuauuuuuuuuccagcaacaaggcaaucuaauguagcuaaaaaacccuccugcuauaaaauaccccguagugcuggauaaaauauaaauuuuguuuuuuucaaacauccagcgugagcuuuaagacaauaaggaaaauaccugguuuuuaaaaaaugaaugauuuuuacauauauucuuauaaaugagaugggccuuaccuuuuucuuguacuggccucuucugauuuuugguaucagauuauguucaccucuuaaaaagagcugaaucauuuccuucuuuuuuucuauucucuggaacagauuguguaaaacagagguuagauguuccuaaguguccuggaaaauuuaacaguuagauauucuggucuugguguuuuuuacagaaagauuuuugacuacaaauucaaugucuuuaauaguagcagauucuauuuaguuucucuaauucuucuuugauccauuuugauaauauauguauuuuggaaaauuauacuguuuaaguuuucaaguuuauuuguauaacauuauuuauugcauucucuuaugcuuuuuacauauauuuguaaauuccuaacacugccuuuuaaaacuugaccaauuaauaagauguuugucuauaauuauuuucaaagaacuagcuuuuaauuacaucguuuuuuauuuuguuucacuaagcaauaauuguccucuuuuaucucauauauucuacuuucucuguuuccuuuucccaccaacccccacugguauuauuuuucugauuucuugaauuaaauuuuagauaaucaguuuuuaguuucuuuguuuucuguuauaaacagggcuguauauuuuacuauaaauaauaauuuagaugcaucucugaauauuugauacauuuaugcuaggcuucucugauaaguuuuaauuaucuuauaauuuccauucugucuucuuugacccaugaauuauuuugaacuguguggguuuuguuauguguguguguguguguguguguguguacacaugcacgcauguguguguuuaagagaugaggucucgcuguguugcccuggcaggccuccaacuccagggcuuaagcaauccuccuacuucagccuccugaguagcugggaguaugaucuuuauuuuuuugagacagagucucaacucugucgcccaagcuggagugcagcagcacaaucucugcucacugcucacugcaaccucugccuccugguucagugauucuccugccucagccuccugaguagcugggauuacagguguguaccaccacgcccagcuaauuuuuguauuuuuaguagagaugggguuucaucauguuggucaggcuggucucgaacuccugaccucgugauccgccugccucggccucccagacugcugggauuacaggcaugagccacugcguccagccuuuuuuuuuuuuuuuuuuugcuauuuaaagaaguuuccaaauauauuaggaaacuugauuugguguuacuuuuauuacucguuucucauuucuaacuuuguggcauaguauuaguuuccuauugcugcugucagaaauuacugcaaauuuaguggcuuaaaacaacacagauuuauuaucuuacaguucuagaggucagauagccaaaauuagucucucugggauaaaaucaaguuguuggcagggcuguguuucuucuugaggaucuagaggauaaucuguuuuuuuccccuguucuagcuucuagagccuaccugcauuccuuggcuugugaucccuuuguccaucuucaaacagaucugucgcugacucucagaccucugcucuucccucacauuuucuguaacucugacccuucuaucuccuucuauaaggauucuugugauuacauugaguccacccagguaauucaggauaacuucuucaucucaaggcccuuaauuuagucacauauacaaagucauuuuugccauguaagguaacagucucagguuccaggaauuaguacauagacaucuuuaggacgcccuuauucugucuauucacauuauuuauaucauuuuccuucccccaccuuucccacucuguuguuuuggauguuauacauucuguuucuuuuccuugguauugauauuauuuauguguuuaacaguauuuaauauuaugccuuuuuaccuuugcauaccaugcucauuuguacuuuccuugcuuguguuguuuagcauuuuaguuucccuuuguuucuaaaugccuucugcauuaaucaggcuucucuagagaaacagaaccaacaagugagagugagauuuauuguaaggaauugugauuguagaagcuugguaaguccacaaucugcaagauaggcuggugggcaagagaccuagggaaaaauugugguucuaaagauauuauguuggcaaaauuccuucuuguucaggagagguuguccugucuuuguucucuuauggccuucaauugguuggaugaagccuguucacauuauggagguuaaucugcuuuacucaaagucuacuaauuaaaaugucaaccucaucuagaaaacaacuuuacagaaacaucugaauaacguuuguccaggaaucuggguaucauggcccaaacaaauugacaaaaauguuaacuauuacucuuuccaaguuacuuaguuuuucuguuacuguuauuaucaauauuauguacuuauuuaacuuucuaauguguuuaccaauaucuuuucucguaacauauucuugcauuccauucuccuuucuaugcucaguuuuccuucuuuacacauauauuucccaagaaacugggagaaauaaauucucaguuuuuauuugucugagaaugucuguuuuccucacagaccugaaugaugguuuaauaggguauagaauucuuggauaacacuuauauuuccuuagcucuuugaggauauuauucuguuguuuccuagcauuuguuauugcguaugagacaucuaccuuuaauuaucuuuucuuuguagauaaucugaccuguccuuugcugguuguuuuuaagauccuuucuuugccauuaguguuuuuguuguuggugguggugauguuguuuguuuguucguuuugagacggagucucgcucuguggcccaggcuggaguguaguggcgugaucucagcucacugcaaccucugccucccagguucaagcgauucuccugccucagccucccaagcagcugggauuacaggcgcaugccaccacacccagcuaauuuuuguauuuuuaguagagacggaguuuugccauguuggccaggcuggucuugaacuccucaccucaggugaucugccugccucagcuucccuaagugcuaggauuaccggcgugaaccaccaugcccggccugccuuuaguguguuacauuuucacuguacuuuauuuagguaugaguuucuuuucuuuuaauuuauuuauucugauuuuuguuuuuccuagacccgggaagggauucauguggcucaucaguuuuggaaaaugucagccacugucuuuucaaauagguguuccccccuucuucugucauuuccuucuagaaugccuaguaaagauacagauuguauucuguccuccauaucagcuauucuaaucugucauuccuugagguuuucuuuuucuuaagugauuuuuuuuuauugaauuucucuuugguucuuuuaaaaauauuuuaguucuuuuuuuugcauaaccaguguugucauuguggcuuuucugucuuugaaaaaucauucuaaacauuuuuacugguuuagucauuuucagauucuauuuauaguuuuagauuauuuuauuuguaguauuugaaggguaauuugccuauuuauuacaucagcuaaagcuuucuccucgugaugguuucuucaauuuauaauuuuuuauuaugagcucaucuuuacuagggacuauguauucuauggaaguccaguauaguaugugaguaucuuugugggacuauuuacaucuacaucuuuugguccuuaaaaauuucaaggguccagucagauuuuauguuacuuuuaaauuuuacaccacggaauuauguaaauuuaaaacccucacauauauaggauacucuuguagaguuuuuuauguuuuaguggugacuguuuucccucucucauugaaggcuucaaauuaaugacuggcuucuuuccucuuagaguucaugggccacguuuuucuaguuaauuuuucuugaguagcacaccucuuugauucugugagcuuuagguggaugcucaguucuugaucccccaccucacaucagcuauggguauguuuucacuccugcaagugauuuaaagguguauguccaagcacuuagcccuuaaagccuagagcugaguuugaaaccccggggauugcuacagugucuguuuaagcuuauggcucuggcuuugacuucuauuuguuuccagcacuugaggaauuuuuguuucuuauuuuuagcaaaguauuauuuugaaaguauuuuauccaguauuucucuguguuuggagcaggaaggaagcccuuacauauuggcuuggacuauaccauguuauaagaauuuucuguuuuuuuuaacauugauguaauuugauugacucuuaauuucuuucuauuuuaaggauauugguugauucucuaauagcuuuuuaaaaauucuguuuugggauuguuuuaacuuuucuuuucccuccagugcguuuuucaaacauuuuuuguuuuguguguaucugguaccuaauaaauauucaguaaauguuuucuaagugaaaauaagucaaauguuuaguuugugccaaaggacguucuaggugauuuuaauaaguuuauuuguuuuaggccucauauauguuaaguuagacugauagacccuaccaaguuauaaaaugauaauaauaauaguaauaauaauagcuucaaauaauuauaagacacgucauuuucauucuaacccugcaauauguaguauuauuaucacuguuuuacuguugagauaauugagaaauagagaaaguaacuuaucccaaaucacauaguuagcacauggcagagcucuauuuaaaguaagucuggcuccagaggcuuguauucuuaaucauuauacuguagcuuuuauauccuguugagagauauccuugauuauuauuauaccucugcuuaaaauauuuucccacugcuuucuggauaauguuuaaauaaacauuuuauuauuuaaaaaauaaauguuuaaauaaguauuuaauauucuagccuaccuuauucuaucauacuacauaucagccuuguucucuguuuccaauugcuaacaguuuuccaaaggcccucuauuucaugcuuccauguguuuaauuguauucuccccucugccuagaaugucucuccuucugcuucucuccuggcuaacuccuauacguccuuagaaacuacagcucuuuuugaaagcuucuauaacugcuuauugauauagcugucccucucuucagcguuccccuaaauuuguccucccauaaugugucagcuuauagcauuuauuuuacuauguuuuaauauuuuuuuuucuuuuugccucucaacuaaacugccuucucugagguaaaggacuguauucugcacaucuccauaaccccaugaccucauaaacauaacuggcacauaggagauguucaauauauauuuauugaaugaaucgauaauugugauuucauuacuuguuuuacagaucauccguaagauuugucuacugcauugucuuguugaauuuuuaaauaggacuaugaauuauuuuguuaguaauauuaauaaaagauguuuauaaaaacaaguuaguaucuuggaauacaaguuacuuaaugaauuucuuaagauaucuuuuuuaaacauauaacauuuuugcuuauuuaguugugaaagaauaugguuucuauaauaguguguuauuuaaaagcaguucuauuuagcuauuuaguugaaaaugauucuuuggugaaaaauuaacucuguaaauauguauuaagaggaaugccugcucuguuuugauucuauguuuuaauauuuuuacucuuggcaauauuuaaugaaaaugugucucauuaaccuugaaguuacuagucauuauuuugugacugcuuuugauuuauuuacugucuugacuucauauauagaaaacacuaauuuuaucaaagcuuauugcauuguuuaccacuaauuacaaaauaaauaaguaaguaaauaaagaucacauagaaaaaauaagucucuuggggugaaaauuuauuuguaaaacauauauuaaugguuuuuauaugcucauuuucuuauaauaauauagaaaauuuaauuguucacuugggggcagauguuuuauaucauggcuuuuuaaaaaaguuaacucuuuaaauggaaugaaggaauaggagaaaauuacuuguuugagccuuaugggaaauauaucugagauagcacuauuuugcugcaacugaaauucaaacaugaggaaauugcagaaauuuacaauucaauauguguuucaucagggagaaauccacagauuguuuugacacucaguuagaaauucagcaugaagauggacgucucaugaaauuugcagcugcugauugaauuuauauuuccauaaaggccaucaacaguagcagccugcaggggaggaggggggagaaaugacaaaaaucgugaggcuagcauuuuuccucagcauuauagucacaaauuacugguaauaaggguuuacacugaccaggauuaaagaaaaauauagacagccagagggaaggacuucucaguuuaauugauuuuaacuaaauauguccacauuugauaucuaaauauguguuuagucauuuguagaaaaucuaauauguguguaaaaaucaguuuaucuuuacuauuuaaacagaaagaauaagauagcucuugaaguuaaaaaagguuguauaguacagguuuucauaagagccuuucaagauagaagaugaguauuguaggaauauaauacgagcuuguuuucuaugucacugaaauaauuauuucauguucuugcaaguaaccuacaguugauguuuuugagaauaacaauuauuauuuuaaaauguguuuuaaaaauuuuuugaauggauauccaaauaauagugacagagaacaaguuaccuuuucaaggaaauuauuucauuuucaagugugguggguuuuuuauuuuuagcaaaauguacaaaaaguucuuucuuuuguuuaaugcauaucuuguggagauuucauauuauacaugauuuuaaaauauucauggauuguaggugaacugaaggacuuaggaguguguucauuguuccugcagaguucuuugucucugugggcaguguguacuuuuaaccauaacaggaugcccucagauagcuuuauuugaaaauuagaauuuucacaacuauauguaaaaauauuauccuuauuaagaaaaauuauauuuaauuuaauauuaguuuauaaaaagugagaacauuacccagaaaacauguaaauuaaauuaaguguuggucuuuauuuuuucacauacucaauuaagaguuuaagaacauaguguaacugauuacaguuguuuuguuauguuuaauuauauuugagaccaucuaauuuauaaacuauuguaauuggaaaagaagaguauauauuucugcuaccugugcuuaaaagguacacguggacuuuuuuuuuuuuuuugaguuucagaauuuucuuuagguguuaaauaagcauaaucaggcuagauuacaagaaugugcuuauucuucuaggagucuauaaaugcuugcuuugucaacaucacuuccuauuguuuuacuuucuguauguuaauaccaaaaucuaccaguuaaauauauuuugacuuuuuauacauugguuuacaaaccaaagcaaaacuguuuugugagagaaguaccacuguguccaacagauaaaguuuguaaguauuuggaaaaacgauuuucucauuugugcuuuccuuucacagcauuacucaggcauacacauuuuaggucauucauguaauccagacuucccucucuuucuuucuucccuccuugcccaccccacuugagaauuugcuauuuucaacauuccaaaauauauuagcuuaacuauuuaauuuacuacuuauuaaaagccuccuuuuuuucuucuuaucaguugcugucaauuucaucacccgaucaaaucaaugucuuuauuucucuuuuagcuuguugucccugcccauauguauuuuuuguuuuuauguaugagauauaauucauucacucuugaaucaacagauauuuauugacugccaucuuuguaucagacauuauuuuagguucuggggauauguuaauaaacaacacaaagccuucuuuccaccuucauggaguuugccuuuuaguaagagacacaagcaguaaacaaaugaguauauaauaugaugucaaguagaaaugugcaaaacuuacagugccagguaaaaggcuagaaugugacaaaauuagagugcagcaacuacauaauaacuuccagaaggaucucucugaggauguggcauuugaaaagaaaccugagugaaauaagaaagugaguaacauuauagaguucuacauauuuuccuuuuucuuuauagcaugaacaucccccccaccacaauuugcuaugugcauauuuguuuucgacuuauccccuucucuuaucacauucaauauuagaagucugaaaugaugcuucuacagcucccaucacuucuccaugcucauaaaauuucuauauucauauacagauacaaauaagauuuucuggaagggguauuauuugucuuuuacaaaaaugguguuauccuauuuaccuucuucaacacuugcauuucuuaguaaacaguaaauaauaaacaucacuuaggucggaccuaaaguauuauuguuaauaacugcauauuuuccauaguauggauauaccacaguuuauuuaaccuuugauuaauguauugaugaacauuuuaguuguuugcaguuuuuuucuacuaaaaaugauccauaaacauccuguacaaauauccuuuucaacucaugcuuuuaccuuuuguaacaugaauucccagaaauggcauugcuauggcaaagaauauguguaacuuuuauuaauaaauauuaccagaguacuuuccaaaaagaccuuagcaguucacauucucaccaacaauguaggugagugucuuuuuccccacagcuuuauuagcacuagguaacuuuguuuuauauuuuguguauuaucucugacgguuuuuaauccaucugucaucuaucuuccugaugcucaguuuauguguacacuaggcuuacucuuugcagucuuguggcuuacucuuugccgucuuauggaacucugugcccuuauaaaacuguacagaccacuuuucagcaaucuuagcauguuguauuuuaguuacacauuuaaguguauaucuuuacccacucugacccccaacaccuaaauaacaugaggccuagcacaagguagauggucuagguaaauacucacuuucaaaaccaaauguaucugguggagaauacugauaauaggauaggcuauacauguaugggggcaggugauauauggaaaugucuccaccuuucucucaauuuggcugugaaccuaaaacugcucaaaaauaucuuuaaaaauaaaaauaaaagguacaagauuuuuugauugccaugcguguugaauuacucgugcaauugauuucucugugugaaagcagaugagcaagaguucacugcauuuuaaaguuguuaccugaaaggucaaauguauuccuuuuuugacacuauuuccauuugggguuuaagcaaacauuuauauuagguugcacauuacuguguucaggauacaguuauuauauuuaucagauuguugccagcuacucugcauuuuuuuuccuggcucugaaagcacaugcauauucuaggccugugcucugaaauuuuuugaaguacuauuguugacauuuagagcauucugugcugcaagugucuucaccccagaaugcgacgugcaccagugaacagaggucaggcaaggcgaaaaguuguuugucaucugccaagcuguuuguaacaaccagauaaaaguauauuccuauuuucagauuuaaaauguaaacauacaucucuagucccaaccagucucuuuauuuuggaauguuaauguagaaauguccccuugccggcagcuagcccaaucuucuuuucacagucacccguuccagagguuauguuuauagcuagaaccaguguauuuuggcuuuugccuuuauuuauucuuuaugagaacugggaacuauggugacccagcaaaagccugggugaccauggaaguagucuguauuagcgccuggacaccagagaaaagggaaaaugugauccucauucagcccugguugauagagaucaugccuuuaaauggucagucucaaagacauucaguugucacaagugcagauuuaccaguuggcaguucagauuguuacuguacagugagugugagggucuuuagaacugguuuuaguaauguagcauauauacaggaaucuuaggggaugugucauacuguuuucaauagucagggauagcauauugguuaaucccaggcacuucugacacauaugguucugauuguguaggcagaaugggcaugacaaggagggaaccuuaucagcucuuuaaacuaagucuggguuacauuauacagaccauccaauucuuugcccuccuauucccauuuucucauuccccaguuuauucauucuuaccauuuuaaugaaaaugguaagcucugcugucaacaacagaucucagcucuuggauccuuuuauuggaucuuacuauuuaguauggaccacuuuucuuuuugagguaucaacucuuuaauuuaggucuuuuauauauaaaaccauugauuuuguuuucagguuaguuuucugccuuagcuguuuucuuucuuagcauuuuaaaagugugaagucaaucuauuuuauuaaaaguucaauacaucuaaauucacaaguaagagauguuauguaaugucuggauaguguaaugauuauuuguuucugguuuccucuucuuucuucuuuccuuucuuuuuaaaaaauacuuaaaagcauauaugaagauuacuuacaauucuucauauaacuaaugaggucuucugcagcaaaaggccaaccaguuuacauaauauaaucuuuuuauuuuagaugagaacguugcuauuuccugaaccuacuucugcucaacaccuauuucucuuuuaguuaccaucauccuuugccuuagguaucccaccuuucuauuuuguuaacuuuuuucucuggucauaucaccagcaucucuucugguuaguuccuuuggcugcuuuuuuaaacuuaguuuuauauagacuccuugagaguauucguuauucuuaucaaccacuugaacucagaguuauugauaugggcgguaggcucuuuacucuuagcagccaucaaaucacuauuauguuuucuuuuuuuaaauuauuauacuuugaguuuugggauacaugugcagaacguugcagguuuguuacauagguauacacgugccauggugguuugcaacucaucaucuacauuagacauuucuuguaaugcuauuccucuccuagucccccacccccugacaggcccuggugugugauguuccccuaucuguguccauguguucucauuguucaccucucacuuaugagugagaauaugugguguuugguuuucuguuucuguguuaguuugcugagaaugaugguuuccagcuucauccaugucccugcaaaggacaugaacucaugcuuuuuuauggcugcauaguauuccaugguauacugcauaguauuccaugguauacugcauaguauuccaugguauacugcauaguauuccaugauauauaaaaugguaccacauuuucuuuauccagucuaucauugaugggcauuuggguugguuccaagucuuugcuauugugaauagugcugcaguaaacauacgugugcaugugucuuuauaguagaaugauuuauaauccuuugaguauauacacaguaaugggauugcugggucaaauggcauuucuaguucuagauccuugaggaauugccacacugucuuccacaaugguugaacuaauuuauacucucaccaacaguguaaaagcauuucuguuucuccacauccucuccagcaucuguuguuuccugacuuuuuaaugauugccauucuaacuggcaugagaugguaucucauugugguuuugauuugcauuucucuaaugaccagugaugaugaacuuuuuuuauauauguuuguuggcugcauaaaugucuucuuuugagaagugucuguucauauccuuugcccacuuuuugaugagguuuuuguuuuuuucuuguaaauuuguuuaaguuccuuguagauucugguuauuagaccuuugucagauggauagauuggaaaaauuuucucccauucuguagguugccuguucaugcugaugauaguuuccuuugcugugcagaagcucuuuaguuuaauuagaucccauuugucaauuuuggcuuguguugccauugccuuugguguuuuagucauaaagucguugcccaugccuaugucuugaaugguauugccuagguuuucuucuaggguuuuuaugguuuuaggucuuaugcuuaagucuaauccaucuugaguuaauuucuguacaagguguaaggaagggguccaguuucaguuuucugcauauggcuagccaguuuucccaacaccauuuauuaaauagggaauccuuuccccauuucuuguuuuugucaaguuugucaaagaucagaugguuguagaugugugguauuauuucugaggccucuguucuguuccauuggucuauauaucuguuuugguaccaguaccaugauguuuugguuacuguagccuuguaauauaguuugaagucagguagugugaugccuccagcuuuguucuuuuugcuuaggauugucuugguuauaagggcucuuuuuugguuccaugugaacuuuaaaguaguuuuuuccaauucugugaagaaagucaaugguagcuugauggggauagcauugaaucuguauaaauuuugggacacuacugcccauuaaugggauuacucagucaaaugguauuucugguucuagauccuugaggaauugccacacugucuuccacaauggcugaacuaauuuacgcucccaccaacaguguaaaagcauuccucuuucuccacauccucuccaccaucucuuuuuucucauuauuuugggcaggauggccauuuucaugauauugagucuuccuauccaugagcauggaauguuuuuccauuuguuuguguccucucuuauuuacucgaguaguaguuuguaguucuccuugaagaguuccuucacaucccuaguaaguuguauuccuagguauuuuauucuguuuauagcaauugugaaugggaguucacucaugauuuggcucucuguuugucuauuauugguguauaggaaugcuugugaucaaaucacuauuauguuuucacauagaugacuuuaaaaaguugggcuuacauagguuuuauuugaacauuaauuauuacacuaugugaagacagugaugugaaauuuuuuaugccaucuauguauggcaauaccuaauuaaguuaguacaguaauaacauagauguuaaagacaucauuucaaguaggggcuuuauuacauaucaucccucaugguauaaauguuucgucuuauuccacaugaaaccuauuuugugauauagauuuaauuuuuauuaaagaauuguuuacauuuucauuuaauggaagcuguaauuaguaaaccuagaacuacuuaagacacuaguuuaugauaagauugaaaauauguauacauacaaauucauuuauuuccauguuuuuucagcaaaaauucauguuguuuuggcuauaguaacguuaaacucuccuuagguagaauauuuuuucuuggaaaguguuuugguucaaauauauuuuuagaaguccgaacagggauaaaccgaagcuguacuaagaugacuacuuagaaggaguuacaaccucaaacaaaaaaaaguuguagugagaaguuaggcaaacaaaagagaugcuuuuauaguugacucucuugggaaaaacuauacauaaauaaauacaaccuguuucauuugauaaauuaauagcugacguuauuuucauaucagaaggagaacuagacaucugugacuuauggccuaauucugaucaucaaggagaaaauugacugguaaaguagaaucuugagagaaaucaguauguaauuugugaguuuauuacagccaaggaaggcagugcuauagggauuuggaugcauauucuaauuuagacauuagaagaggagccuucagaaaguuuugcagaaaaaaaguagguguuguauuucaagaggaauggaaagaucuuuuuguaaacaaauaugggcaauauaccuguuagcaaucuugaugagcaggagauggaaaaauggcuaaagggagugcuuugacuaacuaguacaguuaugugucacuuaaugauggggauaaauucugagaaauguguuauuaggaaauuuugucagauuauauuuccacaaaccaaaugcaccuaggcuauaggguauagccuguugccccuguacaacgugauacuguacagaaugcuguaggcacuuguaacacaacgguauuuguguaucuaaacauagaaaagguacaguaaaaaugcaguauuauaaucuuacaggaccacugucauagaugugguccgucauugaccaaaauguuggugugugguucaugacuguauuuuaaguauacaaaaaugucuguaaccauagccauaaagaaaugugauggcagcaagauagggagcuugaaucauuacacacacaccauauauuuuugauacauuauauauguaauaauugccaaaggaauuuaaaaacaaaauucaacaaaacagcauguucaaacuaugaaaggaacacaaagccaaggacaguugcucaaauuaguaaaauauaauaccagaaagacuaaaucucagaaagagaugagauauguaaaagucucaaaugacacaaaauagcugucugcuuuuauaugugaauucauguauguguacauauuuggguuuuuuuagguaggcaaauauauauguguguguguguguguguguguguguguguaacaaauauguucucuuuuguuaacauuccucugucuaaauaugaauauuaaauauccacguggagcuaaaacauugggagcauaaacaucugaaaagcuuaacccacugcuugagaagauaguguauuuuuuuuuuuuuugagacagagucucacucugucgcccaggcuggagugcaguggcgugaucucagcuuacugcaaccucugaaccccgggcucaagcgauucuuucaccucagccucccaaguggcugggauuacaggcaugcuccaccaugcccagauaauuuucguauuuuuaguagagaugggguucaccauguuggccagguuggucuugaauuccugaccucaagugauccgucugccucggccucccaaagugcugggauuacaggcgugagccacugcacccagccaauaguguauuuuuaauggcuggcagagaauaagacaacucucuuucucucuugcucuguuuuuuuuuuuuuuuuuuuuuuuuuuuugguaaagggcuuuuaaaacaauauuuaaaaaacaaaaccaagaugguauuaaacauaaaggaaauauccagcaaaacugaaaauggcccaagcuuccggaaacaccauuuuuuauaccuuguucuuuaaaccacagagcagucucuucucuccuucucuuccccacuacaccaaaaaggacaagacacaaaucugugccaggggucucaauuuagagguagcacuccuccuaaucaucacuucauuuuauaauuauuuuauucuuagacuuaccgaaugcuaaacaaguaaaaagaauguuuuaguuuuuucccaauuugucaauaauaaauuauuaagauauuuauuuucauuuauaauauagucuagagcauaugaugagucuacauucuaucuugaaauagcaaaaauuuucauaagcuguaauagcuaaagagaaguuaaaaauccgucauacuauuuaaaauguuaaauuguuauagaggauacuugcaugcuguauuagauaaauaauaaauaaaccacaaaacucaccgguuuaacagaaguguguguuuguuuguuuuuuaaucgaguagaucucauuuaucuuauugacaucacuuggaaaaguuuucagcauugacaagagaagaaaagagucaaaggcucacuugggaugauguuaagggcaggccuggaagaagcauacaucacuuucacccuuguuccacuggccagacccuagccacuugacccccaccuaacugcaggggaggcugggaaauguauacgagcuugugcauauuuggugagugcugcuucuaucauagacuguuaaauuagucagaugaauguuuauugcaaacagugugcaugggacuuuucuaggcacagggcugaauacaaagaugaauaagucauggcuucuucacccaaguggaucauaauccagcacucauuguagacuauagcuuauauuuaguuuuagauucucaaaacaaauucauugccuauuccuaguguuaugagacuaauaacuauuuuuuuaaaacagccaagcaauuuauaucuaccaucuguaucaguuaaaauuuaggcaagaaacagauggcacauucaaauuagguaauuugaagacugcuaaauaaagggacuauguaaaggugugggcugggccuaggagggaaacuacaagguauaggaaaccaccacaaauucaauacuggaaggaugacagcaggaugucuuuaccauuuccagugcugaaacagugaggggaagaagugguuucugggaucuagagacagaguugugaccuugggccagugggaauagccuucuccccauuugaccuugcaagaagagagccaacaaaauaaauucucuaauguuacuguccuucuggucuccuguugguauugccuauuagcuggaucccacuggaagccagagggcaagggaggcuguugauguaauuuauguagguuaccuuucuggggcaggggucagaaggguggauccuugaucuggagaagcaaauagcacaccauccuaaauuuuuuuucaucuauuuggccaguauuauugaggcccugcuaauugcaaagcuguaaauaguauaagaccauauacaaaagacaugacuuuucuuucagggaucuugcucucuugugugggagaagagaccaccaccaaaaacaaaauuuaaagauaagucucuggaagauuuguguuuaggcggugauugagugccacauggacuauaagaugaagugaaagugguaucauucaaaaaaagaagagauucauaugcacacaaauuguuagggaaggcuuuguagagaaaacaaaacuuaaacuugguuauaaaggguugacaguuuuuguagauaggauggcagucacacaugcauauaauuggcucaaaguacaaugaguguagacucuagaugaagguggaaacucauacaaaguuaaugagagauuuuuuaaauaauuugaggucauacuuuagaaggucauaaggagaaaucucaggguucgugcuuuuuaaaaacuguccuaauguucugggagagguuacaaggugccaugugguaaaaguguucugcaaugaaauaaauguauaaaaugcauacuuuccaacccuuggauguaugcaauguguauucaacauauuaaaagcucugaaaaaucuugcuauaaagaaaccacuuuuuccauuuaucuauacuuggugaaagaacccauccccuuuccccuacucgcuuuuaaaaaucaaaacauggugaaaaucauaugaaacuucaguauucuauaaaacauaucuuuggaaaugguucuauaaauaaugggaagccuuugaauaguucugaaggauuuaugacaugauuagagggguauuuuuaggguauuauucugacaagauggauuuuagugcacaugaucauuuaagaacaauuguuauugcaguaauacaggcacauggugcaggucugaagugaaggguaguaguugagcugcaaaaaaugcagacuucugagggccauuaggaaagacaugacagcaugacuuggugguugauugaauaugggugaugggagggacugaauaugggugaugagacggggggugggagggagggaggcgggggaagagagagagagagagagagagagagagggagagagagaaagucagcaauguuacaaacuauaacuuuaaggccuaaaucuuccaguucugugggaguuuguuaaacugcaaucuauaauguacauagaucaucaaaaauaaaauacucuaaaagacauuugagaagacuaagugaaaguauaaaaaaggcaacauaaugccuauucugcaaaugaguguaaaagaauauauccugcaaauaauugugcauuauuacccugguauuaaaauugauugugauucagagacuuagaagagcuguguucugaccaaacaagguuuauggaccagaccacugggacuguagccagcucaaacuguacucauuggucacaccuguaaauguagaacuuuuauuaaccccaccccccagaaaaagaauuuuggcauaguuuacaguaagagccaacucuaucuuguuuauuugagguauuauuaggagugauaaucuaaaagcauugcuaauuuuuauaguauuuuucucucuuaccuuuuaaaccaaaaucauguuagggaccaaaugcuugcuuaauguuugauuugagccacauacuaaaagaaacugauugguguuggauaaagagguaaaugcuaaguaaaucuuuucaaaauuauuuguuauuaaguuauuauuaaucauccaaaaagggugacaaaaaccaauaacuccauaacauuugaggucauguuucuuaauugaugcucucuuugcagcuauaacuuuuuuuuuucauuucauuuuauaugcuugcugucauuugcccauuucucuucuuugcaugaaugcuuuuuuguuuaucuuguuacauguguuuuuauuuauagaagacaaaguacaaugugauacuucuucauuauuacuugcuaaauuccuuguuuaaaugguaagucccuauuuuaauauaguuuuggggauaaauuuacugaaaauauucagugcuuauauuuucaguuuugaauuuauucauauugugacaguaauugguagaaaacuguuucucacagcugacaggccaaaaaaaaaaaaaaaaaagucuuggggacaaagcuaccacaugccagagugcugaggacccaucagauauuuaaggaaguggcauuuguacucgcauuauuuaaguuacuguugaaaaaaagagaugggaagagacuauauuuguaacaagcauauuauagaauucauuuucuaaaaaaucauguuucugaagaauagaacaucuaucagauguuuuauaaagcacauguaacuaauagauaauaguucuucuccaaaagaacuggaaaccaugaaugcuaucuuuuuuagaaucccaaaauuuaaagaaauauuucugcuuccuagaaaauaguaauuaagcccaaauuuccaacugaaucucaaucaauaguuguacuauuuucuaccacagaaaugcuauucaguaaaugguauaagugaugauauaauguauacuuaacuucuguuuugccaauuaacuuagaucauucucaaacugugauuuaggggacggcugguguccuuaagaaucccucagguggugagauagccagucauuaguuuuaaugauuauggcuguauuucucuuucuggcaaggaugaauaauuaugcuuaguaagaaccauagcaucucauugauuucucaucaaagaaaacaaacauugcccuuaauucugaugagguaugcuggacaaacaggaauggguggaacagucaucccuacuuuauuuuauuuuuaauaguuuaugaacuaaauuuugaggagccauuacuauagaucaagauacuauaacucuuuagaacuuugaagauauucuguuaaaucaucucagauccauuacugaaaugaagacuuuaaaaccuucuuaagaaguugcuaagcuguugaacacuugaacuugaaguuuacacaaccuggcaaguauuuuuuuguucuuuuuccucauacauggucaauauaguggguugaauaguguccccccaaaaaauguauauccauuugaaaccucagaauguuaucuuauuuggaaguaggguguuugucuauacaguuaaguuaagaugggaucagauuauggucgacucuaaaucuaaugacugguaucuuuauaggaagaggaaaggacacacacacacacacacacacacacacacacacacgcgcgcgcgcgcgcgaaaguugaaagcagagauuggaguaaugcagcuacaagccaaggaaggccaggagccacuagaaaaggcaaagaaagauucuucccuagagccuucagaggacccucccucccuauacuuucauuucagacuuuagccuccagaacagagacaaugaauuucuguuaagucacacaauuugugauucuuuguuauggcagcccuaggaaaccaaaauagucaguauuccugaacauucucccauaaauauauauuuuuuugccuuuuuuuuuguacaaauuucuaucauuuacuaagcuaugaaguacuugagaggagaacugugucacacucauucuauaccugauuucagaaccccacaaguauuuauuagcauauaacugugggauagucuuauuuuuuaagauucacaaauauauucuucaugagaacacguuaguuuuuauuaaguaugcauauuagagagagacuggaguauaaauaacuguaaggauauuuuguaugaaaaaauaauuguagauaauuaccagguuuggguuucuauaguuagcaaaaguaggauaacuguuguuaucauguuuaugucccauucauaugaaaaauaaaauccaaaguggguuuuaaguaaaugaaaucccuaagggacugucaaccugaauuauccagagaauauucaguuugucauaauuuugcuccaauauuauagagcacagcugaaaauaacugcuuaacuaucaaaauucuauccaaagcacagaucauuuauaaagauuaacauuuaguaaaaugacuuacaaauguguuuaaaguaacaugguauuuuaugaagagcuaauauucagaaguaacaucuaagaggauauauacaaauuuaaauuuuuuaaacuuuaaaggauuggauuauagcuuacauuucugagauaugaaaaauuaccaucaaguaauauucuuaucucaauguaaacauauucuccauuuacuaguauaauuuuuaucucucuuuaaauagaaguaguuuuauaaguauuugaauauuuuugaucgaagaguugaaauacuaccaauagagguacuaaugacuauuugaggugguuguagguuguuuuuucacccguaccaguuuuuuucaugaauuuuaauacacaaagauucccaguguugguuuuaaauucuuacaggcuaagagagacuuagucuuagagagauuguagguaagaaauauaauuaauauuuuaacucauuacugagaauagaccaauacuuucgaguuuaaaacuugguagacuuaacuaugugacucuuucaguuacugcaaguaauaaauuaugaauuauaagcaacguuuaguuuauccaaucaggugaauaagcaucacuuguaaugguuaaaucuuuauguguccaugggcagacauucaaguuaucuucuacuaauaaggagaaaagagucauuguucuuaguugguaggugacauuuuuucccagauauuuguucaccaugugucuuagaggaaagugaagauuuuaagggcuacuuaaaaauuauuuucucuccgcuuuccaacgaugcuuucacaugccaugaaucaaucuaaaaauccccauugcagucaugggcaaaccagaugugcuucuugaagucugacaguuuuccugacauaucaugugagugaaucauauggguaacauuuuucauaauaaacuccaauuugaaauccagguaugaccacguagauuugucacuaauacgcuagagucuuuuuuagacuauauuuguacuuuuggacuuagaacuauuauuuuaaauaccuaaauuagcacaguaacuuugauagcacuguuuuagccauaggagauuauuuaaccuuauucaaaauucauugguccuuuauaaacaaauaauuccaugauuauaauuuaaauuuuuuauaaacucacaugaucauuauuagaggaccaguuccauaaauuaugguacauuuacacaauggauacagcuguuaaaaaaagauauguucuauguauuaauaugaaaaaaucuucaacuauauuauuguauaaaaaggaaaaguacagaacaauuuguagaauaaacuauuuguggaaaaacaaaagugaggaaauucuauguauguauguauuuguguguaauauauauauagagagauauacauuuauauugacuuuauaugcauaaaaauaaucugagaaaggauaaacuaauaaagagggguugccaguugugugugugcaugggugggaacuuaccagaugggacugcaugagggaguuuuuuuauuauauacuauuuuaugcuuuauucuugaaccaugugaauauauuaguccaaauuuagacagauagauaauguucuguuuuuaaaacuaugguagugaauucuguuuuaugaaaaauccaguaaacagaaaccaacuuuaaaaaugguuacauucauucagacaaugggauauuauucaguacuaaaaauaaaugagcuaucaaaccauacaaaaacauggggaaaccuaaaugcauauuaccagaggaaagaagccaaucugaaaaggcuaugauuccaccuacaugacacuucuggugaaggcauaauuguggagacagugaaaagaucagugguuggcugggugcaauggcucaugccuguaaucccagcgcuuugggaggccaaggcaggcggaucacuugaggugaggaguucaagacaagccuggccaagauggugaaaccccgucucuacuaacaauacaaaaauuagccaggcaugguggcgcaugccucuaaucacagguacccaggaggcugaggcaggagaauugcuugaacuugggaggcagggguugcagugagcugagaucacgccauugcacuccagccuuggggacaagagcaaaacucugucuugggggaaaaaaacaaaaaugaucagugguuagagggacagagggauaaauaagcaagccaaaaguauuucgagugcagugaaaauacucuguguaauacuauaauggugaguacaugucauuauaaauuuaucugaacccauagaaaguacauccccaagagugaacccuaauauuaauauaaacuaaguagucaccaugauguauagucucuugaacuuuuuccuccuaacuggagcuuugugcacugugaucaauaucuucccaaaccccucacccacaguuucugguacccacaauuuagcucuguuucuaugauuuugagcuuuuuacacaucacauguaagugagaucuugugauauuugucuuucugugccugcuuacuuaccauaaugucuucaaguuucauccaaguuguuguaaaugacaggauugccaucuuuuugaaagcuguauauauguguguguguguguguguguguauguguguguguguguguguaucuacaucuauauuacauuuucuuuauucaacauccauugauggacacuuagguucuauccauaucuuggcuauugugcugcaauaaacaugagagugcagauaucucuucaguacacugauuucauguccuuuggauauauaaccaguagugggacaacuggauuauuugguagucuuauuuuuaacuuuuugaggaaccaccacacuauuuucuguaaaggcuauaccaauuuacauucccaccaacagugugcaagaguucgcuuuuccccacauccuugccaacacuuguuaucuuuugucuuuuugauacuagucguucuaacagguguaaggugauaucucauugugguuuuaauuugcauuucccugauuauuagugauuuugaauauguuucauauaccuguuggccguuuauaaguuuccuuuuaacaaaugacuauuuagguccuuugcuuauuuuuuaaucagguuauuuuuuuuuuuacuguugaaugaguuccuuauauauuuuggauauuaaucucuuaugagauguguggguuuucagguauuuucucccauucucuagguuguaucuucacucuguuuuacuuuguuuguuuuacugugcagaagcuuuuuaguucaauguaauuccacuugucuauuuuugcuuuuauuuccugugcuuuugguaucauauccaagacaucacugccaaagccaauaagcuuuuucuuguuguuugccucuaggauuuuuaccauuuaggucuuacauuuaagucuuuauuuggaguugacuuuuguauaugguguguauucuuuuucauguguauauccaguuuuuccaacaccaauuuauugaagagacuguccuuuccccauuguggauuuuuggcaucuuuguggaaaagcaguugacuguaauaugugguuuuauuuugggguucuguuuucuguuucauugcucuuugugucuguuuuuaugccaauaccaugcuguuuugauuacuauagcuuuguaauagauuuucaaaucugauagugugaugccucuggcauuguucuuuuugcucaagauugccuuggcuaucuggggucuuuugugguuccauucaaauuuuaagauuguuuuuucuaucucuguaaaaauuauccuuggaauuuugaaaaggguugcauugaaucuagauugcuuuggggaguauggacauguuagcaauauaauaaaucuuucaauccgugaacaugggauaucuucccauuuauuuguguauuuuaaaauuucuuuuauuaaaauuguauuaaauuuauuaaauuuuaauuuaauuaacauuuuaauaaaguaaaauaaaguuuuauuaaaauuuaauaaaauaaaauaaaguuuuauuaaaauuuaauaaaauaaaauaaaguuuuauuaaauuuuaauaaaauaaaauaaaguuuuauuaaauuuuaauaaaauaaaauaaaguuuuauuaaauuuuaauaaaauaaaauaaaguuuuauuaaauuuuaauaaaauaaaauaaaguuuuauuaaauuuuaauaaaauaaaauaaaauuuuauuaaauuuuaauaaaauaaaauaaaauuuuauuaaauuuuaauaaaauaaaauaaauuuuuauuuuaaaauuucauuuuaaaauuucuuuuauagucuucagugugcagguuuuuugcugccuugauuaaauuuauuccuaaguauuuuuuguagcuauuguaaguggaauuguuuccuugacuuuuuuucuauuuuuaauuuuauuuaaaaguuuuuuuacuuuauuuuuuuagagacggggucucgcuauuuuguccaggcugguguugaaccccaggccucaagcuguccucccaccuuggccuacuaaaguggugagauuacaggcaugaacuaccuuacuuggcugauuucuuuuuugaauaguuuacuguuaguguauuuuuguaucccacaacuuuacugaacuuguuuguucuaacaguuuuuugauggagucuuuaggauuuuuuagauauaagaccuugucaucuguagagacaauuuaacaucuuccuuucugauuuggaugccuuuuauuuauuuuucuugucuacuuguucuuucuaggacuuccaguauuauauugaauagaaguggugagaguggguauuuuugucuugcuccagaucuuagaggaaaagcuuucaacucuucaccauugugauguaaacugcgggcuugucauauauggccuuauuguguugagguacauuucuucuaugucuaauuuguugagaguuuuuaucgugaaagcauguugaauugugucaaaugcuuuuucugcaucuaccgagaugauuauaugguuuuuagccaucauucuguuaauauggaguaucacauuuauugauuuguguauaaugaacuguucuugaaugcuugggauaaaucucaacuugaucaugugaaugauccuuuuaauaugaugcugaauuugguuuauuaguauuuuguugaggaauuuugcauuuguguucaucaggaauuggccuguguuuucuuuucuuguaguauccuugucugguuuuuaguauuaggguaaugcuggccucauaaaaugaguucagaaguuuuuuuggaagaguuuaagaaggauugguauuaguucuuuaauuguuugguagaauucagcaguaaagccaucagguccugagcuuuucuuugaugggagacuuuuuuauuauugauuuacucuccugacucauuacugaucuguucauauuuucuacuuuuuccaugauuuagucuugguagguugugucucuuauauuuaaccauagucuuaauauccauuuugcuauauauuaucuaucauaaaaucucuucugaagggcuuagugauaacacaucugagaaagagggaaaguuaagaauuugcauauguguuuugugagggaaccagaauuaaaauucaagauaaccuugggaauaagcaguuuuaaagaccaaaguaaaguaaguaucccuucauuuaugccuggcaaagaauucaugcauacuuaugcuauucuuuguggauccaagcugggcuacauaaugauauucucuacuguuuugcacuguaauugcacuccagauaagugagggacuccccaugcuuggaaaguuaauaguguugcccaaaaucauauuuguuccccacccaccuacauuuauuucucuuuugaucuuucuaccagcuuuucugaaaguuucuuugauccuaaaaucacuacagcuuucuaggcagaagaaguauggcugcucuacagagcgcuagggcuaauacgaauuucaagagcaucaggacuuacucuugcucaccccuccccuucagcagcacaauggcuaggucuuaaacaugauuuuaacuuucuguggucaaaaccugacuuaugaugauucuucuacuuucccaucccgagaguauuaauacaaacugauaguacaaagcuaauacauauaaugcuuacuaaguuccagauacuauucuuggcacuuuacauauaguaacuaauuucauccuaugaucauauuuuauuaucccuacuuuuuauauaggauaacugaggcacagggaaguuaaguaacacuaaagaauacaaguuucagagccagguggucuggcuccaauaucugcaccuaaccaauugccuugcagagaaaaaaaaaaaguuuaaguugauuuguuugucagcauuugucugucagcuuagcuagugucaaagcauucccaggaaauauuagccauuucuagagacuugagaggcauuugaguuaggggcugaccucagcaauuucugaaccagccauggcuguucccacuagaugcacauugcucuuggaucucaguguuguaacauccauuaucuucuuucugauguuucauguuauuuaaacugugaugagacucuugucuuuaucugguaggauuauaaccugccacagagcccaaaagugaaaaaaaaagaaucaacccagcuauuuccagaaucauauuucauuccaguaagguuuccuacugagauauuaaggucaggaaaaguaaaaagaguaaacuagaguauuuuggugaugcuguaugugccuagaguuaaaguggcauuuaugcaaggguauauacugucauuacagugaaaggaaagccuuucuagccauuuaucaaugauuuuauaguccuuacuucauggcagauggaauaaaagaacaaagaaaguuuacuuccaaagcaauuuaauaaacaugaagugaaaaaaaucaagauagacuuguuucuuuucgcauuucccucucacaagugccuuauugacaaaugaauucauuucuuuuucauaucacaaauuuaagugugucccugaauaacacccagcaucuaauacuuuuuuuaaguucuaauguguacuggaacugaguuugaaaauucauucccuuggcuguuucuucccuuuacaauuuggagaguuuugaaauuaccuuuggauggcuuucacugaggagauauguuugcuuguuuaucuauuuuaaaucaagaaaaaacagauaaauauucauauuauuucucgcuaacuaacucaguuggcaaauuauuuuuuuauccugggguuagugccuacucacauuaaacuuuaaaaaggagauugaguuuaaaaugaggccacucuuuaaucagguaggaugccuggaacuauuucaaaggcauauaugguuuuuguuuuuauaggaagugaagaaugagacauuagaguuaugaaauuaagauucuuguugaauaaguaaauuugccuaagguuggggauaauggaaguguguaaugauuugcauugagagguuaguguugucagaagcuaucucccaggcagcuuucuucaagccauuacaccugggccaauaaccuuguuucccagucucagcaaaguugaucuuaauccuaacauccaaauaagaauucuuccuguaaccuuugugguuuuuuucuucaagacauuugagugaagaaccaccauuccucucuaugacuuagauguuacucaucuuguugcuagaaggcagucaggcaguggaaaauaucaucuuugagaccauacaaacaucaugguucugaccuaaguggauuaagaugggugauuggagaggggaguggugguagaaccacauucacaauggggcgcacuuuuucaggcugcgugguuaugucucguuguuuuugacacaaacaugcaagguaaacaugcaucuucaucaucuguuggggccaagguauauuuuaaaaaucaauguauaauaauguccaaaauucaguauauuauauuagaguuuuguguucuuuuuauauauauagaauuuuaguuuggcaauuuuaaggaucaauuauauccuuguggauaacagcugguaauuauauacuauuugagucaauauauugauguaaccuuuuauuaaaacuguuauaaauaagucccuagaguauguaguaauuuuuuauuaacccagccuuacuugguacaaagaguuuucuuuauuaaauaucuuuuuaaaucacagguaaaaguuuuuaguccaaauaauuuaggaucucaaaaaggaccaaaaaagccguauaaggaauaagacacggauuuuuacccuccgaaauuugaagaauuaucagaacaggguuacaaaaucuguaguuugugaauuuuuauuuaguugugguaaaauacacauaacauaaaauuuacuaucuuaaucauuucuuaggcuguaguucagugguauuaaauauauucacauuauuguucaaccaaucuccagaacucuuuuuaucuugcaaagcuaaaacucuguaucuguuaaacaacaagucuucauucuucuucucccccaccauucugcuuuauguguuuaugaauugaacuacuuuaaguaccucauguaaguagaaacauaguauuugucuuuuuugugucuggcucauuucacuuagcauaauguccucagguucauccauguuauagcaugugucagaauuucuuuccuuuuuuaaggcugaauaauauuucauuguauguguauguguguauuuauauacauauauauaaauacacacauacacaaugaaaauuauauauacacaaauuaugcaauuuaaauuauacacacacacacacacacacacacacacacagucugacauguauagucugaugagggacacuuggguuguuuccaucuuuuggcccuccgaaaguugaagaauuaucacaauuuuggccauugugaauaaugcugcaaugcacauggacauacaaauaucuuuucgagacucugcuuucaauucuuuugguuauauacccagaaauggaauugcuggauaaagugguaauacuauuauauauauauuuuuuuugaggaacugccauaauguuugccuuacuacauuauuuuacauucccaccaacagugcacaaggguuccaguuucuuuacaaccucgacaacacuuguuauuuuguuauucugggguuuuuguagaaaggauaguagccaucuuacugguugugagguggaguaguguauuuuaaauucaacuuuaaccuagagaaaauuaugauggaaaugaugaugaaauguacaaucucauuuacagauuauggccaaagucuaaauuugaauacugugcugacugacccuuuucuacucuauuguugcgcaaaugauacucuucaaggaaggauuauggcagccugagaaaucaggaaagcauggcuuggaacuggccaaaacaaaauccagcaagaucucuuugaaggugguauuuaaaaaaaaaaucauaaaauuuaugcacuuugaaccuuguacagaauacagcuguccucagacuagaacuacugacuugguguaguagguaaggugaaggauuuagcaaguucaguuuuccuuucauuaccaauuuauuuccuuaauuuucuacauguaaaagauuggaaaagggcugacagacaguagucagcaguaacacuaauugacaauaagaaauaucuucauuauugcaagguggaagaaucauuuaaaagucaaaaagucacaguaggacacuauuuuaacauaguggacuauguuguguuuauaauuagcaugugauccaaagagaaagugaguacacaaaggauguuuaguucacuaaggcaggaaaaaaagaacucuaaaguauuuuuaaauucuuuucauuaaaacaaucagacugagaauauuugcuuuucaaaggaauuggcuucauuuaucuaaaaaaugcuaucauauggauuagcugauuuuccagugacgcagaaaagaugacauaugguacagaguagcauauauucaaguguccaaaaauauucucauaaucuuucccauguaaaauccaauuguucucuuaauuuuaauuuucuagaaugaugcuucuaaucuccauuagccuccucuuuugcccaccuaacugcuauuugauagauaccucucacagaaaguuucccauuucucuuuacuucacaauucuggguuccuuauuuuuccugugugguaucacagcacacagcauuuucuuucuuguacuuaucgcucucuauugcagucaaucuguguuccuaaccaucugaccccugagaccaccagugugucccagaucaguaauagccaaagagacaaaguuguuaucaugcugagaauuguauauagcauacaucuugguaugccuccaggaaugugaggccauuagguugucagauaugagucauagugggaaaaauauuagggucauugaaccagagugugaacaacuugagccuucuuucuuuuucucccacauauagcaguguuugaccuaggcauuaguauaaacacuaaagugaagaguuuggauuuuugcuguauuaaaaaaaaugcauuguagaauugaguuuuguauagggaugguguuagaauugugguacaauaaaacuauuauaagaucauucucuuccuucuuccagaaaggauguaagauugaagacucaaagauagaggcauaaaauugcagugaaaggaggaauguaaagucaggguggggaaaaaguagaaccagauaugaggcacuaauauaaacucugauuagcuaugcauuuucuaagaguggacucaaaugcaauucugaccuuuguagcaaccaacucaaaaaggagaaaccuuuaagucagaaccucacaauggcucugaggucaaucaaacaacuacuuagagaaguauaacuauuuuuucuuuuccaaaaauaaaguagcuuuauuuugcuuucauucgaaaaacaauauguuacuuauuuuaaaaaaaucaagcaauaaaguacaaaaucuuauauaauuaccccacuagagcacuuguggucauaccccuaagcuucuugguagucaguccagaaaaggaaacaguuggucgcacaacucauacugcucaauuuauauuccaaacaguaugagagcuuguuaauuuuccuacacucuuaauaacacugggucuguguuguuaaucuuuccugguccuauaagagaaaaauuauauuuguuauuuucucuuuuuuucuuuugagacggagucuugcucugucgcccaggcuggagugcaguggugcguucucugcuuacugcaagcuccgccucccggguucucgccauucucuugccucagccucccgaguagcuggaacuacaggcgcccgccaccaugcccggcuaauuuuuuguauuuuuaguagagaugggguuucaccguguuagccaggauggucucgaucuccugaccucgugauccgcccgccucggccucccaaagugcugggauuauaggcgugaaccacugcgacuggcauauuuguuauuuucuauuauccuuaauacuaaugucugaugugacuuuuucuaugguuuuuauaaguagacacuaauguaaugaacaaguauucuugauaacauacuuugauuaauuugauaaguuuuuuucuggaguauuauaauaacacugaauuauggguaaugguauuucaccagguuuuuaauucaguaaaaccaguuuuucuggggcgaauaugauaguguucguuauucaaccuuuuuguugauuuggcuuuauucaggaacauauuugugguagagaccacuagcuuccuaccaaaaucacuuuuuccuucuucguggauacacaaacuaccuuuagcagcuccauuugaaauuaagugugcuaugugacuaaguuuucucuagugcauuguaaaugaaacagaugugagucacuucauuggcaugagccauaaaaaucuccauuauguguuccugggugcucuuuuucuuucugacuaaaugaaauggcaguguucagggaagccuuagaagucauguguugaaaaugacugaguagccaucagccuggaucuuugaaugacugcauggaaagaacugcauggccuaccugaacauucacccagcacuguugcauaagaaacaaauacacuucuaauuauuuaaacuacguaguuuuuuagagucuguuuguuacugcagcuuagccaaucccaauuaauacaauauuuuagaaaauauaacugaacagaaauugagcuagauucaaaugauccaugucaucaggauaugcaccaucuccauaacaugacucugaauugguuucauucauagauagauuuucuccacauaguagaauagauggcccagcaaucacaggucuuacauggucuuuauagcuuaugaucauagaagcugagaaaguaucuuuuccuggaagcaccagcaaaaguucuaggaagacucuucauuggcccagcaggggucauguacccaucccugaaauaguuucuguggcuaaaaggauagaauaccaugggucaaauuugguuaacauuccuaccucuaaguagaagggugauagucccacacaaccccauggacaaaguaggaucauauggaauggaguaguuuccuaaagaaacaauaaagaauagacaucagaauacaauaugguuagguuuuuaaaauuaauauagacaugaaaugagagggaccuggaugaaggucuugguguggauauaaagggaaauauugaaauaaaauauauuuuguugaaaguuugcauugucagggagggaaauaguagaaaaaacaacugaacuuuaaaaaacaauuaaaaauuuuaauuuugguaaaaaauaaaacauaugaggugguaggaucacuugaggccaggaucaagaccagucugggcaacaucacgagaccccaucucuacaaaaaauuuaaaacuuagcugggcacguuggcaugugccuguaguccuagcuacuccagaggcugaggugggaggauuuuuagagcccaggaguucaaggcuguagugagucaugaucacaccacuguacucauuccugggugacagagugagacuaugucucuagaaaaaacaaaaauaaaauaaaaauauaacaucuuaagcaguuugaaguguacaguucaauauuuuuaaauauauucacauuguaaaaacaacuguaguuuuugaauuaggaaaugaguaaaguaauaguccuaucaaaauauuugagagauuugaaaggaaaugcaguucaggccugggagaggugggugucauaaacacugaucaagcaggccagaccauagguuuccaaguccuagggagccaauagaauaguccugggcaggugauuugugagacaggaguagcuaacagugaggaaaauggucuacaccugggcaguugacgucaccauuagaccaaaucucaguagcauucaguaacgauuucuagaacugagauacagggcaaaauccaaggaacaaaacccccuugcuacuuaauugguaccagcaacaaaagugacuucauauugacagacugacuugggauaucuuacauguuccucugcuucaaugcaaaauucccacagguaggaacuuauaggccuuacucauaaagaucagacaauuucagggacuagaugcuaagcucaguauuacaggaagauacagaacucuguguagcagaaguauaaagacauacaaguagagagcauugcuuuaaacaaaaguuuaugacuggagcucauugagugguuagaguuauagauguaauccuguuaguuuccaucgcugagauaaaguuaaaauaaugagagcuguucucucaugugucauuaguauaacuuuaaggggucacugcaaaguaggaauggaccuuauuguuaucaacaaauauuugaguguuucauuauauguaguguaagauuuaaauuucacaagacaaggagauguauauuaacucuuaagaagaggaaaauauauauaguauugcuuuguuuuagcauucuauuccuuuauuuaccauguaugccacuacagaagacuuuauacuuuuauauguuuuaauaauauggcaaguuucccaacuuacaaaucaguugaauccuaaaaauuccauguauguagcuuguugaaauucaacacauuuuaaaauagaaauuguguuguaaauuguaguucuguuuccagaauaauucacaaauugcuuuuaauucacaauucaucuucauugcuucauauuagcaaacauugauuagcagugaaaucaagugguaaaguaacucuacagguuuuugaaaggagauaugaaagauaaaaaaggaguuguauguguauaugagaaaaacacuuuuucaggugggugugagugagcugaaauaaaaaaggcagaauaaaaagcccaaauuaugcauuaucuuucuaaagguaagaaagcagauacugauuucagauuuuuccaauaccuuugccagccaauaaguggugcuauugucacagaauaguuagguuguucugcagcacaaagcaaagggggaagauguggaaaguauaugccaagugguuguaaaauggguugugaaaaggaggcagaaauaaaaaagggaggcagcaugaaccugacuauauguggacacuguuuuuguaguauaggaggugauuaugcuaguacauuuucuuaaauuuccauguaaaaauuaaacauaauucaagacacaccuuuccuuauccauucaauuuucuuugagcuuuaguuuccucaauuauaaaagugaagauuguugugagaauuaagaaaauaaaaauaaagugucuauuaauaucauauacauaaugcucaauaaauauaauucugcucaucuaaaugagucagauaacauuaauaagccaaauuaacauaauauuauugacacguugcuaaauuagccuaaauuacaugaucuucagaaccuggaagcuuauaagaaaguagcaagaaauagggaaaaaauguugagcuuugucauuugcuacuaagaauaaagaauuguucaacuccaauuauuuuauucuuuuguagguaaauauccaggcaugggcuaucaguacauccuugaguagagaggcaggcuccauuuuuauaugcacucuguuuuuggagacccccaucuuaaaguaauaccauguggcauaucuuacuauuagugacuguaguguuuaucuuuuugagcaucauugagaaauaaugaauaaguagguaaaaauugcaagauuaauggucuuuuugcagccuucacaagcaaaauggaaucaacuuuucuuuuucaugcuccuacagccugccuuuuggugcaaucacagcuuauuagcauaucuuucuaacagcgaacuaaaauagagaacaaagauaaaauucaugucauccaauuuuguuaguuauuagccaggguaaaguuugucauaggaagaguuuaaacgaaugacuaaaaucauaugaugcuauggcugggcacgguggcccacaccuguaaucccagcacuuugggaugccaaagcaagaggaucaccugagguuggcaguucaaaaccagccuggccaacauggugaaaccccgucucuacuaaaaauacaaacauuagcugggcaugguggcgcgugccuguaauccccagcuacucaggaggcugaggcaugagaaucgcuugaaccaaggaggccgagguugcggugagcugagaucacgccauugcacuccagccugggcaacagaacgacacucugucuccaaaaaaaaaaaaaaaaaaaaaaaaaaaaaaauauauauauauauauauauauauauauauauauuuauauggugcuauauaaaaacuuuugauggaauuuucuauccugucuuuccuuuuacugcugguaauuggccucagacuaccuaaaucuuucccuucacagcagccugcaguucuggggagucaaaguauuaaaaaugccucuccagugaaggccugcuugcuugaugacaagugaauuggagaguuguuuuucccucuuguuguucagacuucuuugucuuuuccuaagcacuucuuauuccaacaugagaaaaugacuucucacugaacucauccuuucugaacacuggaagcaagccuuaaaucaaguucuagcuuuaaaucauagauucacagcugaaguaggcuuuacauguucuuggaaaacaggauuguagggaaaaugcuacauugucuuacaaccaguuacucaguaguuugugaaagauugcuugacuaacuaaaugaagaauaguauagggaaagaaguaaauguaugguggucuuucugcccauuggcaagaucuugauuuuguuuaguaaaugaauauauguauucacagauggacuggggaaucucagaaguacaguacuuggucugaaucaaugauuuucacaggacucuuuagaauccuaggagugugaggagguaacuacauguaaggggaggggagaaaaggugggugguacucugaaccccucccuuaaccagagaggcucugcuugaauaguuuuguaaauugaaccucuaaagaggauauuuuuaaagacaauaguuugaaaauuauuggcauccgagacuuuuaccaacuaaacccaauuuuugagcuugggaaucugguucacaaauacuaguguaguuccuguuaacuugauaacuaucacauuucauuagaugauuaugugaucuccuucuauaucagaauguuucuauuuauuagugaucaguggugccugguggcuaaauuaaauagauuaaugaaggguauuaguaauuucauggauuaauaaauauaauuuuuuaaaauugagaacuaauguaccacaaaaugcaaucuguuuauuuuuauuaaauuauucauauuuaaaacugccacauauucugugaauuaguaacaguagauaacaguacggucuuugacucuuuuauggucugugauuaaugaccaaguauuugauuucuaugaaaccauuugggucuagaagucaaucacauaaucagcuguaucugcuacauuucgaaucugaaaauaaguuugggcuuggcccaagcuuuucacauacuauaauuuuauaauucucuaaauucuaguaauauuugccaucauuuuuaauuauuuccuuccaucucucuuuuuaccuauauauugaaagcccuaguguucaaauuagauuuucaaagugaaaauuaaauacuugauuauauuauuuuauaccacacuaugaauauuuacuaauuuugaaagaaaauacucuuuuuauauauauuuuuauaucaaggguguaccagauuggaauuuguuugcuugagucacuauaaaauaagauuuccaaucacauucauaaauguccucuuauuguaaaauaguuuuguuaaaacuugaaauucuuguauaaugucuuaaagccuauuuaauuuagcuaaaaaaauuuucauccccgccuuuuuuccuuccuuuuuguguguguuuaagacaucuuaacucauguuauaauuuagauauauucauagcagaaucaccuaauauucauuuuucugacauuuuguuaaauguucacauuuucaauuaugaauauacuucauacauuguagacaauuuagcuuuacaaaaaaguauagaauguauuaagugagugaaguacuuucaaaaguugauuucuacacaucaaucaaaaccugaaaugacuacuucuuucagcucuucauagugaacacauuauuacauggacuaaauagucaugcauucaucauuuauauuuuuuguuugaaugguuaccuucuuuuggagaguagaucagguguaauuguaacugcuuuuucagcagaucaaaaauuccuuucaguuuggaaaauaaaugguuuuucaacauaauauucaaguguuauuucuuuguuuuuuaaaaacaguuuuugaugugugauuuccacaguaauggaagggaaguaaaugaaguaaaggcauuucuaagacuuacauguuugauuugggaauauaaucagaagaccugcuuaacuuuuaauuauaaaucuucuuagauuaaugcaauagacuauucaguguauauuuguugguugaauuacagauguuuuuagaacuuugaaguuuuguuugaauauaaugcucucauggaaccuuuaaaaauuaacggucaauaagaguuuauuguccuugugcaaagcacaaacacaaauuuacaauagguuaaucuuuuuucuuaaauugugauauucuuauguauuuucagauugaaauuuuauuuguggcuuuaaaaaaaauucauuaaugaaguccaguuuaaacguaauauuggugugcuauaaacuugccacaggacauuuucacuaauauaggaaauagguuacuuggaauuguucugcugucuuucuggguguaguuuaagaccuuuuaucuuuucagaucugaaaagcuaaaucauauuauauaaagcauuucagaauaaccaagcauuuugauauaauauuggauuuucugugauagaacaaguugagauuccuuauaggacacuuguaaauaugaggaagcuaauaagauuuuagguaauucauugaacuaguaggcagucuuaaaaauucugaaagcuuaucuguaagacuucuauaauugcuuuaaaaauauuaucuguggagauagucuuacauguucacauaaguauauguaggacaugucagauuauagaaucaucacauuuucaagcuggagugccuccuuuaauuacugugaggaauaauagcuuaugauagucaugcauaagauguuaguuuuuaauuggguaucuguaauaauacuauaugcaagcuuuauaaaugcuaauuuuaaaaucuuaaacagaaagagcuuaugcuuggagucauagaaaugcuuagguucaaaugcuagcuauacuacuuuaaucagcugugaacauuuggauaaguuaacuacccuauaccuuuuuuuuucucaucuguagaagauuguuuuaaagauaaaagauaaaacaugaaaggaaccuaaacauugcuuggugaacagcaagcucuuaauaaacagaugcugcaacugaguaacuuuagucaaauuacacuucaagucauguguaaaaauggcuuucaguauaagaauuccuauuuuagugcucuuaauuuguguucauuuuauuuguaaugguucagaauaacaaaguuugaaagcccacaaaccuaauauauguagcguggugcuuggcuuucaguaguucucacuuucauacauugugcauugauacuucuaaaccuccuuuuguaugcagaauucagucucuuauacaucaccaccagucaacaaacugauuuagaauuaucaccugauuguacugcuugcugccacugcuauaaaaggagagacaucagucagacuauaaggaucuuauucugguuguccuaccuauuugaucaccauuccuccaacccaggagcucgugucagguuugcuuauauacaagggaacaacuaucucagaaguaugucaccucacucagcccagccucucuuucaaccccaaagucaccuccaaauuccacuuaucucuccucaugcuaccccaucaauguaaaauauugggcuagaaguagacaacugguugaaaacuaucaccaagaauuauauaugcuuguggguuacagcucuauagcccucuaccuuugauuugguacuaguggaagaaaaucccuccuccacggucuuagauauuuuaugagcgcugaaacucugaaauguaaagauuaaaggcugcccaaauaucucuccuggccugugugaauggauuaggaaaggaauaguggcucaggaaaggagagaugccugagucugcuguuucauucuuaggaaccauuggugucuccugccacagguaccuucaagagucauacucaccuacagggucacugaaacccuaggaaggcaguauuuguaaguaguaauauuagaaaucuuauuucuaaccauccuuuaaauaauaucuugcgcagcuuucaaaugugugagaacacuauaugcagaagaaagggaaacuuucuaaauaaaaacaaucccuuuccauuaauaauuuuuaucagaacuagucaugauaguuagaaaaugaugcuuuuccaacucugguacuuguuccacauuuacuauucaucaucaugguaagcaagagcccuuuuaucgcuccaauuuuuauuuauucaucuauuuaucuauauuguuuagugcuguggcuuuauuaauuccuggguuuuucucaguguuauauauagugcucagacauuuugguuucagaauuccuuuagacucuucauaauuauugagagaacuuuguuuauggaauauguauugauauuuuuuauaauaaaacuaaagggucagaaccauagcuauaucucagccccuugggcccaggaugauagagugugccucagagcaauagaccauggcuuagugagagaauugcauucacuuguaccuuugagagugaaccuauacaucaggucccaggugcuauagugguuuugaaagaccuugagcugaggaacccaacucuccagacacucugagcaucugugcucuggaucccagugcugccuuggcagccugugagccaugucagaucugacacugagagagauccccuaagcuaagacucaccacugugaggauaacaagaaugagaggauuccuaaagccugugcccuaauaaccuacacugcugcagucaguaccacaaacuccugaagccuagaccagggaggcaccugaaguuauuuccaacauuggucacugcugaagaugcugcauggaaucacauuacuguggugacauagaaccagagccaccacauucugcuuaucugguggcauccuugguaccaucuacaugugaaagucuucaccuauaaaaaccacucuguaaaguuuggaagaggugacuguaccagcagaugugcagauauaucaacacagauacacaagaaacauggaaaagcaaggaaauaugacaccacuacaaaacaaaauaauucuucaguagcugaccaaagaaauggaaguuuacuaauugucuaaaagaaauucaaaauaaugaaccugaggaaacucauuaagaaagaagacggugcaaauaggcaauucagugaagacagaaaagaguuuaugaucugaaugagaaauucaauauagauagauaucauaaaaaugaacaaaacagaaaucuuggagcugaagaauucaaucaaugaaauuaaagauacaauugucggcuucaacagcaggcuagaucaaucaagcaggagaaaaauaucugugaaucugaagauaggucuguuggaaugacucagaggaaaaaagaaugaaaaagagugaagacugccuauaagacuuaugagacaccauuaagaaaauaaauguacuaugggagaaaugcacuuagaggagaagagacagagaaggggacaaaaagcuuauuuaaugaaguaauugcugaaaauuugucaagucuugggagagauauggauauccagauccaugaagcucagagcuccccaaauagauugaacccaaagagcuccuguuugaagcacauuauaaucaaacuaucaaaagucaaaaccagaauuguaaaagaagcaagaaaaaagcaucaagucacauauuaagaaaucuccauuagacugucagcagauuucucagcagaaaccuugcaggccaagagagacugagaagauauauucaaagauguauccaaagaaauaaacugacaguuaagaauacuauacccaacaaagcuguucuucagaaaugaaggagaaacagucuuucacagagaagcaaaagccaagggaauucauuacugcuaguccuuccauacaagacauacuuaagggaauucuucaggcagaaacaaaaggaugacaauuacuaucaugaaaacaugugaaaguauaaaaaccacugguagaagcaaauauccagaauacuuuaguauuguaaagguaguguggaaaucauacuaaucucuaguauaaaggcuaaaagucaaaaccagguugggcaugguggcucaugccuguaaucucaguaguuugggaggcuaaaugggaggauugcuugaguccaggaguuugggaucagccuggauaauauggcaagaucuuguaucuucaaaaaaguuaaaaaaaaaaaaaaguuagcuggguguuguggcacacacaagcuacucuggaggcugaggcaggaggaucauuugagacucagguugagucugcaguuagccauguucaugccacugcacuccagccaggaguuugggugauagagcaagacccugucucaaaacaaacaaacaagucaaaaccaucagaaauaauuaaaacuacaauaaguuguuaaggaauacaaaaagauguagacugugguaucaaaaauguaaauugguggggaggguagaaguccagaguuuuuguaugcaucaauguugaguaauuaucagcuuaaaauaguagauuauaaccauaaaauauguuauuuaagcuucauucugaccacaaaacaaaaaacuacagcagauagaugaaugauaaagagaaaugaaucaaagcucagcuacagaaaauugugaaaucauaaagauaggcaaaaagaggaagaaaagaacaaaggaacuacaaaacaaccagaaaacaaauagcaaaaugacaguaguaagaacuuauuuaucaguaauaaacuugaauguaaauggauuaaauuuuccaaucaaaagugauagaaugguuagauggaguuaaaaagaaaaacaagauccaacuauauguugccuacaggagaccuacaacagcuuuaaggacacacauaagcugaaaguaaaagaauggaagaagauauuccauuuaaugguaaucaaaagaaagcaagcguggcuguacuuacauaugauaaaauagacuucaagugaaaaacuauugcaagaaacaaagaaggucauuaguuaaugauaaaagggucaauuaaugaagaggacauaaccauuguaaaucuauauguacccaacauuggagcaccuaaauacauuaagcaaauauuaauggacaugaagggagaaauagauagcaauacuauaagaguaggagacuuuaguacccccacauucaaaaaugggcagauuaaucagacagagaauuaauaaggaaauacuggacuugaauugcacuuuugaccacuuggaacuaacagacaucuucagaacuuugcauccaacaacaacagaauacacauuuugcucuagcacacaugcauagaacauucuucaggauagaccuuguguuaggccacaaaagaagauugaccauauaucuaguauuguuucaaacuacagugauaugaaacuauaaaucaguagcaggaggaaccuuggaaaauuaacaaauauguggaaauuuaaaaacaugcuccugaaugaccagugggucaaagaauaaaucaaaagagaaauuucuaaaaugucuugagacaaaugacaguggaagcacagcauaccaaaacaugggaugcagcaaacgcauuucuaagagggacauuauagcaauuaaugccuauguuaaaaagaagaaagauuucaaauaaauugucuaacauuacaccucaaggaaccagaaaaagaacaaacuaaaccccaaaaaagcagaaggaaggaaauaauaagauucagaacagaaauaaaucaaauaaggaacaaaaaaaacauagagucaauaaaacaaagaguugguuuuuugaaaaacaaaauuuacaaacccuuaaccagucuaagaaaaaaaaauucaaacaaaauaaaaaaugaaagugaugaaauuauagcagaugccucagaaauaaaaaggucauacaguacuauuauguacaaguauaugccaacaaauuggauaaccuagaggaaauggaugaauuccuagaaaaauacaaccuaccaagauuuagucaggaagaaauagaaagcaugaauagaccaauauuaauaaagacauuaaagaaguaauagaaaaccccccaacaaagaaaagccaaacaccagauggcuuuguagcugaauucuaccacacagucaaagaagaauuaaugccaauacuucuuaaacucuucugaaaaauagagcuucagagaauacuucuaagcauauuuuaugaggucagcauuaccuugauaccuaagccagacaaagacaucaaaagaacuacaggccaauuuuucugaugaacauugguguaaaaaucuucaguaaaauauuagcaaaccaaauccaacaacacaucaaaagguguauacaccaggaccaagcagggagauuuauugcuggcaugcaagacugguuuaacauacacaaaucaaugugacacuucacaucaacagaaugaaagauaaaaacuacaugaucaucugaauuagugcaggaaaagcuuucgacaaagugugauauucuuucuuguuaaaaauucucaacaguuuaguuauagaagggaaguuucucaguguaauaaaggccauuuauuaaaaacgcacaguuaacauuauaauccauggggaaaaacugaaaacguuuccacugagaucuggugcaaggcaaggacaugcacuccugccacuucuguucagcguaguacuagaaguacuagcaagaucaaucagauaagaaacagaaauaaaaggcauccaaaucagaaaagaaguagaauuaucucuaucuguagaaaacaugauccuauauauaaaaaaaauuuuaagauuuuagcaaaaauaaaaaacccguuagaacuaauaaaugaauucaguaaaguuacaggauacaaaaauuagcauacaaaaaaaaucaagauacaaaaauuagcauuuuaauacacaaccuaacugaaaaagacguaaagaaaccaucccauuuaugacagcauuaaauaacauaagauacuaaggaauaaauuuaagcaaggagaugaaaaaucuguacaccaaaaacuauaaaacauugaugagagaaauuaaagaacacacagauaaaugcaaggauaucccaugcucauggaucagaagaauuacuauuguuagaauguucauaguacccaaaccaguguacauauguaacacaaucucuaucaaaauucccauagcauucuauacagauauaggaaaacaauccuaaaauuuguauagaaccauaaaaggccucaaagagcccaaacaauucugagaaaggaaaacaaauuuggaagcaacuuugauuuaaaauuaauaaacacuuacuuucugauuuaaaauuuuauuacagagcuauaguaaucaaaacaguacgguacuggcauaauaauaggcacauagaucaguggaacagaauagagagccuagaaaucaaucuauacauauauggucaacuaauuuuugaucaaaaaaaauuugaugaaaaaucugcggaugaucaauucacuuauauaacauggcauaauauuuguauauaaccuauccacauacuucuguauacuuuaaauuaucucuaaauuacuuauaauaccaaauauagucuaaaugguauguaaauaguuguuauacuguauuuuuuaaauuuguauuuuauuguuguguuguuguuucaucauuuuuuuccccaaguauuuucaguggugguugacugaaucugcagaugcagaacccauggauacagaggacugauuguauacagagaccaggaacaaaacagugguuaccugggacaggaaggggugguugggagaaguagggagauguaugucaaaggauacaaaguagcagauauguaaggugaacaaaucuagagaucuaauguucaugaggacuguugguaauaaaauuguacugugugugggauucaugcuaaaugaguagauuuuaguugcucuugcgacacacaaaaagggauaacugugagaugauguauauuuuaauuuuuuuuaugacuagauguuucuuuuuuuuaauuauuaugcuuuaaguuuuaggguacaugugcacaacgugcagguuuguuacauauguauacaugugccaugauggugugcugcacccauuaacucgucauuuagcauuagguauaucuccuaaugcuaucccuccccccucccccuaccccacaacaguccccagugugugguguuccccuuccuguguccauauguuuucauuguucaauucccaccuaugagugagaacaugugguguuugguuuuuuguccuugcgauaguuugcugagaaugaugguuuccagcuucauccaugucccuacaaaggacaugaacucaucauuuuuuauggcugcauaguauuccgugguguauaugugccacauuuucuuaauccagucuaucauugauggauauuuggguugguuccaagucuuugcuauugugaguagugccacaauaaacauacgugugcaugugucuuuauagcagcauuauuuguaguccuuuggguauauacccaguaaugggauggcugggucaaaugguauuucuaguucuagaucccugaggaauugccacacugacuuccacagugguugaacuaguuuacagucccaccaacaguguaaaaguguuccuauuucuccacauccucuccagcaccuguuguuuccugacuuuuuaaugauugccauucuaacuggugugagaugguaucucacugugguuuugauuugcauuucucugauggccagugaugauaagcauguuuucauauuuuaauuugcuucacucuaguaaccuuuuuacugucuauucauaucccacaacaucauguuauaucccuuaaauauauacaaugaaauuuauuuuaaauacauaaaagugagauuuuuaaguguuuauuaauucauuuuaaaauaucacuaauaaauccauuacauguuaacauaaagaauguauggaucacuauacuuuaccucuuucuuccucccggaucuugaaguucugccuuaauuuguaaaacuuccuuuguauagcauaucugauacauaucuuuaauuggcauacauuuucauuuuuaguauuuuuuaacuugcuuuacugccuaugcuuaacaaggcaaucuuuuuuacuuuuaucuucacauuuuaaacacaauugaacaaaagaaauguuauuaacacacuuuuacaagaaauuucuuuuuccucagaaugucagaguaaguucagaaacugaauauugauuuuccuuuuuaaguuaugcaacaaugacaugaaaaccuuuauauuuuccaugugguaggaaaaaggauauagguacaauuuuaaucucauaaauacaugcgcacauguauauguguuuguguauuuauaaucuauuaguuacaauagucugaaagggaacaauaacauguuaauaugauauuuugagucacgcgcuuacaggucauuuuuauuuuuuucuacuuuuugguauuuuccagauuuucuucagugaaguuuuaaugaaucuauuauuaggauuaaguuaauugauuuaagaugugucuuccacauucugaaacaccuuaaugaaaggcagugguuuuucuuuuuuggaaagaaauagugauuuuuacucuuuuacuuuuagcuuagcccuuguauuuuaccaaccgaaaugucaguuuguagauguaacauuuguagucaucugaaagucuggcaacauaucuuagugguuaagugucuaggaucuggagucaaaagacccauguucaaauccugauaucuguuugcuagcaaguaaaugucuuaaguucucuuaagccucaaucucuuuauaaaugaaauguacaaauuguuuauuuaaaugaaguaauaauaguaccucauagcauuguauagcuuaaaugaaauuacucaugcagagcuaaaacuuaguucaauaucuggcacaugguaaacaugccauaaauguuagugcuuuuuuuuuuuuuuuuuccugacucuggaaaucuaggaccucucccuucuuccuucaaaccuaacaaaacauuguugugaacuacaggauuuuuugaaaucaaggguaaauguaauccaagcaagacuuugauauucaacacccauuaccuguccauaggaguuuccugcugguuguauugguuucuaugcccuguaacaccauauguguggcugggccugucucuacaacccaguguggucugcagugugguuucccaacuguggucuauaagaugacuuuagaugacacaaagacaacccuuuaaauuuuuuaaaucuauuuuuaugggugagcaaaaaacacaacuagcacauuaagucagugauuacaugaauauuuuuuagaguaagguaaaaaugaguauugaggaaaaaugcaaaucacuguaaagaaaaauauuagguuauaguacucuaaaguauggcaaaaauugcaaagaugguacuugaauggcugaaguuuagguuucugcucuagaggcuccuucccauaucuguguccagggugcucauacacugucccagaagcucaguaguacaugugaaaccugucuuuuaccuaaacccuugucaucuacgauaugccuugggaucucaccuuuuauuauguuuucuuccuuccuuucuuucuuuuuuuaaaauuaaaugggcuccauauauuucuaaacaaagaaauaggaaaucuaccauccuccuaaggcaauuagcucaacagcagcuagcuuuuucuuuuuuuaaaguuuggaaaaauauacuguuauaucuacagucuuuaaauacauagauuauugaccauuacuaccuuccugaauucaaacccuguguuucaauuaaauauaauauuguuuaguauuaaauaaaacaacuguguacuguuuuauuuaauaauacucauugaguccaccaaugucaauuauuuuuguuguauuaggacuuauugaaccuacacauauauuggauuaaauguuuuugucaccaaguuaauuuuuaaauguaaauuagaaccuaaaauuuugaugcuugagcagguacuuaaauuugcuguauucacuacgauggaaauuuuuuugcugugauaaauagaguugucuuuacaaauauugcaugaaagcauauuaguauaaguaaguguacaguuugugcauaauuccuuacucagugggaggcauaaauuccauucccaauucauaaaaauugaacaaguaguauuuauuccaaaaaaagggaguaguuuuacagugauuuauugaggagauaaacauaucugauuacaaagaauuuauuuaauaagcuaauagcuuuauuuuauauuacuaaagauguauacuuuuuuaaaaaaucuuuauuucaacuauuucuaaauaaagguuuauucagugauuguccugaaauuaaacuagcucauuaauuacucuuccugucuuugcauacacacacacacacacacacacacacacacacgcacucacauacacacaaauaggcauaacuuuugauuuuuuaaauccuugggagaccuuacaugaaguugaucgaccuaagaguaggaauagaaaguuauuuuuuuuguugcagauaugccuguaguauauaugcauuuaguagugcuacugagaacgauagaccugucuauccucuccccaugugcuaaacuuuauggauguacauuuaaaaacuuauagaccauacauguacuuugaggaucccauguauuugcauuuuuauuuuagacaauaguuuuccuuucuauaacuauuacuccaaaaaacauucuuacauuuugguaauuagauaaggacuacaugaagacaucgguauuugacuaacacauuuugaaaauugucacauaagcuuacuuuaauauaugcuaaauuauaaauacuaaauuuauaguaacuuguuaugauguauuuauauaugugaauguaaauagcauuuuaguaaacauacauguacauauauugaaccucuacugugagagaaaugcaguugucauuguuauaugcuccuuguacccuaauccuuguuccuaccacuuuuaguaucagucccuuguccuacuguaaauuuauuggguaagauaagcaaaagguaacuccucuuuguagaacuuggggaaccucugcguuaggauuaaaucagccugauuaaaugacuucauaaugaaaugcagaacuuccugaccacauacuuaagauuuauuagccauuaauggguugucuaugaacucccagccuuucacuuaauauuacuaagauggaagaaauaaaaccagccauucagcuuucuuaggcuuuccuuuuaugucguccuuucuccugcacagucacucccaggaguuuccuguccacacuuaaaugaauuuacagcuaauagaauaucagguaguguaggagagagauuugcaggcaucaagguuaauuucuuuaauuauguaagucaguauauuuagcauaguguaagauuggcuuaggagugguaagagaaaggaguauuuuguaagguccaaauuucucucccugacuggucugaucacuguuaagccaugcugcucccuuuaucauuccucacuaaugacuucucugucucagcucacauucccuggaguaggcaggcacacuuguuaaauaguaggaaguagaaagccuaccugguuuccccaggcucaaagguucagugagaaagaaacauguuuugaagcaaccauuuugauaaagcugcuuugaaagauauaaugaagacuuucugaaaacagaagaaaauaacaauuaguuuuaugccuucuguauaaacuuaaaauaugcacuaaucaacuuuuauugagaaauauaagcauuaggcauucucauuccauucuugacuucucaccaacuuuuacuuuacuguucucucuguuucauguuucugcauugcuacuauuccacuccagauauuaaucucucaucugaagaaccauagacuuugaaauuaugauaaaagaucaaagggagacaaaacagcagcagcuggucucucaauguggcucuaacaguaacauacgaacuuaguagcuuguaaguggucaccaucagucuaccauagccauaaccaaaccaaugaccaguuuuguuaaauucucuuaagaggaagugauucagaugggccacagaauucaacccauggcuuggcucccuuggguuugccaguguauuagggagaggguggcugcagggucuugugguccauuacauacuuaguaacagcaaugaauaucgauuuucuugggugauugcagcagccauugcuuccucuaagauauauacauguaagucagaagaaguugaacuugcuguugauuauuaaaauauuuuuuauuggccauuagugcucuauaggauuaauugguugcucuuuuucuguacauuaaaucuagauuuauuuauuuaucuauuuauuuauuuauuuuuugagauggagucucacucuguagcccaagcuggagugcaguggcucgaucucgguucacugcagccucugccucccgggcucaagugauucucgugcuuuagccuccugaguagaguagcugggacuacaggugugugccaccaugccuggcuaauuuuuuguauuuuaguagagaugggguuucaccauguugcccagguugaucuugaacuccugagcucaggcgauccacccaccucggccucccaaagugcugggauuacaggcgugagccacugcggcuggccuaccuuuaauuuuuguaggcugugguaaauaauuauaaauuuuuacaguaguuuagaauuugccuuuuguaauauaccuaauucaaaauggaaaucuauucucguuuuccuguuaauuuaauucuuuuacuauauaagggguuaugcaauauucaaagauuaauuguagaacuacuguaucauagguucauuuaaaaauguauuaaugacuuuugucuuauaggacaaacuauucgagagaaaagaauuguagaagcagcaaauaaaaaagaaguagacuaugaagcaggggauauuccaacagaaugggaagguaaguuucugcuuuuaguagaaucucaugggagguaaguuauauaacaguauacaaauucaauaagagcauauauaguuauauacuguuucucuuugcaaaaaaguuuuagugucugaauguuugaaacuuuguuuuuuuaacauugcauuucuuugaaaguugugaaggugcugaauuuuaguaagcagaugcauguauagcaaaaagaacuauuaagcauuaucagagcugagacuaaggugaggcaagccaaaauccuaagaugcaaaauuuaagcaggcacucacuuucauguagugacccagcacuugcacaauccuaggauuugaauccuguuucuggcacucauuacacacaugaacuugcaaaguaacuuaaacuuuuaguuuuuucuuuuauaaauuaugcauaauacuugcuguagauaccauuuggaguauuuuuucaacucacaauaacucuaugauaacugacugccuguuaagacaaggauggaugcucgaucccuuuccuaagacuuugaaguuaaaauaaaagaucaaagggagacaaacagcagcaguuggucucucaguguggcucuaacaguaacauaugaacuuaguagcuuguaaguggucaccuucagucuaccaucaaaguuuuauugcauaaaaagcuaauugauuuuagaaaagcuaauauugcagaaaaagcugauuuacugagaagaaaacggaaacuaguucacaaugagaaguacauagagagaauauuuccuaguuuuccaacagcuuucugguucccaguucaguuucucucugaaugaaguucaucugcaagacugaguucaaaauggcaccucauaaccauguuauguauuucuguuuuuugcuuaccaguuccuagcauagugccuggcacauuguaaggcaccuaguagguaguuaaucaauauguauugaauaccugaggccgggaguggugacucacgccuguaaucccagcacuucgggaggucgaagugggcggaucaucugaggccaggaguucaagaccagccuggcuaacauggugaaaccccguuucuacugaaaauauaaaaaauuaggccaggugugguggcucaugccuguaaucccagcacuuugggaggccaaggcggguggaucaugaggucaagagauuaagaucauccuggccaacauggugaaaccccgucucuacuaaaaauacaaaaauuagcugggcaugguggcacgugccuguagucccagcuacucgggaggcugaggcaggagaaucacuugaacccggggggcagagguugcagugagccaagaucacgccacugcacuccagccuggugacagagugagacuccaucucagaaaauaacaaaaaauucaaaaaauuagccagucgugguggcacaggccuguaaucccagcuacucgggaggcugaggcaggagaaucgcuugaacccgggaggcagagguugcagugagcugagauugcgccauugcacucuggcuugggcaacaagagcgaaacuccgucucaaaaaagaaaagaaaagaaaagaaauaccugaaacuggguaauuuauaaaggaaaaagguuuaauugacucacagcuccgcauagcuggggaggccucaggaaauuuacaaucauggcagaaggcgaaggggaggcaagcaccuucuuugcguggcagcgggagagagaauaaugaaggaggaacuuccaaauacuuauaaagccaucagaucucaugagaacucacucacuucacaagaacagcauggggaaaccgcccccaugaucuagucaccucccuccuucgacacaaggggauuacaauuagaaaugagauuugaguagggacacagaaccaaaccauaucacccauuuaauagauggagcaccuaaggccuaaaaagguuaguuaauuuaccuggguuauauagcuucauacguggguaaacaguagacucauugcuucuugguuggcauagcaugauaccuuacaugugguagcuauaggcauuauguuacuuuuaugccagcaugugaauguaaacaucauuucaguaaaaauauuuuuccauuucugcuuacuacuagaacuaugaggaaaaaaaaaaccauaaaaauaaguagauaccaaagguuuuuugaagaaauacagaauauaaauuggcaacuucuaggagggguaauugagcuuucuuauuuuagcagacucuccaguguuauaaacuacauuuacaauucuuggauaaugcgugcaccuucuuagaaugaguuuguuuuuaucauuuuuuccaauaauaguauagaauuaagauguuuauagaaauguuauaaauaaaugaguacguaaugacucauuuuucagccuuugagacuuucagagaguuugaaugaaguucuaaucuuuuuauggcuguccugaucuaguaauuuggcauaacucucccaugggacauauguuuaaaacaaauguaucaaucaaacacuaaacaaaaauuauuuuuauggugguacacaucaauuaaaugugaaaaauaacucagcaccaugaaaaaguaaauuaaguauuuucagguucagaugaauauuguauuugucaauuuuacugggaccugcaaguugcauauucucccacaauguagauuaaacaaugugcccuuuuucuucguuuauuuaguagguaucuauuaaggaccucuacauucauagagcuuauuuucuagggugggagaaagacaauacaccagauaaauaacuagacuauauuguauguuaauggccacagaaaauaaagcagggaaagggcauagggaguguuggggaagguuuugcaguuuuuuuguuuguuuuuuaagauggagucucgcucuuugcccaggcuggagugcaguggcgcgaucuuggcucacugcaggcuccaccucccaaguucacgccauucucccgccucagccuccugaguagcugggacuacaggugcccgccaccacgcccggcuaauuuuguuuuuguauuuuuaguagagagaggguuucaccauguuagcuaggauggucgccaucuccugaccucgugaucugcccgccucugccucccaaagugcugggauuacaggcgugagccaccgcgcccggccguuuugcaguuuuaaauaguguucagaaaaggcuuuacugaaaugacuucugaauaaaaacagaaggagcuagucaugcagcuaaccagcugaagagcauuacuggagagcaaguacaaaagcccugaggcaggaacaugcucagauguuugaaaaacagcaaggaagucagugugauugggauagaaugagagagaaauuaauagauaagguuagagaguuaauaggauugugaaucuggggggccuuguaggccauuuuaaagacucuggcuuuuacugugagacuggaagccauuguaggguuuugaaaagaguagucauauguucugagguauauuuaacaggaucacuauggcugcugcauugcaaauagacuuaggggaacauaggcaaaauauggagacaggaagcucuuguaauaauuuaggcaagagauuaauugugacuugggccagaguaacagugggaguggaaagaagaaguugcauuccggaucugugguaaaaguaggaccaacaggauuugaugacauauuggauguggagcaugagaggaaagcagacaguaauuacucuuaagcuguuuuggccucaccuggaaaaaggaguugcuguuaacugacaugugcaguuaaaggagugcagugaaaggagcaaguuagggguggaaaaaugaaaucaauuuuggacaugcuaaguuugagaugccuauuagacauccaaguagagauguuaaauuguguaugagccaagaacuuaguggacauaucuguacuggagauaaaauuugggaguugucagcaaauaaaugguguauaaagcaaugagacugaagagaucacacacagaaugaguguaaauacaaaaugagaaauucaaacacugacccuuaggcugcuccaaaguuuaguuagagacaauggagaccaaaaaggagcugccagaaacauaggagaaaaaaaaagugucauguacuagaagccaaauaucaaggaggaagaaguaaucaaaaugucaaaugaggucugaaaauuaacucugcuuuaaauacaggaacuauuuugucugacaaaaauaguucuguagagugguaggagcaaaugcaugauagaaaaagaaguauagcaagagagaauuuggagagucugagaauagacaguguuuaugaggaguuuaucuguaaagaaaaggagaaugaugaagcaguacuuggagaggaaaauggagucaagaaauauuuucuuuuguuuuaaagacagaagagaauuuuguaauagugaugggaaagauccagucagaaagaagaauugcaggaaagaggaaguccuugagaagacaagaugaggcaggaccuaguaaacagggggaagaguugaccuuugaacaaaagcuuggaaaauucaucaauagugauagcagaaaaagagucugugggcauauaugcagguagauggguagaugugguaaugagaaauuguguaaauucucuucuaauucuuacuaaugaagaagagugauuuaaguaaguuccuaaguaucaauagcaacuagaacccagauuugaacccaaauuaucugcuuccaauuuuuuacucaauauuauacugccuacaucauuuauaacuuggcuaacuccuauuuauuacucaaguuuuggaguagacauuacuucccuuuguaagcuuuuucugaccuggcccgucacccccagugauaggugagauguuccuuuuuuuuguuuuuaucucacuuuggaccuccuccaaucaugacauuuaacacacuauaggggguuccuuguuuacuuaucugcauccuccgcccuaaacuggaagauuuuuuagaauaggauccuuaccuuauucauuuuuguauucucagggccuagcucaauaguuaaguaaauauaagcucagucaacauuuguugaaugaaugcauuucaaacugaaaguauguuauguaaguauguuuaaggaaaaggcauuuuggggagucugcuggcuugcugaaaauagucuguuuuaagaagaaagacauggaacaguagaccagaccaauuuuuuucaaacauauagaagauuugaucaggugcacuggcucacaccuguaaucccagcacuuugggagacugaggcaagcaggucacuugaguccaggaguucuagaccagccuguacaacaugugaaacgccaucucuaccaaaaauacaaaaaauuagccaagugugauggcacacacugguauucccagcuauucagggggcugagguggaaggauugcuuaagccugagaggcagagguugcagugagcugagaucgcgccacugcacuccagucugggugacagagugagaccccgucucacaagaaaaaaaaaaauaggagauucuuggacaagauucagcugugggagauaguauaguacuaacuacugggcaauguuauaaaguuucagugaaccuuguaaguuuaauucauggcauuauuuguaguucuuauguagaggcucucauauuugucucucuauaauucagauuguuguauuuaucuuucauuuuuguuauuuuucuuguuuuugguaaguuuaagcuuguuucguguuaacaguaauaaacauuuuuuaugagaacccuaaaauacauacaaagcagaauauaguuggaggaggcagaaaggcccugauccaguuaagcuuuacuuaucacauauacucauuaaaauagaagauuaaugccucagaagagaaauaaaaauuacuuuuuagguauauuagaccauaccugucuaucauuaacacuguuaauaauuaauaucucaguauaaaaugucauacccacuuuuauugcuuuuaaguuaauaauuguucauaauuauucaacaugucuuucucaggccacaggaacuccuuauaaagaauuuucaaaguaagcuucauaaaauaauagaccaggauguugcuaucccuguucuagaaucaagacuuauguuauauccauguucugcaauggucauuuacuaccuuggucauuuuggcaaagggauuuaccuccuauuuuucaucuauaaaauuaaaacgcugaguucauaacccuuuaagccuccuaucuaucucuaaugcucuaugauucaugacccaagaaguaucucgaauaaacucacauugcgacgcagaaucucuggacuuccagaacaauuugguugaaccuccaguacacuugaauagaaaagauuagagagaauauucuugcauuguuucugaccuuagcauucaaucuuucaccauuaaauauguuguuuguagguuuuucucauagaugccuuuaucaaguugcagaacuucuuuccuugauggggcccucugccaauccucuaggguuuguucucuauguagcugucacccaacugguacucugaacugugaacuugcgugaccuuggucucccuagacucccagcuccaucuucuuaacuuauauagucugcuggauuuugacaggauucccucccuggggcacaaccgaaacucaaaguaguaaacuggggcgaucgugaggucagccuucguuuauuuaacguucucugagaccacuguguuucauuauucaauguccauuguuuugaagauuguuguuuuauguaauuuguccuuguugcuccaucuugacuagaagcaaaaggcagcuuuuuuuuuuaacauaccuuaauacauuugagauuuguuuguguacuugcaugaaucaguaaguuuauuccuuuuuauugcugacuagaauucugucauauugauauaucuuuuugcauuaacuaguugaaagacauuugaguccuuucuacuuuauagcaauuaugaguaaaguugcuauauuaauucauauacacauucacguacaaaucugugaacagaaauuuucuuucaaauaaguccuugggcaggauugguagguuuuauuuuaaguauagauuugauuuuauaaaaaacugccaagauauuuuucaauguggcuguaccauuuuguauuuaaguguaaguuugauuuuauaaaaaacugccaagauauuuugcaauguggcuuuaccauuuuguauucccauuaguaguguaugagaguucaaguuguucaucaucuucuccagccauugcuguugucaguuucauuacauuugagccauucuaauugguguguuuugauaucucauugugguuuuaauuuuuaugucucuaaugacuaaugaccuagaucaucuuuucaugaacuuauuugccaucuguauaucuucuuugguguacuuuuauaucuuuuugcccagaauuuuuuuaauuaaaaaaauuaguuuugagaauuuccuauguaucauagauauaaguccuuuaucagauaugugauuagcaaauauuuuucacagucuauggcuugucuuuucauuggcuugucuuuucauucucuugacagugccuuucaaagagcauacauucuuaauuauaaugaauuccaguuuaucauuuuuuucuuuuauauaucaugguuucaauguuguaugaaagaaaucuuugccuaaccugaggucaagaauauuuuguccugugauuucuucuagaaguuugggguucuacaguuuuggguuuuacauuaaagucuaugauacauuuuuaucuguuucauguuuuuuauggcaaucuaauuuuccagcaccguuuuuuuaaaugaccacuauuuuuuccauugaauugccuuagcaccuuugucagacaucaauugacuauggaugugucuauuucugcauuuucuauuccauccauggaguuauuuaucuuuuugcuagugcugauugucuugauuacugaggcuuuguaacaagucuugaaauaaaucauuuugagucugccaacuucuuucccaaaauuuuugucuugguuagucagggcccauauaauguuuuuacacuuuaaauaugugcaguuuauuguacaucaguuauaccucaauaaagcuguaaaagaauaacauagucaucuuggaaaaauaaguuacugaaugaggauaguaauaaugauacaagcaagggauacaacaaaaaagugucagaacugacucuuuucccagucucaggauuugacuuaaucuagaagacuauuugaaauguggauuugccccaaucucuuuaacugaagaacgucaccuugggcauagauuagucuugagauacuaaguuauauaauaugaaguuaucccaaguaacagagcauguaaagaucaaaugcccagacaaaccucuauaguuuuuccagagauauuuaaaguuggugucauauucaauccaggacuuuccaaaguuucuuuaaauuuaaugauaaauguuuugaaaucuuuuuugagguuucuuaauagcgaaagcaaaaacuuacauaccauugggaaucauuuauuuguucuuccuguugugauaaaaaugucuguaguaaaaacuuuaacagaaauaaaaagcaaucuggcaaggaacuaaaauauauuucuucaucagcauacauuauuggaaagccagcagaaagcauggcugaaggaacauguauuuggacaaaguaugcagggcacugcacugccaaauggauguuacaaauguuuuuagcaugucuucucuuauaacagaaagaccauacuucuuaauuuuuguuaguccccaaagcaaagauaaacuagagaagauauagccucagcaguaaaugacccacuuaauaaaaacaacgauucacaggagaaaaaaaaugugcaugaguguaagauugauggagcugcugcuuuaggcuacaaggaccuguaaugaaguuccugagauugugcaaauaaaauucaucauucuuggggaugaaauagaagccaagaguguacauauauacuuuauuuuuuagagauggggaucuugcucuguggcucaggcuggucucaaacuccuggccucaagcaauccuccugccucagccucuuaagaaguugggacuacagacacacaucaccaugccuauaaguacacuuuacuuuuuucuuucuuucuuuuuuaaauuuuagauucagggguuccaugugcauguuucuuacauggauauauugcaugauucugagguuuggacuucaacugaaccugucacccaaauagugaacaugguacccucccuaguuucuguuguucccauuuuuauguugauguauacucaguauuuagcucccacuuauuagggagaacaugcaguauuugguuuucuguuucugcauuaauucacuucagauuauggccuccugaugcauccauguugcugcaaaggacauaacuucauccuuucuuauggcugcauacuauuccaugguguauauguaccacauuuucuuuauccagucuacaauugauggguaucuaaguugauuccacuuuuuugcuauugugaauagugcugcaauaaccgugcgaaugcaugugucuuuaugguagaaugauuuauuuuucuuuggauauauacucaguaaugggauugcugggucaagugauaguucuauuuuuauuaguaguucuuugagaaucgccaaacugcuuuccacuuaggcugaacuaauuuauagucccaccaacaguguauaaguguucccauuucuuugcaacuucaccaacaucucuuauuuuuugacuuuuaauaauagccauucugacugguguaagaugguaucucauugugguuuugauuugcauuucucagaugauuagucauauugaguauuuuuucauguuuguuggccauguguauaucuuuugagaaguguuuguucaugcccuuuccccacuuuuaauguuguuuuuuuuuucuuuuugauuuauuaaaguuucuuacagauucuggauauuauacuuugaugucuuacauuuaagucuuuaaaccaucuugaguucauuuuuguauacggcgaaagguaggggucaacuugcauuugucuauauauggcuagccaguuaucccagcaccauuuauugaauagaguuuucauuccccauuguuuauuuuuguugcuuacugcaaacucugccuccuggguucaagcaauucuccugccucagccucaugaguagcuggauuacaagcacacaccaucaugucuggcuaauuuucuauuuuuaguggagaugggauuucaccauguuggccauccugaccaugcuggccauccuuucaccauguugagauccugaccucaagugaucugcccaccucggccucccaaaagugcugggauuacaggugugagccaccccuccggccuguaguuuucaacuauagaucuugcacauguuuuauuaaacuaauaccuaaguguuucuugauuuuuuuggugcuauugcuaguuguuuucuauuuuaauuucaaauuauucauugguaauacauagaaauacaauugauuuuguauaucaacuguguacuuuuaagugauauuguuaaacucacuuaucaauuguaucaucuuuacuguaaacuucuugugguugucugcauaaacaaucuuuuccuucuguuucuucuauucucaugcguaagccuuuguuuuuucuugccuuacugcacuggcaaggaaccuccacaauaaugaugaguagaacugguaaaagugaacaacuuugccuuguucuugaucuuagcaggaaagcauucaguuuuucacuguuagguaugauauuagcuguaagguuuuuuagaugccugcugucagauuaaaaagcugucuucuauuccucgguugcugggcauuuuuaucaugaaugcuguuggauuuugucaaauguauuuucuucauuuauugagauuauuuuuaugauuauuuuuuuucauucuguuaauaugauuuauuacauugauugauuuuauuuuuaaauuauccucccuuuucauugugguaaaguauacauaacauaaaaauuuccauuuuagccauuuuuaaguauacaguucaguggcuguagguacauucacuguuugcaacuaucagcagcauucaucgccagaacuuuuuucaucuucccaaacugaaacuucaugcccauugaaaaacaacucuccauuuccuccuuucucccagucuuuggcaaccaccauucuacuuuuugucccuaugaaucugacuacucuaaguacgucauagaaauugaaucauacaguauuugaccuuuuuaugucuggcugauuuauuucccucagcauaaugucuucaugguucauccauguuacaggauauaucagaauuucauuccuuuuuugggcugaauaauauuccauuguauauagauaccacauguuguuuauccauucaucgaaugauggacacuggaguugcuucccccuuuugauuauugugaauagugcugcuaugaauauagguauacaaauaucuguagauuuaaaccuauguaaauagguacaguaaauuuaaguggucuagaaaugccacacaaaaagcagaaguugucagaaugauauauauagaagauagcuacaucagacaacaugacccaauugacauaggacacuccacugagcaauuguaaaaugcacauuuuuuuccauaugcucauggaacauucaccaggaugggccacauauucuuuccagaaaugugggagauaggaauacuucucuacucauuuuauuaggcccuguuuaaccugauaucaaccugacagaaacaauaaagagauacuacaaaccaguauccuacauaaacauagauguagaaaucacuaacaaaauauuagcaaccugaauccagcaauauauaaaaagggcaguauaccaugaccauguggaguuuaucccaguaauacagauugguuuaacauuugaaaauccauuuauauucagcauaauaacaaaaaggagaaaaaucaugaguuaauuccaguugguacagaaaagaauugacaaaauucaauauacauuuaugauuaaaaacucuccacaaacuuaaaauagaaaagaagcgccucaaccugauaaagggcauuaaggggggaaaaaaaccuacaguuaaccucacauucaauggugaaaggcagaacacuuucccccuaagauugggaacaagacaaggauaucuucuuugacuauuuacauuucacaucaucuuggaaauucuugucaaugcaauaaagcaauaaaaauaaaugaaaugaauacagauaagaaacagaugacaugauuacauguagacagucuacaaaaaguacguaaaaauuaagugaauuuuguaacuuuucaagauacaggggaauauaaaaucaauuauaugucuacauaauaauaccaaacaauuucuaaguaaaaauuuaaauuauauuacuucaaauacuauuaaaaacuugaagauuuagggauaaauuuacaaaaauauauccaagaccuuuacauugaaaaacauaaaauaucagccgggugagguggcucauggcuauaauccuaguacuuugggaggcuaaagugggaggaucacuugaggccaggacuugcaguccaaccugggcaacauagugacaccuugucucuacaaaaaguaagcacuuuagccaggugugguggugugcaccuguagucuuuccagccuacucaagagccugagaugggagaaucacuugagcccagaaguuugagguuauagugagcugcaaucauuccacagcucuccagccugcgugacacagcaagauccuaucucuuaaaaaaaaagaaaggaagaaaagaaaaauaugaaauauugcugagaaaaauuaaagaagacuuaaauagagagauguacaauuuucauagaucagaagaguuaauauuuaaaagacaguauuucccuucaaauugaucuguaaauucauugcccuccaaucaaaauacuaacagccuuuuuggaauugauaugcugauuuuaaauuuuguauuaaaauacagagaaccuagaauacucaaaacuuuuuuggagaaagaacaagauuggagaauuuaacuuaauauaaaucuacauuuaucaaggugguuugguacugauguaaggauaauuauacaauuaauggaaccaaccugaauauccaggaauuuucucacacuuauauggucaauugauuuuucaauagcaaggaaaauucuuuucaauagcuuguguugaauaacugaauuuccauauggaaaaaauauaaaccuugaacauuaccuuauauaauccuccaagaaauuuaacuugggauuuaucacagaccuaaauauaaagcuaaaacuaauaaacuuuuagaagaaaaagaugaacaaaaaucuuucaauuaugaguagucaaaaacuauuaaauaggacccuaaaacacaaacuuaaaaaaaaugauaaauuggacuucaccaaaauuuuacagauucuuauuuuuaacagauuuauuagagcaaaggaaaauacaagccauagacagggagaaaaauuugccauacaugucuaacaucgaacuuauauucagaauauguaaagaacucucauaccucagugagagaaacauuaauuuuaaaauggacaaaagguauaaacagacacuuuaccaaagaggauuuaugguguggacuaaaugugguucccccacacucuucuaccccauucauguguugaagcccuaacucuaaauauggugguauuuagaaauaugggaccuuugagagguaauuagaguuagaugaggucaugagggugaggccuuaaugauaauauuagugcccguaggagaagaggcaccagagagcuguacucucucccugagcaugcacaaaaaaagaagucauauggguacacauugagaagauggcugccuacaagccaugagaagaagccccagaaagaagcugauuauacuggcaucuugaucucagacuuccagccuccagaacugugagaaaauaacuuucuguuguuuaagccacucagucuguggugguuuguuauggcagccgaagcagacuaagacaauacauaaaaucaguagucaucaagggauacuaauuaaaacaacagugaaguaccacuacauacaacuagacugacuaauauuuuagaaauugauaauaccaacaaaacugacaauacauucaugaagauguaaaguaccugaaacuuucauauauuucugacuagaguguaaaauguuacaacuacuuuggaaaacaguuuauuaguucuuuaucaguuuaaacauacacacuuauccuacaaccuggacauuuuauggcuaaguauucacccagagacauaaagacauaaguccaaacaaauucuuguaccggaauuuucccagcagcuuuauucauaauagccaaaaacugaaaaccacuaaaauguccaacaagugagaggauaaacaaauugucauacuuccaugcaaaggaauacuacacaucaauaaaaaauaaugaacugcugauaugcucauuauguuuguuuuuauugcuguaugucaacauuaccacaauaauaauagcuuaaaauaagacacauuuauuaucuuacaguuucugugcaucaggagcccaagcacagccuagcuagguucuuuaguuaaggguuucacuaagcuguaaucaacccaaggcuggguucucaucuagagacuugauuaggaaaagcucuaccaucccacuugugugguuguuggcagcauucaguucauugcuguuguaagacugagagcuucacuuuuucacugguuguuggccaaagaccacacugaguccuagaggucacuggcaauuucuugccaaugguguuucccaauauggccacauuuuccuuacagccagccagggggaaaaauacuccagccaagaugagcaccauaaucuuauauaacguaaucacaugagcacauauaucccaucaccuuugccguguucuuauaauuagaauucauggguccuacccucauucaaggagaagagauaauacaaauguaugaguaccaggagguggugguuguguaggcuaccuuaagaguaucacucauugccuggggacuauggguaggauaagguggguguuuccauguaaacagacuggggaacuuuuauaggugauggaaauguucugucuguugauuguggugcuaauuacaggauuguaaauauuuuuguuagaaguuguggaauugcacacuugaaauggcucacaguauuuuguaaauuauaccucaauaaaguuaagagaaaagacaguaauagccaugagcaccacaaaauuuguaacuuaaagaugccaacuuaauaauaucccuaagauauccuuaaaagucaauaauuggaaaaugauuuguuucauaauauauccuuugaaggauuuucacaguaaaaacuguggaucucuuauuuuuauaguccuuuaugaagugucagcacucagaacuagcaaagaucauuuuuuuaaagaugaggcuuuauuacagucucuucuguaagugaaguaagcacauauuucuaaugcaauaucuuuuggaugcagacuauugauaaccuuuccguaauuuugguucugaaugguuaccuacuggaucuggugauagaguauuucauuuacuuuagccucuauugacaacgcuucuaaagguguacuugccauuuuuagcaccuguggagauuugaagaguguaugcuucaugaaguauuuucuugcuugauucuucuagucucuuuaagugauuaaagggugcuuuaauuugcauacucaccuuuaaucuuauuauaguggcuuauauucuaauaggaauauuaaaguucagugaaaaucucauacaugcugaugagaaugcaaaugaauauugacgaaagaaugcuaggaucauaagguguaaacuguccaguuaucuugcuaaauucauuucaaacaauguuuacauuauaaugaggacugauacagauuucaccacauaaauaucacuagcaguggcaaaauuauauaauuuauaauuggauaaugguucaguuucagacuguuuugaaguuaacaaaaacaacaaaguaaugucuugauauuaaugcaaacuucagcuggucauuuguuguauguaguaguugggaaauuggguaugauuuuacaaauaaguggucacguugagcauuuccggcuguagccuuuacaggaugcauaacaaauaguaguggcaucacucaucaucccaacaggacauuucaaguaucugguuauuguacaauuauaaauauacaagcuuauuucaguaguuauguuuauguaucuguguaaaaccaagauucauuaaauggucauugaaaaugaagcuaaaagaaguccccugacaguaaauagacuaggcaauauuuauuauaauacauucaguauuuaaguucuauuacauucuuauauuaauggaugaauuuuauaaacuuaugcaaaaccaguaagcuuuagaaaacauauaacagaguuucuccaaccucuuuaacuacuuuggaauuuuuuuaaugauuuguauucaauugaaguauuuuuuuuuucagccuuacaagagaacugaaaaugcuguuuuauagacucaucaguagggcagauuguuauuuagaguuguuuuucucauggugacgauaagugugcauuaugccauuauacuuuuucagcauggucuuaugcccacuggugugucuucauagacucuagaauacaugguaaucauuaguuaaaaguauaauaaucaauaaugauuuuuauuuuaaauaauaugaaaguguuuuugcaucaaaauauguauuuuucgcuaaagggauuauacuuaauuguagcccuggcacaggaguuggcaaacuuuuucuuuaaagguccggaugguaaauauuuuagguuuuuuaugggccacuuagucaguuacaauuacucaacucuaauguuguagcacagaagcagccacaaauaauauguaaacaaauguuugucuguguuccaaucaaccuuauuucuagacacugaaauuuugaauucucuaugauuuucaugucaugaaauacuguucgucuuuugauguuuuugcaaccauuaaaaaaauguaaaaagugguaggcuaaacuuggcuugcaggcuauacuuugcugacaccuguccuagaaguugauuuuucuaaagcuagaauuaacuucuacucuacauuaaaacugaagauauauugcugaaaccuuuuauagauauauaguucauguugaguuauuuuaaaaggaagcuguuuucuagaaaaaaaaucauaauuauacauaaguaacuuuauuuuuaaaaaaacuuuuauuuuaaguucagggguacauaugcagguuuguuacauaaguaaaugugugucuggagauuuugaugugcagauuauuuaaucacccaaguauucagccuaguaccccauuaguuauuuuuccugauccucucccuccucccauccuccacccuccaauaggcuucaguguguguuguuccucucuagguguccauguguucucauaauuuagcucccacuuauaagugagaacaugcauuauuugguuuucuguuccuguguuaguuugcuaaggauaauggcuucuggcuccauccaugucccuacaaaggcaugaucuuguucuuuuuuauggcugcauguauuccaugguguauauuuaccacauuuucuuuauccaguguaucgcugaugaacauucagguugauuccaugucuuugcuauugugaauagugcugcaauaaacauacacaugcauguguguuuauaauagaaugauuuauauuccucuagguuuauacccaguaaugggauugcuaggucaaaugguauuucugucuuuaggucuuugaggaaucucacacugucuucuacaaugguugaaccaauuuacacucccaccaacaauguauagcauuccuuuuucucugcaaccuugcuagugucuguuauuuuuugacuuuuuaauaauagccauucugacuggugugagauggugugauuugcauuucuuuaacaaucaguaaugagcuuuuuauuuuaugauuguugaccacauguaugucuucuuuugagaagcgucuguucaugucuuuggccuacuuuuuaaugggguuguuuauuuuauuuucuuguaaauuuguuuaaguuucuuacagaugcugaauauuagaccuuugucagaugcauaguugguaaaaauugucuuccagucuguagguugucuguugacuuuguugauaguuucuuuugcugugcaaaaguucuucaguuuaauuauauuccauuuguccauuuuugcuuuuguugcaauugcaacaaaauugcaaauuuuguuuugagaauuggugucuucucaugaaauuuuugcccauuucuauaugcucagugguauugccuaaguugucuuccgagguuuuguaguuuuggguuuuacauuuaagucuuuaauccaucuugaguuaauuuuuguguguguauaaggaagugguccaguuccaauuuucugcauauggcuagccaguuaucccagcaccauuuauugcauaagaaauucuuuccccauugcuuguuugugucagguuuguugaucagauagcuguaggugugcaguccuauuucuggacucucuauucuguuucauuggucuaugugucuguuuuuguaucaguaccaugcuguuuugguuaccauagcucuguaguauaguuugaaguuggguagugugaugccuccagcuuuguuuuguuuguuuguuuuuuguuuuguuuguuuuguuuaggauugcuuuggcuauucaggcucuuuuuugguuccauaugaauucuaaaauauuuuuuucuaguucugugaagaacgucaaugguaauuuaaugggaauagcauugaaucuguaaauugcuuugggcaguauggccauuuuagcaauauugauucuuccaguccgugcgcauugaguguuuuuccauuuguuugugucaucucugauuuuugggcagugguuuguaguucuccuuaucgagaucuuucaccuccacuguauuccuagguacuuaauucuuuuuguggcaauugugaaugggaguuaguuuguaauuuggcucucugcuugaguuuuguugguguauaggagugcuagcaauuuuugcacauugauuuuguauccugagacuuugcugaaguugcuuaucagcucaagaagcuuuugggcugaggcagugggguuuucuagauacaggaucaugucaucugcaaacagggauaauuugacuuccucucuuccuauuuggaugcccuuuacuuuuuuucucuugccugauuucccuggccagaacuuccuauacuauguugaauacaaguagugagagagggcauccuugucuugugccacuuuucaagggaauuguauuagucagaguucucuaaagggacagaacuaauaggauauaugaauauaagaaggggaguuuauuaggagaauugacucacacgaucacaaggugaagucccacaauaggccaucugcagcugaggagcaaggaagcaagucugagucccaaaaccucaaaaguagggaagcugacaaugcagccuucaaucugcagcugaaggcccaagagucccuggcaaaucacugguguaaguucaagaaucuaaaaacugaaggacuuggagucugaaguucgagagcaggaagcauccagcaugggagaaagaguaaguccagaaggcucagcaagucugcucauuccgcuuucuucugccugcuuuauucuagccaugcuggcagcugauuagaugguacccacccagauugaaaguuguucugccucucccaguccacugacuuaaauguuaaucuccuuuggcaacacccucauagacacacccaggaacaauauauuuuauccuucaauccaaucacgcugacacugaauauuaaccaucacaggaaugcuucuagcuuuugcccauuccauauaucggcaguggauuugucauauauggcucuuauuauuuuaagguauguuccuucaaugccuaguuuauuaagaguuuuuaacaugaagggaugcugauuuuaauugacagccuuuucugcaucuguugagauaaucaugugguucuugucuuuaguucuguuuaugugaugaaucacauuuauugauuugcauauauugaaccagccuugcgucccagggaugaagccaacuugauugugguggauaagcuuuuugaugugcuacuguauucagguugcuaguacuuuguugaggauuuuugcauugacauucaucaaggauauuggccugaaguuuuccuuuuuugugguaucaaacacugccagguuuugguaucauggugauucuggccucauagaaugaguuagggaggagucccucuuuuuuaauuuuuuggaauaguuuuaguaggaauaguuccagcucuucuuuguacaucuaguagaauucagcuaugaaucugucugguccugggcuuuuuugguugguaggcuauuuauuacugccucaauuucagaacuuguuauuggucuguuuagggauucaguuuccuccugguucaguccugggaugguguaugugucaggaauuuaucaauuucuucuagacuuucuaguuuauguggauaaagguguuuauaauauucucugaugguuuuucuuucuauggggucagcgauaccccguaucuuuuagauacaccaaucaaucagauuugguguguuuacauaaucccauauuucucagagguuuuguucauucuuuuucauucuuuuuugacuauucuugucugccugucuuauuucagaaagaccguuuucaaacucugagauccuuuccuuaacuuggucuauucuguuauuaauacuugugauugcauuaugaaauucuuguauuaugguuuucagcucuaucagguugguuacauucuucucuauacuggcuguuuuguccgucagccucugcaauguuguaucacaauuuuuagcuucuucgcauuggguuacaacaugcuccauuagcucagugaaguuuguuuuuauucauauucugaauucuacuucggucauuucagccaucucagcuuaagcgcaguucugagcccuuucuggagaggugauguggucauuuggaggaaagaggccacucuggcuuuuugaguuuucagugcucuugcacugauucuuccucaucuuuguggacuuaucuaccuuugaucuuugaaguugcugaccuuuggauggguuuuuauuuuuuaguuuguuuguuucuuuuaauagucuagucaguuuuccauagggcuacugcaguuuucuggggauccacuccagucccuagucaccuugaauuuuccaguaccuguagacaucaccaaugaaggcugcgaaacagcaaagcuggcagccugcgccuuucucugggagcuccuucccagggagauacagaccuguugccggccugaaugcacuuguaggagggggcuagagaccccaguuaggaggucucacccauuuaggaggaacaggaucagagaccugcuuaaagaagcagucuagcuaugcuuucauagagcagcugugcugugcugggauaccgcuuccaccccuggucaacuuggacucuccaaagcccggagccuggaauggcuaugucaccgaaacagcaaagauggcggccuaacucucccucugggagcucugucucaggaaguucucaaaucucugucagccugagaacaugggcaggguggcuggaggccccaguggggagcuccugcccggggaggaggaacagaucagggggccacuuuaaagaagcagccuggccacauuuugguagaacaacugugcugugcugggagaucccuuuuguuucuggucgguuuggacucuccaaaguucacagguuggaacugcagaguuauccaaacagcaaagaugguggcccuucccucccccaaggaacucugucccagguagggggcgacacuguugccagugguuggcuggaauucuaagccagugggucuuguccuuugaggcacuguggaaguggggccugcggaccaucacugcuuagcccccucgauucagccuucuuccuagggguauguacagagguccaaccuccugccuugacagagcugcagucacuauugccaggaaguguggagccuaaguauguagagcugcgccucugugcgugccugaguggcugcucugccaagaguccacacagcucugugucagaccaaaggcccugguggaguggguuuaggaggagaucuccugacucaggguugcaaagauccaugggagaagcaugguuucccagggucacacauuugaauacucaccacuucccuaggugggggagguuccccuggcuccaugucgcuccagggugggcuguugugcugucuugcuuuucuucauucuccaggggucgaguuguuuccuugauuaguaccaaugcgaguaccuggauguuucaguugaaggggcuauauuuacucgccccuuugguugcucuccaugagagccacguacccuagcuguuucuagucguccaucuuggccugaaucuaaguaacuuuaauuugggccauaaagaggcaauugaaaaauucccaaagucacuuauuuccuugacuacacaaaggaauugugguauugcuaagcuggauuuucuaauaaagaucaaaauccugauagaacaaauauuuuucaaaauauucauucaauaauuuuuaaaguaccaccucuuuuauagcauuuaaaagaguaaauaccccaaaagaguagguacuuaaaaugacagaaaaauaaaucucccauggguaccuccugccuuugacaaccuuacagacucacaagggagauuaaaaccuuugcaaguuggccaggugugguggcucacgccuguaaucccaggacuuugggaggcugaggcgagcagaucacgaggucaagagaucgagaccauucuggccaacacggugaaaccccgucucuacuaaaaauacaaaaauuagcugggcgugguggcgagugccuguagucccagcuacucggggggcugagacaggagaauugcuugaaccagggagucggagguugcagugagccaagauugcgucacugcacuccagccuggcaacagagugagacaccauugcaaaaaaaaaaaaaaaaaaaaaucuguacaaguuuuggcuagaaauuggccaaauaggaguaaaagcuaauagaaacagaauacaggcugggugcaguggcucacgccuauaauuccagcacuuugggaggccaaggugggaagaucacugaaggucaggaguucaagaccagcguggccaacauggugaaaccccaucucuacaaaaaauacaaaaauuagcugggcaugguagcgagcacuuguaaucucagcuacuugggaggcugaugccagagaaucacuugaauccgggagacagaaguugcagugaccugagaucacaccauugcacuacagccuggguaacagagcgagacugucucaaaaaaaaagaaagaaggaaacagaaugcagaaagaauaacaaggguagaaauuuagaaacaguaguagagaauggagaacacuggaacuguauuggagauacauguaagggauaagugcaagagagaauagagcagggggaaaugacugaucccaagcccgcaguugaauguugcuguuuccacccccacaaaccauucagugcugggcuuuuuaugaagacaaguccuggugcuauuacagaugauccuugguuugcagugagguuaugucccaauaagccuaucauauguugaaaauaucaucauguagaaaaugcauuuaauacaccuagacuacuaaacaucauagcuuagccuagccuacuuuaaauguguucagaacacuuacauuaaccuacaguugggcaaaaucaucuaacacaaagcuuacuuuauaauaaaguuuugaauaacuuauguaauucauugaauaaguacugaaaugaaaaacagaaugguuucauaccaugguaaagucaaaaauccuaagucaaacuacuguaagucagugacagucugugccuaaaugaauaaggcuggcuguuagagcuggucacaagagauaguggcuggugaauggauaaagcuaagacuuuagagccaguucaaccaggguuuaauucccagucgcuaauuauauggcauuaggaaaguuucuuaaucucucugggccucaguuuccaaaucucuaaaaugggaucaauaauucuuauuuuucuaacauguaguuagggucacaccuagccuggcuuucucuuucugguuuaauauucuuugcauguuguucauaaacuuugaaagacugcuuaguugagcguggaugguuuuuagagccagagacagggucagaucugaauucaaauacaaccauuacuacuuaauguauaaauuugaggaauucauuuuauuucuauuucuucaauuuuguagugaagagugaaucaacugaaaugauaaaacaguggccuucaagaucauauucccuacaauauauuuucucacagucuccuauacaacauugcaggcuaagcagauauuauugaucuuuuguuuuuugagucuuauuuuuaagagauuuauugaauaauaguaauaauuauacuaauaacuuagacuuaugugccaggcuucaaaguaaacauuuauguauauuaucuuauauaauuuucacaacaacccugaaguguagauacuuuuauaauuuccauuuuauagaugggaagccugaugcuuagaaaauuaaauaacuugcuccaggugacacagacaguaagugaugaagcugggauuugaacccagaaaaucugacuuuagaaucucauaagcacuauacuauacugucuuccaugugauucugauaacuucccuaaaggcagcugccccacucccuucccauugcugcaaagcauccagcacaguacccaggccccagcagccacuuaacaaaugugggcucuaucucugcagcccaucugccaaguguuagagcuaaggccugaugauauuuuugcuugcuggagcaaaucagaaaagaaaccucuguaaaugaaaaacuuuucuaagucccuuccuuuauaaauugaacaguaacuaauucaaauuuccagaauaauauaauuuugauauugucuugaaguuugcuguauuuugguuuggcuuguaugccauaaauauacccagucgaauuuagaugauuaggagguaugauuuuaaacauaugaaacuguccccucuuuaucuucucuacacuauuauauucucuucaugacacauaucaccaccaaccauauguuuguguguuuauuuucugcaaccccuucaguaguacaugugcuacaguagagaagggacuuaaucuguuuuauucccugcuguaucuccaguaccuaaaauaauauggaguagguacucaaaaaaauuuguuuuauggauaaaaauguuuguguaaauuaugggaaacugacauuuaaauauuauuuuucuuucuagcuuggauuagaagaacaagaaagacuccaccuacuauggagguaagacuacacaaggaggauaucauuuaggaguauauauucccaaggauauacgaagcuucagaaaaacuaugauguauuuucucaaaguguugauuuuauuccaucacagaaaauaacuuaaaacauuuuauaauaaauuaauauauaaaccuauauuauuaauaaaauaauauaugauaaaauaaaugcucauauuauggaauauaacaaaauuuguauaaauuuuaaagugaaauaauaaaaauuuaaaacaaaauuaaaacacucuguagaaagucugaacuuggagcaguuugcaccagguuauuuccccugggcccuggggguucucugugccaauacucaagcuuuuguggaaaaguuugagaaacacugaaucucuuugucuuguccaaaucaugcucuuauguuucccuuaauauuauguauuuaaauccaucaaguauccaaagaaacuuuaaaauacagaauuagcaauuauuuuauaacaguaauuauuaguugacuuuuuauuuaaaacuaaaaaauuuguagucagugauaaacaauaaaaaaacauagaaaugcuaugguauauauguuuuacaauauaauuuuuauauagauuauuuuauaaaaauuauaauuuuaauuuuaaaaauauguaaagaccucuaaaguuauuuuauaagaaguaauuucauaaaaggagagucucuaaaugcauuaguguacugccuuguuuacuuuuugucuagaggcauucccuuucuucuacuauuuaggacuucccuccucucuucuguugccuauucugucacuacuacaagcccugaugacaacauaaaugggcuccgguacucaauccccauuuguugggaaguggagugcucuagagcaggauaaugaugauaccucaacuggcaugcuuauguuuauuugcuccauacauuugucauauacugaacccauuaauguucauucggccagggucugacugaguacaucucuugacccauuucuagcuuuguauguugcuucugccuuggccuacuuuucgcagacccuucuuuccaacauugauaaaauuuggaauaaaagcuguuuuggggggaaaaaauaaaaggcaauaugauccaggauucagaaguaugcccaguaguuuacagugaaggauggauugaagagccuucugauucuccuucucuuggucauaauaagagcuacuguuaucauuugcuucauccauccucagaacuuugaaagccuuauucauagaaacauuaauaugcaaagugauuaauggaggcaauugcaauaguugggccucaggcacaacuucuguaaauuuuagguaauuucagcaccucaaacaaucucuagccagaacacaccaaguccuuccaucccugagcucacucuuguuaauuuugauuauccaaaaugagcccucuuuuguugccucccuuuaaguguacuaucaaucacauuguucuuuaugcugcuucguacccucccuaauacacacacacacacacacacacacucuuuuccuuccucuuggcccuuuccauuguguuucaggaauuucuguuucuuuguuagcaaauuaccauucaccauuaauauuuuccuggaaacuuucucuaccacagaaccucaacugaaauccgucugugccugcaagauagugaguuccuuuuuuuccuugaaguaaguugugcucgcuuucccacgccccacauaaagaaagugaguucaacugcuucuugcuuccccaaauagucuuuguuuguggacccaagagaguggaggaccuuuguaauccauguguauuucucuguaccugaccaucauuuuuauguuugccaacauccaagccagucuaccuuacugauggucgagauuagaaccuggaauauggucuucuccuuucaaugcuuucccaaauuuuagcuuuccaguucuuugacuucauccauacuaguaucccugccucaagugaacaaccacuucauuaggcacacuuuaguuuuuaucaaacacaguucuuaccacuguaacuuuuacacucuucaaauccaaauucuagauacaucauauuaagaggaaaaaauuuuucuuaauguaaaguaaaacauauauuuauaaaccguaacaaaaaaauagcuuauuuaguuauuaagcugugaaauuauaaggcaaauuccacccaggucaagaaacacaacuuugccaucuacuucagccccauauaucccauccuaaucacaaccuucucucucuugacaaaagaaaaccuuaagccaacuuuuauaguaaucauuuccucucauuuuaaauaguuuuuucaccuaaauguacauuauaguuuagacuuguccauuucguaaaaacuucguauuuguuuuaaaucuuucagucuauccucuuccauuucuuuuacuuccuuagaaauuuauguguuaaaauacccagcccaguuggccuacagaauuugccacagucuagauuuugcugaucuuauguuccuggugcacuucaucauguuccucuguccacuguuuuccuuccaaguugacaacuggauccagaaacuagauuuuuuuuccagaucuuuuagugaauacccaacuccaaauaaacuuucuuucauaucuccuauauauuauugcuaaagguuagccagcagccauuagaaugucauuuacaacaguauuagaaaacauagaauacuguggaauuuagugagcaaaacaugugcaagaucuguguacucaaaacuacaaaauguugguaagauacauuaaauaagaccuaaauaaauggggagaaguaucuguucauggauuggaauguacaauauugcuaauguauucauucuucccaaacugauccacaguaguucuuaugcuuuuauuuugcaucugcaucaccugaaagacuuguuaaaacacagauugcuggaccccaagcuuagaguuuuugauccauuaguuuugagguagggccugaauauuugcauuuauaacauguugcuggaugaugcugaugcugaugguucauagcccauauuuugugaaccacugauuuauagauuuaauaaaaugaauauccaguuaaaaccaugucagacuuuuuugauagaaaucaacaugcugauuugaaaauauauuuggaaauguaaaagaccuagaauagcugaaagcagccaugaaaaaggagaugaaaauuaaagggcuaauacugucugacuuuaagaauuacuuuaaaacuauaguuaucuagacaguaugauacuggcauuaggauacuggguaaauaaaucaauggaaaaaacaaaaguccaaaaaguagauacuguacaaccaguugguuuuuaacaaugacaucaaaacaacacaauuaggaauggaaagucuuuuuagcaaaugguucuggaauaacuuaauauccauauggggaaaaauugaucccuaccucacgucauacacaaauauuaauuuaagauggauuauagacuagacauaaaagccaaacuauugugcuucuagaagaaaaaaacaauggaauaucuuugcaauuuugagguagacaggagacagaacaaucuguaaaggaaaaauacagauuaaucagauuuaaucagaauuaaauucuaaugcucauuauaagagaacauuaggaaaucaaaagacuaggagaaaauaaucauaguacauauaucugacaaaggaauuguaucuaggcuauauaaagaacaccucaacucaguguuauaaaaaagaagcuaacaaauauugggcagaaaucuugaacaagcacucuguaagacacguuuuaaguauaugaaaauauacuuagcaacacuaguaaucaguggaaccacagugagauaccacuacacacccauuaaaauggcuuaaauuuaaaagauugacaacagccaucacuggagcacccacaacuuuuauacagugcugguuggggugaaaaugauacaaucauguuugaaaacugacaguuuguuauaaaaucaaacauacauauacccugugaucaaacaguaauucucccggccaccuugaaaacugaagggaucaauuuuuagucacacuuucugggagcucuggccaacaguaggucuaacaccuuggcauacuaugcaaggcuuccugauuugggcccagcccgacuuucuagcuuugucuccuuaggcuacccuacucuucuguacccuacucuacccuacucuucaaggaacucccugcuguuucucaaguuuaaugucuucuccuucucccaucaacuggcauacuccugcuuauguuuaauuccuuuuaaaaggcccuuuaaaauccuugguuguuuuccucaccuuuuuuucccucaacuucuuaacugauagagcuaaucacuacuuucucgguauaacuacacugcuguguacuccuguauaacucuuuaaguucaauauuaaaauucuguguuuuauuuguccauauuucuaacuauuagcuguuuggcacagggauuauaacuuauucauuugugugucauaagcaccuaacacagagccugauucauuauugguuucauuggccauuauagacuuaaaaaucucaauacuauguaauuacaugguuucugugagauggguuugaauuucuaucagccaacuacaaaauaauguuguaaaaguaaacauauuuccaaauugauuguugucuguauuuuguucauaggaauucacauuuaccugcagguuaccagugaaggcggucccuuacuuaggauaguucagcuuaggauuuuuuaacuucaugauggugaaaaagcaauaugcauucaguagaaacuauacuucugaguacccauacagccauucuguuuuucacuuucaauacaguauucaauaaauuacaugagauauuuaacacuuuauuauuaaauaggcuuuguguuaagauaauuuugcccaacuguaagcuaauguaagcguucugagcauguuuaagacagguuaggcuaagcuauaauguuugguagguuaaguguaucaaaugcauuuugacuuaagauauuuucaauuuugugauggguuuauaaggacauaaccccaucauaaguugaggagcaucugguaauaguucagcauguguucuucaguguuguauaaggugaauucacauuucacagagcuaaugagguagacuuuuccuaguccuaacucuauuccauuagaagccacuuauagcaaauacuuugaaauauugcuucuuuuuuuuauacuaacacaauaggaaaaguguaaaguuuuuuguuugaacaagugguuacauuuauugccaauuuuugacaaauuauaugguuuauuauagguuuacaggcaguagaaaaaaguuacaauauuagaguucagccuacuucauuuuuaauauacauacuccauaaaaaagaaagaggagauucuagaaacgaauagagaauggaguuggagauggugcugcuguuggagaugauacugcugcggucuaaaaaaagguugggauggcuggauaggacaacacaucauaguaucuuguuuacuugaccauauucucaaaucugggcugcaggcuccaaagacuuacuuuuguucaugucuaagguugcuuggcccuaaaggacaucacagugacuaaaugcaugugaauuugagaugguggccaauccccauguauuaauuuacaguaagaaaugaaauuggcacagaaaaaaaaaacaggagacugcuugguaaauaugacauuggaauaaggggaguuaaguaaaauaaauguuuaauugccucaggcuuaaaauuucauguugcauucaccuuacaacaaggauagucugaccccuagcaauggaaacauuuaaagagaauuggcuacaauuuucaauucuaucucuguauuagaaauagccuuacgaauuguaauagaaaaauugccaggugcugguuaagccuccuuuucccauggacaguguuuuuauggauugccagcauuugucucugugauucuauuuuuuucuuugcuucucgguucugguugacauauuuccuaugccaugacaguaguuauacucuggucagauguuacuggcccugcagcuauuuuuuuguuuuauccuuuuccuauuucugcucuggcuuaugauguguugaucuuauaguuuaacauucagagaggaaucuuauuucuggauuuuucaggcccauuucaguguugucucuaaauaacuggcauucauugaguaaguuaucugugcccaauauuacuagguucauuuuauaaguuacagaauuaaaaugucuuaaaauugccauuuuauguauagaauccuacuuccugaugacuuaaauugcaaagaguguauguauguauuuaugguuaaauggaccucccacuccucaccccaaacuucacaauaucacuuuuaguaacauaguggaaaugaauaagaaaauugcagcauguucauaccuguuaaacaucauucauuaaaaugaaugaaaaaaaaaacuuaagaaugaacuggagcuguauguuuuaacauggauaaaucucagaagcaaugauacugagcaaaaaaaaaaaaaaagcagcuacagaagaugucauacaauauaccauuuacauaaaguuugaaagcaaggaaaguauaaagggcuuucaaguaaagauagugggucaaacauguaaguucacucucaagucuaaugaaaaugauagugaaggaauuuauuuuaaaagacauaaacccacaaggucauagaaacgugaguaugcaaaccaucaauaaaguuuuggaggcaggaaagcagauggacaagagguaauggauuuagugaaacugagaagaaugaauccuaaucuggcaagggagaaaucugagaaguaauccaauuuaaaccauagaaccacagaaugcucaguaacuggcagugccagaaaacucugaaaguggaguuuaagcucgcacuaaaaacaaugaccuaguuaaaaauccguuuaagaagcaauuagaugcuaaccaauaaauauagaagaaauaacagaguuggaaaaucaccacuauucaagugauaauugggaaaaaauuaccagcagauacuaaaaucauugagucaaacucuguuggggagcaggcuguuuacauggucuaaaggcauuucccuacagauuacuuaucaauuacaaaaggggaaaagggaccuuucuaguagacaaaucugacagauaccaccuuaacuagauggucagaaguuguacuaaguagggcagauuuauauuauaugugcuucuuucuaugaugcacugaggauuaaacauuauucacauaguauucuuuuuuuaauuuuugauuuuguggguacuuaguagguguauauacuuagaagguucuugagauauuuugauacgugcauacaaugcguaauaaucacaucaagguaaaugggguauuuaucaccucaagcauuuauccuuuccuuguauuacaaacaaucuuaauuauacucuuuuaguuauuugaaauauacaauaaauuauugacuguagucacucuguuguacuaucaaauacuagauuuuauucauucuaucuaauuauauuuuugugcccauuaaccauucccacccccccuaacacccagacuacccuucccagccucugguaaucauccuucuacucucuaucuccauaaguucaacucccacaaaugagugagaacaugugaagguuaucuuucuaugccugccuuauuucacuuaaaauaaugaccuccaguucuauccauguuguugcaaauggcaggaucucauucuucuuuauggcugaauagcacuucacuguguguauauaucacauuuucuuuaucaguugaucuguugguggacauuuagguugcuuccaagucugcacuauccugaauggugcugcaguaaacaugggaguacagguaucucuucgauauucugauuuccuuuccuuuggauaaauauacacacacacacacacacacacacacacacacacacacacacacauauaugccuagcaguagaauugcuagaucauaugguaguuccauuuuuaguuuuuucaggaaccuccaaacucuucuccauggugguuguacuaauuuacauucccaccaacaguguacaaggguucccuuuucuccacauuuucaccagcauuuguuauugcccaucuuuuugauagaagccauuuuaacuggggugacgugauaucucguuguaguuuugguuugcauuucuaugaugaucagugauguuggagcacuuuuucauauaccuguuugccauuugcaugucuucuuuugggaaaugucuauccagaucuuuugcucauguuuuaaucuguucauuagauuuuuccuauugaguuguuugaguuccuuauauauucugauuauuaaucccuuaucauauggguaguuugcaaauauguucucccauucugugaguugucucuucaccuuguugauuguuacuuuugcuauacagaagcuuuuuaacuugaugugaccccauuugugcguuuuugcuuugauugccuaugcuugugggguauuucucuuuuuuuaauuaugauuacuauuauuauuauuauuauacuuuaaguuuuaugguacaugugcacaaugugcagguuaguuacauauguauacacgugccaugcuggugcgcugcacccacuaacucgucaucuagcauuagguauaucucccaaugcuaucccuccccccuccccccaccccacaacaguccccagagugugauguugcccuuccugugucuauguguucucauuguucaauucccaccuaugagugagaagaugcgguguuugguuuuuuguucuugcgauaguuuacugagaaugaugauuuccaauuucauccaugucccuacaaaggacaugaacucaucauuuuuuauggcugcauagugacaugaacucaucauuuuuuauggcugcauaguauuccaugguguauaugugccacauuuucuuaauccagucuaucauuguuggacauuuggguugguuccaagucuuugcuauugugaauagugcugcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauuguaacuggugugagaugguauuucauugugguuuugauuugcauuucucugauggccagugauggugagcauuuuuucaugaacagacacuucucaaaagaagacauuuaugcagcuuaugggguauuucucaagaaaucuuugcucaguccaguguccuagagaguuuccccaauguuuuccuuuagaaauuucauaguuugaggucuuaaagucuucgauccauuuugguuugauugcuguuuauggugagagaugggggccucauuucauucuuccacauauagauauccaguuuucccagcaccauuuauugaagagacuguccuuucccuaauauauguucuugauaccuuuguugaaauugaguucacuguagauguguggauuuguuucuggauucucuaaucuauuccauuggccugugugucuguuuauaugccaguaccauacuguuuugguuacuaucacuguauaguguaauuuaugccagguauugugauucccccaguuuuguucuuugugcucaggauagcuuuagcaauucugggucuucugugguuccauaauaauuuuagaauuuuuuuucuauuucugugaaugucauugguauuuugauaggauuugcauugaaucuguagauugcuuuggguaauauggacguuuuuaacaauauuuauucuuccaauucaugaacauauaauauccuucccuuuugccuguguccucuucauuuucuugcaucaauguuuuauagguuucauuguacagaucuuucacuucuugguuaaguuaaauccuaggcauuuaguuuuguuuguagcuauuguaaaugggauuacuucccugauuucagauuguuugcugguggcauauagaaaugcuauugauuuuguauguugauuuuguguacugcaaccuuacugaauuuguuuaucaguucuaacaguuuuuuggugaagccuuuagguuuuuccaaauacaagauuauauugccuacaaacaaggauaauuugacuucuuccuuuucaauuuggaugaccuucauuucuuucuauugucugauugcucuaacuaggacuuccaauauuauauugaauaacaauaguaaaagugggaauucuugucauguuuuagaucuuagaagaaaggcuuucacuguuucucuauucaguaugguuaggcuuuguguccccacccauaucucaucuugaauuguaauccccagguguuuaggaaaagaccuaguaggaaauaauuggauuauggggguuguuuuccccaugcuguucucaugauagugaguaaauucucaugagaucugaugguuuuauaagugguaacuuuuccugugcugacacacacccucucuugccugccaccauguaagacaucccucuuucccuuccaccauaauuguaaguuuccugaggccuccccagccgugcagaacugugagucaauuaaaccucuucuuuuaauaaauuaccuggucucaaguaugucuuuaucgcagugugaaaaauggacuaauacaaguaugacacuagcugugggucuguuguauauggcuuuuauuguguugagguauguuccuucuauacucaguguguuaaagguuuuuaucaugaaaggauguugaauuuuaucaaaugcuuuuccagcaucaauugaaugaucauagaguuuuguccauccuucuguugauaugauuugcauauguugaaccaucuuugcaucccuaggauaaauccuacuuagucaugaugaaugaucuuuuuaauauguuguugaauuugguuugcuaguauuuuguugaggauuuuugcaucaguguucaucagggauauuggccuauaguuuucuuuucuucuucuucuucuucuuuuuuuuuuuaaauguaucuuugucugcuuuugauaucagacaaagauuugguauauugaccuacuagagugaguuuggaaguauucccuccuccauuuuucggacuaguuugaggaagauuaauaugaauucuucuuaaaacguuugguaaaguucagcagggaagccauugguuccugggcuuuucuuugcugggagacuuuauuaugguuucaaucuuauucuuauugguuuguucagguuuuggauuucuuuaugguucaaucucaguagguuguaugugucuaggaauuuacccauuucuucuagguuuuccaauguauuggcuuauaguugcucauaguagccuucuuaugaucuuuugaauuucuguguuauuguaaugucuccuuuuucacgucuuauuuuuuuguauuuuggucuucugucuuuuuucuuaaucuggcuaaaaguuuguugauuauguguaucuuuuaaaaaugacuuuucuuguuguuggucuuuuguauucuucauauuguuuucuucaaauuucauuuguuucugcuuugauuuuuauuauuucuuuucuucuacuaauuuuggguuugguuuccuuuugcuuuuguaauucuuuaacuuucauugucagguuaguugaaguuuuucuacuuuuuugguguaggcucuuauagcuauaaauuuuucucuuuguacugcuuucucuguaucccauagguuuugguauguuguguuuccauuuucauuuguuucaagaaauuuuucaauuucccuuuuaaauucuucauugacccacugaucuuucaaggagcauauuaauuuccauguguuuguauaguuuccaaaauuccucuagcuauugauuucuaguuuuauuccauuguggucagagaagauacucgagauaauuucaacuguuuugaaauuuuuaagagcuguuuuguggccuaacguauagucuguccuugagaaugauccaugugcuuaacgagaagcaugugcauucugcagcuguuugaugaaauauucuguaaauaucuauuaggcccauuuggucuguagugcagauuaaguccaguguuucuuuguugauuuucugucuggauguucuuuccaguacuuaaagugggauguugaagucuccaguuauuuauuuauuauuuauuuauuuauuuaaaauggggucucacucugucacccaggcugcagugcaguggcaugaucuuggcucacugcaaccuccaccuccuaggcuuaagcgauccucccaccucagccccccaaguagcugggaccacaggugcucgccacuacacacagcuagguuuuuuuuguuuguuuuuuugucuuuuuuuuugagacagagucucacucuguugcccaggcuggagugcaggggcaugaucucaggucacuccaagcucugccuccuggguuuacaccauucuccugccucagccuccugaguagcugggacuacaggcaggugccaccacgcccggcuaauuuuuuguauuuuuaguagagacuggguuucaccguguuagccaagauggucucaaucuccugaccucaugauccgcccgccucggccucccaaagugcugggauuacaggugugagccaccgugcccagccuaguuuuuuuguauuuuuuguaguagagacagcguuucugcauguugcccaggcuggucuugaacucuugaguucaagaugugcccaccuuggccucccaaagaccugggauuacaggcgugagccauggcuccuguccuccaguuauuuuuguauuggggucugucucuuuagcucuaauaauauuugcauuauauaugugagugcuccagaguuggguggauauauauuuauaguucuuagaucuucuugcugaauugaucccuguaucauuauauaaugaccuucuuuaucccccccccuuuuuuuuuuuuugagacagagucucucucugucaccaggcuagagugcuauggugccaucucggcucacugcaaccuccaacucccugguucaagcaauucuccugccucagccucucgaguagcugggauugcaggcaugcaccaccaugcccagcuaauuuuuguauuuuuaguagagaugguguuucaccauguuggccgggauggucucgaucuucugaccucgugauccgcccacuucagccucccaaagugcugggauuacaggcaugagccacugcacccagcccuuuaucucuuuuuauaguuuuugucuuaaaaucuauuuugucugauauaaguauagcuacuccugcucuuuuuugauuuccauuugcauaaaauaucuuuuuccauccuuuuauuuucaggcuauaugagucuuuauacgugguguguuucuuguagacaacagauuguugggucuuguuuuuuaauucaucagcuaauuugucuuuuaauagagaauucaugcuauuuacauuuaauguuuuuauugauaaggacuuacucuugacauuuuguuguuucaugguuguuuuguggguuucucuuccuucuuuccuuucuuccugucucccuuuuagugaaggggauuuucuguggugguuauguuuuaguuuauucuuuuuuuuuuuuuguaucuguuguauguuuuuacauuugagguuaccauggaacuugcaaauacugucuuauaacccauuacuguaaacugccgacaacuuaacacugauugcauaaacaaacaggggaagagaaaacuaauaaaaacuguacacuuuaacauguccccucuguuucuuaaguuuuguuguuucaauuuauaucuuacucuacugucuugaaagauuauuguaguuauuauuuuugaucaguucaucuuuuagucuuucuccucaucauaugaauaguucacaaauauuacagcaaaauuggaguuuuacaauauucuauauuauucuguuuauuuacuauuacuagugaguuuguuaccuucagaugauuuguuguugcucauuaacaugcuuuucuuucugauugaagaacucccuuuuacauuuuuuguaggagaggucugguguugaaauuucuuagcuuuguuuauuuuguaaagucuuuauuucuccuucauguuugaaagcuauuuucgcuggguauucuauucuaggaugauaugguuuggcuguguccccacccaaaucucaucuugcauuguaguucccauaauccccagguguugugggagggacccagugggagguaauugcaucauaggggugguuaccucugugcugaucucaugauaguaagugaguucucacacaaucugaugguuuuauaagggguuuuccuccuuuugcuugucacuucuuccugccaucaugugaagaaggacauguuugcuuccccuuccggcaugauuguaaguuuucugaggccuccccagccaugcugaacugugagucaauuaaaucucuuuccuuuagaaauuacccauucucaggcaugucuuuauuagcaacauaagaacaacuaauacauaggauuaaaguuuuuuuuuuucccuucaguacauuaaaugugucaugccacucucuccuggcacauaagauuuccacugaaaagucugcugccaaguguauuggagcuccauuguaugguauuucuucuugcuacuuuuaggauccuuucuuuauccuuaaccuuugggaguuugauuauuaaaugucuugagguaaucuuauauuuggguuaaaucugcuugguauucuauaaccuuuuuauacuugaauauugauaucuuucuuugggcuugggaaguuccuuguuauuuuaccuuugaauaaacuuucuuccccuaucuuucuaccuccuauuugagaccagcaacucuuagauuugucuuuuugagguuauuuucuagaucauguaggcaugguuccuuguuuuuuauucuuuuuucucuugucuccucugacuguauauuuucaaauacccugucuuuaggcucacuaauucuuucuucugcuuaucauuucugcuguuaagagacucugaugcauucuucaguaugucaauugcauuuuucaacucagaauuucuguuugauucuuuuuaauuauuuuaauguccuuguuaaauuuaucugauagaauagugaauuccuccucuguguuaucuugaauuucauugagcuuccucaaaauagcuauuuugaauucucugucugaaaggucacauaucucugucucucuaggauucuuuacuggugcuuuauuuaguuccuuugaugagguuuuguuuuccuggauggucuugaugcuuguggacauucaucgggucugggcauugaagaauuugguauuuauuguaaucuucacagucuaggcuuguuugcaccuguccuucuugggaaggcuuuccaaguauuugaaagcacuugaauguuguaaucuaaguuuuuagucacugcaucuguaucugcauuaguggggacucaaagcccaguaaugcucugguucuugcagacuuguagaaguauugucuugguggucuuggauaagauuuggaagaauucucuggauuaccaggcaaaggcucuuguugucuucccuuacuuucucucaaacagucucucccuccauguuaccaccagugauguucacucaaggcccuagggcuccacagugagcaggugaugaagccgggcaggcuuguauucuuuucuucagggaggugaguuccuugguuccagguggaucuagagaugccaagcaggagccagggccuggagucuagaaccuuaggaaucuaucuguugcucuauucuacuguggcugagcuggcaccggagccagaagaggaaguucuucccacucuucucuccccuuuccacaagcuaaggaguucuccccauggccaccaccaccccaggcucauggcgaguacugccaggcuacugcugauguuuauuuaaggcccaagaggguucuuccaucaguuugugguggaugcugccaggccuaggacucucccuucagggcagugggcuuucuucuggcccagggcagguccaacauuacuuuccaagagccaaggccuagaaucaaggaccccaggagaccgcuugaugcucuaccugacuguggcugaacugcugccuaagaugauuuuugauucuuaugaaggugcuuuuuuggugugaauaguuuuucaauuugguguuccugcagugaggaugauuaauggaggcuucuauuuggaccucuugcuccccucuccucuuauaguauucuugcuaauaauucauaaccuuaaucuaaccagaaggaaaaaaaccggaaagaaacaacuggaaauccuaaauugggagacucucauuucauaaaacaccaggcuugucaugucagugacaugaaugauuaaaaaggacugauacaugacagcuaaauguaacauguuauccuagauuggagaaaaaacuuugcuguaaggaaaaguauugagguaacuggugaaguuugaagaggaaccuuauuaaauaauagcauuauaucaauuuuaaaucuccuagaaaaaaggaaaaggaugcuguuauauucccuuugugauaucguacaacgagacaacugccucuucucuauccauuucaaaacuagaaauuuacucaugggaaagagaaaauaguccagacuauguagcacugcuuuccuaauuugagagaagauauaccauucugaaaaacagaggaauuaaaugaacauguacauacugaaaaugagaccucuagaucuuuuucccuacuggguuuucaaaugaagacaaacaggccuuuaugcuccaggcagaguauuagaagauucgucuuugcggacucuuaccaaccaagaaaaaggaccugaaacccuuauuagguuauagugaaacugagcuugcaacaagcuucaccuguggcaucaaaguuuccagcuagauuuaccuaggaacacuagacaucugagaaaugaaaaacagagacccauacaaauaaauaggguaaaacacuuggauaaaacagacuacuuaaaaacuuaaaauaacugcuauccucagcgauucaagaaguuacuacagucaugaaaugagaacuuaauguuccaaaauaaaaggaauauuuaacaaaaaggaguacuuggaaaaauaaaaauauaauagaaaugaaauguuuaacugaaggguuagaaccuucuauucaauuuccuguaacauagggcagaaagaaacagaaaauagaaaagaaaaauuagaggacuaguaauacuagaagcuagaagacagagaaguaacggugcuuucaacauucugacaguucuagucuagaauucuauaccuaguuuuaugauuuaagcuugaauguaggcuaaacacauuuuagacaugcaaagucucauagaauuaucuccuacaaacccuuucucacaaagugacuaaaggaguaaacaaagaaaaagggaggggugagauccaagaaauaaaacugcagcauuggcaaaggguacuagaguaugaaaggcaaccaguccaggcagagugaauggagagauuuuuuuccccaaaaacaugaaauacauagaguaccugauacaucugaacauaccaaguggggcugaauuaucgauaaguacaugagaaauaaacaaaauucauuuauuugcggaaaaaacuugggaaggaaaaggaaaaauaaucauuuucuacuacauaacucacuuguugacaguguuuacucauaauaugugaauccacaacuauacuaggguauuagggaacacaaagaauaaggcaaacccucauuuucaaaaaugagaaguuaauauauagugccuaaaacugaaaaaauaacuaacaguuuuaaaauauuaguuagcuauuauggaguguuuaagugcagagccugcuuuguaacugucagacacuuuuaaggcuccuugguuuggccuauacuaugaccauaaacaucagcuuaaagaauauaaaguauugcuuuugagaagaggcaacuauuauuugucauaacaagccuuuuagaaugaaauggcccuacaauaaaaagauguauaauuuuuuuaagagacagggucuugcucuguugcccaagcuggagugcaguggcacugucauagcuuacugcagucuugaacuccugggcucaagaguuccucccacuucagccucccaaguagcuggggcugcaagugcacacuaccaugccuggcuaacuuuuuuugauuuuguagagaugggguuucacuauguugccuagguuuaucugcaacuguuagacucaagcgaucuucccaccucagccucccauagugcugggauuauaggcgugagccacugugcccagcccaaugcauaugauugacuuuuuuuuaaaaaaaaaagaauguuaaaaagcacauauacaaugauauggaugagcaguggcaauuuuuuucggcaggguaucagauagcaaauauuuuaggguuugugacccaaauggucucuguugaaacuacuaagcucugccauuguaguaugaaagcaguuauagaugguauguaaauaaguaaguguggcuauauccaauaaaacguuauuuacagaaacaguuggcagguggauccuaguuugucaauccugguaaugaucaaugguuuucaaauugggaugccuauaccacuggauacacaaagacuuccuaugggauauaccauuaugaauagcuuuaaaaaauuaauuuccucauucucucuuucuauauggaguccuuccuaaaaacuaucuaccugagaacucuuucuggucugccaguucuccuuucucacuucuuucaaaaucaucugucucccacuuuucagaagaaaagcuuaccccuuuuccguacuaaaucuuacuauggugucuugccuugcaguuuaaaaaucucccgggcaccacacaaggagacaauuggagagugaaucucucuugagggauaguccuuugagagcaaagcaaagaaagcaucaauaaaaauuagugaagggguaauacauuauuucaugcaggcaacaaacucauggccaggcuccgugccuuauauuauaguuucucugucuaccuagcuagcuagcuguccauuuaucuaucuuaaaauuaaaauucacaagugagaaaguugucauggggaugaauaauaacacguuuauuugaauuuuaaaauuaagucagacuuuuucugacagauaguaagucagauuuggcugguugaguuugacaaugaggacuagccuugccaauuaaguuauauuguuauauucucuguguauugaauaagcugaacugcagcuccaaggcuuugacaaagauauacuuaaagcaugcauucaguauacaauaagcuagaaaaugcauccuuugucauuacuuaagugucaacugaaaugugcaagauggugcauaguuuuucaaaagucuuugaagauaaaaugugcaaaaaacgaagaaaaaacacugcuacuauuauuuauggauauauagagauauuguaaaaguaugaaaacauucaugaaaaugauagaugagaaaccggguaguuauuaucucuggggaaggaaaauguuaggguucacagucauggagagcuuuggucaugucuguaguguuuuauuucuuaaguuggaugguggguuauagguguauguuauuaguuauguuuauuuuuaacacaugaaauacuuuauuuuaaaagaauauaccgaaaccuuauaauuacauauuuuaaaagaacauauugggucccugauagaaaaacaaguuacucaggauaaacugaaaaaugggauacuugaaauuugaaaauaccaaaagcacuugaggaauugucacaguaaugugcauacagaacgaaucaguauaguuuaguucuugaaaguccuuuuaaaagccuuaaggcuuauauauuugcauuacuaauucaaauacuuaucaucaggcaucugguauaugcucaagagcuaacaauuucuuugcauguagacuucuuuuguacauaccaaccugcccuggacacuacacuagacauaacaguuaauauaugucuauaauuuagauucuguuuuuaguauuuuuuuucuauaugaaaauugcucugauacuuuacauuuucagggaaaauacauucauauauuguuuucagaaauuugaucuuauugcaaauuuacacagaagcauguuuucaacaauaaaguuauucugggauuucuggcuuccaaagcuggaaaggauauauccugagcuuggucaacaucccauuuuuuuauuuaccuacuagcauuucuaccuccccaaaggaaaagaugugguugaauggguuaaccaccauccacaauggaaggucccuguugggcaguuuuaugccagucauuugaccuaccucaggccuaaccauuuguuccugccuuugaucaggcaaagagguaggguugucugcacucagaggugccugaggcucugcaaugcacaucugcaaguguaacuguugagcacuuuugggacucucuggcuuagccaauacuaugaucuuacuugauuuauuuuccuuuauuuuauuaaaaauuuaauauaacaguacauuuaaaaauuuuuuuaaauagaaguaauagauuaccugaaauccuaugucuggcugcuaccugaaauccuaugucuggcugcacaacucuuaauuuuagcaaguuaauuugccuaugcauacauugguacauaauuguaauuuuugaaaacuuacucuuuuguauucugcuguuuuuacuuaacuaccguaauaaauaaagaaaaacaagcacuugaaacauaguaacaaaacacauggagaccgcuuuucucuauguaccuucuuugauaaugaccucuaccucugugaaaacuaagagaauauaaaauuuaucauacuucuuuagauaaaugugguaggcagugaucaugaaucauuugaauguuuugagcuccucagaaucuguacucuuaccugguaagcuauucugccucucaaacuguagauguuuauuuauuaauuguacaagaaauguuuaugcuaguuuguguuauaaaucuuuuugguuuugaaaacauuuauuuuaggcaggucuuccuaagaaguaguaucuccaguuucaaggaucccaccuuucucagucuaaaaggacgguuucuuacauacuucuauacaaagcugaggucugaguuuaagcuuauucuuagcauaauuuucccucuauuuugaccuuuaucugacuuuuaaggggcaaaauauaaaagguuuuuaaaauaaguugaauauaaauaaggugcuauuaugaauuauuuuuagauauacuccugcucacguucuuuuaagagucaucaaaacuuacuaggugcauauuaaaaguauacagaauuaguucugaagaguuaaccuucugagucaucauuagucacuaagacaagucucauuuaaguuuuaaaacuggguuuagauccagagugaaaagggguuaaaggaguuaaaaugagguuagguguuuuuugguuuauuuuuuuuauccauacauuuuuucucaguugucucaccaaaacaauuuauguuuuuccucuuauucucuccaugcugaagaaguaaugauuuucucaaucuaaauuuuaaauaaauuacuugcugaucacuuuuaucagauaaauuugacauuuuuuuaaugggcggaauaaugguguuuaagagaauuguauugaucacauuggugauaaccccuauaggauacuaagcaacaguugauugccucugaucuuauaucuuuaggcaugccugauuuuauucucaaauauuuaucaugauggugauaaaauacuaugcccauauguuaguccuauagucauaaagaauuaggcauuuuauauauuuuucuuauauacacauguucauuauauuucauguguucaaauguacucaauuuccuucucaaauuuauauucuggugucaccaugauacauuuauuuaccaguauucuaaaacaucaguaaauagauguaucuagagcagaguuuuugaaucuguguaauacauuuggggcugggaaaucaaauugauggguuacagcuuguuuuucuuuuuaaugagcuagaaaaacauggaauagaaaguaucaguguacaaaggcuuacugggaguacuuauugcuuucugaaacucuuguuguagauacacuugcacauauguuuuguuugugaaguuguggugucaaauguauuucuuacuguauagguuaauuuugugucaacuuggcuagacugugguacccagauauuuggugaaauacuagccuagauuuugugucaaaguauuuuuuuaagugagauuaauauuuaaaucaguauacuuugagugaagcagcuuacccucuauuaaauuaguaggccucauccaaucaguugaggacuuuaagggaaaaaaacauucccucuaggaggagggaauucugccugaagacugguuucuuuucuuuucuuuccuuuucuuuucuuuuuuuuuucuuuuuuuuuuugacagucuugcucuguuaccaaggcuggaauacaguggcaugaucucagcucacugcaaccucugccucccagguucaagcaauucccgugccucagccucccaaaaagcugggauuacaggcaugugccaccacacccagcuaauuuuuguauuuuaguagagaugagguuuuaccauauuggccaggcuggucucaaacuccuggccucaagcaaucuacccaccuuggccucaccaaaguguugggauuacaggcaugagccacugcgcccggccugaagacugcuuucugauuucaacucuuuccugggucuccagccugccagccuacccugcaaauuugagcuuggacuugccuuucuccauaaucaugagagccaauuccuuacagucacucucuguuucucuggaaaaccuugacuaaugcacucacuaaaggucauacucuuaaaaaguuugaaaacuuacuaaucuugagagucauuuuuuaaucuaaugaacugguauauaaaguguuuagccagugcauaacaaaauaugauaggugcuguuauuuuacuaucauuuguaccuguuauuuaaagucaacaagaauccugauuugaugugaauuuauacagaaauaauucugaacucuacacucauuuaacuaucuuuugaaaaagauuaauuuguguuuaugaauacuucugugguauuuugaagguuugcuuugcagaaauuauugugaaauuuucuucuauguuuuugucuccccauuuguauggccuaagagccaccucuguuuucucaucauaauauucaggacaauuuaauauauuugaauuuuuuaaacuacuuucuucuguaguccaagaugauuguaaauucucaauuucaguggaaaaagagacaagcauauaaaaguccuguggcagacaccucuugugcccuaccucacauccuuuuguauuuuuacuccagccuugcugcagcaaccagcugcuaacagguguaaccucauuacagcucuacagaauauauuuugcuuucuucucugacacuguggcaugggaugucuguggggaaucaacuuggaagugugagaggguuaacauaccagauaaaccuugauaccugguaucaaggggauagaagcuaauggauaaaaguuccuuuccuguccauugagcacauaguccagguauauucaacaugacuucucagaaguucucagcagggauugggucccagcacccagagcagugaccaacuccagaacacaccuuuuauuuuggcuuucccuccuucccuguuucauauucuccaguaucuugcuccccuucccuggauuacuuguucaacauaagccauaaaaaauucagaacuguugucucuaacagauaugaacucaaaauguaaauaguaccaaguacagucaugugucacuugaugacagguaggucauuucgucgucgugcaaauaucagaguguacuuagggaaaacuagauaguauagccuacuacacacccugucuauauaguauagcccauuacuccuaggcuauaaaccuguacagcaugcuauuguacugaacuguauguaggcaacuguaacacaaugguaaauauuuguguuucuaaguauaucuaaacagaaaaggcacagugggaccaccgucuuauaugcuauucauuguuaacugaaaugucauugcauagcacguaacuguaauuaaauccaacuuacuuuguaaccguagugcacguugauccuacuggcauaaaacugagaaaugaaagacuuguaaauuuacauguacuuguaaaauguaaguacauuaucgcuuauugauaaaugcugcuagcaaauuaacuccuggagaccuucuuuucaaacaaguuuauuacaauuagcaaugaagguguaaaugugaaucuaauuagucauuuggcuuagccuguuuccaggcugaugucuucuuuauguguuuaaccuuuauaaacauauuguaugagaaugaauuuuaaaaagaagaaaauuaugaaauaugccauaugaucugacccuguuauuuuagguauuuuuuaaauaaagggacucuuuguauguagaaaaaagacuggaaggaaacauaaauacaaaauuauaauaauuauuuggguggugaguugauuuuuauuuuguuguuuaugcguuuuuguauuuuaugaauuugcuacauaaagggaacauuuuucuuuaaucagaacaauauuuaaguuuuaaaaaggaaauuaagaaugcuagcugaauaguuucuuuuucucaguaacugacugacagauggugcaaaggacaugacaaagaagaggcccaucauaauaacuaccucauuucaauucagcaaauauuuauaaagugcuguugugcucuuuuuaucagauaauuaaugcuuuuugucuuuaacaugauuguuuauauaaauucauuuuuacucuuuacuuuuuuccauuauucuuuauauacuuaauuucuauaccuacuucuuugaauggguauuguuucuaguuucuaaagauuuuuauucaaaugucagauuauggaaagauuucuauuuuggacauauuacucucaugaugguucucaaauuuuauuuuuauuauaacuuauaaaucuuucaucuuaaaauuucucuuaguuacuaauauuucucaucuuugaucuagacugucuaguccuguguuuuccaguaaaauaucuacuguauuguacauguagcuauuacaauuuauuuaaaauuaaaauuaaaaauuuaguuucuuggucacccuaccacauugaaauguucaguagcgauguagcuaguggcuaccauauugcacaguacaaauuagaacauuuccauucaucacuguguucaauuggauaguauuccuuuagccucacaguacuuuuuaauucuaaacuuucuuuucauuguacauuaguucguuuucacauugcuauaaagaacuacugagacuggguaauuuauaaagaaaagagguuuaauggacgcacaguuccccauagcuggggaggccucaggaaacuuaacaaucaugacagaaggcaaaggggaaauaaggcacaucuuagaugguagcaggagagagagcaaggagggaaguacuauacuuuuaaaccaccagauuuugugagaacucacucacaaucaugagaacagcauggggaaauccauccccaugauccaaucaccuccuaccagaucccuccccugacaccugaggauuacaauugaacaucagauuugcauggguacacagugccacacacugugucacauuguuucuguauuucuuuuuucuacauucccuuucauacuguauucaauuuuuuaauggaaaauguuaauuucuacucaaauaauuguuaccauuuccucuccuaaauucuuggaugcuuuguaguuuccaucacugaauauugucagcucuuuucuuaugcacuguauuuuuuuuuaucauggcaaagaaauugaaauugugguucuaauagcaucucuagaagaauacaguggcaggcucuggaagggagaaguagguagcugggcauguguaagggggaguguuacuuuuuaucucaaaaucuuuugcaucauucacauuucaugccaugugccuauaguucuuauuuuaaaaagaauaauuuuuucaaguccaucgaauucaagguccacaucaauaacuuggccuuaauguuuagguggucccacaaauaaauuuaaaauagaauaaaaucuacauuuaaaacuguguauugacaaggcagaugguuuaaagaaauagagauucccacaucuucagaucaaaguaauuaaauucauuccccaaaaugaaagguaagccuguugccaguuggauauuaaguaugacaguguuauauauuuaaaauuuagaaaugacugcuuuuauuuguuauaggccaagucuuuugauuuugauuaccuaaauaaucuuggauaacuuuaaagccuggcuaccauaguaauaaauaaccuacacaauauaaaacaguaauacagcucaauguauucugcacuaagugugccccaaguccuaugcauccaaucauauuguuagcauagaaauucaauuauacagaaagagaaauaauacaguaguaccaaaggaaagauccauuucugagggaagguguggaaagaucuucugcuuaaaauaagugucauaaaucuagguauuugcuuaacuugauuucuuuuuuauuuaaaaaaauauguuuuucuuucauucguuuucaaaguaugaaaaacauuuggguuaaaaauugauugcuuuucaucuuuaauguaugaaguucuugcuauguaguaauaaaauuaaauguuuucugauuugcacaacuggauauaaggugaaauguugaaaggaaaauaaaguuuuugugacagguccugucuucaaacuguuucuagcuuuucuauaauuaucuguuuugacaaugucucuucuuaaaacaagaaaaagguuuauuuuagugaggauuaauaagcauaaguuuucaguaauugucuccuucacaaagucaaacuaauuguaugacggauuagcaccaaguuacauggcaguuuaucauaaaaacauuucauuauguauguguucguugaaaauaaucucacuaauaagauuuucuguagaaugauuuccacacuuuaauuaccaaauugauguuguuaucaguaaauuuacaucacauugugauuuaaauguaauaauuuuuaaaagucaguacguauuuucacaccagaauaauacuugcuaacaaaauuuauuugcguauuggcaaaauacuuacauguaauaaguccagugacauauucagggaagauuaauacauuccauggauucaccuaagaaaacaucacaguugccucugaauuuaagaaggaaaagcacuacugaagcagauagagacacaaaaaaacccuucaaaaaaaucaaugaauccaggagcugguuuuuugaaaagaucaacaaaauugacagaccacuagcaagacuaaugaagaaaagagagaagaaucaaauaaacacaauaaaaaauaauaaaggggauaucaccaccgaucccacagaaauacaaacuaccaucagagaauacuauaaacaccucuacgcaaauaaacuagaaaaucuagaagaaauggauaaaugccucaacacauacacccucccaagacuaaaccaggaagaaguugaaucucugaauagaccaauaacaggcucugaaauugaggcaauaauuaauagcuuaccgaccaaaaacaguccaggaccagacagauucacagccgaauucuaccagagguacaagaaggagcugguaccauuccuucugaaacuauuccaaucaauagaaaaagaaggaauccucccuaacucauuuuaugaggccagcaucauccugauaccaaagccggacagagacaaaacaaaaaaagacaauuuuacaccaauaucccugaugaacauugaugcaaaaauccucaauaaaauacuggcaaacugaaucaagcagcacaucaaaaagcuuauccaccaugaucaagugggcuucaucccugggaugcaaggcugguucaacauaaaucaauacacauaauccagcauacaaacagaaccaaugacaaaacccacaugauuaucucaauagaugcagaaaaggccuucaacaaaauucaacaaauuuugaauuagguauucaauaaauaccucucaauacauuagguauugaugggacguaucucaaaauaauaagagcuauuuaugacaaacccacagccaauaucauacugaaugggcaaaaacuggaagcauucccuuugaaaacuggcacaagacagggaugccuucucucaccacuccuauucaacauaguguuggaaguucuggccagggcaaucagacaggagaaagaaauaaaggguauucaguuaggaaaagaggaagucaaauugucccuguuugcagaugacaugauuguauaucuagaaaaccccauugucucagcccaaaaucuccuuaagcugauaagcagcuucaucagcaaagucucaggauauaaaaucaaugugcgaaaaucacaagcauucuuauacaccaauaacagacaaacagagggccaaaucaugagugaacucccauucgcaauugcuucaaagagaauaaaauagcuaggaauccaacuuacaagggaugugaaggaccucuucaaggagaacuacaaaccacugcucaaugaaauaaaagaagacacaaacaaauggaagaacauuccaugcuuauggauaggaagaaucaauaucaugaaaauggccauacugcccaagguaauuuauagauucaaugccauccccaucaagcuaccaaugacuuucuucacagaauuggaaaaaaacuacuuuaaaguucauauggaaccaaaaaagagcccacauuaugaagucaauccuaagcuaaaagaacaaagcuggaggcaucacgcuaccugacuucaaacuauacuacaaggcuacaguaaccaaaacagcaugguacugguaccaaaacagagauauagaccaacggaacagaacagagcccucagaaauaauaccacacaucuacaacuaucugaucuuugaugaaccugacaaaaacaagaaauggggaaagguuucccuauuuaacaaauggugcugggaaaacuggcuagccauauguagagagcugaaacuggauuccuuccuuacaccuuauacaaaaauuaauucaagauggauuaaagacuuaaauguuagaccuaaaaccacaaaaacccuacaagaaaaccuaggcaauaccauucaggacauaggcaugggcaaggaccucaugucuaaaacacaaaaagcaauggcaacaaaagccaaaauugacaaaugggaucuaauuaaacuaaagagcuucugcacagcaaaagaaacuaccaucagagugaacaggcaaccuacagaaugggagaaaacuuuugcaaucuacucaacugacaaagggcuaguauccagaauguacaaagaacucaaacaaauuuacaagaaaaaaacaaccccaucaaaaagugggcaaaguauaugaacagacacuucucaaaagaagacauuuaugcagccaacagacacaugaaaaagugcucaucaucacuggccaucagagaaaugcaaaucaaaaccacagugagauauuaucacaccaguuagaauggcgaucauuaaaaagucaggaaacaacaggcgcuggagaggauguggagaaauagaacaguuuuacacuguuggugggacuguaaacuaguucaaccauuguggaagacaguguggggauuccucagggaucuagaacuagaaauaccauuugacccagccaucccauuacugguauauacccaaagaauuauaaaucaugcuacuauaaagacacauggacauguauguuuauugcagcacuauucacaauaacaaagacuuggaaccaacccaaauguccaacaaugauagacuggauuaagaaaauguggcacauauacaccauggaauacuaugcagccauaaaauaugaugaguucauguccuuuuuagggacauggaugaaacuggaagccaucauucucagcaaacuauugcaaggacaaaaaaccaaacaccacauguucucacucauaggugggaauugaacaaugagaacacuuggacacaggaaggggaacaucacacaauggggccuguugugggguagggggaggggggagggauagcauuaggagauauaccuaauguaaaugauggguuaaugggugcagcacaccagcauggcacauguauacauauguaacaaaccugcacguuguacacauguacccuagaacuuaaaguauaauaaaaaaggaaaaguacuuauaaguaaaaaauaauaguagaaaauaaaugcuauuaucauacacuaugcaaauaaaacccagcuuuuuguucaaccuaggcauguuaaaaagacuuucuaauucuaauauuacaaguauccuugagaaaauuuuccagauaagagcuguucuaauuccugccacacuuaaaagauaacuuaguauaaaagaaaagaaacauucucaagaauuauucuagaaaacauucaucuaaucugaauaccacgaagcuuuuuauugccagaaugcaaaggaaccaaccuugaugucuuuuaaaaaaaugguuuuaccuagcaaaugguaagacaaacuuuuaguuuguaucuuuaacugguacuuuucaaggaauugacuaucacuguugcugaaacuuguacuuaaauauguaacacaaauaucacuuuccuugaaaugaguuaugaauugccaucccagaggauaucaguagaacccaggguacaaguucccaacuuuuggggugcucuggcaucacaagacucuuccuaaauuuguuguauggcauguaauucauuuugaaaagggaacaguagauuuugaaaccaucaaaauucuugagaaacaggauuuggaugcacucuugguuaucaugaaagcaacauuacagguuauugaaccggaagaauuuccccagagaucuuauauaacuugccugacucacuugccauauugcaguguucagucaagcccaguccaagauuuucugacaagucugguucagcaaugccugacuugauguguuuuuucggagaaggagucaaugagauuuaccuucccucccucuaaauuacuucuuauagugaaggguuuguuugauucccuuaauauucauuugaucucugagaaggaacauuguuccagggaaaacuagcaguaggccccaaaaaggaagacucuaaaauuuauucaacaaauaacuuauaaaugccuauucuguguuagauguuggagauauagaggagaaucugcagauggccaagggaguuuaugcuccagugagaaagacagacacauaacaauacgaaacaguaccagaaaugggacauuacaaaugugaaaacagguucaaccuucuuuaggcugaaaacugaaggauaaaaaaggaauacacgagagaguagcaugacacuaaagccagauacuaugaugaaaagauugacaaauuugacaacauaagaaguuucuacuuuuugauaguuaaaauccuagacaaaguuaagccaaagacugaggggaaaaguuuuaaaauacagaauaaagacuucucuuuuuuguauugacaaaguuguggggaaacagguauucucauucaccauagauacagguguaaguugauguuaacuuuuuuuucuuuuuuuuuuuuuugaggcagggucucacuuucuuucccaggcuggagugcaguggaaagaucauagcuaacaguaaccucaaacuccuaggcucaagcaauucauccucuucagccuggcacaggccaccacgcccagcuaauuguguuguuuuuuugggggguuuuuugguuuguuuuuuauguuuguuguagagacagggucucacuuuguugcccaaaauggauguuaacucuuuagagagcaauuuuccaaauauaugagaaacuuuuaaugcagcaauuccaguucugagaagguauccuaaagaaugaauggcaaauguauacaaauuuuauacaagaauguuguuuguaguauuguaaaauaugaaccauucuaaacauucaucuauaggggauugaacgaauaaauuacaauggaauacuaacuaguaugcagccauuaugaaggauaauguacaccuauauauauugacacaaaaaagaugucugaaaaauauugagugaaaagcaguuuauggaauaguauucguaguauauauuuuaucuauaauuauaaacauguaaaugggauacacuauauuuauauuauaaacacauguauaugcagggggaagucuauaaugauuagacuuuuuaacaguggauaugaaauuaugagauauuuucuauuuuguagauuucuguuguuuacauuucuguauuuuuuucaagauguauuacuuuugcagcuaaaagaacagugauuuccauuuuaagaaagagaaaagaacauucugaaggagcuuuuaaaaguucugcuuuuccccuuggcaaauauguacucccacacuauuucaaguuucuuguuucuuugcuaaaccaaaauggcaagcggauuaaaugagaaguauauggcaacacagccagucaccuauuuacuuacauucacuagcugugugauuugucuauuuauaguuuguuucuuccuacuagaaucuaagcuucaugaaagcaggacuguguuuuggucccugccaucucucgaggauuuagaacaguaccuggcucagaguucaugcucaauaauauugagugauuguguacaugaauaagugaaagaaagagggcuucagccuaggucuuuugguggguuccuucuuuacccuugauucuccgucuccuuuguucuuauuucccagugaucuuuuugcuucccucccccaccuccuuugagaauucucaccucaauuuguuucuucauauugcugucuccaucacugcuggaacaucgcugagccucucuuuuucuccugacaccaaacuuaaaggaagccugucuccugggcuaccacugauacccacuuguacuuacaccugauggcccaacccuuagaauucacucuacaacccuaauuaguagucuagccuuuucaguuucucuuagcagaagagauguuagugugguuccucccuuuuaccuuuccuuccuucccauaauguuauuucaacugguuucaucagcugcugcucugcuugggaauucuacucccuucucaguauaguuguuucgaguaguaacugcuuguuagugcuauucacauugccugaaguggauuuuauuguuauugcugcuguaguguuugugguuuaucugacugcuguacuucuaguuggccacaaggucacauuuuccaaauuccugcuacuguaucacuuuauauccuagguuauccucuuaaucccaccuucuccaaucccauaauaagaagggaaaagcuugcacugucuucauaaugguggcgggggugggggcaauagaguccugagauccauuuuaaguaaggggcacuugccuaucugccuucccacaguauccuugccucuuuugagaaacaacaccaguaguccuucugagauguaagcaaccucuuuccaaguuuuggucagucacaggcacuauggaugauguauuguaacccaucauauuuguauuuguuauuguaguugugcuacgcuguggguaaauuccuuaauguguacuagacagggaauauaaccaccauuauagcacuauuucuuuggggaaaaaaaaguguuuuggguccaaaauaguugguugacuuuaacuuucuuaccuuaagcuauuccuaaguuaggaaguccuuauaugaguggugauauauuuuaagccacauacuuggugauugauagguggcagguacacaaagaaaaauagagaaauauuuuuucuuacuuaauuuucaaaaguaguaaaccgagucauuuuaccacauugauguuuuuaaacuaguauaaauuuccaagaauauaaauaaguuuguaucuaucuuuucucaauuuucagcguuacaaagggaagggguauaagcaauuuaaaaaaaggacuuccuuuauuaaugauggaauaugauauauucuugauuagcuauuuaaguuuacauuuggauuuauaauacaacugcacuauacaaagucagauuaucagucaacagugauugcccucucagauggucuacuaaaaaggaaaccaauuaacagugaguaaacacagacagagccacauucauucauuucgcaaauauguguuaagcaccgauuaugugcuagacauuguuguaggcccugaauugugggagacagaaaggcauaaagggcaggcaaaaaccuauuuucauacagccagcauaauacauacacuuuuacccucugcccuagcaaucuaaguucuaguagaaaucuacuaaaaauuaucuggugaaaauacguaauuuggcauaauuuauagggcuauuuguaauaguaguaguaaauacgucauaguaaaagagcagaaacaacccaaauaucuauuaguaagccaugauauagcuacacaauggaguccuaugaggcuaaaaaggagugaugaaaauauccuucuauagaauguucgugauauauugucaaguaaaaaaaguaagaugaaaaacaguugauaguaccuuuuauguaaggguggagaaagagaugcacauguauuugcuuauuuuauaaagaaaaaaugggaggauaaacagaaaauuaauaaaaaugacagguagagggagggaacagaguagaagagcaaggauggaagcuagacuucuuuuauuauaucugguauaauuuugccuuuggaacuauauagauguuuuacacaauuucaaaauacauuaaucccgccaggcgcgguggcucacgccuguaaucccagcacuuugggaugccaaggcggacgggucacgaggucaggagaucgagaccauccuggcuaacacagugaaaccccaucucuacuaaaaauacaaaaaaauuagccggacgugguggcacgugccuguagucccagcuacuugggaggcugaggcaggagaauggcaugaacccaggaggcagagcuugcagugagcugagaucgugccacugcacuccagccugggugacagagugagacucugucucaaaaaacaaaaacaaaaauuaaaagaaauuaauuccccccccaaaauuuuuuugaaucccugaaacaaauaaacguguuuaucaaguagauagcagaaucacacaggaaaaaaugauuucacaugacuuuaagacauuguacaucagugaguguauucauuauuuauccuuuuuuaaaauuuuaaaaaauguuugucuuacucuucuuacuaucauucccaauucagugaguauauuccaaggacaaaaagaaaggaauacaaagaaauccucaacuauauuuaauaauuuucuuagcaguaauauuggcauuuuuauuuuacacacauauuuaaaauaaauauauuaauauucucaggaaccaaagcuuauagcauaaaagaaauuaaauaaaaaccuacaauauuaaauuugaauuggaaaugucauuaugaacuaaugacauauuuuuucugaaaaaaaaaaaagcauauuuccuacuucgguccacuggaaagaccuaacagcaaugacaguccaguagcaauuaacaucucaucucagacuaugaacuuuuuaccauuuucuauucuaaggagccagggcuccuuagagaaauagcugaugucaagucucgggcaggaaauguacaaggagagucuaggacaucuuuuuacaccagagagcaaagaaaccaagaagauuaugucaaaaggauauaggagccaacuggaaggggcucccacuggccaaagaugggucaaguuugagcaucaaaaauagaaauacuaaccaaaacaauugauugaaacauucaaauauauaaauaugaguucauuauauuaaaacauauuaauuggucaugugugaucucuggaccagaagcaucagaaucaccuaguaacuuguuagaugugcacaucaggggcccuauccucaguuauugaaucacaagguagagcccaucaaucuguguuuuaauaaguuuccaggugauucuaaagcauaccgaaguuugagaaccacugcucuggauauaauugccaguuuacaugaaauacaaggguaaagaaacauguuagaugauaccaccaaggcuguaauuagccagaaucacgugggcaaggcuacagaauuaaugaccuuuacuaauaaaucaguaggauugggguggauuguguauuuuuagcugcuggccuucucaaacuaaguggauauaggagcuugagggucucaccauuuggaaugcagauuuuuacuuagccaucuuccacuauccccauuuacaguguggcacuucaaccuagcccucuucuuggucccuacaucuaagccugucuuuauauauauauauauauauauauauauauauauauaucuaggguggauugcuuuuuuucucaccaguaucccuguuugcaaacauuuaggauuguuccuuuucuacucugcugaauuauuuguuguucuauuuauuuccaucuuuuuauguugucauuugcuauuuuagaugacacucuguuuaucaaaaaagggcuuugaguuuuucuaaucuugguaucucuuuuauuuaagggguagguuuucaaaaggaguaggggaaauuuugggacucuugaacuggaaagucuguuucccaauuugauuugaccauacaacuuuuuggcaugucaagcaccuuuuaauuuccuggaaagcuagugugaucuauggaagacuuauuugggaaguguuuccucucucuccaguacagucugcaucugccuccauaaccuccuucaaacuucucucucaaggucaccaaauaccucuuuaaugcuaaguccguugaauaugucucaauucuaaccccaccugcauuucauagaguuaacugccucccgucuugaauuuccuuccccuuguggcuucuuuacuuaauuuuguguucccuucaaaccaggaucugagacaaggauuuggauacaaguaacuuauuugcaaggccacuucuaaaagcauuagaguugaacaguaagaaagggaaaaaaagaaagucacuaaaaggugccuuaauaagcugguuaaaugcugugggcaaacgagcucaguuuugccagcagcccucugagagacugcggaacacaucacagaguuguuccauugaagagcaaggaagcugggguauuuauccaccaauuucucacuaaggcucacuccuggggaguguuaauaacucccugguauuuucauccugcccauuauauaaggugaauaugguccucagaccaagaacugcagaaguuugaaguaagaaacaagcuucaucuaaauaagcuauuuagaaagcuacagaguaagcugagagaauauggaugaggcaucaauauuuacuacuuuuaccaaugccguuuuuauuauccccucacuuucuagaccauucuuucucaacauguuguugguuccuguuuuucccuuaccucuuaaauuuuggugguccacaugaaguaucuguucuugaccuuuggcucuucuucucuacuauuucucuggacaaucucauccuugucuuggcuucagccacuacauauacuuccagauuuccagcacuggccucucucuugagcuagacccauggagucauuuauucauucaacaaauuauuuuucaacacuuacauaauaugcuaaacuugaugccuggaauguuaacagugaacuauacauauuccuggcccuuggaguuuauauucuagucaagccauauaaacaaauacauaaauaauaaggauuaugagauaugauaagugcuacaaaguaaacuggguguuguucuuaugucugguuggaaagaucacuuuacauagauuagccagggaaguucucuuuaaguuauuggucuucccugaaguaugagauuuagcuagccaugugaagaacugaaagaaaaagacuuuccagcagagagcuaaaagaggccaagugaaauacaguguguuuaaagaacaaagaagcuagugagguugaaguauaauaaccaaagcagaaaaugacaugaaaugagauuggagaggucggcagcaauugggucauuuggagccuuguuguguucuucagaagcagacauugagauaaaagguauuuauuaggcauccuuaugaaaggaagaggaagaaaauaggaauggacagaggacaaagucgaaaugugauguaggcccaacaaagcuucagccaauuuaguaggaagcucuggagcaaguauugcccaucagagucuuuguacaucugguugaaauagcugggccuuuauggcccugccugccugccuuauucaguuacuggaugugggcugcucuggaaaaccauuagaaagguggcuacaagcuguggcacaugcuaaaauuguugacagcugcagacugucugcucacagcauucacugcagcugggaagcaaguccuuccuugaagaagggcuuauccaaauaucuccauauuugccacaggcaaguuuggauuuuguugcaaggacccauuuaaaggguuguuagugagaaguggcaugaaaggucacucugauuucuauguggacauuagaucauagaggaccaaggagacuuauuaggaguccaagcaagaaaugcuauuggccauagagauaaagagaaaugcacaauucaagauaaauuuugaaggaagaauugauaaaauuuagugcuagguaaauguaggagguaaagaaaaauaggaaucauuuaaguaaauguauacaguugcguaagggaaggugauuuagcugcugcuggcuaaagugcuucuucccaccaugaggacaucccaguaacagccuccucccccccagaucgugcccacuggugugcauuugauaugucacagagacuacuuugagaguauaguaauuaacuuuuaggacuuccgguuagcuggaaggcuccucucuauguucaugaaguaggguguugccuuggagcuugcuuuuaucuuagcaugugaggaaagggagaccaggcccuauugaaacaaggcaaaccuucuaggggucagggaaacacuguagucaggcagcaggauaccuguaugcaaagccauguguguggcuugcugagaacugugcaaagaguaauaaguaguagaaggaaaauaugguggaggcagaaacuuguuucaaguguagucuaauuguauggccuuaaguuagcccucugagccuaaggcaucuuuggacauauuuaauuuaacauguuuguuagacauccaccuccacccagauaguuggcuauauuauucuggagcuuggggagcagucaggcuugaaaugaauuugagcuucuucagcauauguagacaauauuuaaacuugggauaagaaaugauuacuuugagagagaauacagauacuccuuaacuuaccaugagguuauaucccgauaaacccauuguuaaaucaaaaauacauuuaauacaccuaacuuaccaaauucauagcuuagccuagucgaccuuaaaccugcucaggacacuuacauuagccugcaguugggcaaaaucaucuaguaacacaguacacuguagaguguggauugucuacccuugugaucaaagugaugacugggagcugcugcucaaugccaccaccuagcaugaugagaagguauuguauggcauaucacuagccugggaagagaucagaauucagaauuugaaaauacaguuucaacugaaggcaugucgcuuuugcacugucauaaguugaaucauuguaagucagggaccgucuguauaguaaaaaagagggcuagaauugaguccuugaagcauuucaguguucugaaguuuggccaagaaggagcuaacaguuugauaaaaagauauuuggauauuuuacagacaacuuaaauuugguauguuuaaagcagaacucuuuuucuguuuccuaccaugguuaauggcauuaucuguugauagcgacaggaggcagccaaaugccuaggcuaauaggggcgggucccuggugaaaccccaccuucaagccaaaaacagccuggaggcugaaagaccaggcugcuggucccagaugaaaccugcaacccagagugagaacuuauguuccuguuugccugcccuuuccugauuaauuuuuuuugaauaaugccuuuuaacaauugaauguugccuuuuccaauacucccuacagccugucccuuucccauucugagcccauaaaaggcuccugacucagccauauuagggguacuuucccacuuucggauagggggaccaccccuacauccccucuccacugaaagcuguuucaucacucaggaaaacucccugccuuguacacucuucgaauguuagcacauccucauucuucuuaggugcaggacaagaacucaggaaccaguguguaagccagacuuggcccaagugggccgaguaggugggcugucuccugcagcagguagcguggucaagcaaggccugggcagggcaucgccagccagaguuccucagcuugcaaagugucacugucaucacugauuagaaacagggauuguccucaucuccuucaccucuacauauuggugacuaagaccuuuuuccuauugaauaucuuaacaaucuuuuuuugucugucucaauaccauugucuugguuccugcccuaaugauuuucuuacuugcauuucugcaguggccugcuauccgauuucucuguuccagucuugcaccucuccaaucuaauuucuauaguugccagagucaucuuuuuuaaaauaugggauaaacauauaagucuccugcuuaugguugccagauuuagcaaacaaaaauacagcauacccaguuaaauuuuaauuucagaugaacaagggauaauuuuacauguaugucccauauaauuuuuaggacauaaauacuaaauuauuugauguuuguaugaaauucaaauuuaacugagcauccugcauuuuaucuggaaaucuugcucuuccuucagagcccaaaaauguuucaccaucacuuucagggugaaaccuaaauauccuaacacugcauuacaagauucagcauguucuaaccccuguauaccauaugaaccacucaguguccugaauuugcuuugcugcuuuacuccuucauaccucugaucacaugcuuacuuuuuccuagaaugccccucucuucuuaguucucugguugauucugauugauuguuuaauacugaaguaucaccuucucuaacccuccaguccacucuggauaauaacugggacaccagggcugggugugguggcucacgccuguaaucccagcacuuugggaggccaaggcgggcggaucaccugagauaggaguuggagaccaggcugaccaacauggagaaacccccucucuacuaaaaauacaaaauuagccggacgugguggcacaugccuguaaucccagcuacucugaaggcugaggcaggagaaucacuugaaccugggaggcggagguuaaagugagccaagaucacaccauugcacuccagccugggcaaaaacagcgaaacuccgucucaaaaaaaaaaaaauuaauuaauaauaauaauaauaauugggacacuagcuuuucuucugcauucucauaacauucuuuguuuuauaugauugcagaauuuaucauauuauaauuuaauuuuuuuaaaccugccucucuuccuuagauugugaguucuuugagcacaggguaaaaguugugucuuuuaacucaauccuuggcacuuagugggcucucaguuaauauaugcaugaaccaaucaguuagugaaugggaaaguaggaaaggacccauaagcauuagccacauaauuggccauuggagcuuacccagcucuucccuaugguaccuccuuugaccauccucuuuguuccucaaagaugcuucauaagaauaggaacuagguuuuaaucucuguaucccuaggcccuuaaauuguaggugcucaguauauauuaaaugaaugaaugaaugaaugaaugaaugaaaaacacaugaaugaauaaguauaucuuucagggccacagcuccuguuguccccugcaacaaguccuagagggugcugccucugaccauauuuuuuauucucuagggcaggcucuauauagccuaaguuguagcuucuuuaugucuuacuucuucucauccaacucuucuucccucucucauccuaggccagaagaauucuuuucccccgacagcagcuggcacauaacagcucaaugaauguuagcaaucauucacagauggagccuuuucuuuccuccagggcucuugccuuucugccauuucuuucucucucucugaggccaagccuggaaagccauggggaucugacauugcuuuuucucccagggauuauggucuuuccucuucccacacaagggagcaagguuuucuuugucucccaccaggguaguucaauuaaauaggacuagcauuaagugacucuaauuauuuuuuauuaauguuuaacugcuaaauuucuuuuucaauuaaauaauugugucuuuaugcuuagaggcccuuuuugcguauauaugggaguucauuuauuuuaguaaaggaaauaccaccugaaaaacuguuaaugacuugagcucugugauuaguucauuuuagugacauuuugagauuuaauaauuaaucuggcucagguucaaagaaagaaaacuuaaugccagaaauuccuagccagcaaagaauauaaacaaaccauacaauuguccccucaaauaacaggaaucauugagauagccuucuugcaauuagaaauguuuugaaaaaaugcaugaggaagguucaagaaagcaugucaaaacaacaaaacucaguguacauucucauuauuguaauugaucaaaggauguuugcaauagauuugaauuugaauaaauuaaaugugacauugauuuggcagaggcguacuagugauuggcaagaacauguagcaggagcagcuucugcuaaagcauaacucacuugccucuuguuuuauucuaauagauuucuuagcaacccaguacuaucauacuaaccuaagcucugucacuuauuuacucuuuggguuucuacucccauccaggcaagauuaaauuuauuuuugauuacugaucuagcagguguucucuugggccuaaauacagaauaccuuuuggugaucuaugcaccucccucuuuuuucuucuuucuuucguagaugaaaaagggugaucuaauaacuuauuucauccuggcaguucaacuuguagaacuagaaaauguaguuuaauuaaacaacuuggcaauaaaauucgagcugagacaucacuauagcauuugcuaggcuugaauuguuucucagcauguuacaaaauuaacacuguaaaagaauauucaacucugaacguuuugaaacaacaaauucccauuauaauuuuauaauuauauugaggauugggggcugugugguauauucugggaggcuacuuucugggcaugacuaucuaauaguaaacaaauguuacugguauggggucccaaaacauacuucaugccaaauuucacuuauaaucuacauaaaucguuuuguagucuaugaaaaacauuuuaauugacucaaaggcaauguacucauacuuuaaaaauuuuaauauuuauuaaaauaaaaauuauucacuaguauauaugguuuaaauuauggaaagaaauuaguggagcugucaaggucaaauuuaugucugguaagcaguaaaaaauguaugcauuuggguauauuuaguaauugaaauacuuuuacaucuuuaucuuauguguacuuugaaaaguaugucuagcuccaauagauauuaaagauauauguacauuuagcuuuugucacaaauguaccgcuaauguauaauuuuaaauuauaacuuuuuauaaauccgguuucucauuuuuuauauguaauauaacuugaacuucauaaauaagcuaugguuuuguucccacagaagacugaaaaagaacccaguuacaugggccuaagacugacuccugagccuuaacuugcucuugaaaauagugaacuuucuaacaaugaagcacuguugaauuuauuuuaaauuauauuuagauuuugucuuggcauguguuuugaacuucaguuugaacauaguuauauaugauauacuuggaauucacaaguacuugaagcuaaauggagaccauuuauaaauacuaaacuuuagaggagccuggagccagaacauuaaagaugaaauggcauauuuuuguguguguguguguguguguguguguguguguguguguguguguguguucaaccugccuuuuuucuaccuggauucauaacauuuuuaaagcaaaguucuaauucccuaauaaagggcugagcauuaacucuauuccauuuccaugucuaucaauauaaaaauuauucaaauacuuuugaagucuauuauuauggaauuuuaugcuuaccaugaauauuacaccaucagcaucauauauauguacauauaagguauuacugaaacacuccuucauagaagaauucucaguugacuagguuugagccuuuuaaggagaaaaauugggcuaagggauugaaaucuugaaugaugguuugaaaacaguuauucauuuuuauuuauacacacauuacacacaacauaaaaaauacuagugacauuuuacauaucuuaaauuaauaaaaauggguaauuuauaauuugcauaauuuguauuuaccuuuucuuguuaaguauauguauaauaacagauaauauuccuaaaaaauauuuuguauauauacuuagaucugcaucuaaauauuugauuccauuuaauaguauagacugaggaauguucacucccacaccucuggucugaguguggcuccagagaagcagaaugguggauaccugagguugaaaacucuuuggguaaccuuugaaccuauucagauaucucucagcccuucccuuuccccaauacucaucaaguaaucuaaacuuaucuuccagucaugauaacuucaucagagagcacuggucaucagcucuuagccuucccucagauauuagagugcauuuccaaagcccagguuuaaauagcuuuaguuuucuuucucucucccaacacaucauugcagagaccucuaguauuuuucuaccauuuguuuuaccuccucuuuauaauucaaauauccacgcauguuaucuaauaacuuccauagcaguaaguguauauuaaagcugaauuccuugccuuuauggaaaguuaauguauaguaggauuuugcaugagggacuguaugauuggagcagaauaacuacuuauuauaucaugccuaauaucugugagugagcuauaagucagcauguuaguagauuccauauuuaagcuuuguuuuuuaaaaaaacaaacuuuaaaucucuuuugucauuacuacacauagcaaguugcagcauugaaugcaacaauaauacagcuaccaaaagggcucuuaaccagggcucuuagcaaaguaacagcauuggaaaggacuugagccacaaccuuuugggggcuuaaguucacaucacugaguaaaugaauagugcacuauaaauaaccauuaacuacauuacaaaaacaaugaugagcuuguuaaaggcauuuagaucuuuucgcuuuuucucuuuuuuaaucuaauccuucacaaacaaugauaauuuauauuaaauuuugaccagaaaaauauauaaauucaaacauuaaauacaugcaaguugagcagcucaaauucgaaauccagauugcuccaaaauccaaaacuuuuugagcacuauuaaggcauucaaaggauuuggggauacuuaacugguaaguaaaaagcaaauauuccaagauccaaaaaauuccaaaaucccaaacacuucuguuccuaagcauuucagauaagggauacuuacccuauaacaacauaaacaacucaagccuaaacuaauuugcuccagcugaacaccccugaaaugagagagaugcucacagaacauuggucauucauaacauauacauuuaaggaaaguuuugacacaccgauuuugauacagcucaugccuuuuuuuaauuugucaguaugguuucuuucucuucuucccugagauugguggagaaugauauucuucaauauuucacuccaggagacucuuuaaaugacccuuuuagaagggguugaccucaugcaugacucucaauugucaacuccaugagguucugcuucagguggacaagaaggccauuguugauacacugcucuauaucccuagucaggggagccaagacagugguauaaaacauggaagcuuuggugacuagagacuuuuuguugaugggaauaaggagguaauaaggcagaguguugcuaauuugagggcugcacgugguaacaacagcccuuuugucucaggcugugcgucuccugaaccagguucacaaagcuugagaaguuugcuuggcaguauagucaucacuggccucaaaauccguauugguauuuucaauggacaguguaacaaugcuucucaugugcucagggaacuuagauuugguggacguagaguuuuaggguauccagcaccuggcagaguguccaaaccucugguguuuuuccucugcaaugaaguccuucauucugaucauuuccagugcuauuuauucuacaagguuuccaucuuguaucauuuuccuucaguugaaguauguccuuuaauuuuucuuauaguagauauuugugacaaauucagcuuuugucugaaaauguucuuauaauaccuucauuuuuaagauguuuucacuggauauaggauucuaaguuguuucugaugagaacucaguguuauuucuuaucuuugucuuuuguauaagugucuuuuuuccugugucuaguuuuaagauuuuaucauuaguauuuagcaauuugauuuggaugugccuugguuuuaugauuauccugcuugggguuguugagcuucuuagaucugugaauuuauauuuagucauuauuuucucuucuccuuccaugaccacauguauaucagacugcauaguauuguccaauagcucacugaggcucuguucauuuuuuagcccuuuuuuaaaacucucucuugcuucaguuuauguauuuuccauugucuuauauucagauucacuguucuucuacaaagaagcacucaauuuuuuuauuucauagguuguuuuucaccuugaaguuauauuugguucuuuauaacaguucccauuucuuuccucauguugauuuuuuuucuuuaauucuuuagacauuuuuauaguaauugugauaaaguccuugucuguugauuucaucauuucuaucauguguaggucuacuucuguugacugguuuuuagucauccuuucgucuucaccucuugauuacaugaugaacauugaaauauuauguuuaguaucucaguuguguugucuuccuuuaaaaaauacugaguuuuguucuggagggccauuaauugacaugugaaccagcccaaacuuuuggaagcuuuuuuuuuugagacagggucucacucuguugcccaggcuggagugcaguggugugaucuuggcucacugcagcuuugaccuccugggcucaagugauccucccacuucagccucccgaguagcugggaccacagcugcaugccaccaggccuggcuaauuuuuguauuuuuuuuucuuucuuuuuuuuuuuuuuuuuguagcaacaggguuucaccauguuguccaggcuggucaugaacuccuggacucaagaaauccacccaccucagccucccaacgugcuaggauuacaggcgugagccaccacguacggcuagaaucuuacuuuuaaguuuuguuagaguagaucuagagcagugcaguccaauccaaauuuuugcaaugauggaaauguuuuauaacuguacuuuccaauauaguggccauuagucauauuuggcuaugaaauacuugaaauguggcuaguauaauucaguaacugaauuuuuuauuuaauuuaaaugguauguggcuagugccuacuguauuguacagcauaggucuccaauaagcuguacucucgugccaguuuaguccuacaccuaaggagugacccuuccgggaucuuuacaaugucucagguguucaacgagcucucccuggcugguuagaacuugacuuuuuccuaguccagugcaagcuccagcaauuuucagccuauaguuccccaguauucuuuagugagaaguuguccuuccugcuuuauggaguuucaccgcgcacauggacagcuuaauauucagcugaacacucaaguggguuacuaugcagauuucuaaaacuuacucuguguauucugguacuccgccuaacauaucccagcauauuccagcuuucucaggcucccuaaacaaccaucucuaucucuccauaaaccaccauccucugguuggguucccccacccuguguagcaaccaguaaugugucuccagccagaaagcugggaugauauaggguuuaucuaauuuguuacucauugaugcccuucagggaucacacuacugugcugccuauuguccaguaucugaaaaauguauuuuuguccaguuuucuaguggugccauggcaggaggacuagccugguaccaguuauuccaucuuuugucugaaacuaguagauuaccucuuacuaacaucucuacccauuucagagagagauguguacaaguuugcuauguuuauuuuuuaauagaaugaaaucacuauuuuaagauauauuuguaccuucuguuguacuaucacugcccaguagccaguucuuucccaaccuuuacaacagcccauugaagaagacaacauuaucuccauuucacacaacaugaaagugagacacagggaaguuaaauaauauucauagagucacacagcugguaaaugguaaaacugggauuuguauucaguggucuggcuucagagcccaaauucuaugccacuauugagaaacauucagugaauaacaaugugaagaguauacauaugaguaauuugagguauaaauauuuauacuuacauagucacauauaaacaagauucaauuuuuaaaucaauaauguuuggcuuacauuagaauauggaaaaaucuguaaucugcauaaacuuuucaaucuuuaagggaacucuagagguuacuuaaggggaacaaaaggaagauacuuccauuugguauuguugguuuauucauuuauuuuuugagacagagucuugcucugucacccaggcuggagugcaguggcgugaucucagcucacugcaaccuccaccucccagguucaagcgauucucaugccucagccuccagaguagcugggauuacaggaguacaccaccacaccuggcuaauuuguguauuuuuaguagagacaggguuuugccauguuggccaggcugguaucaaacuccugaccucaagugaucugcccgcuuugaccucccagagcgcugggauuacagucgugagccaccacacuggcccauuuggcauuguuuuauaaaagcuuacucaccuuguaauacauaacuaucuuaggaaacauaauacuguuaugaguauaagccccauuuucagauaaacugagacuaaaaaaguuaaguagcuuucuuggugucacacggcuagcaaaugguagauuugggauuggaacccugucugagucaaagaauuacccauguggauugucaccacaguguuauuuuuuuuaaugaagaagugaaauauuggaagcaacaguagagguaguuguuaaguaaaucaugguacaauacuagugauaaaauaacauucagccaucuuuuuuuuaaauguuaaagaaaaauauuuauuggcaacaagauaaauaaguaaaaugaugaauauuuguuuuuaaaauacaaacauuuaugugaagaaagaugcccguuccugcuuuauccuuacacaaacacugaaacauacuguuauuugauaaacguauggagauauagggugauauuguuccaaggaauuggaaggaaaaauacuugcuuuuugguaguuuguauuugcaaauagacuuucuuaaaaguccuuaaggucuacaauuccuauccuguuuucuccaccuaacuacuuucuuaucaauuccaaauauuuucauuguuguuguuuggggguuuuuuuguuuuguuuuauuugagauggagucuugcucugucaccuagguuggagugccgugguacaaucucagcucacugcaaccuccaccucccagguucaagugauucuccugccucucagccucccgaguagcugggacuacaggcaugugccacaaugcacagcuaauuuuuguauuuuuaguagagacaggguuuucccauguuggccaggcugguguugaacucuuggccucaagugaucugcccgccucggccucccaaagugcuaggauuacaggcaugagccacagaaccuggcccuucaauuccaaauauuuacaagaccguauuuccuuucauaaaugauuuauguucuguuuaauuuugccugguaccaguuauguuuuugguaccaguuuuguuuuuucagaaaaacaaaaggaaauucuuuuuuaggaaaaacuauagucuccauauuuuuuaacucugaaaucuuuaaccaucuucauauauaaaaauaauuaauauauucagauuggcuuuucuuuugccucaauagcuauuauaagaaagucuuagaagaguaauguugaauaaagagaaauuaugugaaggcaggagaaacaagaacagaucuuugcccuccauuuucuuuucaucaaaaagcauaugcauguaccaacuguaagacugcaacuauagaggugacauaaauaaaguaggcaggggcacagcuucaggugacaugacugaucuauuauacaaaauccaagcaagcuccauaccaauuucugaguauccucuugcugcuugaggucgguuacuaguggaaguuuaaccugguccugaacuuuucauuccgcuccaaagaacgaacuuccauuaagacacagggacuugaauuuuugucuacuuccacuauuuccaguaugauauugaggaauuuccuuugugauacaucaucaccuuauauaagaauucuagaggguauaggaagaagaaaaccugauuucucuacucucacccucacuuggagcaaccauacagaacucgcuuacuguggugauuaaacuacucauggggaauugcuauguguugugaaaauuacaagaauauuuauaaauauuguucuuuccugcacauauuugcuuugagggagaaguuucauuagaugggcccuucuucacaucuaaaacuaagucuuaacacuaaaaccacaaaaacuuuucccccuuuaaguacaaacuauuauuuuaaauguuacuuuaauaucagagcuuaccuuuuuaaaggacuauacaaucaauauuacuugaaauucacuugagaaacagaaaggugauaucauacauuuagauauccagauguugcccuuuaagugacauuuuuugaaaguuuugaaauuuuaaaaauacuugacagaacuuuuuuuuuuuuggucaguguugucagauauuaguuacauuaacauucuaauuucacauuacaaauaacauauucuuaaaaauuagauaauacagguaagcaaaaagaacauuaaaaaauuucacacauuuagaaaugcauuguaaaaucagaaggaauggaccaggcgugguggcucaugccuguaaucccagcacuuugggaggcugaggcgggcagaucaccugaggucaggaguucgagaccagccugaccaacauggagaaaccccguuucuacuaaaaauacaaaauuagcugggugugguggcacaugccuguaaucccagcuacucgggaggcugaggcaggagaaucacuugaaccuggaagguggagauugcggugagccgagguugcgguaagccgagaucacaccauuguacuccagccugggcaacaagagcaaaacuccgucucaaaaaaacaaaaaaaaaccaaaacaaacaacaacaacaacaaaacacagaaggaaugaauaaagaccaaagauguaauuacuguauugcauuuauuuuuaagauacguaucuuuucaaauauuaauaucucugaaacuauguguggaauuugccuuucuuaaugcuauagugaugcuucuuaaaugugauggucuuuuauucaaggaaauacaguaacaaaggauugauuguaauuuuggguauagauccuccuagauagaauucugaggaacagaacugcauuguacaaucuguuugcacagauuugagaaaguauuuccaauagcaaagaaccucucugcaacagugucuagggcaugccaaacccugauuccauuccuauccuccuccuuuccugccauaccacuccagaagagaaagggaaauauuaauagaugaggcuugguucugguacuacagagggugacguuagcauucacacaucugaauggcaaagaaaaaaaaaaaaggguagucagagcacuucuuucucaccaguggaaaaguacagucacugaguuuuagggcagaaaucaguguuaagcuuaggaaaucuuucauagagugucucaggcuucuguguaauauuucacauuuguuuguuucauuuuuugaguaguaaauauuucuacuguggggugcuucaugucuauuauagcauaaaaucaggacagaacuguuuauguaacauuaguauguaaucauacagcuuuuucaaacuuauauacauaucuguauauuauuuaaaugcaaaguauguauguauauauuuauauguauauaauguauuuuauuuuuauuggcuauuuuuauaaaaacuuuuuuuaacuagaaauuuaauaauuucuuccauuuauauauacaugcaggaaauacuaaagaaugaaaaacacagagaagaaaucaaaauaaaaagccaagauuuuuaugaaaaagaaaaacuccuuaguaaagagaccagugaggaacuccugccuccaccaguucaaacucaaauuaaaggccaugccucugcuccauacuuuggaaaggaagaacccucaguggcucccagcagcacugguaaaaccuuucagccaggauccuggaugccacgagauggcaagagccacaaucaaugaaugcauuauggucaaaucuuuucauguauauggaugugacuauuuuaacaaauaaaagaagugaaaaguuauuuaccuuguauuuucugaauguacaauaguuuccuauucuauuaaucuugaguucauuuuuaguaugcacaagaaaugugagauuauguacuguagaaaccuaacuucuuuuagacuuaaauccuucauuugacuuagucauuguuauuuaugaauuugcuuagauuuguuuuucccucuuuggauuacucccuugagaaggauccuguagcugugaaugcuuaguacauuuuggaucuuuaugaucauuugggaaccacucauagauagaacuggguacaaauaaugaggguaaauauuuuucccucuuuggauuacucccuugagaaggauccuguagcugugaaugcuuaguacauuuuggaucucuaugaucauuugggaaccacucauagauagaacuggguacaaauaaugaggguaaaauagugagcucucccaacugaucaaauauaggagaaaaaagaaugaagauucuuauuucuggagaggugaccuguaagauucuaaaagacuaaucaaaaaugugaacuuggauaaaacauguagaggcaaagaaaacuuaguugauaagugaaaaaaaccacuaagaccuugaugagaggaugggacaaaagcuagcuuauggugggacucugguuggaauuugaagagaggaauuaggaccaauagaaguauacaauccauaacaaagucugaaaggacaguagagaaagaaauaaugcaauaacuggaguuccaugagaacgaaaauuacuuugaaaaaauagaaaauuggggaaagcucucaaaaagcagaaauuaauuucacuagaagacagaagacaauguacauguuaaaacauuacauacaaaaguacauuaaagggccacacauuuucuggaguguacaaccaaguuuuuguuguuauucuaaaaguuuuucucacaauguuuggcauacaauagaugcucaauauuugcugaacgaaugacccaaaugugugugugugugugugugugugugugugugugugugugauuacaaaugcuuuucuuuuguauuuuuuuauuauuauacuuuaaguucuaggguacaugugcacaacaugcagguuuguuacauagguauacaugugccauguugguuugcugcacccaucaacucaucauuuacauuagguauuucuccuaaugcuaucccuccucuagacccccaccccgcaacaggccccagugugugauguugcccucccuguguccauguguucucauuguucagcucccacuaaucagagagaacacguguuguuugguuuucugucuuugugauauuuugcugagacugaugguuuccagcuucauccacgucccugcaaaggacaugaacucauccuguuuuauggcugcauaguauuccaugguguauaugugccacauuuucuugauccagucuaucauugauggacauuuggguugguuccaagucuuuguuauugugaauagugcugcaauaaacauacguguccaugugucuuuauaguagcaugauuuauaauccuuggguauauacccaguaaugggauugcugagucaaaugguauuucuaguucuagauccuugaggaaucgucauacugucuuccacaaugguugaacuaauuuacacucccaccaacgguguaaaacuguucuauuucuccacauccucuccaguaucuguuguuuccugacuuuuuaaugaucaccguucuaacuggcaugagaugguaucucauugugguuuugauuugcauuucucugaugaccagugaugaugagcauuuuuucaugugucuguuggcugcauaaaugucuucuuuugagaagugucuguucauauccuuugcccacuuuuugaugggguuguuuuuuuucuuguaaauuuguuuaaguucuuuguagacucuggauauuagcccuuugucagauggguagauugcaaaauuuuucucccauucuguagauugccuguucacucugaugauaguuucuuuugcugugcagaagcucuuuaguuuaauuagaucccauuugucaauuuuggcuuuuguugccauugcuuuugguguuuuagucaugaagucauuacccaugccuauguccugaauaguacugccuagguuuucuucuaggguuuuuaugguuuuaggucuaacauuuaagucuuuaauuuaucuugaguuaauuuuuguauaacguguaaggaagggauccaguuucagcuuucuacauauggcuagccaguuuucccagcacuauuuguuaaauagggaauccuuuccccaugucuuguuuuugucagguuugucaaagaucagaugguuguagaugugugguguuauuucugaggcucuguucuguuccauuggucuauauaucuguuuuguuaccaguaccaugcguuuugguuacuguagccuuauaguuuaaagucagguggcgugauaccuccugcuuuauucuuuuggcuuaggauuguuuuggcaaugugggcaaaaaaaagauuuuugguuccauaugaaauuuaaaguaguuuuuuccaauucugugaagaaacucagugguagcuugauggggauagcauugaaucuauaaauuaccuugggcaguaugaccguuuucacgauacugauucuuccuaaccaugagcauggaauguucuuccauuuguuuguguccucuuuuauuucguugagcagugguuuguaguucuccuugaagagguccuucacaucccuuguaaguuggauuccuagguauuuuauucucuuuguaguaauugugaaugggaguucacucaugauuuggcucucuguuugucuuucuugguguguaggaaugcuuguaauuuuugcacauugauuuuguauccugagacuuugcugaaguugcuuaucagauuaagauuuuugaaugacccaaauuuuuaugcucugaauaucuugguuaagcauuaacaaugaaugccuaaaaacacauaaauuaaaauuuuuacuuaauagcagguaaaaauuuuaacugccuaagaaauacacuacagaaacauaaaacugcauaaaacauuuauacuaaaacaaguaaucaaaugacaaaaucaccacacuuaaugacaaaaagcccaacauuccagcagcccuguuauauaauaucagguuaaauauuuuaucuuauuacaucauuacaaagugauacuacauuuuaccacagaggcaaaaaaggaacuagucacuagguaauaugaaaggagaucuauacagccagcaggguugcucagaccuguaauuccagugcuuugggaggcaaagaugggaggauugcuugaggccuggcauuugagaccagccugggcaacauagcgagaccccaucucuauaaaaaaaauuuuuuuuuuuuugagauggagugcaguggugccaucucggcucacugcaaccuucaccuccaggguucaagugauucuccugccucagccuccugacuagcugggauuacagaugggugcaaccacacccagcuaauuuuuguacuuuuaauagagacggaguuucaugaccccauucgagaccauguuggccaggcuggucucgaacuccugaccucagguaauccagccgcuucagccucccaaagugcuuggauuacaggcaugagccaccacgcccugcggcaaaauuuuuuuuuaauuagcugggcaugaugguguguaccugcagucccagcuacuugggagguugaggugggaggaucacuugagcccaggauuucaaggcugcagugaacuaucaucaggccacuguacuccagccuggugacagagcaugacucugucucuuaaaaaaaaaaaaaggagauacaauuugugauauaguugggacugugaauugagauuaagauguucuuaacuccuagacuggauuguagagaaaacuguaaauguuuuaacacacuaguguuucuacugccaaauuccuguuaucucauuaauugcauuccauauacaccuuuugcaaauguuuaccauauagucuguguuucccaaacuuuggguauuugaccaugugaucccuuuuaauauguuugagaaaugcagaauuuguccuuaaauauuuauuccagauaugaaguaaaucagcaugauucuauaaccaguagcaaauauaaaagcaaucauuccuaaauaggaucaaauugccuccaacuuagaaccauauaaaauauaaggucuauuucaacauuagguuuccagcccacagcuuccugugcuuuuuuuugagacagagccuugcucugucgccaggcuggagugcaguagcaugaucuuggcucacugcaaccucuaccuccuggguucaagcaauucuccugccucagccuccccaguaacugggauuacaggugcacgccaccauacccagcuaauuuuuguauuuuuaguagagacgggguuucaucauguuggccaggcuggucuugaacuccugaccuugugaucugccugccuuggccucccaaagugaugggauuacagacaugagccaccgcacccggccuccugugcuuauuucuaguuugcuuauuauaaacaaguaaaauuuaaaauguccuuauauaucugauaacuaguaauaugcugaaaguuaucauggauacuauggcucaaguucugacauacaaacuuuuauuuauuugcugauuuuugauaaaauguuuguuagaggcagccaggggacagcuuucuuucucccccaagaccagcuuuagaaugguaauugauuguacuuaguucucagaacuucagaaacaauguaauaaguaaacaauuucuuaaaaguauucuagauaauagcaaaugggauucuuuaacaacaguacucuguugcagugagaggugauuuuucugaagaaucccaaaccucacaauauucucuauacuccagccccuuacacacacacacacacacacacacacacacacacuguaaaguaugaaucucacauauauagaaaggcucucuaaaugauggaaaaaaguggaaaaaaaaagcauaugucaaacaaauacaaaacuggcauguguuaagacuaauaaauuauagaaaaacagaccuuuaaauaccuuuaaguuguuacaacagaacugaugaaaccauaacuuuaguagguaacugagaauuaugacuauauccuuugcuucaauacuuuuacucuaaaaugugacccuaaguaaaacauguacauaaauucuuuccaugaacagcuugauugcagaaaaccaaacauauuauagauauaucuuaacacugaauaauuucagugccuugaguuauaauguguugcucacacuggcaccaaguagagacugauaaucuaaaagaauagcauuaaguguuauucaaacugguccauaaacauucucagugguccuuagguucugagagauacaguccugaaauuuuacaaguaugcuuagcuguaacugaaauucuaacuugcauaacauaauguaacuuaaaauguuaguuccuccaaaaaaaaaaaaaaaauccaggaccucuuuauaaaaaauuaucaaauuuauuuuaaugucuaguuucauuuuuaaacuguagcugcuagacaauuuuuuguaauuuaaaauucauuaauggguacagaaaacauuaauaagcugacagugaauuaaauacuaacagugaauaaaauuauuggaccaugcauuuauaaaagccauguuuaauaguaaaacguuccaguucuacuaaacugaaagaaacauccuuuagcucccuacuuccaauuacagcacauucucauuuugauauaauuuauccuuuucacccaaucacuacuaugcccaacaaaauguuuccaaauuuuauaccuuucuuuaccacuuaugaaguauggcguaacuguuacacuuuaagaguucuuuaaaagaaaugugaaauuuaacguuuuacuuugaaccuguuugaucagaaaguauuaaauaucacuaccacaugaguuaaaacaaagaaugaaauaaaaaacaaauggugucuuuguaaucggcgaauuacuugauaagacauuuuaacuauuuuacaguucugcuuagcacaagaauaaacuggguuccaagguacuacaguguuuggcauuuuuacugcaagcuuuaaaccauaguguuacuccucucaagccaucucuaagaaaauggcaguguuugugaguacaaaaauuguucuguccaguaggugguauucuacauagucgagauaagagaauucuuuauaaaauuauguuuuaaaaaauggaaaaugacuuauaauuaccagcugucucaaaggcuguaauaagaaaaaugcagcaaauagaaguacucauuaauauuauuuuguuuugagaaagccagaaaugauucuaagaaauaaacaauaauaauaaaagauguaauuaauauacuguaucccuuuuaagccaaagcacacuuuuuaccucaagacuguucugacuuuuacauucuuaauuuccuuuguccaaaauaggaccccauuuuaaauagaguucauuugaauugaguucauaaucuaaagucacuuuuccccacaagauguuuucauuucaguauauaaacugcuaagcggcaaaugacuaagucaguuauaaagaauuuguaccacaguaaaugcuaauuuacaauaacugucaauagaaaccuauaaacuucuacacccacgccuaaaaguuacuauaguauugaggucagaacuaacaugauucuuccauuuggucaaauuucauuuacuaaaucauacugucaagaaauccaaagaagaaacuuuaguggauucuuccaaagcuguguaauuuuccaaaugauuuuccucugguugcaaagccuguucaguccuucaauccuuuuuuagucguuuagcuuuugcaauguuuucuuggcguuuuugcuucuucuuuugcuccuucucccuggccucaaucaucuuggccaauuuccaagacaguacagcacuugcuaggaacaguggaguaagggccaaaauaacgguuguaaggaagccauagggguccuuugcagcccauuccacaacauacucagcccaagccuuuauaucaaacaucuucacagcagucuuaugaaaacuggggcugggggaggcggguggagaacacagaggaaaaaaacaggagaaaagacuaugugguuaaucaaauuuugaaaaaguuuccucacacaaccaguuaacucaggauuccauuaucacucaguuugcuuuuuuaaaaaguacaacuuaguacuauuguaauaaggacuaguaucucugguuaggaaaaaguaauucaucuaguacagccagaauagugacacuucaaagagguaaaguuauagaagauuuaaaaaagccaugugacucugucauaaggacuaugcauucucacaugccuccuauauucaagacaaacuuuauuuaggaggaggcuuuuauaaaaaucuugaguuuucuguggucauuccaggaaacagcugaauacaguuugucauuuuuugacauauccuuaguauuacuaauuaacaaaaauacaaaucagcaaauuugguguuugaaaaggacaagcaacagagcaugugaaaugcucgcagagaaggagagaugacuauuuccccgaaugggaaggagaggguaagggagucaugacaucgcauuaauaugccaaagaagcaaaaaguacugugcuauuuuaugcccuuucagcuuugaggaccucuguuggaauaagccuaauuuaauaaaugagaaaguagccuuaacagaugccauguguuuuguuccuuuuugaguguaaggaaaaggcaacuggcaaaugaggauuaugugacuugagugacguuuucuauuuugccccagaggcuuuucucccuuucauguuugugucaaccgcuauucaaaguggagaauuagaauaccuggguagggaaugaguguauauacauccacuuacaauuucaacuggaauuuuuuuaaaaaaaucaucuaccuuaugcuugaguagugaucccuuaacuuuguccugguguuauuagugacccaaucacgacuucagaugacccuugguagucugucuucuugaguucuacuguacacaucugagagacgguuuaaauucuguacaauuggcuaguuggaaagaauacaaaaaauaaaacaaaauuuaagucacaauuucaggauaauuguaauaaaauuuuaaauggaaaauuucuauauuguauauaugcaaccuauaugacaucuaaaauugccuauccgguauaguaacuuaauacguuucuuccucauuugaauuuacaauugcaaaugcccuguaagaaaauccuaauuacuggaaaucaaguauuuuacuaaguuacuuauuucaauaauaaaauuuuuuuaguucauugacauacgggagacaaguuggcucacugacugacuuacacagcguauccguuccuagauuuucaauuuuuauacuaaaaauguugccacucauuuauuuacuggauuagguacaccacuacaaaaucaaacagcucaucuuacucuuuauaaagguuuuuuuggguccaucauacaauuuguguccuuuacuuaaaaaauuagaagacauaaccaaacaaauuauaguaauucacccacagucccauuaccccaagaaaacugugacuaguuuuaauuauaucuuccccacgauuuucaacugaacacacaugaaagugccuaauacguuaaauaucuuagcuccuggacuucauacgaccucacccauacaguuagaauuagguacuacugagaucgaucugccuucaccuucuccagcccaguagcgaauaaacaauguaaguuucagaaauaagcaaaagaacuuugcaguaaaagagccaugguccacaggccacacaucucccugcaacucaacuucggacccaaacgcucgcgccuccacacuuucaggaauaaauccuacucuuccgcccaaaacggaucgaccaggcucgaucucccaaccagacccgcguggccccugcggcugcaacggguagcacuugacggccguccgcacuuccuccuuugucuuucccuuauuccuuacguuucucccuugcucacucuucccuccuuacccuaucggggcugcagacccacggaggccacguucacuccugcccgucggccuuggcaagcgcgggccccuugucgcgcagagcggaggguccugggagauccuggguuggcccagccacaccuugcgccgccgccguuucugcuggacaccaggagaaaaccacggcagcugcagccaccaacuuccccuacauagccccacgggaucggaucccacuccccacucaccgccagaccggaagcaggaaggcggaagucgcggccuuugcgucccgcccacaggcgacccgagccgccagccgggcgugaguaagucuagggcccaguuuccggcugcgccauugcugugugggucuugggaccucgaguuggaggacgcgggagggugggggcgggggcagggcagcgcugagauuuccggggagcggcaggugaggccgcgcggggcgggugacggcacccgggcgggcuccuuuccaggcuggagcccgagacugccacguccugcggggaccaaguggugggcgaggaggcguggagcggcuucaggacucgaggagcgguuccgaagcagcuagggacuuuugccuuugccccccgaggucgaucggaagacaacccccauccccugcuguagcgggacaguuggagggucaugggugggugaaguguuuggcugagggaaacucagaccaaagagcagcggcaagaaagcaguuggguccccacaaaacgcccgaagucaaggugagggucacacaacgacucuugacgauuccggcgaguucauccuggugcacaucccacuccaugccucucucuucugguuggacaauaguuacauccuuacgaaaaggaggcaagcuacugggccuugguggauccacucaaccuuguuaccaagggacaugccgccaugcuaugugaaaagggggguuuuguuguuuguuuuuaauuuaaguaucuaauucguuucacgaaagaaugaucaauaccggcccagaguaaacuugauaaguaauuaaacugucagggcauagaguucccauagaggugcuuguucuuucaauacacaaauaaagggaugcaaaagucaacaugcagaaagggugaguuaauauugucuucuaaucuacaggaacugaaagauuagcuaaucugguuugguuggugaccaaauuuugugauugcuugcacuguuugacuaccucugacaaauguugcaagaccucuucacugauucuccaaagacuauagaauguucucuuucaggagcaagcugcgacauguuuaacuaguuuagguaaaacaacaauaacuguuauuuaccagggaacaggcuuuuggcagauaaucuaacgaucuacgauacuguucguugggcauauguuaauguuuguaauguuguauuaccagcaguuguuuucuuacuccuuuuuauuugaaaaccuggaugauaguuucaaagccuaugcugcuuaggccuagccuguaccuuaguagccagaaaaaguagacucagucacuggauugugugcacugaauacuuacuugagauaacugauuuuucuaaaacuuccccaagucuugaauccaagaugugggcagaauguauuauuuuaacauccuucguuccagaggccaaugcguguuuuauuuuaaucaugauaggugguuuucccaguuacugccuccggauacuugcagugcugcaucccuaguuaaaagcccagaagucuugggcaggaaggaagggcauauaaagagaaagccuuuguaguucuuuagcuguaaucuagaccagggguccccaacgacggacugguaccugguuugcagccuguuaggaacggggccgcacagcaggaggugagcgaugggugagugagcauuuccgucuaaguuccgccuccugucagaucagcagcaucauuagauucucauggugcgaaccguaaugugaacugcaugugcgagggaucuagguugugcgcuccuuaugauaaucuaaugccugaugaucugagguggaacagcuucauccugaaagcaucccccauccccguccauggaaaaauuguuuuccacgaaaccaguccuggaugccauuaagguuggagacugcugaucuagaccaugccuuuacaaucuaaguuugcucaucuagcuucaaguuacaggacagucugcaagaccaggaacagcauagggguugccacaguggagcuccuuacugcagucugcauugccuuaacuaaagguggugucaggauugauucaaauacugugaacuacuuuccauaaagagaagucugagcucgugaacugagauucacaguugugguacaguaauguuauguauacucugauaaaucacucugaguguguuuccacuuagauauguggaaagcauacuaggcaaucuccaaugcccuuucagcuuuaaaaucuguaaauuggacuggauuuggucauuuuucuuaaauaaauagcauaguaagguauuugauagaaacauuauugcaaguuuucuuaaggucuuuuuuuuuuuuuuuuuuuuuaauuuugagacggagucucugucaccagggcuggagugcagugcugcgaucuuggcucacugcacccuccaccucccagguucaagcgauucuccugccucagccuucugaguacuugggacuacaggcgggcaucaccacgcccagcuaauuuuuguauuuuuaguauagaugggguuucaccauuuggccaggauggucucgauuucuugaccucgugauccacccgccucggccucccaaagugcugggauuacaggcgugagccaccaccgcgccuggccuuuuuuuuuuuuuuuuuuuuuaaacacggucuugcucuggcccagcuggaaugcaguggugcgaucauagcccacugccucuucgaacuccugggcucaagggauccucacuccucaccuucugaauagcugggacuacagccacaagccaccaugcccagcuuagcauacucauuauuuuuuaaaccuaugaccaguguuaauuuucugcuuaauguauucaguucuaagucaagcccaacuagagagaaugaguuucagugauuuuuuuuuuuuuuuuuuuugagacagggucucacuaagucacccacgcuggggugcaguggguccaucacugcucacugcagccuugacugccugggcucaagcgauccucccaccucagccucuagaguagcugggacuacagaugcaugccacuaugcccaacuaauuuuuaaaaauuuuuuucuagaggcaggguuucacucuguugcccaggcuggucccaaacuccuugccugaagugauccuccugccuuugucuuucaaagugcuggcacuacaggugugagccacuguuccaggacaagaucuuauuucuuuguuugaaaagauccuuaaucagguuuuuauucucucaaaugucugucagaauacgaauuuagaauaacaaggaaauaaggucugcuuuauuuacuuuuaagaaauaaaauauuauucauguaaguuuagccaaacuaacuaaaccugaugcuguuaaugaaauagggccugccuuugcauaagauaauuccuguguaguauaucacaccaccagccucuucagcacuaguguacucuauugcaauuauauuuuauaaguagagccuuauaaaauucuuuugucuauugagaauggaaguccuguggcagucccaugccauuuuuuuucuuaaaaaguauuuuucccuugauuggugcaaaauuauaucucauucuaacccaugucaaaguuguaaguagugaaaccagaauaagauucagauaauauuaagauaauaauauaguuuaauaauaacaauugagugugucuaaaagacuuugagaguucucuuaccugcaucuuacuuugauggaauugguuucuucccuaaauuuuauuuugugagguuuuuuacuuccauugaaacauaaugcaaaacauuucuuaauaggcacauuuauguaauauuuauuuauuuuuauuuauuuauuuauuuugaggcagagucucgcucucuugcccaggcuagagugcaguagugcgaucucagcucacugcagccuccaccucccagguucaagugauucuccugccucagccucccgaguaguugggacuacaggcgugcaccaucaugcccagcuaauuuuuguauuuuuuguagggauggguuuuuaccauauuggacaggcuggucucaaacuccugaugucgggugauuugcccgccucagccucccaaagugcugggauuacaggccugagccacugugcccaggcagugauuuuuuuuuuuuuagcauaaucagauuuuagugauauuugaaaguuuauacagaagaauaauuuuuuuuaaagcuacuuauuguggccaggcacauuggcucaugccuguaaucccagcccuuugugaagcagaagcagguggaucaccugaggucaggaguucgagaccagccugaugaacuuggugaaacccgucuccacuaaaauuaaaaaauuagcugggcgugguggcacaugccuguaaucccagcuacuuggcaggcugaggcaggagaauuguuugaacccaggagguggagguugcagcaaacagagaucaugccauugcacuccugccuaggcaacaagagcgaaacuccaucucaaaaaaaaaaaaaagcuacuuauuccagcucuuugggaggccgaggcugguggaucaccugaggucaggaguucgagaucagccugaccaacauggagaaaccccgucucuacugaaaauacaaaauuagccaggcaugguggcgcaugccuguaaucucagcugcccgggaggcugaggcaggagaauugcuugaacccaggaggcagagguugccgugagccgagaucgcgccaccgcacuccagccuggcagccugggcaacaagagcaaaacuccaucucaaaaaaaaaaaaaaaguuacuuauugaguacuuaguauguaccaggugcugggcuaggugcuucacacuuauuaucacuaauccugaaacuaaacaacaccacaggauuguauuuuuauacuaauuuuacagauagggaaccagagacuuuaaaaauaaagcaggaauuuuaaguauaucuggccaaaaucucugcucuuuuuuaaucgaaaaacaaaaccauuguagaaucaaaaaacaugcuuucauucuaugaaaucagcguuuuuugucuuucauuuuucuugacaaaaaaugcugauuuuauaauaugaaaguauguuuuuugauucuauaauuguuaacagauaauaacuaaaauccccccaaacuucaaaauugccuauugcccaggugguggcagcaugucucagagagccaaugugcuggggaagguuuucuccaaccuugccaguugaucggcuucuucaucccacauacaugacauuauaaaccucucaauucucuguugggcucuuucacugcuauuagaccaacccaucggugguucauggucccauuagccucaucuucugaaugggucauacucugccuguuucagccuauuuucccugcaaagugugaccaaauuguuuucuggaaaacucauuuaggccuauccuauaaguuguuucaguuaguauuuuuccaaccauuauuaaauguuguuuggcagaaacaccuccuaaacuguuaguuaauauuauuaagaaaugcuuguuuaaauuagaaggcaugcgucucaaacuuuggaauacaccaauuaaaggagauaaugaaaagcuuauaaaagauagaggccgggugcgguggcucacgccuguaaucccagcacuuugggaggcuaagguggguggaucaagaggucaggagaucgagaccauccuggcuaacauggugaaaccccgucucuacuaaaaauacaaaaaaauuagccgggcguggacuaaaaacacaaaaaauuagccaggcgugguggugggugccuguagucccagcuacucaggaggcugaggcaggagaaucacuugaacccgggaggcggagcuugcagugagccgagaucgcgccacugcacuucagccugggugacagggugagacuccgucucaaaaaaaaaaaaaaaaaggauagaauuagucuucaaaauaagaacaauaaaauucaauagggagcaguacaagguuauauaauuuggaaggaaugcauauaaauauauagcagauuacucguuaaacuuucauuagccaaaaauugcuuaaaacguucuuuucauauguuugcagggcuacugccuuccuagagguuucaaaugaagugcuaccuauuacaaaaggcuucuccacccccauaacauuuuuuuucuccacagcuuuuaccucaaucugauaccuuguuuacugguucacugucuauuuuuuccacuagaauguaagcuauaugaggucgguuaccccaauaccuagaacauuguuuuaaauaauugauuucacgauguagcauuguugcuuacaaauaaaacugagaauguuugaaggaauuaugaaauaauuuaaauccuggauauuugugaagcucauaguaaagugccaaacuguugaaguauguuuugaaaguggugagauacccuaguaggaagaggucuaaaagauuaguaagauguuuugggaaagguuaaaauaauuguaguuaucguguuaaugagagaagacuaguuacuuaaugauuuccaacuucguaaaaguauuuacaggaaagucgugauucaucauuuucauugauaaaaagaauuaguccuaggccguaggugcuacgauuuaagauaagagcaagcuagacuagagaucuaaauagagaucuuugaaaaugggauaagaguguauacgcagacuagaugcccucacuagauacuuuccagccugugauuccaaacgcagauugugggagaaagauuagauagcaggugcuucuguuguugauaauuccuugcuacccauggccauugccauuuuaaaaccaauucaguguguuuuuugagcguagucaauauaggugauuauauauugcuguuuuggguaguuuauauuuguugacauaauacugaaaauuggaugugugcuuuuuuaacuccaagacuucauauuuacaaugcuuaaucuccagaaugccaccauacauguacaugcugcaaacuaauucccuguaguuagcagccauccuuuuggaggaguaaaauguccaguaaaucugaagccuuggguuguaguccugcuaaaaucguaagagacccuaaacuuucuggcugaaacuagaggaucaaauauuaggccugucccuauaugauuuuuagcuaugucaaguaacuuuuuauuucuguacuggguucuccuagccauuaaauuagaauugcuaucccauugggaagacuaauucacguuuaagaagccuucaguguaaaagcuuuguauugcaaaagcagccccuagcacgauugccuucaccaaguagcauuuuaauuuagaccuucuaccuucaccuaagcuaacugcuuaaaguaaccaugcaaaaauuuuuaacugcauuugcaauaugauguugucaaggguauuguccucugugucauauugugcccuuuuacuuuuuuauuuuuuaauuuuauuagagauggggucuugcuguguugccagggcuggucucaaacuccuggccucaaacaauccuccugccucagccucccaaagugcuuggauuacaggcgugagccaccacacccagccucaguguccuuuauauaaagucccauguaagauauauuaguaagugauucuuagaauaguuucggaagccacuuuuugauagugaaaauuuugucaggaagcucaagccaaauuugaaaugcacguuuaacggucauccuaaccugcauacuugcauuucuuuuuaaauaugcuuuuccuagaacagauauccuuuaucauuauuguauauguucacguaggaagacaucgcaauccuuugugaaauaaugugggguacagguugccuguagguaaaguguuugaaucucagaaguuuacauagagaccccugauauguuaacagguaguuacaaguaaaauucucccauugauccaaauuuuuauguuuauuuuuaaaucucauaacuauucagaaccauuaguucucauucagaacuguggaacguaagaaaucauuuggaauugcaucccaaagucuaauucuaaaagcuaguuugugucuuuaaaaagcuuucagaguauaauguguauauuuggaaucuacuuuaaaaagugaacaaaaauuuaaugauaccaggcuauaaauauaguuuccuaaaccaucaguuacacauccuggucccucacuuaaagacauccuggucccaaauuuuuaguugcaucugcugaguucaguuuauguuuuuaggcuuccuggcuuaaaguaaggaaguagagcaaucugaaaucagaaacuccauucuguuucauauaugucuucuugaaguaggguaaguaauacuggcaaguuugaugaguuucuggaggcuuugaauuugaaguuuuccuaaauuuuuagauuugcccuugaccaacuaauucuccacucucuguaauaagcagauaauaauaauuccugccuucagacagaaaguuggaccaauuuuuuuuuauuuuuuuuuuuaucucuagguuuuaauauucuguuguaggacuaugccacaguuguagaguuguacuguuaaugaauauagguguauaggaaucugauguaaucucuaguucuggguucauauuuuaucucauuaugugggucaaggaaacuuuauuuuugugccuagauuccuauauccauaaaauaguauuaauaauaccuguuuauugugauacuaauuaauaaacauguaacuuccuuuugauaauaaaaagguuguauucuguagaauucauuuguaagaugauuguugggagcuuacacagauuaucauguaauuaauacuauaaauaguagcuaaguuccucacuuagccuguaaaugcagauuugacacacagccuaaguggaaauagugccucuguguaaaaaugguagaaauuuuaauacugguaguaaauaguggccagacaugguggcucacgccuguagucucagcaccuugggaggccgaggcaggaggaucccuugaacccaagaguucaagaccagccuaggaaacagggugagacuuccuaucucaaaaccauaaauaaauaaauuaaugaaauuuuuuaaauagcaaaaauucaaugaauuuuugauugccuuguaccacaguaugauuuuguaaagaguuauagaaaaugaauuugucuugguccuuuuuuucaaacuuuuauacccuggaagguaugaaugcuuugucagcacuuuuuggaccacuuuaccauauauguagcauugcauauaugcaauacguauaugcaaucauauauguaguacaggaaucacuuuuuguugcaucugucuucaaaucugcuaauccuuuuauaccacagagaacucaaagcuacacaugggccuauaaauuauucaugcauguauguaaugcauauggaauauaguccuauacauuaacugugaugugcccucacccuguaucccccacauuauuaucuguagaaugagauacaaacuucuuagaggauccuagagauccuacuagucuggcccaggcuccuuacaaaucuucugcaugauagauuuauuucagaccucuuguaauuccaagacaugucuucugguucggugguugaggguauagacucaaaccaaacuaccugguuugaaucccagcucugccucuugcuaggaugcugcugcuaugagaauguaccucacagacccccaacuacagggagcuuacuuggccaagggccccagcugcuugcuaugcugugaaauccaucacuauguuugugcuaagaccuugcuuuucucacaguucagcaacugagcaucauagagauucuaggagacccaagacucuucugauagccagcucaggcucaaggacauccccauugcuuugccaagccuuccuuaggcuacauggcagucugguacacuuccacacaaccuucuuucccgcucucuuacauuuggggucagacuugcauccuagugugauaguccaccaguucuuucccagcuccuucccuaucuucucucacagguguuuucccuaauaaaaagucuuguacauuuagucccaucuuggcaucuacuucuggggugauaauauuggaacagucccauccauuaccugacugagaagaugccaccuuaguugguagauggagcauucauagucccagacauaacuuugcagcuuaauugcuuaauuucaccaguguugacuuggaacccugucccaauagaaggaaauaauggggcuaagugugauacaggcauuugaaaaugcuugcagagacagcagaguuggcugguuauugcuaacuuaaacacuacaaguggaaaacaagaaaugggacuguuaacaagcaguuaauagcuaaguaugagaggcucuaugguaacuuacaaagaggucuuuaucaccuauaggacagauucaguugaaccacagguucaagagcuaauuguuaagagucacagagcuccagagacauuggaccauuuaauauuuagaauaggcaggucuauuaauguagagaaaccugggauccugaacaugggauggggucuggauggaugccccugcagcucccucuggaccuucuggucuaacuaguaugucugcugugcuggaagauacagaagcuugcugccacaaggcaguagcccuuucucccaccuucuccaacuuccccuacuuccuuuccuggcugccaagccaguaacuaagauuaaaucccaacauaacccagcugggacaugcugacguauuugcaagaaccaggggagcacucuugggauuggauuuuaagggugcuugggucuguggacuaagcugucuuaggacagccaaguaaaacacugaaacugccucccacuccugccaagauaguaaaucagacacaauauuguauccugggggaaugacggaaauuagucccacuauuuaaaaccugaaggauggaggagugguggucccaaucguaucuuuuaauuugcaggcugcuccuugaaacugaauagauccuagaugguaacuauagacuucuacuaacuuaaccaaagaauaacccugcucucaccugcugugcuggacucauugcuagagcagaucaguacagauacaugguaugcaaucuuugauuugguaaaugcauuuuauaccauuccaguuggaaaacaggaucagaaauaguucacauucauguagaacagacaaaaauauucaggcugaguuuugccucagccuguguuaacucucacccucagucauaauaugaagaacucuggaccaucucaucccucagaacaccacacugauccaguuuauugacaacauccuacuuauaggacaggaugaggaagagauagcuaguauggugaaggccuugguaagauaccugaaugccagaggaugggagauaaacacugaagauucagagaacagucacauuaguaaaguuuuuagagguccagugcucagggcagugucgagauauccucuccgaagugaaagacaaauugcugcgucuuacagccucuauaccaauaaggaaguauagcacuugguagaccccuuuggguucuggaggcaacacauucuacaucuaagaguaaugagccagcuccucauauaccaagugacguggaaggucgccagcucugaauggggcccagaacaggaaagggcucugcaacaguuccaggcuucaggugcaagcagcccugauacuuggaucauaugacccagcagacccuagugugucaguggugggaaaagaugcaguguggaauuuauggcaaguccaguggaagagucauaacauaggccccugggauucuggagcaaggugauaacgucugcagcagagaauuguauucccauugagaaacagcucuuccaugucacuggcugcuauagagacugaaugcuuuaccaugggacacuuaaaccuccuccucccuauccuugagugacugacuuucuaacucaauauuuauuaguugacauucuacugaaagaaagcauuuuccuuccucccccauucauuuuuucauuuguuuauaacagaauggacucauggauucuuagucaacaaaucaaauauuguuacuguuguuacuuauuuugauguucuaacugucccaguuuugaccaaugggaaccccaggaugucuauguccuuuacuuguguccucaucauucuuuggggacuuucuugcuuuuugguacaagauguuccaggcucaacuuguacuauucccacucuagcccugcaauuggcuauuucuccaaggagcucugcuuccuuuccacguagaaugguauucaggaaccaagaucuacugagugccagguuugcucauugcuacuggugugucauuguguguagucccucucagcagacggauacauacaaaaauacuuauauuuauuucuagcuacuaaaaaccaugaauuuguacugauaccuucaacucuagucaaaugcugcuuucuaguuucccccuuuuccauauuuauaacuccuuuaacaggaagaaaccuggcugccauuauccucaaaauauuuauguauuugcucaugaauagaauacacagaaaguaauuuuagaauugcuaacucauacuacugugaaaagaaagcuuacuagauuuuggggugacguguuucaauugucuuucaauuuggcagcugaaaugccauccuuuaaauaagguuaacauauucaaacuuaagccccaaauaacccuaucuaggccaugagaacuggaugguucagaggcuuauuaaaaggccguagggauucagcaaucuuuagguuacuagcuuuaauccucacaucuacuguaacuaacagugguugacacggaauuguuuauguuggcuaauaguagcugaucauggcuuuaucuuccaggucuuagugauuaaaaucacaucacugagaauugccaccucagcugaaggaaagggcagauuucccacaacggugcuguuuaaucuuuuuaaaagcaaacuacaacagauuguucauaaguaauuucugugcaugcaaaaaguacuuaaagcacaauucucaguuacaucuaauaagugugcaauaugaucauauccuuuuuaaaaucccaucagguuuuacaagcuacagauauuuuugaacaaauauuuagaaaaugauucaaggaaaaaggugcuaucaaaggcaguacuuugaaucuggaaggccagugcuuucucucugcaccaaaaccaaauugauuuuaggagauggcauuuuuuaguuggaauauaaauucaguuuaggauuuuguguaaauguccugucaacaucagguuucaagagugcaagucauuugugccuucauaaggguuucuuuucacuuuuaguaguuugugucauuuugcuagauguuguuaagcacuuuuaacuugcauucuuagcauuaaaugguaagcacuccacagaugaaugaauccuuuaguauugacaggaccuuugaggaaggcuuauaguuacuaauaucaguauucaguguuguucgguacauuagcuugucccucuaaaaugagcaguaaacuuaaaauuuauuacugucaucagcuuaauaucaguacaucaacuugccuauuuugcuugauaguuuaccuuuacauuuacuguaucugcucuuuacuaaaaccaaauuuuguguugaguccuuaaagugucuggccuauuuucuaugaacuuguauaacuaggaaaauguuagggaaaagaagaaggagcacuuucagucuuuggaaagcacauugaccuaauucauaaggcgauguaaaggcuggaauuaugcaagcuggccugccuugauauuaucuugucuaaaugaccuuaaauuaaugcagcuauaguugauuaaacaaaaauauaaauuuauuauuagaaaguacaccugucaguuuacuuuuauuucaucucuaccaaagcguaugacauuuguucuucaaggaaaccauugaugugcaugcuccuaauuuuaagacaguccaguugggauuccuuuaagguagauuaguuuuuagguagaguaucaucauuaaaugucugugguaggcagugucuaagaugacucccaaagauacugucuuccuuguauuugugcccuuguauuauccccuccuguagaguuuggguuggaguuuuugauaaacagaaucuggcaaaaagcaauggaugucauuuccagguuauagauaaacucuggcuuccaccuugcucacccccuuguucucucacaugcuuacuuuaacggaagccaguuaccagacuaugagcugcccugaaaggcaggagagccaaagaaagcuucuggccaacagccggugaggagcccuguccugccaauagccacucgagugagcucacaugcaagcucuccuccuccccacacccagccuggacugacaccccaugaaugcagucuucaagaaacccugagccagaggacccacuaagcugugcccagauuccugaccaagagacacucugagagaagggcuggcuguuugaagcugcuaaauuuugggauaauuuguuacccagccauagauaacuaacacaauguccuuuaaaaaacaaaaaacaaaagcccaucaaacuuccuguuuucuugauagggcuucaacucacauuugagaucaauaguuuugcacagugauugucaaccccggcuguacauuagaaucaccugggcaguuuuuuaaaacuacaaguaccugggcuucacgccaagcaauuccacuugaauuggucugcaguggagucugggccucaguauuuuuuugaaguuccccagguaauuccaguaggcaaaugaggaaucacugauuuaacacaaguggacucagcacuuuccaaguccuggguguauugagcaggauauggagcucccugucguaaguaaggcaagaagacuaacauguaagaaagaaauuacaaggugauauaagaagcacagaagaggaaacacccaacucagccugauaaaucagaaaagguuugacagaaaauauuaggccauuucuuaagcuuaaguguaucaaaagcuaguuaacaagaacuugggaaaauaaacauuccaggcaggggaaaagcaagaguacaggcacacagcugucagagaauaagcagggagaugguaugcucauguuugaguaauaggucaggaaaaaacuccagaggggugaaagaugaggacacgaccuguggugguggcgaccuguggugguggccaaaggaauagagaguaggggcgaaugaauuugcuagucaggaucuacgauggcuaggauguggagcgaggcacugaaacacagaggagcccggaaugacucccaguucugguuugcugauuguguagguggaagacuaacuuuggcagcaaguacgggggaagcaaaagcagaagacagagggaaaugaacccuccaucugaaacugaaacaguucaguuuuggaccuguuaaguuugaagccucagaauaaacaacugguggcaguuggcccuugaaaugaaaacccaguugccaugucacuugccagaagagcacguucuuguggaugauuugguguauuuggaaauaaucgacaacuaccuucuauuuuggugcuuuggugauuugcagucagcuuucaaugagacugggaagaucuugagaauuagcugucuugacauuuggaacacauuccauugcauuaaaccaaagaagccuuuaaaacugaaccaugcaugcugcuuuucacuauuuuuguucacuggcuacgguucauucccaccauacucuucucuuagguaccauugccccacguaagcagguaaugccuugguuugcccagcucuugguagaauuuugaacugacagcggauuacauugugucaugaggugggaagggcugggaaggcaacauccacauauccccauuaugaucuagucauuguuuccauuucaaaggagcgauauauucagcucagcacuuccgucuauuuaagauauguuagcuccaugaaucagagugaaucuacauauucccauugugaaccugacauugaaauauacguuuuccaguuucaaucuacucaccuguuaugagugaagcuuaccuuuaaaaaaaaaaaaaaaggagcagagauauuuaauauucccaauauuugcuuuugaugaacugauacuuuugaacuuuuaaaacuauuuuaugucuucuguacucacagcucguauacccccacaagaguggagaagccacagggaaauacaacuggaucuuacugugaaaggcaggauuaugaggucucgauaucaaggcugccuagaggcugguauaaaaaaaugcugauguccacauaacuuguaacucuuaaguaaaucaaaccuguaauucagcuuggcugcuucuaagucauuuugauuccugccaacagaacauuaaugaacuuagcuucuccgcaaguuuauucauguguaauacccaauuccuucuuccucguuccagcaguugccccugguacaucugauaagguggaaagcuagacuaggucauacaaauccaggucauuacuuaaacccagauuauuauagacuguucucuaauuuuucugucugguuuuagaguggcaaacagaagaaaguuucuagggcuuggguuuggaaaaaaaauccauacacuaauaauucuugucuugaagaaacauuuuauaaaauuuagcuuauucuaaugccuuuauauuuccuacuuuuauucuccuuuugacaaugauaaauaauucaauuauauugcaguuuugcuuuuggaucuugguuuaccuccauggauuuacagugaugggaauauucuagaacaaguagucaucuagauuuccccaaaugcccugagacugauauaagaagcauacuaaaauggacaugaaccuaauuuuucgaaguauaaaauaauauaaaccaguugugaccaaacuugccuacaaauuagaauugccuggagaucucuaaaaugccaaagcccgggacauaucccaaaccaauuaaaucacuauuucucgaggugggacacaggcgucaggagcgcuuuaacucccaggaugauuccuauuuguagacaagcuuaggaaccacugaccuagacaacuguguuacuugaggauucuaagucggcacagcuguggcguguucacuacccagcccugcccuuggcaugauguucucuccuauccagcuucuccaucaucuuccuccaccugauucguagagaccucuggacaucugagccuaagcagggccacuaaaugagagagaaucccaucacugaaaagcaacaaugaauauauuaaggaccacagguggguguaaaauagauuuuugcaaauuuugugaauuguuauuuguuauauuuuuccugauaacaaaaguuuuaugucaaagauuuuugucuuccaguuuuaguuucuuaugcaguaguuuuaggaaacucuggugugccaagaugauauuuuuuuuucaugcuugggugauuguuuuagaauuccuucuuugaguucaagaacaucuuuaaaauaucuaacucagggguauuauguguguugagugagaauugucuauuugccuucuuuaaagaaacacaauuugacacaaagauagguauuaaaauuuuuauuuucuguguauacacagcacauuaguuauuuauuuaagcaaccacuggcuguccaaaaacugagggaggcaugauauaacaccgauuguuuaccauagccuuuaucacaacucagagcucuagcauuguacaaauaaucacauauugucuuaaaaaauuaaaaaacuaaaguaauccaauaaaauaaugauuuugcucucuguaucuuaggagagauagaagaaauauugcaacugaagcugcuagaugguuaugauuaucugaauaggugugaucuugacuuuagcgaauuaacagguaagcuucuuacuaugagguuggugcaaaaguaauugugguuuuugguaauugcaccaaccuaauauaaguacuucauuaauuguaaaccauauuugauuuagaaaccauuuauacguaauuucuggacuuguauucaauuaaaauaaucuaugcuaauaugugcaaauuauaaucccacucuugcuuugaucaucuguuuucugccacuaacugccacugaggaguggaaaaagaaggcacauagcuguaaucuaauuucaaauaauauuugucagggaagauguuugguuggaaaaugcauggcuuuuuuaacucagauuuuauucuauaagugauuauugggggcagaggguagaaaaaaagugagaauacaugucugucucaugauaaacaaaagccugagauguuacaguuacuuacuaaaaucacuuuuaucauaugaagauuuuggauaaaucauuauuaaggaaacuaaggacagcuguggcauggaaucagcgggcuuucaguuugaaucccaguuacucacaaauguaaagugguauuuucauuccucuuuuguuaaaaugcuuuuuuuaaauguaggaaguuuacauuuuguccuagaucacauuggcuucuguucccacaggaaauguuauaugcuauaugucaguuuucauuucauuaaaagugaaaguaaacaugguaugcaucagccaaacaguaacuaaucccgacauaauuucaguauuaaaugaggcuuggaauauguauuugaaugggcaugauaguuugggaaacucuaauucagagaugucccacuuauaacagugauguuggagaauaggguuaccaguuauggccuauauuugcucugucauaucacguucuuacaguauguaauuauauuuggagaaauauccuuugagccauaguauuuuggagucaaguauuaggcuauaauuuagacauuguuuuaguagaauaaaguaacuuuauaagauuguuccagaucuuuguucuauaucucugucuuuuauccuucccccuugcagaagucauuccuauuuaccuuauuuaaaaaacgagagaaaguauaacucaggcugaaauaaagcaccagacuaaaaagagaugcccauuuucauucaauauuuauauuugccagaauaaagggagacaaauaauuauuuugccuuuaaggccuugauucuggaugauagauuaaguagacagacuguugaccacaugugacuuaaggaauauuguuaauuauuuuaccaaucuuuggaucaagguuugcuugaaguaaguaagcugugcuguggauaaaccuuuggaugauaaagagugagcuguauugccuucaauauuguuugcaucagaacauuacuaagugguaucgauuuugaaaaauaaaauucaacuuucugagaacauagaccagauucaaguauuuuuaucuuuuuuuccccccuuuuuucagagaauggaaucucuccacguugcccaagcaggucucgaacuccuguacuugagcuauucucccaccucugccucccuaagugcugggauuacaagcgugagccacuguucauggccuuagggacuuuuaaauguuaaauugauuuugaccuacccaggagcuagagaauaccaaugauuacagaggggagaauaaaauugccguauagauuuucugugcuccuuuagaaaauccauucuggaguaaagagaugggcaauuggucaacugaguuucuuucuuguauaauaugucagaguuugauauugucagucuguuaaccaagauuuuuauugggauauuugcugaaagaggcucuaagaauaucccaucaccaguaauuagaauuuguuacagguuucagucaggguaguugaaagggagcuaauuugguaacacaauaaccuaguacccaacuaauucaggagcaugaagaaaaauugguugauuaaggcuuaagucagauaaauaauacuauagguugacauggcuggguuagcucagguuuguauauuuguuuuuucaaagaggcagacuuuuccuaagauuagaauccacaguaaugauggaagcaggaaacuuaggggcaggccauagguguaaaaucaaaguugagcugcuucuguguuacagcuguaagcacaggaaguugcccauuuuuuucaagcacuauuucugcauagucauauaucagcuaguguugucaacauagacacaagagacaauaggaauacguacaugcaauuccaccaucagcuaaaaaacccacauaagucuuugaagcucucaaauaacacgcaugacacugaaugguacauuuugaugcacuuugaaacucuuaucucuuuaguugguaaguacauuugaacacuuaauaugugcucagcagaagagaaggagaacaagggaagucuaauauaaaaucaggauuuuuucuuuucucuuugaagccaauuagaauguguguaugugugugugugugugugugugugugugcguguguguguguguguguguguauuauuuaguguaguaauccuuggguuuuuuuuaaaaaaacguguuuuacuaugaaguguaacauacaagaaagugauaacauaugacauauacagcuuacaaaugguuguaagaauuaauacacuuuguaagugccacccaugguaaaaauaaguagguggagaaggaggagaagaaaagaagaauuuaacuagcaugucagaagucucauggaucucuuuccagucacaacccucucaccaagcucgauuccuauucccugaguaaguucuaaucuuacuuuucuuuuuuuuuuuuuuuuugagagagagucugacucugucacccaagcuagaguggugcaaucucgguucacugcaaucucugccuccuggguucaagugauucuccugccucagccucccgaguagcugggauuacaggcaugugccaccaugcugugcuaauuuuuguauuuuuaguagagauggguuuucgccauguuggccaggcuagucuugaacuccugaccuuaggugauccgcccgccacagccucccaaagugcuaguauuacaggcaucagccaccgugcccagccuaaucuuacuuuuaaaguaaucauuuauugcuuuucuuuacaguuuaccacuuggaugugcauccauauguaccauauacaaccauagaguuuaguguugugugucuggaaacuuuacagaaugaggucauacuuuauauauucuuuugucuuguuucuuucacuuguuaucuaugauguugaauguagaugcagucuguucauuuucauugcuauguaguauuccauuaaauaaacgacaacuuauuuauccauucuacuauguuggacaucuggguugcuuacaguuugcauuacagauaauguuccugugaauauaguuaugcuaucccuuggugcauauaggcuugcauuucuguuggacauaguccuagucaguaaaaaggaauaugacagaagucaaugaaacugucuuuuucugaaugaaaauuuagugagccaguaaucuaaugaggaaaacagcuguucuuuuuguuauucuaaugguaggugcugucuggauauaaagaugaccauuucauuugcuuaauaugaaugucuacaaguauguuucaccaagaaaauaaaauacauuuuaguuuuaaaccauaucugguauuauuucuagaauucuaaaauuaacaggauaaaaaguccuuagagggcaaggauucuuucauuuuuuaaauguacuucacagugaccauagcaaugcuauuaagaugcugaaucccaaccaaauaugcauucucuugacaaauauacuuuggaguaaaauuauuuguacaaaugcauauaacuuuucagauguccagaacuuuaauuuuuccuuuauucuaaaaagggggaaaagauggauuccuuuaacuuaaaacuguuucuguuuugaaagccucuauccugaaagauagaaaauaauaguuuugaugaauccauguaauauucuguguucuucacaauuuuucuuacaacauuauuccucuauacauguucuuaguauagauaauauuaauguauuucugaggccauuaauaauuauaauuugggccuuuuguuugccuuuugaaccuggaagacaaaauagauaguauauuaagaugcaaauguauauuuucuaauggacuugugcuucaaagcauauguauuuuagggcuuggccugauuuugccagcuaaggccagaucauuguaaauugauuucaauaucuuucugcuuuuauaagcuuuguucuaaagcuucacaggaagaaucaaaauaauguuugucacacuguucuagcuuagcugaaaucuuguuccuguuuacacuaaaugaccauuggccuaaugcaguuaacaugaguacuuuacaacucauccaagaacuauuucaaguguugaggaaaaggcacuuuaauugaaaaauuacuuaugcaggaucagacugagcgagaaugcuguuuuuuguacauucagcauauuacacauaccacgcuccauuuugcuccuuuguuauaacaaaugaauucuuuuuugcaaugaaaggauucuuaugguuuaucuuccuuggggauuguaacuuucaaaaggugcucuuaaauauauuacuacuuuauuuaaacuauucacuucccagaugugcagugcuuugcacaaagaauaauucacuaaugccuugagcacacaaaaggaaaaugcucugcuggguuucccuuuuuauuuuacuuuccagugguagguuuaugacuugaugcccagcuucuuaauaaauucaccucucacaggacacaguucucuuuaauauguuuuccaugcuuauagaaagaaacacuguauuagcaaacaccaguagaaauuucauuuucaccacguugcuuucucuggguauauauagagaaaccccuuaaagggcuucuccaggacaacugaaaguuaucuuuuucauugaucucuucuguggcuuuaaaauauuuucuugacaacauauuguuuuuauuaaucuaaauuaagcauuuuagauucuuuuaugaauuuaaaagauauuaaaaccaaagaauuggaaaaauaucuaagaaaaguuacuaauuuccauggugggguauagaguugguguguguaggaaguuauacaggcagaggagcauuggaagaaaagugguguuuaaggaagauuacuguaaacuggcagcaggcaagaguccaggacguuuacccuuccaccaaguuuucccagccugcucuagccaugcuauuauuuuacaagcuccuauacauauuauauaauauauaagcaagaauggauggaugggucaaaauaaaaugcuucuaucagcaaguucccuugauaagacagcaauggucaaaauucacaugaaauaaaaagaucuuggauaugguuucuucccgggacuuagaacuuuaauauguuaauguacgucuugagguuccaaaaagggccuuauauuucaaggaaugcugguguuucaagcaacagaguuugggaaacaacaagguaaaugauaaucuaaugcauuuagguaagagguaagugaaaguuagaauauaugcuugagcaacauguaaccauaauggcuguggagucccagcuuugaauaucuuggaagaauagacaauuaucaauguuccucccucucaaaugauccuucucaacacagguugugcuugaugaaucuuuaagaacagaaucuuagcaggauuuugucaaaugccuuuucuucaucuguugagauaaucauguuuuucucuuuuaguguauuagcaugaugaauuccauugauugauuuucuaauguuaaaccaauccuacauuuuucagaugaaccccacuugguuaugacguacuauccuuuuaucccuuuaauauauuguauuugauacucuaaaauuuuguuuagaauuuuuacaucuauguucauaagggauacugguuuguaguuuccuuugcuguaauaucuuuguauuuucugcucuauuuuuggaaauguuugaguaaaauuguuauuuauucauuaaauguuugggagaauuuacccugaagccaucugugcuuggaguuuucuuuuugggaagauuauaaacugugauguccauuucuuuaacagauacacaguucauaccaauacccucaauuccaguccaacaccacaaagucuauucuaguuuucauccuuuccauaccuguaacucccuacccugacaaugagaaaccccucucccaucaucuuucacguacuuccuuauuugguuaaugucucuauauauaacccaucuucuuuugccgcugcugccucuccaauacaagugcccucuucaccucccuuggggucugaaacucugccaagggcagcaagugcuacuuccccuucuaccccucaaugcaugcccuccuuacacuacccaggcugauaccauaugccagacugcccccauugcauggugauauggcuuggcucuguguccccaccaaaauaucauguugaauuguaauucccaauguugggggagagaacugguuggaggggauuggaucauggggacagauuucccccuuucuguucucaugauagugaguucucacaagaucuaaugguuuaaaaguauguggcacuucccccuucauucuaucucucuccugccaccaugugaagauaugcuugcuuuccuuucauccuucugccaugauuggcaggaggacuuccugaggccucccuagccaugucuccuguacagacuguggaacugugagucaaugaaaccucuuuucuuuagaaauuaccuauucucagguaguucuuuauagcagugugagaaugggcuaaugcagaaaauuguuaccagggaauuggggucuugcuauaaagauaccugaauauguggaaacaacuuuggaacuggagaaugggcagaggauagaacaguuuagagggaucagaagaagacaggaagaugagggaaaguuuggaauguccaggagaguuguugagugauuguaacuaaaaugcugauaguguuauggacagugaauuccaggcugagguacucucagacagagaugaggaacuuauugggaacuggaguaaaggucacucaugcuaugcuuuagcaaagagacuaguggcauugugccccugcucuagagaucugugaaacuuugaacuuggaaagauuauuuaggguaucugguagaagaaauuucuaagcagcaaagcauucaagauguggccuggcuacuucuaaaagcuugugcucauuugcauaaacaaacaaaugaccugaaacucaaacuuauauuaaaaggggaagcagagcauaaaaguuuggaaaauuugcagccugaccaugagguagaaaagaaaaauccauuuucuggggaggaauucaaggcugcagaaauuugcauaaguaaagaagagcugaauguuaauagccaagacaauggggaaaaugcuuccagggcauuucagagaccuucacagcagcccuucccaucacaggccuggaggcuuaggauggaaaaauaguuucaugggccagguugaaggucccgugcagccuuaagacauggugcccugcaucccagaugcuucagcucuagcuuuggcuaaaagaagucaagguacagcucgggccauugcuucagagggugcaagcccaagccuuggugacuucaugagccugggccugugggugugcagaagacaagaguugagguuugggagccucugccuagauuucaagggauguauggaaaugccuggaugcccaggcagaagucuugauaugguuuggcucuguguccccacaaaucucaucucaaauuguaauccccacguguugagggagggaggugauugcauuauggaggcaguuucccucaugcuauucucaugauagugagggauucucaugagaucugaugguuuaaaaaguguggcacguccucacuuggcacuucucucuccugcugccaugugaagaagguccuugcuucuccaccuucuaucaugauuguaaguuuccugagcccucccagccauauggaacugugagucaauucaaccucuuucccuuauaaauuacccagucuuggauauuucuuuauagcagugugaaaaauugacuaauacaagccugcugguauuacucaauacaagcagcagggguggagccuucauggagacccucuacuagggcagugcagagggguaaauguggcauuggagcccucacauagaguccccacugggacacugcuuaguggagcugugagaaggggccaccauccuccagaccccagaaucagauccaucaacaacuugcaccaugcaccuggaaaagccacaggcauucaaugcuggucagugaaagcagccacagggacuguacccugcagauccacaggggcagagcuacucaacgccuugggagcccaccccuugcaucaauguagccuggaugugagacauggagucaaaggaaaucauuuuggagcuuuaagauuuagugacugcccugcuggauuucagacuugcauggggccuguagccccuuuguuuuggccaauuucucccuuuuggaaugggagcauuuacccaaugcuugucuccccaggaauuaacuaacuugcuuuugauuuuauaggccgauaggcagaaggaaguuuccuucucucagaugaaacuuuggacuuggacuuuugaguuaaugcuggaaugaauuaaaacuuugagggacuauuggguagccaugauuguguuuggaaaugugagaaggacaugagauuugggagaggccagggcagaaugauauaguuugucucugugucccuacccaaaucucauguugaauuguaauucccaguguugggggagggaucuggugggagaggauuggaucaugggggcagauuucccccuugcuguucuuaugauagugaauucucacaauaucugaugguuuaaaagugaguggcacuucccccuuugcucucucucuccugcugccaugugaaaaugugcuugcuuucuuuuuacccuuccaccaugauuguaaguuuccugaggaaacuuguacagccuguggaacugagucaaugaaaccucuuuucuuuauaaauuacccagucucagguaguccuuuauagcagugugagaauagacuaauacacauggacacccuccucacuuucuccucucuuccugccaacugagucuguguuguucaauuuaaacuguuuuauucaauguaucuguacauaacuggcaaauaauaaauauguaaucaaugacuuaaaaacuacauuuuuaauggacauguucuauauuggacuuugaagaagauauuauugaacuaccugaguguauacucgagcucugcuguugccuaacugugcagccauggagaaauuaaaucaacuuuuuaauauuucuguguccucaucuguuaagugggaugauaauauaaauaauuauaagauaauauuaaugaagauagauuacacgugaugccuacuaugcaccaggugccauacuaaggacuugacauauauuaggucauauaaucuccaaaaugguuuuuuggaggacaugcuauuauauucauauuacagaagagacaguugucguuugauguagugccaguaucucauuuuucagaugaggaaacaaagcacaaagaaauaauuuauucaagaucacauaacuaauaacuggcauggcuguaauccagacacuaugccuccagaaaacaauucugacacauaugaaaauuccuaguacagugcuugcuacacagugggugcuaguaaguaauaauuauguuaauggauaaagugauuaauuauaauaugucugaaucacuauuaucaggucuaugacacaggaagaaucauggcacuguccaauuggaguggggaggaugauccauuuuuagccugaacacaauuggcaauaauuuuauuaacucguuggagguuaaaguucucucuauuuauugcagguugguaaaggaggcauuauuacauagaaagaagacacagacucagaaauagguuauguacuucaaucuaaaaggaaaagaugggaaaaaauucuaguugauagaagauaagaaaaagaacuaauggcacccuagagauauuauaauaaacgaaagacaucaaagcuggacgaaguagcccaguggcuucaaggagaacaauagaagcuugaaaaacaucuaucaauccagaucagcauuuaauaagagccaaaagcccacagauccauuaauuuaaugaaccugugaaccuggaacauuauaggugcucaauauauguuuguugaauugaucugacaauccuuuaaaaagcuuaagucaaauuucuaguuaaaggcacacguauaauaaaagggagaacaggaaagaagaaaacagccucaaaauuuuggacuuaguguacuggagaaagcagauuuuuaaacuguuagugaggaaagcggagcagaaacucaauuuacauuauaaaaucccccaagacccagguauuucuggaaagugagggugaagaugagguuaaggcuucaaugacaguguguuaaugaagcaauuauucuuuuauccuuuucccacuuuguacagcaacugccccugacccucucagcuccuagacagcuggcugucaaaccaaaaugcugcuggcagaaaaauagaaaucuuauugcagggacagaaaagaacucagacccugacaucaggaacuccucaaggaauaacauguugaccuugggcaucccccaagggaugggcccagcuaaauugcccuacagugaagacuauagccaacaagcuauaugcacaugcacagaguuucuaaucagcuuucugguggacaacuuuugguuucagcaaaacagccagagaauaccagaagggcaaggaaagccucuugauaugacugacaccaaacauacuuggaagaaauggaggcacauccgggagaugugcaccaucaaguucagaaacauaagagaaguuguuaccuucauuaaaaaagaucagagugcuauguuuaaaaaaaaaaaaaaucacagaaccaaaaaaaaaaaaaaaaaaaagcuuuuggaaguuaaaauugcaguagcaaauauaaagggaguuuagauaaaauaggagauacauauugaaggcagaauuuaguaaauauugcagaagguaaaauuauaaaaacacaaauauauggaaaguaggagagaaaaaauaagaaaaugggaagaccaauccagaagauuugauaccuaaauaauaggagcucuagaaagaggaaacagagaaaauaaaggcaaggaaaguauacagaguaauuuaagaggauuccucagagcugaaagccauguuuacccagcacaauggucuaaaauagauccacaucauuucauaucaucaugauguuucagagcaucauggauggaaaggaaaucccacaaucuccagagauauggggaaaaaaguuucauaacaggaucaagaaucagaauagcaccauauuucucaaaacacagcaguagaagugauaggacaaugaaaaagugccuucaaacuugugaaggaaaaugauguuuccaauuucaauuccaugccaauccaaaagugugagggcagaaugaagaucucuaaaagucuauuucccuugcacucuuucucuagaagcuacaggaggaugugcuccaccaaaacaaggauguaaggcaagaaagaggaagaacugggacccaagaaacagagacaaggagagucucuaggauggagaaaggagaccucaaggugacagcaguaccuagaaaacaugccugggauggaacaggucagaagucuccaggaagaauuucuucaggaagaugaaauugaucaaacacauauuuuaaauaucucaagaggaaauuugcacacuuugggaaggauuuccauuaaauuaccuacaaauuuauuuuaaaaaguaagcaaaucuacaaaaagaccaugauuacauucagaggauuguaucaccuuaaucuguuagaggacugagaaaguuucaggagaguuccaaucuuugugagggcuagucuauuuccaguucacucuuuauuucuaggauuuagcuuuuaaugaucucagucuaaaaccuggggaauauccuaugcucuauccuaguggacacugaacuccaauuuuguccuguuggccuuuugaguccaucaaagcuuugcucaguuauucagccaccucuucuaaaaucagcaguaacuaaggugaauacagccucaaauuuccagcgcaccucucugcguuucuuacuucuuccugaucaugaucuuucuucacuguuuuguuaucucucugauaauuucaagcaaauuuuaaaaauauuuugucuaguuuuucaacuuguucucagugaaaggguugguucuaauuacaaaguuugccauucaagugaacccccaaaacuuacuuaaaacauuuucaauaguuuuugggguacaggugguuuuugguuaaguaaguaaguucuuuauuggugauuucuagaauuuuggugcaccugucaccuaagcaguguacccuguaccaaauguguagucuuuuaucccucacccugcucucacucuuauccucaagucuccaagguccauuacauuauccuuauaccuuugcauccucacagcuuagcccccacuuauacgugagaacaugugauguuugguuuuccauuccugaguuacuucaccuagaauaauggccucuagcuccaaccaagucacugcaaaugccauuauuucauuccauuuuaugacugaguaugaguagucuauauaccacuuuuuuuuccuuuuuuuuugauggagucuugcucuguugcccaggcuggagugcagugccacaaucuugacucacugcaaccucugucucccagguucaagcgauucuccugcuucagccucucgaguagcugguacuacaggcacgugcuaccucgccuggcuaauuuuuguauuuuuagugagaugagguuucaccuuguuggccagucuggucuugaacuccugaccucaggugauacacccccaccuuggccucccaaagugcuaggauuacaggcaugagccaccgugccuguccuauaugccacauuuuuuuaaccacucauugguugaugggcauuuagguuggcuccauauuuuugcaauuggugaauugugcugcuauauauaugugugcaugucuucuucauauaaugacuuuuuugggggagguccaaaacauacuuuucaucuacuaacucuguguaucccuauauguaggaauauauguagaugcaauaaaguuauauaaaaaggaaaguaagggccgggugcaguggcucacaccuguaaucccagccugagcaagagugauuaaaaaaaaaaaaaaaaaaaagguaaguaaggacaugauaaaaacaagauaggcugugugugaggagaagaugguagaugaagguuauuuccaagucucuagguuucaucugagaugucgggucaagggagcuaauuacauuauuuaaauauuuuaguuaaauauuauaacuaaaagaaguucauacauaaaccaaugauaaguauauguuauaaauuauaauuaauccaaaucuguguaucucaguuucaauaaaaagaaaaaacuuaugcaggaaaggaaauauaguauauuauguggcacaggugaggauagcauuuaaguaaugugaaugaauacugaauggugaucuaacuaaaauuguccauagagccaaaauuuaaaauuaaaaguguguauuuauguggaugaacaggaugcaaaagauaagcaaaucuucaucuucuauacugggaaaucagcagauaauggcuaaaauggaaaagugaagaaaucauauaauaaucauuauuugaaguaaaaacguaaagaaagagaaucugcuaccaggguucaaaaugguugccuggagguacagugguggaguugggagugagaaaauaaguugauauuuauuuauaacaagauuguuaagguuguuugacucccuaaacugcuuauaaaaucgguaaauuuaguuaaaauaaaaauuaaaaauaauuuuuaaacaauaucagaacuaacuaaaaauaaaagaaauauguaguacaaaauaaugaaaacucauaucugaguauacuuugccuaaaacuuauccuaucaauuaaucuauuauuucaaccaauugguuuucagccaauuccuuuacucuuuuucacauggcaaaaguaugcuaugccugcuuucaauuaaaaaaaaaaagcugaagaaaguaugugcgguucaucugcauggauuuuuuaauuuuuuuuauuugaauuuaauuuaauuuaauuuuagguuccaggaugcaugugcaggacaugcagguuuguuacauagauaaacaugugccauggugauuuguugcacuuaucaacccauuaguuaaguauuaagcccugcaugcauuaacuauuuauccugaugcucuccacccccaccaccaacaggccccaguguguguuguuccccuccuugcguccauguguucuccuuguucagcucccacuuauaagugagaacaugugauguuugguuuucuguuccuguguugguuugcugaacauaauggcuuccaacuccauccaugucccugcaaaggacaugaucuuguuccguuuuauggcugcauaguauuccauuguguauauguaccacauuuucuuuauccagucuaucauugauaggcauuuggauugauuccgugucuuugcuauugugauuagugcugcagugaacauacacaugcauguaucuuuacaauagaaugauuuauaucccuuuggguauauacccagugacgagauugcugugucaaaugguauuucugguuccaggucuuugaggaauugccaugccaucuuccacaaugguugaacuaauuuacauucucaccaacaguguaaaagcauuccuguuucuccacagccucaccagcaucuguuguuccuugacuuuuugauaauggccauucugacuggugugugaugguaucucauugugguuuugauuugcauuucucuaaugaucagugauguugagcuuuuuuucauguuugugggauacauaaaugucuuccuuugagaaaugucuguucauguccuuugcccacuuuuuaaugcaguuuuuuuuacuuauaaauuuguuuaauuuacaaguaaauucugaauauuagaccuuugucagauggauagauugcaaaaguuuucucccauucugcagguugucuguucagucugaugauaguuucuuuugcugugcagaagcucuuuaguuuaauuagaucauauuugucaaguuuugcuuuuguugcaauugcuuuugauguuuucauccugaaaucuuuggcugugccuaucuccugagugguauugccuagauuuucuucuaggguuuuuauaauuuaggguuuuacauugaagucuuuaauucauuuugaguuaauguuuggauaaaguguaaggaauggcuucaguuucaggcuucugcauguggcuagccaguucucccagcaccauuuauuaaauagggaauccuuucucuauugcucauuuuugucagguuugucaaagaucagaugguuguagaugugcagucuuauuucugaguucuguauucuguuccauuggucuaugugucuguuuuuguaccaguaccgugcuguuuuguuugaaguuggguagcaugaugcuuccagcuuucuucuuuuugcuuaggagugucuuggcuauaugggcucuuuuuugguuucauaugaauuuuaaaguaguuuuugcuaauucugugaagaaugucaaugguaguuuaaugggaauagcaaugaaucuauaaauuacuuugggcaguaaggccauuuucaugauauugauuuuuccuaucgaugaguuuuucgauuuguuugugucuucucugauuuccuugaguagugguuuguaguucuccuugaagagguccuucacuucccuuguuaacuguauucucuuuguagcaauugugaaugggaguucauucauguuugggcucucugcuugucuguuguuggcauauaggaaugcuugugauuuuugcacauugauuuuguauccugagacuucgcugcaguugcuuaucagcuuaagaaucuuugggcugagacgaugggguuuucuagacacagaaucacguuaucugcaaacaguuugacuuccucucuuucuauaugaauacauuuuaucucuuucuccugccugauugcccuggcuagaacuuccgauacuauguugaguaggaguggugagagaggccauccuugucuugugcuguuuucaaggugaaugcuuccagcuauugcccauucaauaugauauuagcuguggguuucucauaaauggcucuuauuauuuugagguauguuccaucaauaccuaguuuauugagaguuuuuaacacgaagggauuuugaauuuuaucaaaggccuuuucugcgccuauugagauaaucaugugguuuuugucuuuaguucuguuuaugugaugaauuauguuuauugauuuguguauguugaaccagccuuguauccuggggaugaagccgacuugaucgugguggaucagcuuuuugaugugcuacuggauuugguuugcuaguauuuuauugaggguuuuugcaucaauauucauuagggauauuggccugaaguuuucuuuuuuguuguaucucugccaggauuugguaucaggaucaugcuggccucauaaaauggguuuucagugguuuggaauaguuucagaaaaaaaugguaccagcuucuuuuuguaucucugauagaacucagcuguaaaucugucugguccuggacuuuuuuugguugguaggcuauuuauuacugccugaacuucagaacucauuauugggcuauucaagaauucaccuucuuccuggcucagucuugggaggguguauauguccaggaauuucucccuuucuucuagauuuucuaguuuauuuacauagagguguuuauagcauucucugaugauuguuuguauuucuguggggucaguggugauauccccuuuauaauuuuuuaucgugucuacuugauucuucucuuuucuucuuuauuagucuagcuagcagucuauccauuuuauuaauuuuuucaaaaaagagcuccuggauuuguuaauuuuucaaaggguuuuucaugucucuuucuccuucagugccacucugaucuugguuauuucuugucuucugcuagcuuugggguauguuugcucuugauucucuaguucuuuuaauugugauguuagggugucaauuugagaucuuucuagucuuugaugugggcauuuagugcuauaaacuuuccucuuaacacugcuuuagccaugucccagagauucugguggauugucucuuuguugucagugguuucaaagaacuucuugauuucugcuuuaauuuuauuauuuacccaggagucauucaggagcaguuguucaauuuccauguaauugugugguuuugagugaguuucuuaaucuugaguucuaauuugauugugcuguguucugagagacugucgugauuucaguucaucaaaaaaaagauuauuuugcuuuugcugaggaguguuuuacuuccaauuaugugaucgauuuuagaguacgugacauguggcacugagaggaaugcauauucucuuguuuugggguggagaguucugugcauaucuaucagguccacuugauccagggcugaguuuaagaccugaauaucuuuguuaauuuucuaucucaauaauuugucuaauguugauaaugggguguuaaagucucccacuauuaucaugugggaguguaagucucuuuguaugucucuaauaauuuguuuuaugaaucuagggucuccuuuauugggugcauauguauuuaaaauagcucuuccuguugaauugaacccuuuaccauuauguaaugcccuucuuugucuuuuucaaucuuugucgguuuaaaaucuguuuugucagaaacuaagauugcaauccuugcuuuuaucugcuuuccauuugguugguaaauuauccucuaucccuuuauuuugagccuaugugugucuuugcacaugugucucuugaauacagcacacuaaugggucuugacuguuuaugcagcuugccguucugugucuucucauuggggcacuuaacccauuuacauuuaagguuaauauuguuaucugugaauuugauugugucaucaugauucuagcugguuauuuugcagacuuguuaauguaguuccuuuauagugcuauuggucuuugcacuucaguguauuuuugugguggcugguaauguuuuuuccuuuccauauuuagugcuuccuucaggagcucuugcagggcaggccugguggugauaaauucccucagcauuuggcugucugaaaaggauuuuauuucuccuucacuuaugaaacuuaguuuggccagauaugaaauucuggguuggaaauucuuuucuuuaagaauguugaauguugacccccaaucucuucuggcuuguaggguuucugcugagagguccacuguuagucugaugggcuucccuuuauagguugcccggucuuucucucuggcugcccuuagcuuuuuuuucuucauuuuaaccuuggaaaaucugaugauuaugugucuugggauugaucuucccauggaguaucuuaaugggguucucuggauuuuguaaauuugaauguuaaccugucuugcuagguuggggaaguucuccugaaugauauccugaaguauguuuuccaacuugguuucguucucccugucucuuucagguaccccaaucagucguaguuucagucuuuuuacauaaucccauaguucucggaaguuuuguucauuccuuuucauuguuuucuugucugcugucuuauuucaguaagauagucuucaagcucugaaauucuuuccucugccuguucuauuuggcuacugauacuugcaguugcauugugaaguucuugugucggguuuuucagcuccaucaggucauuuauauuccacucuaaacugguuaugcugguuaacagcuucuguaauguuuuaucaugguucucagcuucucugcauuggguuaggauaugccccuuuagcuuaacaaaguucauuauuacacgucuucugaagccuacuucugucaauucauccauuucagccuccuccuaguucugugcccuugcuagagagguauugcaaucacuuggagaagaauaagcacucuggccuuuugaguuuucagcauuuuuuguuguuguuguugauucuuucucaucuuucugaguuuaucuagcuuugaucuuugaggcuccugaccuuugagugggguucuuguggggacuuuuuuguugaugcucuuguugcuuucuguuuguuuuucuuuuaacagucagaaugcucuucuguagggcugcuucaguuugcugggagucuacuccagacccuguuugccugggucccucccacaccuggaggugucaccaguggaggcuacagaacagcaaagaagacugccugcuccuuccucugggagcucugucccagaggggcaccacccugaugccagugggaaugccccuguauagggcgucuggcauauccuguugugggggucucacccagucaggagacaugggaucagagacccgcuuaacaaagcacucuagcugcuccucaguggagagggugugcugugcuggggaaaucccacucauccagacugcccugacuccucagagacaccaggcggaaagacuaagucugcugauccgcagagaccauggcugcccuuccccuacgaggcucugucccagggagaugugaguucugacuauaaaccccuggccugaguagcuaaaauucccacaaggaggccccacugguugaggagggacggguaagggucuggccuaaagagucagucuggccaugaucugccacagccacugugcugugcuguggggaauuccuccuggguccaaaccacccaaucuccccagcauccacaggggaaaaccagcagacuggagcugcagugguggcugcugccccucccacugggagcucagucaucuuaggcagcaggaagccacagugauaauggccacccuucccccugggagcucaguuggucuuaggcagcaagcagcugcagugaugacagccgcccaagccccugggaacuugguagucuuagucagccuccagccgaaauguccgcugagaaccugcacagcucugugcugggaaccaaagcccugguggugugggcucaugagaggggguaucgugaucuguggguugcagagaucuguggaaaaugugugguuuucccaggccguguagcacaaucacucaccgcaucucuuggcugggguugggagcuccccuuccccugugcagcuccugagugggccaucacuccacccugcuuuuccuugcucuccgugggucacgccaacugccuaguuagucccagugaaagaaccuggauaccucaguugcugguacaggauucacuugccauuuucguucucagugggagccucugacagcagcuguuucuguuuggcuaucuuggccccucccccagcacagauuuuuauaaaacuaauggcuauagugcacaguccuaagauuccgaaaagagguuaaacuuuuauuugggaauaauacacugaaaagacagguacgauguuguucugauugaaaaagcuccauaaaauaauugaacacguacuauuagguaaacugaaaacuagaaaaauuauuaucuaaaugauguaacauuauuaagcacugugacaaggauucuagcaaaacugcaaaaaauccuguuccgcacuucugguauaaaauaucuuuuuguucaggcaugauggggcacugugucugcuagccauagucggcauguuuuaucuucuaguuaacguauaucaaacccagcacucaaauacaacuuuccagauccuggaugugacagugaagcacuguucagagcccauuuucuuuggccauugaucucagaugcacccugaaacaaaaguauuuacaacaacaaugaaagaugaguuugcauggaacauuuaaacuuuauguucuuuaguuuugccaccucuaaaaugagaauaaucauuuuagcuuaccuauuagaguuguuccaaaaaguacuuaagaugauugugaaagacaaucaccuuaaagaaaaaaggacuacuugaugguuacauauuacaauaagcacaaaagaaaaguggacuuaaguuucauaucaggguaggaacaggaugguuucagcuuuugagaguaucaugaguaggugucauuuaacugaaugaauggaaugaaccauguguauuauauaaauaagcauauacauauuuuauaaucuugugauauuuaccagauacuuguuaucuacuaguucuuuguaaaauacaaaauauguguauauuuuuguguugaccuauacacaaaacucuaauucaggacuuuagauauagccaacgaaacagcuacuuucagcucccacaaaaguaaaugaauauacaacguauuuugccaguaccauaagcaaugagucaacaggccccauaacauuuuuugguuacauguuuugagugaccacauuuugaguuacagggauuacagaucucauggccauaaaaaguaauaacacucccaccccaucaguuauugcauuuauaucuagcuuauucauuucugccuccacauuggguaacuagggaaacaaugaugucacugcucagugugguacuuagaaacuucuuuaauuaggcuuaugguuggggaagccuacagucauuuaaugagucucaccucuaccacugcaauaaacucauagaacuuuuauuuuuccgggcugcugauaggggaaagauuauaauucuaucuaaugcauuguuuuggaaaaaauauguauucuaaagcauauuuuuacugaaaaaucaucuguguguuugcaacaggaguuuuuugauguacauugacaacauugaggcaauuauaugacccaaauuaaauguuccuugugggaccgugguccuuugagcagucauccuuccccuggcccuuccuggcaccuagcuuuuggucugagaggcuggguuuccauuuugcucuucuuuauuaugauuuuuccuacucugucauguugguaacagcaaguuuuaaaaaauaaacaguaucugaauguaaaagccaccugcccccaaaaugggauagaaauuaaauaucagucuuucuaguaaaauaaauaaauggucacucaguacagcucagccaucacuugcuuaauauguuugauauaguuuggauauuuguuuccuccaagucucauguugaaauuugauccccaguguuggaggugggaccuggugggagguguuuggaucauaacgacagauaccucaugaauggcucaguuccauccuugugauaaugaaugaguuccuacuguauuagucucugugagaacugauugucuaaaagagcauggcaccuucuccucucucucuuuucuccucucucacuguuagaugccuguucccccuacucuuccuccgugaguggaagcuucuugaagcccucacuaaaagcagaugcugacaucaugcuucuuguacagcacccacaggggaaaaccagcaguaaaggcugcagaacuaugagccaaauaagccuuuuuuuuugauacauuacccagccuuagguguuccuuuauagcaaugcaaauggauuaagucaauguuuguguucuuaauuuccaaaauuauuuccgucaucuuauuuuuucaaacuuucuacacucccaacugcccucccucagcuguugaccuaauaauauaauuuguugagaaaauggaagcaaccagagaugaauuccauuauuuucccaccaucuaagccacacaccuaccuauauccacaccugucuauacucuaccuucccucugccucuaugaaugaagggucccuguucugggcaaaggccaaccccuauccuugggcucaagauccuaccugcucuaauucccaauuuccccuccccaucuugcauguguuucuuccucucuguugggcaugcuuaucauuccuauggucuacugucucccaacuuuaaaaaaccuugccuugauccaaccuacagaaugggaaaaaauuuuugcaaucuacccaucugacaaagagcuaauaucuaaaaucuacaaagaacuuaaacaaauuuauaagaaaaaaucaaccccaucaaaaagugggcaaaggauaugaacagacaauucucaaaaggagacauuuaugcagccaauggacacaugaaaaaaugcucaucaucacuggccaucagagaaaugcaaaucaaaccacaaugagauacuaucucacaccaguuagaauggcaaucauuuaaaagucaggaaacaacagaugcuggagagguuguggagaaauaggaacacuuuuacacuguuggugggaguguaaacuaguucaaccauuguggaagacaguguggugauuccucaaggaucuagaacuagaaauaccauuugaccuagccaucccauuacuggguauauaaagcaugcugcuauaaaaacacaugcacauguauguuuauugcagcacuauucacaauagcaaagacuuggaaccaacucaaauggccaucaaugauagacuggauuaagaaaauguggcacauauaccucauggaauacuaugcagccauuaaaaaaaggaugaguucaugucauuugaagggacguggaugaagcuggaaacgguucugagcaaacuauugcaaggacagaaaaccaaacaccacauguucucacucauaggugggaauugaacaaugagaacacguggacgcagggcagggaacaucacacacuggggccugucgugggguagggggcagggggaaggauagcauuaggagaaauaccuaauguaaaugacaaguuaaugagugcagcaaagcaacaugggacauggauauauauguaacaaaccugcacuuugugcacauguuuucuagaacuuaaaguauaaaaauaaauaaauaaauaaauaaauaaaaauaaaaaaaccuugccuugauccuauguagggucaagcuguuggcccauauuucuccuccccagucacugucaagugcgauauauuucaaaagggagacaauagcugagaagucaaagguccacaggauuuggacccuugaaagaaugucuaccauuugcugucuucauuuccccauuuccuauucucuucaaacuccucauauugagugucuucuccacuggaacugcucuugucaggguucccaguaauccaaucuagucacauccuguggaccuuggccucuugggagcauucaacacaaauuaauacugucugguucuugaaauauugguucccuccagcgccucugcccggccaccucaucugggaagugaggugccccucugcccgacugcccaccaucuggcaagugaggagugccuuugcccagcugcccacugucugggaagugaggagcaccucugcccagccaccccaccugggaagugaggagcaccucuguccggccgcugccccaucugggaagugaggagcaccucugccuggcugcugugcaacuuuccaagugugaagugacagccuugugugugauuuuuccugucuuccucaaguuugcauuuuugacauuaaaguuuacuuuuuaauuaaaaaaaaaagaaagaaauauuugguucccuccuaaaacagagccugagacaaagacuuguagucagaugguuuauuuggagaaggauuccaggaagcugaagugagagguuguauuaguccauuuucaugcugcugauaaagacaaucugagacuuggcaauuuacaaaagaaagagguuuaacggacuuacaguuccaugugguuggggaggccucacaaucaugguggaaggcaagaaaaagcaagucacaucuuacauggauggcagcaggaaaagagagagcuugugcagggaaacuccuguuuuuaaaaccaucagaccucaugagacuuacuuacugucaugagaagugcaugggaaagacucacccccaugauucaauuaucucccaccaggucccucccacaacacauggaaauuaugggagcuacaggaugagauuugugggggacagagccaaaccauaucauuccacuccuggccccucccaaaucucaaguccucacauuucaaaaccagucaugccuucccaacagucccccaaagucuuaauucauuucagcauuaacucaaaaguccaccauccaaagucucaucugagacaaggcaagucccuuccaccuaugauucuguaaaaucaaaggcaaguuaguuacuuccuagauacaaugggaguacaggcauuggggaacuacagccauuccaaacaggagaaauuggccaaaacaaagggccuauaggccccaugcaaguccaaaauccaguggggcagucaaaccuugaagcugcaaaaugaucuccuuugacuccaugucucaaauccaggucaugcugaugcaagagguggguucccauggucuugggcagcucugccccuguggcuuugcaggguacagucucccuccugcugcuuucaugagcuagcauugagugucuguggcuuuuccaggcauacagugcaagcuguuuguggaucuaccauucuggggucuggagaaugguagcccucuucucacagcuccacuaggcagugccccaauagggacuuugugugguggcuccaaccccacauuucccuucugcacugcccuagcagagguccuccaugagagcccccacucugcagcaaacuucugccugggcauccaggcauuuccauacauccucugaaauuuaggcagagguucccaaaccucaauuauugacuucugugcaccugcaggcucaacaccauguggaaaauuccaaggcuuggggcuugcacccucugaagccacagcucgaccuguaccuugccccuuugagucacggcuggaguggcugggaugcagggcaccaagucccuaggcugcacacagcauggggacccuuggcccagcccaugaccauuuuuucuuucuaggccucagggccugugaugggggaugcugcugcgaagaccucugacaugcacuggagacauuuuccccauugucuugggaauuagcauuuggcuccuuguuacuuaugcacauuucugcagccagcuugaauuucuccucagaaaauggaauuuucuuuuccauugcauugucaggcugcaaauuuuccaaauuuuuauacucuguuucccuuuuaaaacuaaacaccuuuaacagcacccaagucaccacuugaaugcuuugcugccuagaaauuucuucugccagauacccuaaaucaucucucucaaguucaaaguuccacaaaucucuagggcaggggcagaaugcugccagucucuuugcuaaaacauaacaagaguuauguucccaacaaguucaucuccaccuuagacuaccucagccuggauuucaugguccauuucauuaucagcauuuuggucaaagccauucaacgagucucuaggaaguuccacacuuucccacauuuuccugucuucugagcccuccacacuguuccaaccucugccuguuacccaguuucagagucacuuccacauuuuuggguaucuuucaggagcacccuacucuacugguaccaauuuacuguaucaguccauuuucaugcuguugauaaagacaugcaugagacugggcaauuuacaaaagaaagcgguuuaauggacuuacaguuccacauggcuggggaggccucacaaucaugguggaaggaaagaaaaagcaagucuuaucuuacguggguggcagcagguagagagagagcuugugcagggaaacuccuguuuuuaaaaucaucagaucucaugagacuuauuuacuaucaugagaacagcaugggaaagacccacccucaugauucauuuaucucccaccagaucccuccuacaacaugugggaauuauaggagcuacaggaugagauuuggguggggacacagccaacuauaucagaggucauagagaagaaaggaaagucaauaaaagguccuauuacggaaguggccacaguuacaggugauuggugcaagaagugauuaauucaugagacccugaagagugugauaaaauguaccuuagaaccaucugccugggggauagaaagggaagcauguaucuacuggaucucauuucccacagcucagagguagucucacaaguguuaucuucucagucucaguucaugcacaagugucagcagauuccuauuucaugggucagauaagccccagggcagaaagggggagauggcugguuucuaccugagacaggcacuucccauuuguaccuguaugaagcuguuagagccuucaugggacaugucacugcagcaguggcuggagaccagcuuccugacaccacacuuaucaagcacauguagaagccuuuugugcugacuucucugcuucucaucccaauguuggcauucucccauggcucugugcugaagcugcugcuuuuaaaaauccaaucacucucacaugugaccucauucuguuccauagauguaaauguaucuauuugacucccaaaucuacccuaaucucuacuuagaacuccagacuucaguaucuacuaauagucugcuugacagaugugcaaauggagucuaagaugcaucuuaaacugaauauggcaaaaacagauuaguuguucuuccaacaucaccaccacugcugccacccaaaaccuucucuauccccagucuucagaggaucagcauccaucaaguguugaaaagcaaauuuagaaguuagcccuuauuccuauauuucccucauccccauaucagcaaguccugggaaugcauccuagaagccauauccuccccuucuccccaucucugcuaccacugccuagcccaagccaucagcucucaccugacccuacgauagcuucuuaaugcuccguucuucccacaaagcuuucaguuacuaaagaaauauguucuaauuacauauucuuaauguuugcuuacaaaguuaucucucugucaaacuuucaaacuuuuucauuacugaaauaaaaccauuuaugauguuucuuaacgagagcaugcuaacauuugccuauuucuauucccccauuuuuuaugcuugaacuauguuuacauugucaaagcaaauaacuauuacauaucuuuuaaccuuuauuaguucuuaguacuuauuuagucuuaguucuacaaguaaccaugaaucuauugcucaucaucagcccuuguguaauaucucugaguuauuguugucugaaguuuauucucuaguacagcaguccccaaccuuuuuggcaccagggaccaauuucauggaagacaauuuuuccaugaacagagagauuaggggauggcuucgggaugaaacuguuccaccucagaucaucaggcauuagauucucauaaggaacccacaaucuagaugccucacaugagcaguucacuaaacgguucaugcugcuaugagagauuaaugccacugcugaucagacaggaggcggagcucaggcaguaaugcucgcucaccugcugcucaccuccugcugugcagccugguuccuaacaggccauggaccagucccagggucuguggacccccagguuggagaucccugcucuaguagauuccuaaagaaucacuuaugggaaugacauucuuugaguugucacauauugauacuaguuugugcccuuuguagugaaaaauauguuuuugcuagauuuaaaucuuuggcuuauauuuucuuuucuugucuuaaauauguuacuccauuuuuuccugccacaaagcauugcuagaaauguuugauugauuauguguaaucuaauuuucuuuuuuggggaagagaggguagaugcucaaauaauuguuucuuuuuaucugaagacuacuaagcuuaaaauguaguuucaaauauuugucugcuuuaggaauuuuuuuauuuauacuuuuuaguguuuguucuguugccuuguuuuucuucuucaagaauuucuauuauccauauauuggaucuccuuugacuguuuucaguaucugucauuuuuucucaaauacuuuuuauuucuuucuuccuuuuauuuaaaaauaaacuuccccuuucacuuucuauucuuuuuaagguguuuuauuuucuuuuuauuuucaugcuccuuuuauuuuauucuucauuucaaaagugauuguuuaauuucuguuucuuucucaaguuuugucaccucauuuuucuacuucugauuuauguugcucuguuauguuuuauuuucuuaauaucuuuuagaucauuuugaaguaauagguuggccuggcacaguggcuuacaccuguaaucccagcacuuugggaaggccgaggcaggcagaucacgaggucaggagauagagaucauccugaccaacauggugaaaccccgccucuacuaaaauacaaaaauuagcaggcgugguggugggcaccuguaaucccagcuacuugggaggcugaggcaggguaaucacuugaaccuagaggcggagguugcagugagccaagauugugccacugcacucaagccugggcgacagagcaagacuccaucugaaaaaaaaagaaaaagaagagaagagaagagaaauaauagguuaauguuuaucuauuuuaugggcaugucuuucugaaauccucucacugacuaggaauguuauucuccuccuuauucuauuuuuuuuuuaauaacagcaugaaaucugacuucaguacuucaguguuuauuuuuauguggcauuaguuugccuuaacuuuuagaaagaggcuugauucagggaguuuuucugauuucacagagcuaccgcuuguuuucuuaugguguuaacauaauaccguagcuuguguucuuaaauuuccugauuuugcuucccucucccacuuuuaucugcaccauuucuuuccaugcucucuguugucuugguccuuuugagguuugguuuacuaucagcccuuuugcuauaguguuggggcccuggccuggaagggagcccuggcugaucauuuucaaaaguuuauggacucuucagauuuuacugugcaccuuguaaucaccuacuauuggaguagaugaaacccuguugguuucaccuguugucugcuaauuggccugcuaugcuuucagugaauucugaacucuccugcuuucacaucugggagaugcccuauagcuucucucagcuucccucugcacagaugcuaauaugaggcaaaucuuguggcuauuggugggucguccucacccacuuguauuuugggcuaucuccaugaaccaaguuucguuguaaauguaguccauggcuuuuggguuaaacucucuacuuguuuucuguuuuuaugcagggauuuggcuuuuaucaccauugccauucucuuguagcauucucaaggaacuagccacuuuaagcaacaaaucaaucagccaaauuuucuuugagucaacuguaugguuauucuauuugaaaugauaaaacuacuugauauguaccaacauaaacaaauuuuacuuuuaugaaaguaaaacaaaauguaugucugcuuuuuugcuagcccaaacuugucucugcuuagagcccuaucaaaaauggugucacaaaauggaguauagugcuccuaauguuaauacuuuucaggugauuugaucacauaaauguaaauguuagagagguuuauaugguucuauuuagugcauuaauauuguaacugaaguucaguuucugacuucauacacaagaguuaauaaauaggcacauuuaccuacugauuaaguaaaaauagcuucccacacugaugauugaacugacaaaggcuuuagggaauuagaacuuaaaauuuuacuugacauucugcucaccuuaccaugugaccuaauucaugacugcuuuacccauugcuuuaaaauaauauucacccagaacuaguauuuuuaaagauaauuuaagauguccccaccaggccagucuggcaagugcagcuucuuaagacuauaagagauuaugccucuaauauuuuuauuguugaagagauaauacccaguaugauuucuuuucacuuagacuuccgaauauggaauauuuucuuguucuaaaucaaaguaugagaugucuuuuuuaaaaauaaugaaaccaccaucacugauggagggagagauugaucguuagauguaacaugauaugagaaagccaguguaauauguaaaacuuugaugguaaaauauagaugaugaguauggagauguuuacuauaaaauucuuucaacuuugcuguaugcuugagaauuguuuuaauaauguauuagagaaaauaccacauaaacuuugaaucucugugaaagagaaauggaaaaaauucuuggauuucauucuaaaaguuccuuauuuaaaaccaaauaaacuuuguaagguuuagaggaauuguauuuugaaaguuuuuccuauguguaucuaagcacauuuuaauaacuuucaugaacuaagaguuucucaaaaacagguuguaucuguucuucuuuacagaaguucucuauccaaaauaguuucaggaaggagguuuccgugauacaggcuuaaaauaaaaacugaguuaaaaaaaauuuggcuggcugaauauggugccagaagaugcugguguagauaaggcuuccuccccaugcacucaugcucaccaugggcuuuuauuuuuuagcuggaauaggagggauguguucgguugagggcauaggcuguaagaagauuuuaaggggaugcugucagcuuugccaucuaccccuagaaaugggauugaucccucaggauuagagaaauaaaagccagaaagcagaccuccugaaacucuggacaaaagcagaccugcuguggggacuccaugaaugaguguccagaaagaaagaaaaaggccauucuuccaacucuguguggaagucaggaggacugcagcaucuugaccauugccaguuuggggaaccuccaauaaccagcauccuuagcauaaacauuauuguucucaaaaugcaagccuucagcagaaaucaugguggaguucagucaaccagauaccugggcagugguaaggacaucugcaugggagaggaaacgguggaggacguaaaugaggcugccaugacagauugguuaguaggcaccuaggaggcucccucaguggcuuacagaaacaaaugaggaauacucagaguuaguuucucguuuggggauagguuacuuaaaaacuugccugagguaggaauucuugcccaagugacugauuugagcaccguucuugggagaagcgcaugagagaagcaggauagggaaggggaagaaagcuacucaagaacgaagucucagcuggaaguuagcuuccaucggaccccacgcacggauucuggaaagugaaucacaucacagaauuggccuuuuguacuccaugucucagccagucauuggcugauguuugcccccaagucccaaguguagagggcuggaauagccuuc

SEQ ID NO: 17405 - RNA, 1160 nt, Homo sapiens
gcaaauuauguuggaauaauugggcauccauccaugcaugugccaaaauaaaaaaagaaccucaacauaaaccuuauacuucauacaaauauuaguucaaaguggaucauagauuuaaauauaaaacuacagaacuuuuagaaaaacaggagaaaaaucuuuguuuugguauuaggcaaagaguuuuuagacaugacacuaaaagcaccaaacauaaaggaaaaauaugauaaacuggauuucaucaaaaugaacaauuuuugcucugugaaagacauuggaugagaggaugagaggacaagcuacagauggggaaaauauuugcaaaccacauaugugacaguggagugcuaucaagaauauguaaagagcucaucaacucaacaguaaguaaacaagcaauccaauugaaaaaugagcaaaagacuugaaaagacauaucaccaaaaguaugcaguuagcagaugggcauuugaaaagauguuugauguaguauacauuagggugaugcaaauuaaagcccuagggagauacaacuauguaucuauuaguauguuuaaaauaaaaauacuaaugauaucuagugcuagugaggaugcagucacuggaaaucuuauacauugcuguuggacaccuagauuguuagucacuuuggaaaaguuaguuucuuuuaaaguuaauaaguacauugacuauaugauucagcauuccuacuccuggguauuuauccuagagagacaaaaacaauguuuacacaaaaacucguuaagugaauauuuauagauugccaguaacuggaaauaaccuaaacauucuuccaugggugaauggauaacuauuguacauccauacaauguagcaccgcuggguggcagaagggugcgacuguaaagggagagcaggaaggagcguuuucgggaguaauggaauaguucuguuucuugauuuuggugguagauacacaaguguauacauguguuaaacuugauagggcuauacaccaaaaaaaaaaauuuuauuuuaccauaugcuaauaacuuucuuaagcuagagauuugcaaaaccuguauuuguaccuccagugaaagaaacucaaauuuaaguuguuugagggagguggcccuuaagucauuuucuguggcccugggaaaaauucuuuc

SEQ ID NO: 17406 - RNA, 1246 nt, Homo sapiens
auuucauuacauccgcucaaaaugaacagcugcuaagucaucaaguucucucaacuuugcuucuaaagagaaaaguuuaguuuuagugcuucagugaaauacuuuuuugaaagaaugacuuuuauaaaauucauuuguuuauuaugguaaauaaacaacuuaauggcaagggguguguuccuuguaaaggugaucacggaauguuacccagaauaacacagacaucucauuucccagagaaggaaaugguuuuauaaguuuugugaggucucuugucugcuuggccgguuuacagugcuggucucuggagcugauccgccccuuugcuuuguaagucucagcaauugacgaggcuaggcugggcgcugggcuuuucuuuuuuuuuuuuuuuuuuuuuccuuucucacugcccugcgguguuuugaacugccuucuuacagacgucauacagcccuugaggaauaguuucugccuggugagauugaaugauaguucucauucacaaaacccuggauucuaagcagggacacacagaaauuacuuucgcagguaaaucagcccacccagccaaaguguggagagauuuguuccuuggcugacuucuuugcuccacggagaggaguguuuuccugugcuugcccugaaauggaacuuccuugacagcucucccguguuacaguaccucccggucauuuucuuuuucucucucucuaccugcgcucuucgagugucagaaaccuuuaaagcuguuacuauggaauugcaaaaaagagaucaagugacucuuucacuaugcugguuucccuugugacccagaugaagaaucaauucagaauucaguuccucccuuggcauugcaagacacagaagaaacugucacuuccuaacagccuaguacuggaguaaauucaguaugaaggaagaaagcgcuccugcguguuagaaccuugcccaugagcuggaccgaggacaggagauggacuccaggaaaauuggauuucuucaagcagccucccuuggaaauggaauaucuuuaaaaucuucuuugcagaaagacaguuagaauguauuaaucagaauaguugaagacuuauuuuccuuuuuauuuuuuuucaaaaugagcauuauuaugaagccaagaucccgaucuacaaguucccuaaggacugcagaggcaguuugguaacguucuuuucucucaugcuuuuccccuuuucucuuuuaagauugacguacuccuugagua

SEQ ID NO: 17407 - RNA, 1185 nt, Homo sapiens
auucugaaacgcaaaggacuccccguuccuaaucagcgcugcaauccaccagacagucuccuucugccggcagcuugccaguuaagacuuuguuccuuagcguucuguccugcaaggacccccugaaggagaagagagggcuaaguggaucacagcguguccuccgugucugagcuuucagagccgugugugugugugugugugugugugugugugugugugucccucaaccaagguuagagacuagucaaugcugcuucugauuauucuucagguuuuacuaaaaggcuucagucuuugauauaaggcuauucccccgacacaguggcuaagacccucuuguguaagugcuccuagcucacucucuggaucagaaccagcgcccagguccccacgugaagcccauauucaccccagauggcagcaugcaccuccucuccuuuuuuuaauaaagaaaaagaaauaggagguugggaggagaaggaaaauaaucauagcugaauaauaauagcagaauaggaaaauaguaucacuaagaauuaaauauuucacucuaaauacucaugacuuguuaagaggucugcucucaaaagcugaauucacaagggaguuaauacauacuaaacccaguaugcauuccuaccuagcaguuugggggcaauuauuauggggaugaugaacuuucuccauuuacaguggaguguauuaugguccaaaucuacccuaaagcauuugggaaaugucuacaguucaaauuaagauguuuagagucaaggucauuucgcuugaugauggaaugauacaugucuaguuagauuucaucugaccaaucuuugacacaaacacaucagaauugucuugguauccaccaaccaaauaauguuuguuucucuugaagauugcugagugacccauaguaagcuuauuaggagauuaggagcaacuguuccagagagaagcuguuuaacaacauaugaaaugugcaacauaauuccaucuagaacuauuuagaaucauaacauggaagaacagcagcuuacaccugguucaacccuucuaccuuuaagugaggaaacugaugcccaaaggcugcgucaugcuuuacucaaggucauccaccuauuaagaggcaggacugacaaacuaaagcugucucucucuaaaugguaugcuuuuccuacuaca

SEQ ID NO: 17408 - RNA, 1104 nt, Homo sapiens
uuggccaccgcccaggaucugcaagcugcgcgcccacaaguuucggcacccauuuggacuuucacaaucggagauggcaguggugaaggcaucaacaucaaaagcuaccaggccuugguauucucauccaguauaugcaagauacuggcaacauuaucaucaagcaauggcuuggaugcaaagccaccacaaugccuacaggaaggcgguggaauccuguuucagucuuccaugguucuuccuuccugcgcuucuuccccaaagcucuuacgauaaccaggcugcguauccucaguccuucuaugaccaucauguggccuagcaggacucccccugcaguucuucacauuucagagggucugggcaacauccacauggcagcaguaggauccaggcauccacaagagaagaccaagccuuauccaaggaggaagagauggagaccgagucagaugcagagguagcaugugaccugagcaauauggaaaucaccgaagagcuccgccaguacuuugcagagacagagaggcacagagaagaacuacugcggcggcaacagcuggaugcggagcgccugaacagcuacgugaacgcugaacacgaccuguacugcaacacccgccggucgguagaggccccagcugagaggccuggugagcggcgccaggccgaaaugaagcguuuguacugggacagcgccgccaagauccaggccauggaggcuaacgugcagcugagcuuugacaagcacugugauccaaagcagccuaauuacuggccggucauccccccgaaguucugagcucggggcacagggcacccagccucuuccucuuccuuuuggauacgcgcucuucaucucuccuucuguacauuucucagggaaaggggacuuuguacugagguacaggcacguucaccacagucccagugggccugucacgggguggauguacugugccagccacuuggaggucggcaggacauauucuguugccaacaugauaaauuuuauccugacauaaaaugauaauuuuguauauauuauacugguuuuuuauguugucaguaacaguucaauucauuaaaguucuugccuagaaa

SEQ ID NO: 17409 - RNA, 6833 nt, Homo sapiens
ucuaggggcaugggcgggggccagacgggccucgagugggauccuggcacgguuggccgaucggcccgggaucccggcugcgggcccgugucugcccuagcgcgaugggcucgaaugcccggcuccacgaaucccggccuuucacccccacggccucucggcacugccccagcuagacaccagcgagcucgucacagcgcgggcaggcacugcggggcagcugcagacgagcccugucauacggccggaggaggccucgccugcccgugcggcgggcuccgggcacccugauaccuugacacaggaggccccgggcggccgggaagggcugugcgggggagggacugcgucuacacccgcgcccgacucgcucgggucacggcacugcccugccaccaggcggcuggggcgggggugaggccaggcgucggcccucgcgauucuguuuuguacgcugaggcucggagccuucgaagaacgggacagcggggcccacggacggcucugaaggccuucccgcggccgcaagagaucucggcggccggcguuugaggcgcgcggcuccgcugggaagcgagacccggguggcgggacaagacuugcuucccggccacgcgcgcucggccggccguggggcggggcauaggccgugacgugaugucgcguaucgagucuccgcccccuucccgccuccccguauauaagacuucgccgagcgcucucacucgcacaaguggaccgggguguugggugcuagucggcaccagaggcaagggugcgaggaccacggccggcucggacgugugaccgcgccuaggggguggcagcgggcagugcggggcggcaaggcgaccauggagcuuuugcggacuaucaccuaccagccagccgccagcaccaaaaugugcgagcaggcgcugggcaaggguugcggagcggacucgaagaagaagcggccgccgcagccccccgaggaaucgcagccaccucagucccaggcgcaagugcccccggcggccccucaccaccaucaccaccauucgcacucggggccggagaucucgcggauuaucgucgaccccacgacugggaagcgcuacugccggggcaaagugcugggaaaggugacaagcggagggcgccgggcugccgggcgggcgggaggucuguccgggcgaccccaagccgggcaagcccgcggggucccucgcccgccgcuuccggguuuuucggggguccgaucccagcgcgaggugggcuccucaccugcccucuggcuuuugugcgccggcagcgcuggggaucggcuuugcauucuuagccucagaacugugugucucccgcagcccagagaaaugcaucuugagucuggaagcgagggcuuucuacaucagaccucucucccucuaucugcucccagggaauuuuccugacaagucucaucagagauuauuuuucaugucuccccguuccaacucccuccauaaagcuccccuuuauaaaagaagaagagaaacuguuugaacuugcuguuuccagcaaugcauuucucuucaugagggagcuuuaacgaagucgaaugccucccucuguccacccuccuccauuccucaauuuuuuuuuuuuugcuuuucuuucuucccauuuauuuauuuauuuaaaauaucugccguccauuuuugugccauccucaauuccgucucggcuuuguuuccuuucaggguggcuuugcaaaauguuacgagaugacagauuugacaaauaacaaagucuacgccgcaaaaauuauuccucacagcagaguagcuaaaccucaucaaagggaaaaggugcguaugacucuugaguaaaguauuuucuuugugugcaaggauggcccuucccuguuaggaaaaugucuucugcauguguaaucacuggcuuuuccgaggugacuggaagcuaauaagccuuaccuugcuuuuucauuuagauugacaaagaaauagagcuucacagaauucuucaucauaagcauguagugcaguuuuaccacuacuucgaggacaaagaaaacauuuacauucucuuggaauacugcaguagaaggguaagugucaacuccuauuugagaacauuugcuuaccccgaauuaacaugguauucaaagaguauuuuaucugggauuuuagcuguggcagcacuuacacugcaaaguuaacuuucauugcucauccugcaaagggaaaccagugauuuugauaacuguuuugacagauucucuuuuuuccuucuccucuucuuagucaauggcucauauuuugaaagcaagaaagguguugacagagccagaaguucgauacuaccucaggcagauugugucuggacugaaauaccuucaugaacaagaaaucuugcacagagaucucaaacuagguaagucauugacgccaaaagcugaguuuuguguuagaguucuuuuuucucucucuguuuuuuuuuacauauuaauguucuuaauugggaucucgugucugcaaucuugcuuuugaaugggcgacuuucauauaacaauuggcugccuggcuccaaaguggauguguguguacuugguuagaacgcauuuucaaagggauucacauuuuguuuuguuuaucgucuagggaacuuuuuuauuaaugaagccauggaacuaaaaguuggggacuucggucuggcagccaggcuagaacccuuggaacacagaaggagguaagagucagaaagaugcauccuaguagacuuuuguggagaccaaauaugccuucauuauuuugcauuuaauguuucagagguccgguaauaaaaucuauaaaucauagcaauguuaauuuaaagaaauacuuauuaaaugcccacuauggacuagacagagcacccugugccucuaaauugauuaugaaagcagucaaugaagucuuuucuuggcuuaaaauguauaaaaugccacgacgucccuggcuuuaguugguuaacaacacuuugcaugugggcuaaaacaacgugugugcauuuuuaaaaauuaccaaaacucauuuggucagaucucaauugaauuuucagaugccaaaagucaaauguuuccaaauagaaauucaguauagauuuuaagauuuuguuuaagauuuugucucccaucaagucaugucaagagaaccaaguuuaaguaguggaauaguuccuaacacgaucucaauauuuugucuuuccagaacgauaugugguaccccaaauuaucucucuccugaaguccucaacaaacaaggacauggcugugaaucagacauuugggcccugggcuguguaauguaaguaaaugcagcagaauaauuaaaaagcaaauucggauuuagauuuuaacacuugaaaagaguugcuuuaugaccauugcuaaagauguguuucuuugcacacagguauacaauguuacuagggaggcccccauuugaaacuacaaaucucaaagaaacuuauaggugcauaagggaagcaagguauacaaugccguccucauugcuggcuccugccaagcacuuaauugcuaguauguuguccaaaaacccagaggaucgucccaguuuggaugacaucauucgacaugacuuuuuuuugcagguuggugcacuaucuuuuuuuuuuaauuaccugguauugaucccaguuaccugacagguuacugaaggcuuuuucuaauauuccacagggcuucacuccggacagacugucuucuagcuguugucauacaguuccagauuuccacuuaucaagcccagcuaagaauuucuuuaagaaagcagcugcugcucuuuuugguggcaaaaaagacaaagcaagauauauugacacacauaguaaguuaacaagacuucuuuuccuuuuucguacccaauauuauauuuaaauuugguaaauuaguuaaaagagaauuuuauauuagcauaacuuggccauauuugcguauucuuaaauguugauauuuauagcauaauaaauccauaccuugaauugugauugauagcuuuuuauuuugcaaacacuaaagagggcuuuuggggguagcugcagcuaaaggcaaagguaaaaugcuauuuuugcccaggaugcucauaaguuggucaauaaugcaagaaggagaaaauaugacuaacccuguuccuaccuuguuaagauagacuaauguuuguaauucuguuucuugauauacagauagagugucuaaagaagaugaagacaucuacaagcuuaggcaugauuugaaaaagacuucaauaacucagcaacccagcaaacacaggacagaugagguguguugggaaagaguaaaguagauacucacgcuuuacguuauuuccacucuuuauuaauuagcacuuggacuaugauuaucaugguucaaauaugucauauuuacuuaaaguuuuucuucaaacccuuugaaagggaaguuaaaacuaaaaggaagucuuuuaguuuuacagugcaugcaagugaguuuacugcguuaucuuuuaucuggcuuguguccauugcuuuuugaugagcuuucccagcaauugccucacucucaucuuaaucuggaauucucacccuuaaaugaauuuagaugcuugacucauugcauaaaucuucucucuucuaaggagcuccagccaccuaccaccacaguugccaggucuggaacacccgcaguagaaaacaagcagcagauuggggaugcuauucggaugauagucagagggacucuuggcagcuguagcagcagcagugaauguaagugguugucaaucguauuuuaaauaaugaaacucgaaaugccagugcuaaauacauaauaauuuaagucaauuuacuuuguagcuuaauuuaacauagaaguaguaagauuacaggaauuggaaaauaaucuugaguucuaugucuuucgaauuaauggagugaaacuuagcaucuaccaaagccugagguuuuauugcuaaaauauuguauaacuugaaacauuucugucugacuuuucaggccuugaagacaguaccaugggaaguguugcagacacaguggcaaggguucuucggggaugucuggaaaacaugccggaagcugauugcauucccaaagagcagcugagcacaucauuucagugggucaccaaauggguugauuacucuaacaaauauggcuuuggguaccagcucucagaccacaccgucgguguccuuuucaacaauggugcucacaugagccuccuuccagacaaaaaguaaguguaucaauuaaugaaauccugucaguucucuagucuugcacuaaagaaaucuaaaaacaaugauuaacugcuucuauuuuuuuuuccucuucucucccuuucguuccuguuuuuauagaacaguucacuauuacgcagagcuuggccaaugcucaguuuucccagcaacagaugcuccugagcaauuuauuagucaagugacggugcugaaauacuuuucucauuacauggaggagaaccucauggauguaaguacuguggcuuuagaguggugacauuugaaguguaggccacaaagcaguagugucugcaucacuuugaagcuuguuagaaacagauucuccugaccuaccguugguguacugaaucagaaucuccgggagguggaggcagggauuuccaaagccauucugaugcuugcuuaaguuugagaggauuuucuuagaauaauaauagagugcaugcuacaaaaucuuuguaggcacuaacucacucuccuaaucucuuccaggguggagaucugccuaguguuacugauauucgaagaccucggcucuaccuccuucaguggcuaaaaucugauaaggcccuaaugaugcucuuuaaugauggcaccuuucagguaaaugaacucuucaggaaagugcacguuuagguccuaaacagaaagauuuguaccuagacaguuuagugauugacugaacuuuucuaauucucgaauauuuugagagaucuaaugucuauguuuauuuuuuaaggugaauuucuaccaugaucauacaaaaaucaucaucuguagccaaaaugaagaauaccuucucaccuacaucaaugaggauaggauaucuacaacuuucaggcugacaacucugcugaugucuggcuguucaucagaauuaaaaaaucgaauggaauaugcccugaacaugcucuuacaaagauguaacugaaagacuuuucgaauggacccuaugggacuccucuuuuccacugugagaucuacagggaagccaaaagaaugaucuagaguauguugaagaagauggacauguggugguacgaaaacaauuccccuguggccugcuggacugguuggaaccagaacaggcuaaggcauacaguucuugacuuuggacaauccaagagugaaccagaaugcaguuuuccuugagauaccuguuuuaaaagguuuuucagacaauuuugcagaaaggugcauugauucuuaaauucucucuguugagagcauuucagccagaggacuuuggaacugugaauauacuuccugaaggggagggagaagggaggaagcucccauguuguuuaaaggcuguaauuggagcagcuuuuggcugcguaacugugaacuauggccauauauaauuuuuuuucauuaauuuuugaagauacuuguggcuggaaaagugcauuccuuguuaauaaacuuuuuauuuauuacagcccaaagagcaguauuuauuaucaaaaugucuuuuuuuuuauguugaccauuuuaaaccguuggcaauaaagaguaugaaaacgcagaaau

SEQ ID NO: 17410 - RNA, 2786 nt, Homo sapiens
aagcaauuuuaauguacugaaagcaaguuauauaaaauaaaguguuuuuggagauuaauuuugguuacaugcauuuuaaagauuauguugucagauaaagccaauaaggaauaaucaaauuauuugaaaaguauuaccuuaaacaaaaaauucuuacugauuccauuuuaaagauuuauaacauaaguacaaguuucccaacuaagaaaaaaagagaagugauuccuuccuccagaguaccuuauaaugccugaauaagcaauccaaauaaauauuuuaaauuuucagaaauuacccugaaaaauacaaauaaugcugauauccaaauauucagaaaucacugcauagauuggaauaaacauacugguacuuaaaauugguuaauaaaucaucacuggaguaacuaaaauauuuuagacauuauaggaacauacauugauauuuucaaagauguuaguaucucagagacacuuugcauaaauaaguauugcuaguuacuggacauaauaaaguagaauuauucuaaaagcuuuccaaggauaaaacuguguuaguauacugguaguaaaauguauaauuaauaaagaugcugcagcuauauuuucccacagugaaauccuugcacaagagaaguaucuguaauccuggucuacagaaauuauuuaagaugugcuauuacacuaagaaauagaaauaaaauuaccucugucaaauuguaccauaaugacauuaauuugauauuauaauaucuaucucucuuaagaauuagacauugucuguaguuuugguaugagaagguucaguaagaaagauauuaaaauauaauuugaccagcagaacuccacuaugagcugaaaauuuagaugauuuauaaacauuaauggaaugguggcugucucauuaugcuuauuuaguaagggaaacaauuaaaauauguaccuaguacaacgaugacuuuugggaguaaagaaauucacauuagcuguucagauagcuagauacaucagcauauuucacaauauauuuuauuucccuggugcuuauguauauauggauauuauugaacuuuauaauucauuaucuccauacaaagaaguaaacaaaacaaagauacuuaacuaguaagacacggcugcuaaaugcauacgcaccuuuuuuuuuuaaacaaguuuauacagccuguucuuguuaaauauuuuagcgagaacuaaguuuuaaagcuugauaauuauaguuauccauucugaaaugacauuucucgugauuuuacuccuugucacuuauauguauuuaagcuggccuaccuaucuuugaacaguauaggcaaagaaaaaggaauaugguauuagaauucaccuucacuugauggagaaccggaugugguuaucuggguaagagcccagguuacuuggauggagagauggguuugcugguuuacacuaggaagagugacguauuuaccucgauucuacugaaagcggauaaaagcaguaccaucacugugaccuaggaaaagggaaaauguaagcccacuaauauggaagcccauucagaaacauuuucugugaacgauaggaggaccagccucaucauauuccugcuuacugauccacaucugcuggaauguggacaggcuggcaaggauggagcccccaauccaaacagaauacuuccgcucugggggagcuaugaucuugauuuucauggugcugggugccaggguuaugauuucuuucugcauccugucagcaaugccuggguacauggugcucccuccagauaacacgguguuggcauagagauccuugcgaauauccacaucgcacuucaugauagaguugaagguugucucauggaucccacuggacucaaugcccagaaaggaaggcuggaaaauggcuucagggcaucggaagcguucauucccaauggugaucaccugcccaucaggaaguucauagcuccguuccggugaggaggaugcggcugcccugaccaucuccugcucaaaguccagggcuacguagcacagcuucucuuugacaucucgcacaaucucccgcucagcagugguggugaaguuauagccucgcucugucaggaucuucaugagguaaucagucaggucucucccugccagauccaggcguagaauggcaugaggcagggcauaaccuucauagaugggcacgaugugagugaccccauccccagaauccaucacgaugccugugguccguccugaggcauagagggacagcacagccuggauggcgacauacauggcugguguguugaaagccucgaacaugaucugagucaucuuuucccgguugaucuugggguucaggggugccucggugaggaggaugggaugcucaucuggugccacacggagcucauuguagaaugugugguaccagaucuuuuccauaucgucccaguuggugaccacuccaugcucgauaggauacuucagggucaggacgccucucuugcucugagccucaucucccacguagcaguccuucuggcccaugccuaccauaacgcccuggugucgaggacgcccuaucauggaggggaacacagcccggggggcaucgucaccaccaaagccugccuugcacaucccugacccauuauccacuaccaaggcagacagcucauugucagucauggugcuggcugagaucuuccagacgagugaacaggacaagugaauagacagugaguaagagaaagugaacaggccuaaaacacuccagaaaugcuuucagacacgg

SEQ ID NO: 17411 - RNA, 4199 nt, Homo sapiens
aacuuuaccugcagcauguaguugaucugccaagucauauaacaacuuaaaguucucuccacucuucaagccucgaccucauuuaaaaagaugaaaaaaaaaaauuaggcaaacaucaaauacauucuggaacaauuuugcuauuuuauauacuggaguaaauuuucauauuauguaacugccauauuaagcaugucaccuccucuauaaaccuuuucuggccucugacacuccuauacuucuauaaagcauucaacacuacuaugauuaccuaguuaacuaauuguguaauuaauaugaguuuuuuucccacuagaauaaaaacucuuuaauuucaggaucuauaucuaucuuggucacugccauaucugcaauauuuagcaaaacucuacauauaauagaugcucaauaaauuucucugaaugacugaauaaaguuauuauuugaaugggagucaucucaaggacuuuaaacuccucgagaggaagaacauucugccuuuucaucuguuucuccagcacuuggcaauaagccugucauagaacagauaaccaauauacauuucuugaauaaauaagugaauaaacaagucagggcccagcucgguggcucacaccuguaaucccaacacuuugggaggcugaagugggcggaucaccugaggucaggauuucgagaccagccugaccaacaugcagaaccuccgucucuacuaaaaauacaaaauuauuauuuuuauuuauuuauuuauuuauuuuuuaggaggaguuucacucuuguugcccaggcugaaaugcaauggugcgaucucggcucacugcaaccucugccucccagguucaagcaauucuccugccucacccuccugaguagcugggacuacuggcauccaccaccaugcccagcuaauuuuuuguauuuuuaauagagacgggguuucacuauguuggccaggcuggucucgaacacuugaccucgggugauccacccgccucggcuucccaaagugcuggaauuacaggugugagucaccgcgcugggcguaguggcacaugccuguaaucccagcuacucgggaggcugaggcaggagaaucgcuugaaccugggagguggagguggcggugagcagagauugugccauugcacuccagccuaggcaacaagagcgaaacuccaucucaaaaagaaaaaaagaaaacgaaaaacaagucagauauaucacuucaaaauauuaauuuuuuuuucucaaugauacuugcaauagaaggcugucugaaagcuuauuuuguuggauguuuaauugcaaggauuuaaaaagcauaacaguccuuauuuuuucaaaaaguuagucagugggccauaaaaaaaucauuguuuuuaaagacaaggagcaugauguauaaaaauaagcaugucuuaugcaauauuaacaguuuugauauuaaauguuaagaaacuuuuuaaagaguuauacacaaagacauggacaacucuggaaaucuuuccaaguggaaagaaggguaggaauuauacacaagauggcccugaaauucaagccaguucuaucuauaauugagaagccaaccauacucugcagaauucauggaaguccaucaauaagauggcaccaaguggcaaaguuaugcagauaagauuuauaccaugcucccccuggugccagugacuaggugugcaacagaaaccccaaacuguguauuaugcucauaauuucauuuuccuaauugguuaaaugggaauaauaucccaaacuucccaacuucuuacauuugaaaaagaucuguguacuucuaaaauaaauacuaaaaauaaaaaaaaaaaucaaaguauuuucaauuuacaucuuuuaagauuaauauuucacuuaccaccagauaccaccacuuuggcaccuguuagcucuggucgaucacuuuuuguuaauuucuggucaagccacucugauauuuccacuggugaaguacuugaugcugcauacauuaauacauaauaaaacaaugacuaugauuucaaguucuauaacaagaauuauuuucaagagaaacacacaaguauauaauuccacgaaauuuaaguuaauuacugugaauuuucagugcuccuaauuaauucucucugauaauggaaagacuuaaggagacuagauuccagccuuugccacauuagcuguaugacuccagaaaucauucaauucucugagucugaauauagaauaacuuucuuucuaugagguucaaauaagacacuauauauguuaaagugugacacccuccacacguuuccuauuacauucuucuguuauacugaaucacccaaauauaauaggaaacagugacaagaguaaaaaagcuuaaucuuaauagauccucugucucccacucccuugaucuaccaaagcaacuauccuaguaccaaagauaaugugaaaaagauguaaguuauacauauuuauuauuuuuguauaagcuugggaauaucauuuaaauugaacuuucaaauacuauucauuagaaauguaggcagaggucaucucuuauuauaauacagucuaugaauuaaaaaaguaagaaacaaaacaaaaaaacuccaaaugaacacucacccuuuucugaacuggcacuaccgccacuuguugcugcagcaucaaaggauguuccacggacagaaaacacuuucacuuucucaucacacuucacuguacauagagcauuuccugaaacauacaaucuauuucuuaaaagcaacagcaaaaggcaacaaaacuagcacuccuuugaugcuuggaauuuacuucacagacaaggcaagaaauaacuauugaccaguugucuucuaacucuauuaaguauaggaaaaaaugaaccauaacggugaagaaacauaucagcagauaucuguauaacccuggaugucuuuaaaagcaggacagguacuaccacaccuagaaggaagaaacucgaacaggcauccacacuaagaagguacacuacaccucuaaaaggaauaugaacaaagcuuccuucuccaaaaacaauacaaucaguaacucaaaacuaugagcugcaacaacuuaggaagaauguagcuacugugcaugcuaaaggaggaauaucuugaaaacacaauaggucauaaagaacagguaugaaugugcuaagauuuuaagaggauuugagacacucuggauuagcuaucacauuaacaguaaccuaaaccaugacaaaauauuuucccucaaacauuauggaagaugaaaagucuaauuucagaauuagccauucauacuggaauacacaacuuuaaucaggcaaaaaacgaagaguucacugccuucuccgaccccacuagagaccagugugcuaagcaaaaaaucaacugaagagacacugaaaugaauuucuuuucuuuuucuugagacagggucuugcucuguugcccaggcuggagugcuguggcaugaucacaacucaccauagccucgaccuucuggcucaagcaauccucccaccucagccucccaaguaucugugacuacaggcauaugccaacaugccuagcuaauuuauuuuauuuauuuauuuuugagauagggucuuauuauguugcccaggauagccucaaacuccugaguucaaguaauccucccaccucagccugccaaagugcugggauuauaggcacgagccacugcagcuggcuaaaaugaauuucuuaaugccuauggaaaugaaguagaagcagcaaagauugagaauacuauuuuuuuuuaaguuuugcuuuuccagguaccacuuacaaaauauauuaaauugugaaucuaauuuuuauugaucacuaggaaaauaucacccugcaaacugaauaaacaggcaggaaaucucuguguuugcgauccaucagagagaaugccaugucaagggccaccagcaauucuagacuaaaauuuuccucagaaaccuuuaagaugguccacuuaaagcaauuguaugguuugauuuaaaauucuaucuucaagauuaauuuaugcuuuucacuaaaauuuaacauguugauuaauuaucuuccuugaguacucaccugcauaaauaguucucacaaaugugucaggugacuugauugcaaugaugucagaaaucggggcaaccucaaguuuggcugcuacucugggcaaaagguucu

SEQ ID NO: 17412 - RNA, 4199 nt, Homo sapiens
agaaccuuuugcccagaguagcagccaaacuugagguugccccgauuucugacaucauugcaaucaagucaccugacacauuugugagaacuauuuaugcaggugaguacucaaggaagauaauuaaucaacauguuaaauuuuagugaaaagcauaaauuaaucuugaagauagaauuuuaaaucaaaccauacaauugcuuuaaguggaccaucuuaaagguuucugaggaaaauuuuagucuagaauugcugguggcccuugacauggcauucucucugauggaucgcaaacacagagauuuccugccuguuuauucaguuugcagggugauauuuuccuagugaucaauaaaaauuagauucacaauuuaauauauuuuguaagugguaccuggaaaagcaaaacuuaaaaaaaaauaguauucucaaucuuugcugcuucuacuucauuuccauaggcauuaagaaauucauuuuagccagcugcaguggcucgugccuauaaucccagcacuuuggcaggcugaggugggaggauuacuugaacucaggaguuugaggcuauccugggcaacauaauaagacccuaucucaaaaauaaauaaauaaaauaaauuagcuaggcauguuggcauaugccuguagucacagauacuugggaggcugaggugggaggauugcuugagccagaaggucgaggcuauggugaguugugaucaugccacagcacuccagccugggcaacagagcaagacccugucucaagaaaaagaaaagaaauucauuucagugucucuucaguugauuuuuugcuuagcacacuggucucuaguggggucggagaaggcagugaacucuucguuuuuugccugauuaaaguuguguauuccaguaugaauggcuaauucugaaauuagacuuuucaucuuccauaauguuugagggaaaauauuuugucaugguuuagguuacuguuaaugugauagcuaauccagagugucucaaauccucuuaaaaucuuagcacauucauaccuguucuuuaugaccuauuguguuuucaagauauuccuccuuuagcaugcacaguagcuacauucuuccuaaguuguugcagcucauaguuuugaguuacugauuguauuguuuuuggagaaggaagcuuuguucauauuccuuuuagagguguaguguaccuucuuaguguggaugccuguucgaguuucuuccuucuaggugugguaguaccuguccugcuuuuaaagacauccaggguuauacagauaucugcugauauguuucuucaccguuaugguucauuuuuuccuauacuuaauagaguuagaagacaacuggucaauaguuauuucuugccuugucugugaaguaaauuccaagcaucaaaggagugcuaguuuuguugccuuuugcuguugcuuuuaagaaauagauuguauguuucaggaaaugcucuauguacagugaagugugaugagaaagugaaaguguuuucuguccguggaacauccuuugaugcugcagcaacaaguggcgguagugccaguucagaaaagggugaguguucauuuggaguuuuuuuguuuuguuucuuacuuuuuuaauucauagacuguauuauaauaagagaugaccucugccuacauuucuaaugaauaguauuugaaaguucaauuuaaaugauauucccaagcuuauacaaaaauaauaaauauguauaacuuacaucuuuuucacauuaucuuugguacuaggauaguugcuuugguagaucaagggagugggagacagaggaucuauuaagauuaagcuuuuuuacucuugucacuguuuccuauuauauuugggugauucaguauaacagaagaauguaauaggaaacguguggagggugucacacuuuaacauauauagugucuuauuugaaccucauagaaagaaaguuauucuauauucagacucagagaauugaaugauuucuggagucauacagcuaauguggcaaaggcuggaaucuagucuccuuaagucuuuccauuaucagagagaauuaauuaggagcacugaaaauucacaguaauuaacuuaaauuucguggaauuauauacuuguguguuucucuugaaaauaauucuuguuauagaacuugaaaucauagucauuguuuuauuauguauuaauguaugcagcaucaaguacuucaccaguggaaauaucagaguggcuugaccagaaauuaacaaaaagugaucgaccagagcuaacaggugccaaaguggugguaucuggugguaagugaaauauuaaucuuaaaagauguaaauugaaaauacuuugauuuuuuuuuuuauuuuuaguauuuauuuuagaaguacacagaucuuuuucaaauguaagaaguugggaaguuugggauauuauucccauuuaaccaauuaggaaaaugaaauuaugagcauaauacacaguuugggguuucuguugcacaccuagucacuggcaccagggggagcaugguauaaaucuuaucugcauaacuuugccacuuggugccaucuuauugauggacuuccaugaauucugcagaguaugguuggcuucucaauuauagauagaacuggcuugaauuucagggccaucuuguguauaauuccuacccuucuuuccacuuggaaagauuuccagaguuguccaugucuuuguguauaacucuuuaaaaaguuucuuaacauuuaauaucaaaacuguuaauauugcauaagacaugcuuauuuuuauacaucaugcuccuugucuuuaaaaacaaugauuuuuuuauggcccacugacuaacuuuuugaaaaaauaaggacuguuaugcuuuuuaaauccuugcaauuaaacauccaacaaaauaagcuuucagacagccuucuauugcaaguaucauugagaaaaaaaaauuaauauuuugaagugauauaucugacuuguuuuucguuuucuuuuuuucuuuuugagauggaguuucgcucuuguugccuaggcuggagugcaauggcacaaucucugcucaccgccaccuccaccucccagguucaagcgauucuccugccucagccucccgaguagcugggauuacaggcaugugccacuacgcccagcgcggugacucacaccuguaauuccagcacuuugggaagccgaggcggguggaucacccgaggucaaguguucgagaccagccuggccaacauagugaaaccccgucucuauuaaaaauacaaaaaauuagcugggcauggugguggaugccaguagucccagcuacucaggagggugaggcaggagaauugcuugaaccugggaggcagagguugcagugagccgagaucgcaccauugcauuucagccugggcaacaagagugaaacuccuccuaaaaaauaaauaaauaaauaaauaaaaauaauaauuuuguauuuuuaguagagacggagguucugcauguuggucaggcuggucucgaaauccugaccucaggugauccgcccacuucagccucccaaaguguugggauuacaggugugagccaccgagcugggcccugacuuguuuauucacuuauuuauucaagaaauguauauugguuaucuguucuaugacaggcuuauugccaagugcuggagaaacagaugaaaaggcagaauguucuuccucucgaggaguuuaaaguccuugagaugacucccauucaaauaauaacuuuauucagucauucagagaaauuuauugagcaucuauuauauguagaguuuugcuaaauauugcagauauggcagugaccaagauagauauagauccugaaauuaaagaguuuuuauucuagugggaaaaaaacucauauuaauuacacaauuaguuaacuagguaaucauaguaguguugaaugcuuuauagaaguauaggagugucagaggccagaaaagguuuauagaggaggugacaugcuuaauauggcaguuacauaauaugaaaauuuacuccaguauauaaaauagcaaaauuguuccagaauguauuugauguuugccuaauuuuuuuuuuucaucuuuuuaaaugaggucgaggcuugaagaguggagagaacuuuaaguuguuauaugacuuggcagaucaacuacaugcugcagguaaaguu

SEQ ID NO: 17413 - RNA, 80609 nt, Homo sapiens
gagcgaauguagcccgcgagagaaaauggcggcggcggcggggaaucgcgccucgucgucgggauucccgggcgccagggcuacgagcccugaggcaggcggcggcggaggagcccucaaggcgagcagcgcgcccgcggcugccgcgggacugcugcgggaggcgggcagcgggggccgcgagcgggcggacuggcggcggcggcagcugcgcaaagugcggaguguggagcuggaccagcugccugagcagccgcucuuccuugccgccucaccgccggccuccucgacuuccccgucgccggagcccgcggacgcagcggggagugggaccggcuuccagccuguggcggugccgccgccccacggagccgcgagccgcggcggcgcccaccuuaccgagucgguggcggcgccggacagcggcgccucgagucccgcagcggccgagcccggggagaagcgggcgcccgccgccgagccgucuccugcagcggcccccgccgggugagcagcacggccggggucgcggcggggacuuggagagcgggcagagggcaaugaaugaaccccgggcaccaugcacggcgucccgggguucagcgcagcgaggcuacgcgccgcucgccgggaccuacgccccugagcaccccccgaccccuucggagucgggcggcgccccggacccagccugggggaccggacggggacgugcggaagaguuuguuauuguuugcagacaugugacaggcgugcgagccucucugcggggaaccguugcgaaaagguguagggggccacggcuggcuuugugggacuccuggaaucggggcucuccgaggagcccgggggcggggcacggcccugcggcggcgcccccggacggguguccccggggcaaaggcacuggggggcgaggcccgagccugaggcgggcgguggucggaagaggggcggggugggugagaagcccgaggucgggugggagacugagaggaccgaagagaaaguagcaggucccagcggccgugacaggcagagccccucggcccgcccgggacucgagucccuaggcagauaccgcgggcugggcccggacgcaggcggcgcgcccccagcgccggccgcagggcuccaggaggacggcucgguaacgccugucaaagccgugcggcgggaggcugcacacucgcggaggcuugcagucuuuuaggaagugcgguuugucuaauugcagcccccaaggggcuuugaguguuccugggaaugcgaacugcacugcuaagucacuugagugacuucuguuuggaguuugaauuuggccuuugaaguuugcauuuggcggagugguguaagagccaggaccggaugugucagccauucaguuucaaagcaguggugacugcuccccgcagccccuccggcuuggcccggggacugcggcgcgggugcagugcuuccugcucggugcccuggcgcgggccgcccgcugaauuccaggggccgcagugcggugggcuucggcucagaugcgucuucuggugcauaugaaguacaguauguguaagguaauuuagaccagcgguuuauuggccucgcccauuuuuggcuacuggaaauuuuuauguuaaaggaaauucuuuuaagugugacagcuacauccuuguuuguuuguuuuuuaaaaaccugauuaacguaugcaaaguacaaagucuugauggguauuuugaguugcuggaaauguuuuugugauagucccucguggcccuguagaauucccugaccuuuauuaugagaagaaagcgugucauuuugugagacgaauuugacaguaggaguccuugguuuggauucauuaucuaaagugaucuggcauuuuuugugcauuugauuauuugcuuaaaaucacgauccauuuaguauuuggaaguccccuuccucuccccaagaacuaaaaaauaugcuucgcacuguaccauggcacuacugagaccaaaggagauuugugacugauacaguuuugugugcacuuguacauguaauuuauucuuacaagaguuauguaccucuauaguuuucccauuucugugcagauuguauuaaaacuuaacuggaauaauucuuugaaggcaacuucuacuuuaaaugaauuccagauaaaaauuuuuaaccccaaauuuaagaaauuguaucuauugagaccuaacuuuuuggauacaauaaauaauuuagcaaacgucagcauucuaguacucuuaaugagcugugaauauaguagaagagcauccacuguaaaaauaauguacugaaauuguuuaauguugucucuugacacaaaauaagaggacuaagguggaggcagauagaauuuagggacuaaguaauccaugcuuaguauuugcguuuuguaaccgagguuuuuuccccuuugcuuaagguguagauuauaauugcacaguauaagaaaauaaugggcuuguaaggauaaucuuuuuuaaagaaauuauuuuuacgagucagaaugcuguugguuuaucccaaaugucauacguaaagauuucauuuauaguaaaauguugauucccuaaccuuaugaaauauagugaauuuuuuuuucuuaacaauuggguugaaauucauuugaaucuguucguauaaaacuuuguggggaaagggcuuguaucuuauuugaguguguauauuuuguauugcauguugguuaugcuacacuauuacuuaccauuuaaaguuuuaggaaaaaaaacccuuaauuauagccaacucaauaaaauaucaauugaacuuuauguuuuacuuuuuuuugacaguuaaguuacauucauacuuccaagaggaaaaucuaagauuuugaaauauuugagaguucugugaucuuuuuuuuaauuuuagaauuuccuucugaucuuugaauguagaaaauauacuuugaauuagaauuuauauaaauaaauaauacucguauuuaaauagaagauuuuaaguuugucccucuuuuucagggugauagcugaaaucagugaaagugccuguaaguggcgcccaaggguuuggaauuuuuccuuauauuacagaauuuaggggcuuuuucuuccuauuuacugucuuugaagaaaaauuacaguguuacucuccauugaacagccuauugugaguuugguagauauaauuaccccauccuauuuuuguaacuuaaaaaaccaaacuaucaauuugcuggccccgugaaagaacaagauaugcuguacuuguuaauguuaguuuuuguuuaaaacuaaagguauuucacaggcugcuuuuauauccucauauagcccucagauuucacuuccuuuuuaaagcuauuaggcuaaaaauaugauuuagugaccuuuuacuaaagaggagguauaagagcauuauuaccuaaaaauuacucuuaaaauauuaagugggugacuuuauaaaaauaaagguagucacauaaguuagucuuccgugaauuuguaaguuuuuaguuaagaauggugucaguuucauuuuaaaucagauaagaaaauuaaugcauucuucaaagaugaaccuuaauauaauucuggaagagaaauauaagagcuagaauuguugccaacuuuuauuuucuuuucauaucugauuuuggcaagagugacugguuaaccaacauuccuuaauauacgauuuccaaugcacuaaaacuccauuuuguuagauacgaaaaacaggaaguagcccuguucauugauauucauuuacaacuuccauagcaccucgagcauaauauguugcauauuuuagaaauggccacugacuugucaacuugcagauuucaaaaugugggaagaaaggaguguuuuuuugcuuucaacaagagcaaaaaaaaaaccagcuacagcuugccuaggcugagucggcuaaucaguccuugacacuggcugugugcaucccaaaggaagaaaugaggggguggcaagguaguuaauggggaauggauuaccaugaggaaaaauauggggcauucagaaaugcucucagguagaaagcaccucuuuugcauuuuguacuccagucaucuucuuggguugagggcugucuguuacacagaaggcgaugggaaaaugugucauggaaaaguaguagucucuagaggcugcuuaggaacugcguguauauuacaccucuaaucuuggaauucuuugcuucuaucaaauauaucaaguauagacuugguuguuuuccuuaguccuugccucuuucuauauccuaaguuaaaagcuaaagcaacuuaaacauguaaaugguagacuauuaaugugaggaaauguguaagauuaggaguaacccaaaguugucuuuaagaaauuauuuaagaacauguuuaaucaugaaagaaauaaucagggccggaauuaguaaaugguucauugcaaagcaugagauuagucagauacucuuuucaguuugcaaaaauauauuaggauuuuaucuguggcuuaaaacauacucauugagcauauagauaugccuagauaccuuuuacauaaucaacucuuuugccuucuguguguguguaugauaucuauuauauguauuauauauauguuuauauauaaucucauuugaucaucacugcagcccccuaagauaguguaauuucuguuuucuguaggugcaaacucaucugagaugguaaaaccucaugauuacacaacuagaagacagcuaggauucaaucccaagucagacugacuccacaguccauuucuuuccacuacucugcuucuuccauuuucuuuuuucaaauuaauaaucaaauuaauugauuauuuuuaaggagaaauuuguuuugcaggcauucuaauagaccaugagcuaggucucuacccugugcuaaguuugccuguuaauguauauaauagguauguuucuguaaccuggccuuguauauguaauacaaguaaacuguauuuggaucacccuaucaugucagccaaagaggguuagucauuaguguugaauguuucuuagauuuauugauuugugcuguauuaaaucauaagugaaaggagauaagcugaaauuaauaugguucauucaugguaaucacacaggaagagaaacuuuuacuauugcuagacccuaccccuuuguuauuguuuuagauuucauccauucaacauuuaugaacuucugcaaggugguggucuugagugguggagaaaaagaucaugagugcacaagcuguuucugucgguagguuguaguaugaacauguuucacaauaccguguuaagugcuauaagagagauggggauacagaggggauacaacauauuaguuucaaacuauuucugccuauuuucugauaagaauauauacaacacugcauguucaggcauguuuuuuuuucuuccaagggaaaauuaaaaaggagauacggggagcaagaaauucaacaucugcuacugcuaguucugaaauucugucuuuauuauuaguaacagcaacucuacuaguuacgaaaacaacauggagaaauauaaaauauucuuuagggcauaagaugaucaagaagauagccuugucuuuauuuacucuauggcaugucauuggugauugaguuauguuugguauggaagggaguucuguauuguuagugauugaguccuuuggaauaccaggcugguuugaugcagauguuaauuugaucgagauguggagauguuguagcauacuaaggggaauuguuaaaacucaccaaguguauaauucugcaaguacacaucugucaccugggaauuacuaagccaccagaccucuugaagccuggagaaagugcuuggagccacaugggacagccuacacaguacuguaguuaguacguuaacuaaguucaucacuuguaagcauaaugauggauagacauggagugagaacagggucaguacugggguguagguggaagcuuugcucuugacagauguuaucauuacuuuucuuuuuuuauuuuuaaauuagaaauggguucucacuauguugcccaggcuggaaucgaacuccugggcucaggugaucuuuccacauagcuggaacuaugggugcaagccacugugucuggcuuuacuuuucuucauugccuaaacaauaauuuaaguuauauguuaacacauaaucuucaaacuggucuuaugguauucugaauacuaaacaucaguuguuaacagaccaggaacuuuaucugauucuuugcaccaucucccagcaucuagacuagugucuggcacccaugaauauuagguacccagaaauguuaacaugaauuaauuuuccaaaagugguuaaauuaguauaucugaagauuaacuuacuguagugagauuuuaaucaugaucuagcuuaagacgaguuuugaaggcaagaacugucuuuuuuuaggaguuuuuguauaucguuugguauuuauuuauuuauuuuugagacggagucuugcucuguugcccaggcuggagugcaguggcgcaaucuuugcucacugcagccucugccuccuagguucaagcaauucuccugccuagccucccgaguagcuugcugggauuacaggcaugccccacuaugcccaguuaauuuuuguauuuuuuuguagagacaggguuucaccauguuggccaggcuggucuugaacuccugaccucaagugauccacccaccuuggccucccaaagugcugggauuacagaaaugagccacugcggccagaccauugcuugauguuuaauagcaguaguuggcauuuagcaagcagucauugauaauauugaccaauuuuauguaaugugagccuucuaauaauuaguguaguuacaaaauaauuggagccaugcucaaacugucaaauauugagaaaacugaauuccugguauuugaaagugucuaauuauuugcguuaauugguaagccccuccugauuuucuacuuaaccaugacacuucuuccguggcgcccaucuucauucucuugaacauugauacuggaagauucccagggugguccuaggccuucucucauucugucuugucgauccccaccccagucuuauuaaugcccuuagaucaguuauggaccauuuacaaaugauugcagaguuuauuguccuaaccaugaucucuccuaaaguccagaccuacaccuggcuacaugacuucugcgcagucagaugucuaaaaccaaauuaaagaucuucccuaaaccuucuccuaacauguucccugcucauuaaauggcagaaccagaacccaggagucacccuugacaccuccuccucucaccucgucagauucagaccauccuuaggugcuggcaguuugaccuguuaucacaccccuagccaggugcccauugucucucauuuccacuaacuuaguggccuccuugccugaucccuguguccuuucuccuuugcuguccguuccaaucuguauuagguggccagagugaucauuuccaaauguaaaucugaucauaacuuccucccuccagaaaaguaaauguaauuuaauuuuaagauguucagauggcuuccauuuggauaaagaccaggaaaucuuuaacaugccugaccgagucccugcccgguugggccccugucugcuucuccaggcccaucucagcucacacuugcccuuguuccguggcaggguugcgugcuuucauuuccucagacucacucacugccuucuucuauagggcccucacaugcucccucugccaggaacacuguuuuuccauaaagucagcuccucguuguuaaaaucuuaacucauugacacuuccucagggaagcuuucccucauccacccagacuggcuuuguagcagggugucccuacugucaguguugugcuuuuacauuuguuaccucauuugaugaaugacugccuucccccuagcaccuagcaggaugccuggcauaggguagacacugcauaaauauuuauugaauaaaugaaugagagggauaauggcauggcauguucaaauuaguggauccacuguuuuuccuguuuagucagacguaguuuaggacauagcugaaaagguguuaaauggcaaaagucuagacuaugguguuucaacacuguagauuugugauagacucauucagagguaccuggacuuguagacgugccugguggcucgagugaaauaggacagcuuaauguaguagagagcaaauagcuauacugcaugacaacuuuauagguaagaagagucugcuauguguauauaauuauucuguacuuaauagggaguuaagagugcguguguguauauauaugcauuuauauauucacacauacaucugugaauaaauauacacauaaaggugucaugcauuaauauaauuauucuuauuuuuaaaguucucagaaugucaucuaaacuuaagauaucauuuuuagaauucuuaucugauaacccuacuucauccaaaauucauuaauuugaucauaauucaacuugggauaaauaaaaguucacauuuccauugaagaaaauauuuguuaggcaaguacuccaugagauugcagaagccaagaacccauguaacaaaacauuucaaaguuuacuguugguaaguaaacccagcagccucucuuaucuagaacauggguuagcacuaagaaguaagaaaaaauacucuaagcagccaaaggaccuguaacaaaauaugugcuuugaagcacuuugauuuuacacuuaguagaguucccagggcauuugcucaggauugauacuuauuucagauguuguucaugcaguguuguucaugugguguuccuaacaugcagcaauuagaagcagccaguuagaagggguggcggugugaguccugcaagaggcagguuccccaaaggcagcaguguuggcacaccugacagugagaggagagagggagaauaggacucaaaacauugcagucgggggccaccuagcauugguacaauuaguuccaucuagggcagccucugccauuuaaaaauauacucagugaagugaaguuggaaagcuuguaauauagauuaaggaaaauuacuauccaagauaguuauagaaagugucuugaucuuugaagugguaaaccucuaacuguucuguaagauguauuucuguagccuugaugauacugaauaaauauguacuuuagaauuacauaaaaauggaugcugcuuaccgaaugucuuaucuauuaucuguguggagaaaucuuuuuuguuauuguugaccugagucauuuuauaccuugcaguuucuuuaaaaugcauaauaaucaccacuaccacuaauauacugaucuuuuccgguuuuuuaaaaaaaauuuuuauuuuuuuuuuugagacggagucuuaaagauauuuuucuugcuccaagggucuagauucuucuuuuuuuguuguuguugagauggaguuucgcucuuguugcccaggcuggagugcaauggcacaaucuugguucaccacaaccuccgccucccagguucaggcaauucuccugccucagccucuugaguagcugggauuacaggcgccugccaccacuuccaacuuuuuaaauuuuuguauuuuuaguagagacaggguuucaccauguuggccaggcuggucuugaacuccugaccucagguaauccacccgccucagcuucccaaagugcugagauuacaggugugagccaccaugcccggccaggucuagauucuuaaauaaccaaauuucaaguuuuguacaaagauugaaggaaagcuagucuuuaaccaggaagaaaaggauuuguuaagagauuaucagccguaucuuugcugacucauugauacuguggugccuaagacaucuuggcuuuugugacagaauccugcauacaacuuucuccaggauaguuccuccaggagggaccccucugccaggcacuguggcagucacauguccaggcugcaucucugcccugcucagccucuucauccuugcauucagaucuccaugugguuuagggugcccaucaggguaaacacugccauugucucuuuaauugcugugcucuuacucuucuggcuuucacaccuucagcuuccaaucagucaccaguucuuguuauugccacucuccuaguagccugagaauccauccaacuuccuccacugccaugacugcuaacccagggucaggccacugucaacccacugucaaccuuuucuucacccucagaaugaaguccagacuccauaaugcaguucagaaacccuuaggacucaggcuucugcucacuuucagcagccccucagaauggucugcucccgucauuucagcaucgugcucaguuuuagucccucaacugaccguucuucuuuuuuuuuuuuaaagaaaacaauuuuuauuuaaaaauuuauuuuauaagaaguauuggcaugaauacauagauaaggcauuugaaauggcuucucugguuggacuguugaccagcugaauuccagcucuguccugcagcugaucacccuucuuucucggcgugcccaaugcucuuaccucuaucuagaauacucuuuccagcuccguggugagguuuuguuuguuuuguuuuuauucucuuugcaauaaagaauuauugguauuccacuaaaaaauaaauguggcuuuguagaaaucagugcuguacugugaauucugccgagcucugguuuaacaaguuccucgauaucugaguuagauuugcuacuuuuaagccuuuuuaguuuuuuucucuaucauuguacauguagucaggucuuucugaacgacaguguucacaaagagauguuuguaaagcacacauuauuguaaagugaaucagauuuucuuauuuuguguuaaaagcucagagauguggucucagggaaaaaauguugcugccaaccuacauauuacuguccuugagaauaauccgagaccuucacaggucagacaacagaugugcucagauacuucaagcagagagcuugaugacgauguaagcaucacaagauuuaugucagcugcuggaccuccacagacagggucccagcaagcugacagguuguaggugagcaagcacguuagaugugcaggucacucacaucccuuuuugugggaucaauggauguucuuuccugagaaaugaaagggcagaugaguaagcaugcuagagcaugugucuucaguccugcugucacuccugaggagauguccaugccuucaagaaacacucagagcugccagccaggcaccaaggugcuggggacacagcaggagggaagucuccaucacuugccuguggaggagcuuaccugaugacagacagugcaggcccccguccacugugagucggggaggcaucaggaggcuuuuuugggaaaugugagguggagcaccaagccaagucccgauaaacguggaggaaugaaccaggugaaaggaacuugcaaggagguuuuguggccuagggguggguggagaacacacaggcccagaaaucagcagucuuaggauggcauggaggacugcaaguguaguucagguaacucggccagaguggaggcaggguccagggaccaagcugggacacgauuucuggcucuggccagagagagagccacgcagagcucucugccucguauugcccccacuggccaauccuugaaucucagcgcuuaggacaaaauaaaaaagccuuuguaauuugacagguaaccacagaguguuaggaagugggucaggaggccccaagaaggauuuacaucagagcugggacaagacagucuggggucacaaaucugggagcuguggcuuuuguacuucaguagcuccauguaguuucagagguucacagauugggaaguguucucauggcaaaaugaauuccauccacugugguccugaaugugguuuuggaacuacauguuuccauuucagagaccaugcacuguagugauuaagaaccugggccuugcugggugccguggcucacgcccguaaucccaguacuuugggaggcugaggcggguggaucaccugaagucaggaguucgagaccagccaggccaacauggugaaaccccgucucuacuaaaaauacaaaaauuagccgggcuugguggugugugccuguaaucccagcuucuugggaggcugaggcaggagaaucacuugaaacuggaaggcagagguugcagugagcugagaucgcgccacugcucuccagccugggugacaugacgaaaacuccaucucaaaaaaaaaaaagaaccugggcccuaggaauuagaccuguuagcuacuuggaccccagggaagucacuucucugaaccuugaauuucuugucucuaaaauggggucguuggugguauaaugaagcaccauucuugauccagaaaaguauucaguuaauacuaacuguagauaauacucuugcaaguaacugucuaugcucacuacuuaaaccuuuaaccuuuuagaaugagguuaagagccucccccaagguugcugugcuacuuaucacuagguuagcaaaggcgguuuguguagauaauacaucaucuugauaacaauacauuuuccccuguuauuuugaaaugauuuacuagaaaaauagaaaauggcaacuuucaaaauucugugauaugggauaaagcaucuccucaggguucuuaucucugugaccuaaugcagguuucuuggucuucuuuucucaucugugaaaagaaaagguugguuuacauaaucucucaguuccauucaagcucuagcaacucuccaaaaauuuaacuuggaaauuacuucuuguggcuaaauuuagcuguaauuauugaaacaacaauuaguuuuuugaacuuagaaacucuuggaauuuuaaaccuggguaacaacuauaaagagaaaugcaaaugaaaagcaacaaaagcuuagaaaaaagaaaucauguuugucaagcaacauuaagugaugagaaaaucuguuuuuuaaaaagcguaauaacugcuaggagaauauuauuuugcaaauuggagaaaauaaauuaggucaaagucauuagcauguuuguguuuagcaaauacuaccuuagggggcaguuuuuaaaguaacuuuaauuuuuugacaacuuugcuauuaaaagcuaucuuuuucuucuuaauguuaauuguauaaagaagggacauuuuuggauauaaccucuaaaaaagcuucuucuuugacuucuucuuguguuuauuuauaaagaccuuuuuguaaauaaacauguaugcaucuuuuuuuuuuaaguuaaaaaugcaucgcuugguaacaaucauauugcuuccuaauugugaaaauuuacauuuaauuauauuuuggggguuuuuucauguaauuuggauagaguugacagcuacuagaaaaugcaacugcauuucacuauucuauuauuuugggcucaaguucuaaaaaauuaugacuuucaaauagacuuggaauaagacuguuuaacugauuuaaucauuguaauugcaccaacuugaaucguauucacagaaaccaccuugccuauugcuguuuuucuucuuuuuuuuuuuuuccucuuuuuucugagacagggucucacuccuucacccaggcugaagugcagugacaugaucaugacucacugcagcgucaaccuuagcgggcucaguguauccuuucacuucagccuccugcguagcugggaccacaggugcaugccacugugcccggcaaauuuuuuuuuuuuuuuuuuuguagugacagaguuucgccauguugccuaagccggucuccaacuccugggcucaagcaguccacccgccuuggccucccagaaugccaggcuuacaggugugagccaccaugccgagcccgcauugcuguuuuuuauacacugaacugaaacuguucauaauucauugcagagcacacggacauucagcaguaauuauuuuuugucuuggauuccugguaguaaagaaugcuugauccuuccugcuucugccccaacccaugcuaguucuuacuguugugaucaguuauuagauauuuauuuggggcacuuacucugugcugcuagcacgugauuuccagauaaggcugugaucaggaauagagcaaagucuugaaucuuggucaccucagcaccauucucuagguaguugugacugauggugauaacuggcuguagguuuuguuaccaguaaauaaggcagcuaagcugucaucugcacaaugcaaacugaaaucauccugcaguuuuuuaaguggauaguaggacauucccuccauugcaagaugauuugcuaggagaguuuuaaauagugcugaagacacacgagaacaaagccuucccuuuuugagcucagguccaaaaaagcaguuuuggcauuaaagagaaaagguuuaugcucaagaacuucuugcuuuuucuucucccucuuacuucuuggacuaaguguuggugauaagauacaaaaccguuggugucugaaguaccucugaauccagcagccuucuaaagaaauguuaucagaauuauauuguguaauauaaugcuuucuucuuguugaggaugccccagaauaccgauagaugucacagauuuugcagauuauaauugugaauuuaaaauuuaaaaugucauauauuuuaauuacuaaaaacaaauuaguagacauuucuuaucugaguagaagauacuguuggccauaaccuaauccaaaaugaaauuuuuuuuccccaaguuccgucucuguuucuuguuuuacuuucccucucucuuucuuaaacacauacauauacuaccuaccccacccccaugcauauacaggucuuucuaaauuacugccuuuucacuccacaugaccaaguuguuuugggacuugguguuccagguucaguaagccucuuacacuggguucugugcuauagaaaaguugcuauagugcugguacacacacauuuuccuguaaauuucucaguucuuuauuuaaaaauaaauauuuuauaaaucauuuauugagcauugauaggguuuguguguguaaucagaugcuguccuucugcuuuauacuuuggauuaccuguacuguacuuuuuacaccuagucugacuuccuguccuuauacuauuggguuacuucugccccagcuguaucauuuuguguguauuuagagcacaugagcuaaaucuuauauugguuaaagaguuuaaaaaucugucacaaaauuuugcccaaagacagaaaauuuuauguugucauuuacuguuuuuuuuuuaaauaccuagucuaggauugauuuuuuuuuuuuguaaugcacuaugagagauugccuacauuaaaagcauugguaacagcacguaaauguuuuguaagaaguuucugcguaaggaauauaauauauuuaaaauguuaauucauucccauaugcuuaaguagucaugugugucagaucuuuucaaguacaguguucuugcauuaaaauagccuagaaauuuuauuucugcauuccaguucugucuucuauaacuuuuuuuuaacccgugaaaaugggauaaaauguuggguuuuuuuuuuuuuuuuuuaggaucaugugugugaauuugagguucagagacugcagucacugcagagaccugaaagccauuacugucuguccucugugauuauauguguccccugugauucccaccugcaggauuaggaaugggagggagagcaggggguagaaaagggaagguggcagaauccaucgcaaaccagugaacuccaaaaccuaaucaggcuucuuucuaggcagauucuaugagagacgaagacagaccacaaaaaaccuagcccuaauuuuuuuuuaacccaugauuucuaauguuuaucuauuuguucauuuuguaauucgaguuuaaucagaccaacuaucaggcaggcauuuaguuugcacuuucaaaaauugaaacuuacacauuuauuaaaugauauccagaaucauuuccuuuuucuuuuagaacauuaaacauuaauccuuuugaguauucucauguauuucaagguacuuaugauugcuuauguaggacuaaugcaaaaauuaaaugaauuccaugagaauucuuuuuugaccucacaagaguuaaggagaccuacuuuaugugaaagugagauuuuuauagauaauacuuugaaaaccuaaauuacucugauacuaaacaguuuacugugucuguuaaaguaaaaaaccuaauugaauugcaguugaaauucaagagucuagacauuccuugugggcauauuugauuuccucuuuccccuuuuagcuguuggagagggaauugccaggugucuuuaguggaaagauauuuaaccugcugucugacugcuuauugugguagaugaaguguuagcacuggcucaggcuugugagaccguuccccauuacuguccuaacacuuuggcaggauuuugaguaaaguuacuuuauuuaaccucuuuugaguuugaccucaucuaugaauuagaaauaaugauacccuucauacuuagagaauuugggaagagcaaaugagaugaugaauauaaaaaccuacccuuucagaaggguaaaaauaaaauacuaggauuuauggucauagcauuuuagaauucggaaggacaaccuccugacucuaagcaguaaaaguggcaagcaaaggggguucagccauuguugagagauuuccuacuucaguacagugcugggucugggauccagccucaaucauccuaguucacugucacucuccuacuguacuuaucugaaauggcaauaauaguuaacuuccucugugcuugguacacuggaugccuuauauaaauugucucauuuaagucuuacaucauccuugugaauuuugauucccauuuuacauaugagaaaucagagacugugagaggugagguauccuggcaaggugguagcacagcuaguggguggcaaagccugaaacugaaccuuagcaguuugacuucaagccugcguucuuaaccuuuaugauuaucuuugcauauuuuuuuuaaaucaagagguaaguuuguuuaaucagagcacaaauuuuauuaucuuggaaaaauuauucauuucuuugucuuagcuuuuauucauucuucacauaguguauuaugaagucaaaaucauauguagugaugacuuuuuaaauuaaauuaucuauuuaggucuuccaaaaauacagaaaacauuagugaagcauuuuaaguuuuuguuuuguuuuguuuuuguuuugagacggagucucgcucugucaccaggcuggagugcaguggggcuaucucagcucacugaaaccuccaccuccuggguucaagugauucuccugccucagccucccuaguagcugggauuacaggcaugcaucaccgcacccagauaauuuuuguguuuuuaguagagaugggguuucaccauguuggcuaggauggucuugaucuccugaccuugugauccgccugccucagccucccaaagugcugggauuacaggcgugagccaccaugcucugccaugauuuuuuuguuuuuauaugaaguucuucuaaaauaaagcaaguuauaaacacaaauacauuuaaauuucaguguuuuuacaaggccagggaagagacgcggcuucagggaaaaauaugguugaacuuuguuaauacauacauuuuuuugccagcaaaauuggagauaugcuuggugugcacauacauuaaaagcaguaauuguuaacacuuuuggaguacuucacagagugccugcccagacugucugacaugcuucucauuuggugccuacgcagccuugcacaguaguaaggggagagugaacacucaugaccuccugcugucuaugcacacacucccucccccacagugccucagcucacaccugaguaucucucugcaugcucccagggagcuuccugcaguaccuuaggcauucugaaacgugugucuuuacaacaagacacacuuguuaaagcuguuuacaaaugagccuuggcgggggcggggaaagcugguuuucauuuccaguuauuuuaaauuuaggcuuauuucacacuucagcauucuuuuaauuaauguguuuuaauuaaaagaauuaauuauucuugguugguaaugcccuuuaauuugaguaaagaugauaucuaaggccagcaucuaguauuaaguuaugccuagauggacuucuguucauuuauucuguuacuggugguuguucuuuacuagugaaauaaguuaacgaaugccugccugucacauguggggccuuuauuuuguguucagcaggcaccuucuuugauaauuauaagagcuuagugacugagagaauucaguaaucuuccugaccccuaugccuucccaacaaaggagauuaucuuuuaguuuauagaaaggucacucagguaaaacugaaaucuccuucaaggcaagauaaauaucuuuauccuuaacugugucucugacaugccauuauuuuuucuucaguaguaguuugcuggcccauaagucuuuuaugugaacugcuuaugguuggaaacuuaaacacugucacuuuagcucagcacuuguuuauugacauacuuuccuauguguauguacugugcuaggaacugagugagcccuagguaaaugcuggagccaggggagauaaaaagagaguuuaauucuuguguucucuagcuaguuauugauuacuuguagcuaauuucauaagaaacucuuggaggaaacugaagaguaguuguagguucuaccuggaugugacaggauucuauguguaugccuggauaugaggacagcuuguugaauacugccuguuaauuugcuuuuggguggaucaugaggucaggaguucgagaccagccuggccaacaugguaaaaccccgucuguacuguacaaaaaauuagcugggcaugguggcaggugccuguaaucccagcuacucgggaagcugaggcaggauaaucacuugaacccgagaggcggauguugcagugagcugagaugaugccacugcacuccagccugggcaacagagcaagacuccaucucaaaacaaagaaagaaaaaagaugagagaaauauuguugugcuuuaagaaagccuuuuaaauuaaaaugugaguugacaccccagccagaauaagggugauggugucaggcuccugaaaaugauuuuguuguguauauuuuacuuauauacagcuuuuaagagaauaacuuguauaaaauaagauacuuaauuuuagauauuauuauaauaagucuuaacaaguaauaagauauaaaauuaaguaucuuauuuuauacaaguuaauuacuuauuagugguaauuccaccugcaggcuugaaguuucauggccuccaguguuucucuccaauggaaccuuugcuccguugaaccuuggauggcuuagaaucuggcacagaugcuaaggguugagaagugaaugauaguucuguuggcaaucuuaauuccuugaugggcaggcccaggaucacauccauaccuuagaaaggguagcagggaaauacuagcucagcuuccucccugaagaaugccaguauuuccuggaaaagagcugaagaggauccuauggaggagccugagaccacugcagguuaggagacaggaaggcagggaagaggagacaggaaggcagggaagaggagacaaggaggcagggaagaguugacaggaaggcagggaagaggagacaggaaggcagggaagaggagacaaggaggcagggaagaguugacaggaaggcagggaagaggagacaggaaggcagggaagaggagacaggaagguaggaagaggacuuuuuccaaggagccagugguccgcaguagggaugcugcugguugagggcuacagaggacguggguuaauggagugaugggagugggacguacuuuacugagggaugaaggagaggugcggaaucuuaggcuacucuggagaaaccuggagaaggagggagaugggagagaaauagaagcuagaauguuugcaaagaugaagcauuuugggguuuggugguuuuuuguuuuaagauaaaaagggggggaauuuuacaagcugaagagauggcacagagaggaaaaaguuuuauuugugguuaaaguagugagcaugcuuuucugaaaugucauuucucaaggagauggcggcuuggagggggucaauugaugguuaauaggaagccagucuaaugaaaagcuagcuauaccuuugaaauaggaaauuuguaguuagaaauguuuguguucucuuuguuuaaauuguagcuugugguauaacaaaacauucacucaucaaauuuuguaaagaauuggcuguaugcagauacuaggaagauggcaguaaugaaacagacacaaaucccugcucucagagagauaauauucuaacaaaaacguguuuguaagugugcgcagaacccauuucaugauuucugcuugguuuguggacucgacugagguugaugugagcaguuccuguaaaggaccaucccuaucccagguuguucagagaauuguuuuccguccaagcccucugaguggcucuuguguuugucuacccucuuccuaauugucgcuuuuaaauaccucauagaaauacucucucuccauauuucaacuuggucagcauguguaccugacuacagccagucaaauuuuggugcuggugacauggguguggcagugcacgugggaagguaauucaggaauuaccuuuuuuuugguaauaaugucagaguguuaaagugauuaguuuuuagagaguuaauuucggaccuauuuagaaauacccauauagauauuacuuauucucuugcauacugauaggcuuucuuggauggggaaagugguagagaugugauuaacgcuuugggcauuugugcgguuuaucuugucucugcuucgggucgggagugacuuguuacuguuuacaugaggcuaguuguguggcacucccuaaacaguuuauugaaguuuugucuuguguaugugacugucauauuaugauggcagaguuguugagaacagcugcuucagccuauugucaaacauuuuggcccuauccauccagcauacuucuuuuaggggacugaaggaaagggacccaggagugucugugcagacugucauccuaguaaugcuuacuuggaacagugaacacaaucgauucaagucucaagucuuuugauuuaccuuaauccauuugaauuuuguauuuuagccaccuuuguaucuuugacauaaaaccaucacaggguacuccucucagaaaucuuggaauaaaauugacacucuagaaaacagaugcuccauuuuuuaugcuuaugcugugguuuuaaauguauccugccagcaguauccccccaccuuaagcuaggagaaucuaggugugagaaauuuggauucggaauuccagcacugccccccagacaugcccauucacugacccccugagcuaguucccuuucuuccucuuggguugcuucccuaauaggaugcacuucauggcuuuugcaucuccccucccagccacaagaucuuugaaucucugaggguuuucuucaaggcauuuuauuccuacuuaccacaggaaaaauuaacagccauuaacaaaauuauagacauggguaaguuccuaaguuagguuuucacugaaauauauaugagucuagacucaugguucuuagcuucuuuacugaccaucucuuagucuuuuccugggguugaaagcugucauuuuucccaagaguggugugggagcucuucccucuuucugcagugccccaggacuaacaguggauacuuggcauacacaaaggccucagugaagcuuauuuacaucuuggagaucuuucuggcguagaaguucauauuggaaaggcauugcuuccucacagcuuccuauguacaaauacugggcauuugggagucuggaugaaagaugaguaagacaaaggcuuuguucucaaguaaaaguccaaggggaaaagauuaauccauuauuuuauuaaguacauauuuauugacuaccacccuugugccaggcuuucugcuggggcaggagacauaagcuugagacccauuuccguccucacggaucucaaagucaagagugggaaacagauaagaggccauuauagcagugcucuuugcugagugaggacugaggaagauuucuucacacugaguuuuaggggacguggccagugggggaggcugaaggcagcaccugggaugguuucuccaaggggacccuagagcuucaguuaaugaggugaacccuacagaguacugacaccaggaaauaugccuaaggaaaacuagauaaacuaggguuuuauuuuuauuuuuugcuucuucuguaugcuaggcaaacucacauuuuauuagcugucagucuguuuucauuuuucaguuuaaaaguuuucagguugauaacuuugguccgguaucagucagagugaugaugaauugagucaaagcuguuguuuuaaaaagaauauucauaugcaugccuaugaaaaagagcugucuuguuuuaaaauggaguaauacaauuuguguuacaaguacaguucuuugccccauuuccauucaaauugucauuuauaucugaaaucauuaaaauuagaaaacaguuaugaugaaugucuuuugaagcauauagcaggaaaagucauaagucaaaaccugccaguuuaaaguaaaugcaauuauuugguucuaugaaauuguagcuuuugcuauagugaaaagaaauuggcauauuuaugaacaacuccaggaucucauugaaaugaggaagacauuauuuaggaagacaguaaugauucagacuauauuuaggacaggauguuagaguuaaugugccuucucuuucaagugauuagugggcagaugacaucuuugguauuaaugauugccugaguuaacauuuuuaaggaaagagugccaccuacugaaugaagagcuuuuguuuucuuccauucaauucgaagaaucuuguuucacuuugaauccuuaguggguggcauuugcugggcagugaucccgucuuccaguggauugacuaggguagcuaggauucuuagagggaguuuaugcccccaaaaccagguguagaaacaaaaccuaagcauaaacaugauucagcacuuggcaagucucaaaaccuuaccaucauguuaauguacucacuggcccagaagguuuuuuguuuuguuuuguuuugagcuaggagcaaauggcugggaggaaaugaacuauuccaaaaaauaauugaaggggauugaagagcauaugacauuggucgagaucuucuggggagacuucguuuuccuagggaauaauauuagugcagagauugcuugaucacaacuuggccauaggucaguggagggauuccugaggucaaguugcgaauccaaaggccuacuucagaguaauccauauggugcucuuuuuguaguuccuaacaauaguaucucauuagugaaagguugaguacaugaacagcagcaaacacaccaguauccgaauuaaaggacaucauuugagaauuucgcauagucauuauuuuuaguauauugggacauuuuugauguuguggcuuaauugacuacuaggcaucagccaucuccagcuuuuuccacuugucgauuggauuaugcaagucaugagugguauuuaaaagagguggacuguaugcuaaauugauuuauccuugcuuauguguacagauuaaugguauaauccaugaggggugauagauuaagauccugaagugaaaaaauacauauauagugucagguauauuaaccaaugguuaguugccuuuuauuuuuccaguguaaaguauagcagauccuucaauaaugucauuuaguugaacauuuuggacaauuuugcuaaaaaguugaugaggauaaaaaucucuucuggcagaggcuacugucuguauggaguuugcauacuccccccaucucuggguggauuuucucucaguacucugguuucccccugacaccccaaagaugugcacguuagguucauugucaugucugcaaggacccagacugagagaauguggguguuuguuaaugcacccugcaacgggaugacauccuacccagggcuaguucaagucuggcacccugaauuguugggacaggcucuggccaccugugacccugaacuggaauaaguggguaaauaaucaucuuauuaauguuucuuaaauguauguuacagcucacauuuuuucaguguuuaguguuagaaguguuuggggucucuagaaguuuggugauguuuuugugaccagaaauaugccauagaaacuuucccacuuguuuacaucaauuggccuaugguaaaguugguuuuaaagucaaaguuucucuuauuguguaacuugccauugacaucuacucauguuacuuaaauaagcguuuuguuuguuuguuuguuuuuuguuuuuuugagauggagccuugcucugucacccaggccggaguacagugcccugaucucggcucacugcaaccuccgccucccaaguucaaacgauucuccugccucagccucccaguuagccgggauuacaggcacaugccaccacaccuggcuaauuuuuguauuuuuaguagaggcaggguuucaccauguuggccaggcuggucuugaacuccagacuugagguguucuacccgccucggccuccuaaagugcugggauuacaggcaugagccacugcguccagccaaauaaugaguauuaauuggcugaauagcaaguauucucugaaaacauuauuuaauaauacaaaacuuguaaauauuuuagcaauaacuguguuuucagauuugcacucagaaaacuaguaugacuuuuaauauuguaucccagcuuuucuccuuuuaaaaaacagaaaacccuaacuucuguaacuugacugagauuaagcguaucugauaccauuauuccagauuaugagaaaagucagcuguguggcuacagagagcucuggccugaaguaguuauuaauagaauucacauugggacguaaaaacaacuggaacugaaacuuggucugagagccgccauguuucaugucucauuucaggcuacuacuuugcaucuuuuugacuuacagcacuuaaauaugcaaaugcaaaauuguuaagguuuuuuuuuuuuuuuuuuaaagauggagucuuguucugucugucacccaggcuggagugcaguggcacguucucagcucacuguaaccuccgcuucccgaguucaagcgauucuccugccucagccuccugaguagcugggauuacaggcaugcaccaccacgcccagcuaauuuguguguguguuuaguagagaugggguuuugccauauuggcugggcaagguguuucacaccuguaaucccagcccuuugggaggccaaggcaggcagaucaucugaggucaaaauuguuaagccuuuuaaggaagagaaauguauggcuuauugauuuaaaaaaaaaaaaaacuagacagguuaauauuuuucauguaaaacgaucuuaaaaucuuugugcucucuacuuucucgaauguucugcuugacaguugucugaacuuucugagagcuuugauagagucuuauacauaauacgugccucucuuaguaauaaaguuugaauugcuaugauagugaauauuggaggagucuaaaaguucguaacaguaugucacccauacugauauacugccugaguuaguacaaggggucugcagauccacuuagcuaccacguagauggugaugauaccuuaagaaaggauuuucacauucaaaaacauggagagccacuggauuauagaaugacaaagaauauuuuacucaaaaaaauuuugggaaguacucuccagauuuaacgauuaaaaggaauuugugguccuauugagcuuucuaucuucugauggugucuaucugccugacaggaauaauauugauguggcaguggcgauaaaugaauuguauguucacacugaaugacccuaagcuaucaucuuguagucugaugugauuucauagguucuuaaguuccaaaaagguugugaauuucuuaagagcaugucauggcuaauggcacagucaggacuugauuaugaauuuccagaccccugaauccugucauuuuccuuuaguuccgugaagcuucccacaguguggaguaguaguucaguggugcauguuuauuuuuaaggaaauauuucaagcauacagaaagauacagauggaauacauuagauaauaguauaauaaacagccagaaaaccuucaccuguauuuaauaaauguuaauauuuuauuguacuugcugcagugcaguuggauguguauuuuuuaaaggaacuaauauuaaacaguugaagccuccuuugucuucuggcuagagcuucuucucucccucaauaccagcagaagcagccuuguacagcagucuucauauucuagauguugcuagucaacauuguuaccuucugaaaccagaaaaaaaguuuuauuuugcuacugucaucuguuuuucaaauaacuuguuaaaagaaguuauaauaacagcauaguggaggaggacaggacuuuaaagucguagagagcugguuuugaaacucagaauugucacugacuauggagaguuaaucaaacuacuuaaucuuucugcagguuucuucaucugcccaaugaagaugaggacucuuaccuuguagcuuuggugagauguaaagccacuguauggacaauaccuagaguaguacuuagaacagaggaggcacugcagaggcuagcuuuaauaguaguaguagugauaguaguaauucaguuuauugugggcuaccaugcacuuggugccauugcaaguacuucauccauguucauuuaaaaagugagguaagaauuaacuauauguaaaagacuuagaacaagguguggcggguaguaggugggucauaaguauuagcuauuauuauuauccccauuuauaggagaauaaugggaggaacucuaagaaguuaacuuucuucuaaguacuuuacauauauauuaauuuauuuaauccuggucgcuacuuuauaugguagauacuauuauccccauuuuauagugaggaaauugaggcacaaagaagcacuucuaccaagauugcacagguagugucagagcuuauaucuuaacccaggcagucucgcuccagaacucaugccccugaucgcugugccauacuucuucuguaugugguauggcuucuuaccuuaucuauccaguccuaggaacauaucuuucaggugguaugaucucuauugacuaagaaguccuuccugguuuuguuguagaugcaacacguuuccucaugugaccccagccuguuaaaauggggucauuuugauagaagcuaccuggauuugauucguuuggguggcuguugcuccauaaguaccuuuaacagucucuucaccccccacccaccaguucuuccugaaguccccagugugggucuuacaugugcugaauuuggccagugacccaguagccgucucuggucagcacugcuuucuggccauugccaucaccuccuucagccacauuggccucgcccccucggaccugcuucacccaccaguccugccaguaacaccaccaucagugcugaagaugcacaauguucccacugugcagaguuccagggucuuuacaaugaaaugagaaccauuccccaggcccauuuauuuuauuuuguauucugggacuuacuuguaaccauauagagaccuuuagagaaaauaaauuaccaagguuuuuugguuugguuugguuugguuucucauggcuuuuuugcuuucaccccagaccuaagagcuuggcagagaaugaguggacuggaccaggggcaaaucuuugugacagacucuggccucugcuagugguuggauugggccaggcuugaauuucugaugcccccuucucuuaggguggguucauacaacgagacuacccaucucgcuggcugucuaaauaaucuuuucuccccauauucauuuugaauuauuggagccuuaauugcacuacagacaugcuaaauuuugugauagcuuaaguaguauuaagacauuaagauuccugguguuaguuuuuucucugcaauuuucuuagaaauauugacuuacuggagccagagggucuguagagaugagccaguacagguuucuuagaguauguuccaaggaacacugcgcuaucaaagaugcucugcauaaaaggacuuccauggcaagugaaugugaggaaugcuacauaccuucuuuuuccccuuggagauuaaugacacauguaggucuuauuagaggcucugugcuguccugugauaaauaaagccaacuaacuuguuuuuaucaaguguucccugauuugcagaaucauuagauguuuaguauuauaggauuguuuuuuuugguuuuuuuuuuuuuuuuuuuuuuuugagacagagucucgcucugucgcccaggcuggagggaucucagcucacugcaagcuccgccuccuggguucaugccauucuccagccucagccucccgaguagcugggacuacaggugcccgccaccaugcccggcuauuuuuuuguauuuuuaguagagacgggguuucaccguguuagccaggauggucucgaucuccugaccucgugauccgcccgccuuggccucccaaagugcugggauuacaggugugagccaccgugcccggccuaggauauuauuuugccaaagcuaugucuucuguuuggaacaucuuuuggccuucaccaacucucucuuccaguucuguucuuuaaaauuauucaggcaucaccuccucuguggaucuuuucaggacucuccuagauaaaauuaaggauggagaucacuccaccuucgcaacuguuuaugggauguuaaauacuuuuauuacagcagaguugacauuguguuuucuugcuucugugagacagaaugauuggaggaacacagacccuguuuuauuuaucuuucguuuuuuaauuuuucuucuuugcugccuggccagugcuuaucugugguaggugugccagcauucauugaacggagugguuugcuagcauucaaagcauaaagaagaaaagcugcauuugucaggaagucauucuuccucauucugagcaucccaguuaacaugccuuuuuaccagguggaaggaaauaguauaguacuagcuguucuguagaauuuugaaagaaauccuucuccuagcaaagacuguaagagggcuuuguaugcuaauucgggguuauccccucuucuccuuuaaucucagagcauuaaaaacaguuaagggcuuuuuuaaaauagaagguauucacucaaaauauuacauaucuauaacuucuuaaaauacagaagcuuuaaauuuuguuagugggguaagaauuauaguaaguuguauuaugccauaaccuacauauacuaacagaccacuuucguaaguauguacuagcccuguugaguugaccacuuagaaguauacucaaacugcacugccacauuuccccaaagguaacaaguaaacauaggagaaaacauacacugcagccuucauguaacacugacuugggaucuuuuuaaugaacacccaaauggugaaggaacagagguuuucauuucacugugccaugcauucuguaccagugcccccagauaagggcaggaugcauggccuugcugagaacaccccuccccccacaguaguaguguaggaaguuccaaccuacuucucuaguguaacgucucucuagguuuaugcaucaguugucuuguagacauucccagcccuagauuugucaaguagcaaggggggauucuuaaaaggaaaaacacguuuagccaaaaacuguuuuguuuuguuuuuaaaaacauccuucuuacuuacugaucuguguucaacaauuagggaagaggauacucacaauguuucauuuuuccccaaagguuucuaaagguuuuuccucaaguaccaaggacacaacaaaggaaagaauaaacaguggaauuuuuagcgcagaaugucaaaagaauacaagguuuuauggguuuuuguuggaaaggaacaagugggaaaugggaccauauuaauuuuaaacucccucuguugggugcucagaacauaguuuaccuuaagccugauggauguucugaguuucuccccgcagggagauaggugaaagaguccuaguauuuagaaguacuguuacaaagcugauuacucugaugagugauauaaguguuuuaaagcaauauuuagucuaaguaguaaauauuccuaagacagacaguaacuuuacaauucauuuguuuuguugucuuaaauggcagaacaauguuguuuuucugucacuaacguuuuuauauguuuucuaagaugaugaaucauacagaaucaccaaacucauauuucuguucaggucugaccauuuuuacaauuuucauuugccuauguaaauauuacccacauauuauaguucauaauuugugauaugucagcagauuucauugaacuugagucuuaggucacaauagaacuaacaacauauuggcuucauucuaguccaauuuguuuucuuuuaugccuacacaccaaggguguucgcuugaaaacaagucuuccuucaccuccugcuuuuucuccucaccugcucuuuaaaaaauaauuguaccugacucaaauugauagucuucuaggauuuucauucgcuaacucaaauugcuagucuucuagaguuuucauuugcuaccaaguuaacuugcuuacuaacuugauuugucuuaucucuuuuagauuuauuuaaaaucccuaccaauuuuaagagucacugcauauucuugauuacuucugcauggcuauaucuccaugucccccucuccgaauucugauguguauuugacuuguuuggauuauauuuccuccuggcaaguuuugacuucguugcaguuugacguuuucuugaccugucagugcucaugauuguuuccguggcuuaacaaaguguacauauuuaguuucauuauuguauaaauuuguugauuuuucuguucaucuauuaacacauuuagaagaaagaacuuuucuuuuuccaaauuugaacagaacaucucaauucuauuagugaugugcuuaguaauguguauuggauugauuuauugugguacauuaauaacuugaaugugguaguuuuuaauggaaucugccagcuacauuucugagagacaugagugugccaaagaaacaccauaaccaagcuuuuacacuacugccuuauuuucuuucuggaacuaggcagguguaaagagaugauuuagaaaaccuuuuugcauuuuaucuuuuucuuaguguuuaucuggguuucagcugcaaggaauauagccccuuucguuugaugauguuuauccauauuuaaacauggccaccugaaaguuuagccuuaguguuuuaucuuaaauaugucagugacuuuggagacuguugaaguacauccauaauguuuguauguuaguuuaaaaguaaaaaagacuuggucgggcgugguggcucaugccuguaaucccaguacuucgggaggccgaaguggguggaucacuugaggucaggaguuugagaccagccuggccaacauggugaaaccccaucucuacuaaaaauacaaaaauuagcugggcguuguguugggcgucuguaaucccagcuacuagggaggcgaggcugcagaauugcuugaaccugggagguggaggcugcagugagcugagauccugccacuguacuccagccugggugacagaguaacacuggaucucaacaaaaaaaguaacacuuuuccugcaaggcaguuuucucaaauucauauuugaauauucuuaugacuauuuguggucaagaaagaugccuuuuaaucauaaaauaaucuugaauagaguuuuuaaaaaauguacuucaugcaagaagacaaaugagaaucuuuuccuucacuuaauaauguauucucugcucauaauaaugcccuggucuacaguugucaguauuuuaugcagacguuauuuuauauguuccaguggugucugaaauuuauagcacacugaguuugaguuaccaguaauaauuuacuuagaaaucccuucaaguuuauucaguauucaauagaggaucaguugcuuuaaauauauucauacauuuugagcauguaagaacauuuaguauaggagaacuguacaguuaauauacauuuuucuuuuugauucacuuuucuucucuaaagggagauuugggcauguacuuuauagacugagucaaagguaauugacugcaaaaaaaaaauugauacagaguugccacuuuuaagaaugauuugauacugacuaguagcucucugucuuuuguaaauucccucuuauuauaguuaguugccugaugauuguuacaaauuuacuaauuuggaaguaauaaaaacuuucgaauauucuuccuuuucucauugaaguucuuuaccuuuucucuuugaaguuacuuacauaucccuagaggcacuaguuuaugguagaaguuguuaagggcuauguuuguccaucaugaaugaugguguaacaucugcaugguguuacuucuuagaucuuuguugauuagaagugauaaucagcuacucugacucugaaucagggaguguuuaucaagcccaugacaucuguuguucugggugcuuuguuccuagcugcaggacaaggaaaaggcccugcccucaaagaauuuacccuuuccuugucuaguucagccagugauuguguguuuacaguaugauuaucuauuaauacauugucuuauuuuaauuuugguuaauuuuauauauauuuuauguuucuauacuguguucugguuuucaaaauccuguaauugugcuggagaauacuuuuaauuuuaaaacucaaauggagugguguuuugauggaaacuaauccaugauuuaggguaaauggaguuauugugcaugaccauguggaauauguuaucaauaugagucaaucagaaucacuaaggugguauuaaacugcuuauaugucuuguuuauaauuaguuguguuauugucuuuguuacuugacuuccauauuacuuaacuguugaugugguuaaucagaacaugagcuuuuugagggugaauucuaugcccauaucucucaaaggccuaaauaggaauguuugcacacaauacuuaaaauaguuuuuccacuaauaaagauuucugauacagauucaacauacuauaaaacugauuucaaccgggugcaguggcucaugccuguaauucuagcacuuugggaggccagggcgggcagagugcuuugagcucaggaguucaaggccagcccggacaacauggagaaaccccaucuguacaaaaaguacaaaaaaaugagucagguaugguggcuugugccuguggucccagcuacucgggaggcugacgcuggaggauugcuugaauugggaaguggagguugcagugagccaagauugcgccacugcacuccagccugggcgucagagccaaacccucucugucuuuaaaaaaaaaaaaaaaaagaaucaauccuuuguugugcuaaagagaggauauuuacccuauggggggauaaaaguaguagugccuguuucuuguuauaaauaaauagcaguugugccgucuuuaguccucagggucaaacuuuacugaauaaaaucuggaauaaaaucuugugggaacuaauuuucagaaugugagccauuuuuauacauuguuacuucuuauguaaaccuaccuauguuauaaauguuguaucauauaaagauggaagauucgcccuuccaaugguuuauuuaaucuuccuugcuuagaaggaauaggccaacaguuggcaaagacaguaugucucuggagaaacuaucuuacuggaaaauagaauuguccuaguauugagauaaagaugguuugguuuugguuuugguuuuguuugcagaugccucagaucuaggucaacagauuaaaaguacuuguaaauauucauuuuccuuuuguucuuggaagacacagacugugaaaucacucucaucugaguguaagucauaguguuuuuuacauauagacuuuaucaccuugaacauguaacugaaccucccauauccuuugucucaucuguaaaauggaguaguaagagccgcgucucaagagaauugacugaguaacccaugugacuguuagcccuauccuugggaaggaauugucagccuuucuguuucauuaugcucucccuauccucaguuuaagucauuccugcucuuguccuuuaccuggaaccuuacacuuuaagugucccacaauggacuaggauuguuuuggaaggucguuccucccuugcuguccucuuccucaguaauauggcuuaugaguuugguagugugugaauuucuucugcuaggaaggcuucacagguggaccuuaauuaguuagcucugaauugugccuaucccaaauaauguauuuucuaggguuccuugaaguuccuuggacaccaagagaaucaagauacggaaaucuuaauuuauaccuaagguuaaaucucauuaauuuccagaaagguuuucuacgaucguuauagucuuaguugccucuauugcagugaaaugcucuaauaaugaagagaauuaauaugcuucuuuaauuauuauaauuaaucaaaucgucacuguuguaaaaacuuacaaaacuuguuuggauuauuaucaaauagguaucagcacaggugcugacuucuuguaaaaacaaacuuagacugggcagugaacacucauagcagcagagaguacagcucuugaaucaaaccuguggggguuugaaucuggcccugccacucacuuacaaacuguguuacccugggcauaacccagccuccccaagccuccgauggaaaagaccucacaggguugcuggaagggugcaguaaauucauacauguaaagcaccuaauccauugucuggcauguaauauaauuuuucugugaugacacucuggcaguuauuucuccauaucgcugguuguugacaaacauaauauuuccuuccuaaggaugagccauuuaauaaauaacuuaaaaauuacaguagacugguaggauucuuuuuguuuguuuauuuuuuuggacauggaguuuugcucuuguugcccaggcuggagugcaauggcgcaaucucagcucaccgcaaccucagccuccuggguucaagugauucuccugccucaacuucccuacuagcugggauuacaggcaugcgccacuaugcccggcuaauuuuguauuuuuaguagagaugggguuucuccauguuggucaggcuggucucgaacucccaaccucaguugaucugccugccucggccucucaaagugcugggauuacaggcaugagccaccgugcccggccaggauucuauuuuugaguguuuaugaaauguccccugugugccaggcauugugcagaacuaguguuuuagucagacuauuugagguugcagggaacagagauggguuaaaauuuauuucauuccaaauuaaagaauccaccaagaaguuuccuccauugcagcauguacacuuggcccguggagaacuagucauucauuauccaggggugguauaaaaguggcugucaucaucuaacagcuuaucaggggacccguguacaacuuguuagguugacuuuuguugcuucugcaucccugucuuucuucuaauuucucucucuucucccuuauuucugucucaguguuucuacuuauuaccuugcucuguuuccguguuaagugccacucuuccugcaguaacacuauuuguguguuuuacuuucaaacucucagggagagagcugacucaggcguacaauaccguucaguacagaaggucauuggaccaaggaacauuccuggaccaggcagcuguggaagcugggauggauucagauguauaaagcaccuuaagcauuagccaccacccuuaggacugggcagacccuucgcuucccagaaaggggcaguaugucaggucacugggcagugugauagaacaaugaauaagagggaacuuguccuggaagagcucacaauguggagagggaagcagauacuuaaacauauacuuaauuuuaugauauauuguaguuaauauuuaccaugcagcgggagagcagcuaacugccguagaauggugguaggaaauucuucauugaagccauauugagauggcaaaggguauuccuggcagggaaaaaaaaaaaaaagucaucugcagagacgggaguaaaauaucaugguauauuuaugaaguuuuuuugugcuaugagaagagggccauaguugguauuuaaggggcuccaggaagaaggucuaauuuaugguacugaugaagaugauuagacauagaaccaggagaaaaagaccucauagaagaguagaggagagaccuacaagagaguuagcacaaucaacaguggcugacaccacauuauaaggggaggacugacuacaguuucccugagaagggacccuugaagcaucuugguuuuuaacaggugaguuuuguaggucuaggaagagucuagcacuagaaaccuaaccucagggaguaagcguucuugaaguucugugucaggucacaaauucauucuuaggaaugucuagaaaccaaaaccaagaaaccucauguuuccuaaauaaacaggaaaugaagauaaagcuugaucuguaauagugcuuaaguuucucuuauuuuucugaccacaauuuuauuuauuuuuaagucuucaagguaguuucucaaaacacauuguuuagcugaaaucuguuauuuuuuuaaggucaaaaguguauacacuauuauuuaaaauagguauguuucuggguaauguuuggcaaaaauaacuccccgaaacauucacguuuaaccaacaugaguuggagauggcucucaucucccagugacuucacagcuaucuguuuagauuagcuuugguuaaaaaaagauuuuuuuccugcuauggcugugauaucuuaauuggaugauaaaucacugcuauauacauacauacauacacacacacacucaucuaguaaaaaugaaaacccuauauaugccuggcuuauggaagauuauauguuaggauuauaacaaaaacaauacaaguauguaaaaaaauuuuucacaguuugguucuguuucagagagaaauuaaacagaguagaugugauuuauucguggcaaauacaauaggauuuacuauauauuucauugauucaaagaucccagugguuguaaguuguaccauuauuuuauauacuaugaaggaaauaacaccugccaguuaaauuauaauaacuuuugauugcaagaggcauucauauuucagauauuaaaaugugaaaaaauacacauuuuaaaauuaaugacauguaauuauuacaaagagacuaggaaaaacacuuugguuuauauuugcagauuaauuuaggaacagugaaaauuguucugaacaacaucuaaauugcaaauuuagucuuaauuaaauacagaauuauaaaaaaaguuaauaagaauagucauuaaaauuuaaaacugggaaggcuguaggacugccagaguuaauaagugaucauucacuuaauauauguucauacuuauuaugagccagacaugcuuagauguuagguguauagauggcgauaacacgugguccccucacucauggagcuuacaguucauaagagaggaacaguuugcaaacugcauuaaccauguuaaaggaaaaauacaagugcugugaaagaauggaacugggaguucuuaauugaaauugggaaagucucugaggaguugaggaaaaucuagagaguggguagaaauuagguaaaaaguagacagagaaggaagcagccuguccagaagcccugaguaggaaagaucuugggguuauugaggcagugaagaagggggguugcaggucugaugacaggaauugaggugagaccacgaggugcagggccacuuagguugggcuaaacauuuuggauuuuagucuaagcccggggggaaccacuagagcauuuuaauggaggaaguaacccuggcugcacugugaaaucuggguaagauucaaaguuaaagaagccucguuaggagccuguugcuaguucagagcagguuuaagagcagcuugaccuggaugggcgugugaauggaagacauauuuuuuagaagauuauuugacaauauuaucaaaagucuucauuuguguacauuuuuaacccagcauuuccauuucuagguguuuauucuaaagaaauaauuuaggccaaaugugguguaaucccagcacuuugggaggccgagguggguggaucaccugaggucaggaguucgagaccagccugaccaacauggugaaaccucaucucuacuaaaaacacaaaauuagccaggcgugguggcacaugccuguaauacuagcuacuuggaaggcugaggcaggagaaucacuugaaccugggaggcggagguugccagugagccuauugcaccauugcacuccagucugggcaacaagagcuaaacuccaucucaaaaaaaaaaaaaaaaaagaaagaaaaaagaaaaaaauaaucucauaguccuuaaacauaaauaagguaaaacgaaauuuaaaaaagaaucucagauguguguaaaaguucagcuacuagaaugcucaucccuauuauuuaugauaaaagaaauuggucuaaaagaugacaguauuuucaaacaaguggaaaggaaagagacacauuagacuuuaaggaggccaugccauccagaaagauuuguuuagacaaggaacauccuuuguguguuugacucagggccaggaacagaaacugaaaauccauagcagagaagagauacuccugaaacagauuugggggaagagagauagcuaggaccagaggaaagacuaucaagcaccuuggucuaggagugcaggaguuucugguauaaaaaugcacugcaguuccacugugaggcuuauuuuuuggaacuagccugggaaccaaaccaccucuugcaacauuguuacuggagggggaaagcgcuuuuaauacuaaagacuuggaagugaauuuuuauuaugcagucaccacauaaauucaguugccuacaaagcugagccuccuggaauaccaacugagcaggauggacuuuuuuggaagacacuuuauccccuguguucuucaccccuaccucucuuucucugccuuccucucccuccuccuuuuucuccuccuccuuucuucucugccuucuucccuucucuccauccccccuuccucuuuccuucuuucuccucccucccucucuuacuuucuucuacacauccccuaauauuuauauuuuauaaucagcauaaaaagcagccaagcacauauaaguaaauuagauaauccuccuuuuuucauacuuuuugaaagucucauauugcuucuauauaacaguauuuguguguguauguguguguaaggaaauauuuuacgcuguggucuuaaugccuauuugcaaguuucaaaccaaauguuauguauucuuuguauuucuaaaaaugucuaggccaguugcugauacaaagauguuuaauauguugccuucuacuuuccucacagucuugaugcuucagugaaacggguuaaccguuuccuuucuagugaauauuuuuuuuuaaguaguuucuucuuccuuuggcugauucucugaagaucguacuucauaguugugauuagcuggaaaauuccuagaggaguuugaauuugucuuuguaguaaacuugagguucuuguuuuugguauuuccuugaguauuuccuuuuccuaucaguguagaaaaacuguucucuagcuuuaaagacuuuucaaaauaguuacugaaauuagcuuaguauuuuuaaaguuguuacuaaucccaaggugcaguugcuuuaacugcauccuuauaaaucagguuuucaaaucuaugcauaucguguaugcauguaugcucauguggauauggguauauuuuaaaauuagugauuuucgugagcuugaugcuuugccuguuaggcuuuguagaguuaauucucaaacguucuuaguuuagagauuguuuuauucugguaaauccacaccauuuuauggaguaaagaucaaauguuuguacuggauaauuuuuauucuuuauagaguaccccaagugcuuuguuaugaagucacuguucuaugaaaauaaaaauuuaaucauguaggcuaugaaaaauuguuuuggggucauagaugauguaguuaaguuucacuucacuuauuaaauauuuauugagcuuauuucagauaaaucagcauauccaccagauucuaucuguauugacuuaauuuauuggaaauccugggauaaaaguguaguaauacacccuucuaaauauuuguuauuugggugguagaauuaaaaacaaugcagucuuagugaauauauuuguuaauauagugcuuaaugucuugggauucauuuuguuaacuacaguggaacauaggucugcaugauauaugucaguaguauauaauucagaaucuuuucaagcuuuaagucauuugggguuuuuagcaguuaucuuuuuuauuacauguccguuggaaguauaaaauagaaccauccauucuguuuguucuuggaaauuauuuuucauauauacauuucucauuuuauuuguuucugccugcauuuuagucgugagauggagaauaaagaaacucucaaaggguugcacaagauggaugaucguccagaggaacgaaugaucagggagaaacugaaggcaaccuguaugccagccuggaagcacgaaugguuggaaaggagaaauaggcgagggccugugguaaguggcuauggguuaccaguuauaaggaagaaagcauaggaggaaauggaaaaguaagcauaaauagauccucuuguaagcuuuucuucuucauuuuaaauguaguaguuuucuuuacuugauauuguggucauuuggaagaaaccauaauuaaaacugugcucauuaaacaacuuaaacuauucugggaacuuaacuguuguguuugguggagggguaaaugcuuaaaccaagacugcccucucaugucaguaucuaaaauccuuucauuggaguuuuauacuguacuuguaaauuuuaaaaagaauuuuuccaguuuauuuuagauguuuuaucucuaagacaggauccaaggaucuuaauuucagaaaucuucuaggaaagaaaacauuuaauugcaguaauucauaaguguaaugauuggguuuucacaugcaugcauaagaugugcguuucuccaacuuuguuacagugucagcauguuauccucauuugacaugaaaaaauguuuaauagaccuauggggauuaagauaaauuaaaaaugugugggguuugaugaaagaaaaucuagaguccuagauuuuaaaaagcagggauacucuguccuuugcuauagguauaagaauauauauucuuauaagaauaccaucaugaaaugugugucuucauucuuacaaaggaagaaguauuacaguauccuagcacuaaucucucucagcaaguuuuuauuuuguucuuuuaaaacagauauggcaacuuaaaauucaucuaagcuuugacaagggucuaaauacaccccugccaagugauugucugcccuacauucaucccauaugccuauuuaaguuuacauuuaaauuaauuagauguaaauaaaaguaaaaauuuaguuccucagucucaccaacuacauuucaaaugcucaguaaccacauguggccaauggcuaccuuuuaggcagugcaguuuuagcacauuuucacugccucagaaagcucucuuagauguguaguacugacucgugucugacuuaaauaacucaauaaucccuguggcuuucgauauccucaucacugagcugcagucugucaggaauauuuuacccacugguucucauucuaaccgauggaauuauacagaauaaaucuaauuguuccuuuccauaccagcacuugguaaguuauuaugggcccgugaguccuugucuuuacagcuaaguuucuacauuucuuccauuuauuacucacgugaggugguauggugggaaccccucaccauuuuagcuauucgugccagaaggugaauaugaagaaauuaaggauuuaucuuagagaagagaaagugcuauugaaacaucuuguagaauguuggcaguuaaaagggcauauuacuacucaaucaauauaaagaacuuuugaacaagcagagccaucugaaguuugaaugugcugcuuucugagcuccuuuagauggagguguucaaacagccuaaaucuuuugagaauaccguagggcauaaaucacaacuuuuuaaaaaugagccagcuauuuguucuuuauuauacaugaacuaagaauauccaguucucuaaaacaaaauuuugguuuuuauacuguucacuuucuagcaaguaccaaaguaccuugucuguauauaagacaugagugaagagggaggagauguguggaauaagaugcauaacacauaguccuuaagcuuaauuaugccacccuacauuuuaugauuuacggauuucguauuauccuuaggaaguuuacuguuuacuugggaggucugauuuuguuuguuuuuauacuuuaaguaaguugugucaaaucauucuugaaacauaaaggguaaauaucuccaaaugggaaaauuagacuuauacauaauaaauagaguaauacaugaaauaucacaaagcaacuugugacuaggugccaaaugugugggaugggcagaagagcaauagggacuuaggaaagagaaggaaugucuugcugguagacuucagggaaguuucauaaaaggaagaauuuuaacucagcguagaaagauggguaaauuuuccucaugugaagguguacugccuggggugcugcaggcuggagaugaguauuaaaauaggaggagagugagugaaagcacaggaggaggaagggucaggcaaguuuggugaacacagcaacuggcuauagaacaggagcagugggagaaaguccagaaaggucugcugagcuucaguuguacaaagcuguggaguuuggccuuuggucauggcuagauuaggucugaaagccuuaauuaaaaaaaaaaaaaaaaaaaggcaggucuuguaaacugcauuucugcuugagaaauugaucuuuaaacuucuagucucuuuugguuuucugagauacacaucuaaccuauuauuguaauauaacauuguaaagaaacacacacacaaagcagggaaaaugauugcauagugaucaaacuauuugaaauuaugcccaguguuguuucaagguccuacauuuuguaaaaacaaauaaaaacguaccuagaucuuugaucuaguaguugaauaaguugacuguagaaguuaugagugcuuauuuuucacauuuguuuaaucaccuuugauuguugcuuuugaguguuaaaugaguuaggguauauaauaacaaauaauaccauuucuacaguuuuguaugcauuacaaaauuguaagggaggagguugcguuuuaacuaguguuaaauccuaaaugacugaaauuugugcagguaaaaauaaucuuuuacauuaauagcuuaaaguaauaauaaaaguugauauauugucugguauacugguauaauauuucauaacaaaaacucauuaaguguauuuccuagucuaugauauuuacauuuacuuaccuuuuauauuuuuaaguaaucaaaauauuggaauacuuugauucaggugguaaaaccaaucccaguuaaaggagauggaucugaaaugaaucacuuagcagcugagucuccaggagagguccaggcaagugcggcuucaccagcuuccaaaggccgacgcaguccuucuccuggcaacuccccaucaggucgcacagugaaaucagaaucuccaggaguaaggagaaaaagaguuuccccagugccuguaaguuaauguuacaacaaauauguuaguuuuuauaauuuuuagcuucauuuauaacaaagaaaagacuggccagccaucuguuagaacaucaguuuucaaaauaugaucugcagaccccugaggauggggggggugguuccugagacccuuucuggggucuauuaggucaaaacuaauuuugugauaaaacugggauguuguuugccucuuucccugcauugauauuugcagugguggguaaagcuacuggugccuuuucccaauuuaaggcuacaacuguagaaacuauauucauuauugcuauguaucagccauuaaagaaaaaaaugccaguuacacuugauaaugccuuugacaaggaaauauaaauuaauuuuauuaaaucuugacucuuaguaaauacgugccuuuguaauauugugugugaugaaaugggaugcaugcauaaagcacuucuacauaccaaaauccaguaguuucuaaaggagaaguauuugugcgguuguuagaguugcaagcugaacuaguuauuucuuucauggaacaugaaaugagugaccaacaaacuaugauuauuuagauuuggguauuuggaagacauuuuucuuaaggugaauuaaaugagacugucacuucaaggaaagcaacuuaaggcugggagcgguggcucacaucuauaaucccaccacuuugggagggcgaagugggcggaucaccugaggucaggaguucgagaccagcuuggccaacauggugaaaccucaucucuacuaaaaauacagaaauuagccaggcaugguggcagaugccuguaaucccagcuacucggggggcugaggcaggagaaucgcuugaacccaggaggcagagguugcagugagccuagauuacaccauugcacuccagccugggcgacaacagcgaaacuccaucucaaaaaaaaaagaaaaaaagaaaagcaacuuaaguauuuuuucacuaguguuaaaaguugagaugucgaaacaaaaauuagaauuuuagaaagcuacuauccaccacuaugagcuugacagccucccagugcuuagacuuuucugauaagauuggugauaacaaaugugauuauuuucaugcuguauaaugaaauaugugaacauuuggaagaucugcguaacuuaaggaaccaauauuuuccacgugaucaguguaugauaauaacaaaauuauucauagguaaaagauacauucaaaguguaaaauacaccauuuggauuuuuaaugugccaguaggaaaaguuuguugaugugguuucagauuccacauuacaacugccuuuaagaaaccauuuuuugagcuuugguauaguaccaaagaauauucaucauuauuugaacaggcaguggcucacaccuauaauccuagcacuuugggaggccaaggugggcggaucacuggaggucaggaguucaagaucagccuggccaacguggugaaaccccgucucuacuaaaaauacaaaaauuagccaggcgugguggcaggcaccuguaaucccagcuacuuuggaggcugaggcagagagaauggcuugaacccgggaggcagagguugcagugagccgagaucacgccacugcucuccagccugggcgacagagugagacuccuaaaaaaaaaaaaaaaaaaaaaaggggcuauuaaaauacuccuuccuuuuacaucuacguaucugcaugaggccaaacuuucuuucauauacuuuaaucaaaacaucauaucacagcagauugaaugcagaagcagcuaugagaaucuuagcugucuuguauauuaagcuaaacaucaaagaaauuugcaaaaagauaggugguaaauucaugugagagagagacuucuaguaguggaaaugcauguuaagacucacuuucuaacuuugaagaacaaaugauugaauggaaaaaugguugagauagugaccacaagaggaguuuggguuuuuuuuuaagaucuggaguuauuaagguacauaaauucguuaaaaaguacauuuaaagcaaaaacauuuuacaguaaaaccugaugcccaacaguaguuguuggcucuauguuaaaauaccuuuaaauuaacuauuaauuuuuguuaacuuaaaacaauaaucaguuacuagcucacgaaucugcagauugggcagggcucagcagggguggcuuaucucuguuccuugugacauucucugaagaugaaagguccaagacugcuucuucacucacaugccuauugcuucagcugggauacuggaacacuuggggggcuguuggcaucucuuccuccuagcacgaagacuggguugcaaagaguauuguuucgagaggcaagucucaacaugcaggcucuucucaagccuccacuucauuguguuugcuaaugccuuauuguccaaagcuaguugcaugcccaaacccagaauugaugugauagggaacuacacaagaauguaaauacugggagguaugguucaugggggccaucaaaaugaaaguuuacaacaaguauaaacagaacugucuuccuuccccacaccccacccccaaaacccacuuugggcauauaugcuagacaaaguuaccccucauucuuuuuaacaguuacauagccuuucauuagcuggauaaaucaugguuuauuuaaugaaugauauacuaaugaacauuuauaaucuuuuuaaccuuuuguuacugaaaacagugcuucaaaaguauuuuuauacguaugucaucuuguacaucugugagcauguaucugugaacauauccauaggcuggauaccuagcaggucaaaaugacgugugcaugcauaauuggcuuuuuuuguuuguuuuuacuuuuuaguaacugcuuuuuuaaaaauaauggcuuuauugauguguaauucaucuacuguacaauucaccuguuuagauuguacaauucaguguuuuauaguauauucacaggguuguguagccauuauuacggucgguuuuuaaacaucuuuauuaccccaauaagauauccuagaccuauuagcaguauuaaagcaaaauagguaguagguagccugggguuguuucuacaccuggaaaugaaaccaaccuuuagccaaucacaaacagccagccagccuauuuguuauauaacuagggacuuugcauaaugccaugcccaaguaaggcaaacaccuagcuguagccaaucagcugauuccuuugcuuugcuuugcuuuguguucagccuguaaaagcuggcuguucaaggugcuagaucagagaucucugaacuugcgguuuugaguaccacuugguucaugaaucauucuuugcucaaauaaacucuguuaaauuuauuuugucuaaaguuuuccauuuaacaacagucucucccaacccuaggcaaccacuaaucuauuuucucuauauauauaauuugccuauucuggacauuucauauaaaugggaucacuuaauaggugaucuuuuaugacuggcuucuuucacuuaguaucauauuuucaagguucauccaugcuauagcauguguuaguacuccauuuuuaauugcagagcaauauuguauggauauaccacauuuuguuuaucuauuaguugauggacauuugagcugcuccuguuugguggcuauuaugaauaaugcuacugugaacauuuguguacaaguuuucagguggacauauauucucauuucucuugaguuuauaccuaggaauggaauugcuggguaauacguuuaacauuuugaggaacugcuauacuguuuuccaaaccagcugcacauuuuacauucugccagcacuauaugagaauucuaauugcuuuguggucuugccaacauuuauuacccuuaacuauuuaauuagggauccaaaaaacuggaauuuccacuggacauugauggaaagaccaaguucuaggaaaguuaguauagugagaguguuauauauuauccucacccuaggagcguuuuugucagcuuccacuaauuuguuuuuauugaggaagagucugcagaguguauguugggaggcauuccauggcagcguuuguaaauuuccuguuaaagaagauuaauaaagccuucaauagaucccaggaaguuggauuuuuaguuuuuacuacuagacacagcauucugccugcuuaugauauauacuuucuaugcuuuuuguuuugguuuauauuagauguuucaaagaacucaaauguuaauagaauaauuuauaaaauuaccacaugguugucucucucagccagauauuuaucaacauuuauggggaugacugagauuuuaaaaguucaccugagaugaguaugucagacaaaaucauuuagccuuuguuccauaauauuuuaaaucugacauuuuuucagacuauaaucugccacaugacugucuuguaugaucuucuuuggauaauaguuucuuuuuuuuuuuuuuuuugagauggagccucgcucuguugcccaggcuggagugcaguggcacaaucucggcuuacugcaaccuccaucccagguucaagugauucuccugccucagccucagaguagcugggauuacaggcaugugccaucacacccagcugauuuuuuguauuuuuaguagagauggguuucaccauguuaacccggauggucuggaucuccugaccucaugauccgcccuccucggccucccaaagugcugggauuacaggcgugagccaccaugccugaccggauaauaguuucuuaauuaagaaaugagaaacguaccuaauaaaaaaaaauguugugaaguuucagaguggcagaaucacaccaccccgaagagccccuucaccagauggcuucucaccauauagcccugaggaaacaaaccgccguguuaacaaagugaugcgggccagacuguacuuacugcagcagauagggccuaacucuuuccugauuggaggagacagcccagacaauaaauaccggguguuuauugggccucagguaggauucgucaccauuuuauacuuuauuaguaguaguauaugguacuaccucaaauuuauauacuauaauguucuuaaauuuagaucaauuaauucccuauaguaaacaaaguuaaacuuaaaauguauuuuaggcuaauauuuuucuuuaauguauuuaugagguuuuacuaucuuaauauaccauagaauagaaauuugaucuauuuaauaaauucagugaaaaugaaagauuaaaucauggaaauagcuguagauuuuucuuauauacaaagauaaugaagaauaugaauuaauagaaacuuuaguauaaaaaguuggaaauauuguaaaagugauaaauuuagaaguucuugugaaccacagauguauuaaccuauagguuuucuuuuuaacucuuuagaacugcagcugugcacguggaacauucuguauucaucugcuauuugugaugcuccggguguuucaacuagaaccuucagacccaauguuauggagaaaaacuuuaaagaauuuugagguaguuuuuaauaaaugcuuagaguaaaauuguuagcauauucuuaggauauauucuuaaaauuuauccuucacuaaauuuaggcagugaccauuuuaaaggugugaagguauguaagaauuaguugaugcuuauaaauaguucucaugagauauuuacuaaacuuuuucuucuagcuugaaaaaaacaaacacugaccugcuguaagaauguuguccuuaguaaaaacuauaauguguucuuauuuuugaagcucuuaaaucaacuuuaugaaaaacaugcaaauuaaagauaaauaauucagccucuagaacucuucauauguauaauuauggcacaaauaucauuguuacugucuuuuuccaauguuagguugagaguuuguuccagaaauaucacaguaggcguagcucaaggaucaaagcuccaucucguaacaccauccagaaguuuguuucacgcaugucaaauucucauacauugucaucaucuaguacuucuacgucuaguucagaaaacagguuaguacuuuuuaaggauuucaaacauuaauccaguguuacuuuuaauuuuagggguaauuuuuuauaucuacuuguuaaguugcucuaaaaugauuuaauuauugaaucuuggcuuucaaguuaaaaucaagggugaagauacuaaaaguucgcugggcaugguggcucgugccuguaaucccagcaccuugggagacuaaggcagaaggauugcuugagcccaggaguucaagaccagccugggcaacauagggauaccccaacucuacagaaguaaaauaauuagcugggaguggugauaccuguagucccaguuacucgagaggccaaggcaggaggaucgcuugaacccaggaguucaagucuccagugaccuaugaucgcaccacugccuaggugacagaacaagacccugucucuuaaaaaauauguggguguguguauguauguaugucuguauguauguauguauguuaaaggucaugugaguguguguguguauauagacguuuugugcuaaaaacuacagcauucaugugaaucuucuuucuguucuguauauugcuuuauugguuuuaguguaaaaauuagauuuuuaaaaauuaauccacaaaggagugcugcuucucuuaccagggcaccuucuauguuauucccgaagugcccaguuugagaagcauuguucugagugguuaaauccugucuucauccuauuaaucuguuaaguauuguaacuaccucaaaauucaugaagaaugaaaaagugacagggucguaacaagggugcagugaagagaagagagguuuucuucaucuguggaaaaaguaaauguuugaagaauuuucuuaauuuugauuaaaugaaauaauuuuagaauccuagaguuuuacgaguuuuuagacauugaagauuuucuaguuggcaugucucagugacacagcgauaagugaagccaagagguuaugcagcucauuugaggaaagguauagccagaaccuggguaucuuuguuuuaccccucaucucuucuaaauaaaaugaaaaaaaugagcuuuauuucuccagccuccugaacuccuagccccaagcauuccucccaccucagcgucccaaagugcugggauuacaagugugaaccaccacacccagcuccuuuuuccuuuugagugacauuucuguaacuuuuuacuguggagaaaaauaacagaugcuuaaaaccaaguagucaaaauagaaaguuucucucugagguuaaauauauauauuuggauuugcauauccauggggggaaucacaaaaguuaucuugguuacugagauuguacuguacauacauagauagauuuuuguuucguauaaccacuauuuuuauaucuaagaucaauaaaaagaaaauacagaggaaauuuaucuggaggucugauuacauacaauuuuaaauguuaugcccaaaacaauaauaaaagaauuaggauaaacaaauuuaaaauucaauugaaaaugaagggcauaaagagaauauccaccaaaaaagaauuuuaaggggcuaagaaacacaaaaacuguucagucaaccuaauaaccgaagaaauguucauuuuuuaaaaaaagauaccaguuuuuauuuaccgaaauaaugaagacuuuuuaaaugauguaauucaguuauuguaagcaugugcuugaucguauguaaagccguauagccuuuugaagaaaaaaggaauauggcuuuuaaaaacauuuauauucauugauccaguaaauguucuucuuaaguaaaaguuuaaucugagaaaugcaaaagccucacauauaucauauaugacuguuucucauaguauuauggugaaaaaguagaaacaguuuaaauauccaacagcaauugaaugauuaaauuagcauaugcccauguuacaaaugucauguaggcauuaaaauuaugcuuuuggagaacguugaauggccugggaaaaugucgauaaguaaaaccaaaucuagguuauaauaauauauuaugcaugaacccaguuuuauauagaaaagguauuacaaguauguaaaaaucggaaggaauaaaaacuucacugguuauuaauaggaggugcuauuauggguaacuuuuuuuaaacuuuaaauauuuugugguccauuuggucucuuuuaaaacuacucagcucugcccuuauauccugaaaauagccaaagacgauauauaaaugaacgggauggcuauguucaguaaaacuguauuuacacaaguaguccacaggcugauuuguuuuccuuauaaguucauuacucccugcucuauacuuguaauuuugcuucagaaaaaacuaugcuaaaaaaaaucugaaacgucaaaaaaaaaugaguacaaagauguuuguaaugguuucuuucuuucuuuucucuuuuuuuagacggagucucucucugucacccaggcuggagugcaguggcgugaucuuggcucacugcaagcucugccucccggguucaugccauucuccugccucagccucccgaguagcugggauuacaggcgccugccaccaugcccagcuaauuuuuuguauuuuuaguagugacaggguuucaccauguuaaccaggauagucucgaucuccugaccucaugaucugcccgucucagccucccaaagugcugggauuacaggcgugagccaccgcgcccggccguaaugguuucuuaaaauguaaaaauauggaaacagcuuauauguccaacauuaauggauacuuaaaacaggaucuaucuagucaguggaaaauuaugauggcauuaaaaauuaugugguggaagcaacccagguguccaucaauaaaugaauggauaaaaugugguauauacacauaguggaauauuacucagcuuuacaaaggaaggaagugugcuacaacauggaugaaccuuuaggacauuauucuaagcaaaauaagccagucacaaaaagacaaauauuguauaauugcacuuacaugagauacuuagucaaaaccauagagacagaaaguagaaugagccuaggugggaggauauguugaccagccugggcaacauagugugacccugucuguaccaaaaaaaaaaaagagaaaagaaagaaaagaaaaauuagccaggcauggguggcaugccccuguggucccagcuacucaggaggcugaggcaggaggaucucuugagcccagaaguucaaggcugcagugagcuauacuugugccgcuguacuacagucugggugacagagcaagaaccugucucaaaaaaauguagaauggugguugccagaggcuggaggaaggagaucauggaaaaugguguuuaauggguauaggguuucaguuuuacaagaugaaaaggauacuggagacacauaguggugaugguugcacagcgugaaggcauuuaauaccacucacguguacacuuaaaaaugguuaagaugguaaauuuuauguuuugcauauguugccacaacaaaaaaaagaauuauguauaugaagaguuuaagugcaauuuuauaauaaaaauuuuuaaaauaugaaauagugcauauauauacauaaaugaucugaacaaugcuuacaaaauauguacuuggaaaaaagaugggcaggaaauaccccggaaugguauucuuuuuguugucagagaaguauuuaauaaguugcacuuauaauuugacuaaauugugaaacuuuauuuuccucuaugaauaagcuuaauuuugguauaauuauuugaaggguuaguugaccuuggauuauuuuugccaugaauauuuuuauuauagguaguuguauacaucauuucuguaaugcugcuguuaauucuuuguuacuaaugcaugcauagucuugacaguuuuuccccauccuaaguagcuccauaauuaggaaaagagaugggcagguacaucaggagggacagacuaguaagugugccuucaucacaggaaucacgcauuaugacuuugcugacuuguuugacuagcuuuuuggaaagcuuuuugugcauuuggggaacugguuauuuugcugguaguuacucagaucuguuuuucagggaaaaguaguuacuguuuuugccauuacuucuaauggcaaaauuagaauuaaaaaaauuagaaguaauggcaaaaaccgcaauuacuuuugcaccaaccuaauaguuuaagauaguagaagugcaauauugggccuagcuuagcagacucugaaauuuauagauguuguaaguuuauggcauauucuucucagauaaaaguguaaugauagaucugccacaaacugauuuuaugauuugaggcaacuuauuuaacaucccagagccuugucuuuauauuauaaugaaaauacggcuauugauuuuaaaagccaucccucacaucaugaagguuuaaauaaaaacauuuaugaaauagaaaacuaaagcccucuuuagccuggcugcacacaaaauaacuacuguuaacuauuucauacaacuuuuaaaaauuacauaaaucaaggaaugaaacucuucuuugcacacuucguacuucagcaaacacaugcacgcacguucccccauccauguuucucucaacuuucuuacuguuuuuaaacaaauacaaagucaugccauauguucuggugugcaguuuucuuuuacuuuuacuuuauauaucaagaauauuuuuccacaucaucaccaaauuacauacuuuuuucuuuucauggcuguauaagauuauguugguacaccauaauuuauuuagccauugccuuaauuaauguacauuaaguacaucuccacuuuuugguuuacauacuuaaaauauguagcgauaacauccuagaaaauaggauuuuuaggucaugaauauauaccauguaguauuuuaagaaauacuaacaaaauuuccuuccagagauuuuaguuuuuacuccuaccagcagucuauaugagaaccugguuuucugugccauuaucagggccagauguuaccaaucuauuauuuuuuauuccaauugccuuuuuauuuccuuuguccauuguacuauuuauuaguauuuuucuaacugauuuuuaaaaguacuuuguauguuagaaauacucaaguauaugcaauauaauuaaccauuauguugcgauuuugccauaaauggaaucauccuauacaugguaguuuuauuuugaccucauuuauggauuucucuguuccuuuuuaaaggcuucaaggugucuggguuugccauaauuuguuuagccucuuuuuggcauucauuugguuguuuugauuucuuuucguuauucuaaauaauauugcaguggacauuuucauacauauaucucuauauauuuaucuuuuuauuuucuuacgauacauuccuagaagucuaggugaaagauuguguacacuuaaaaugugauguguuccuagauucauuucugggaaaguuggaucaguucauacugccaccagaaauuucugaaauaggcauuuaaauuuaggauguggaaucuuugagcucuaagguccgccaguacuuaaaaucuugaaacugguaccauguaguguauuuuuauacauagucaaaccuguuggucuauucaaaagguacaguagcagaauuugggggauacaaauguuucuuucuaagauugcagucuguguauugaauuguuuucauagcaaagaagguuaacucacaccuacaaucuauaaauacucguguguuaaucugauuuuaaauuacuguauauuaauaguguaaauauguaucucuuaguuauauaagaugcucuuaagaauuucuaauguauuuauauucuaagcaagcagaaaguguuuuuagcauauccguucuacuuuauauucuuuuaugcuuaauacuuuuucuuccccuuuucuauagcauaaaggaugaagaggaacagauguguccuauuugcuuguugggcaugcuugaugaagaaagucuuacagugugugaagacggcugcaggaacaagcugcaccaccacugcaugucaauuuguauguggcucuuuuucucccuaugcuuacucaacacaguugcucucugagcuaacuauguuauuuaagaguguaacauggcuugaggggaaauuggugagagaauaaaaaaaguauaucuaaguccuaaguccuaugugaaaaguuuucaacaaaugggaauguaggaucuuuaggagaugaccugugugagcaaagaaaugcaauaaagugugugugacauaugugauaauggaagaagugcacagaauuagaaacaauuucaaucuggaagguauacaugaagggaaggagguggaagaagaccugggcaggcauuacagaaaggcuagcaucaaaguaagguuuggaaggacuuuaccugguagucaaacagggcagaauguuuugaaaaauaguaagcagaguacauguuaucagaaugaauaaaauagcauuugcaaaucaaaaucauuuaaccugcuguguuuacuugcuuucagauaaacauuuaauuagauuauuuuugagguuccuucuauauaaauucuauaauuauaaacaguuaugaaauaaaaauaauguuaaacauuuacauuuuuguaagauuuuguuucuguaauuuuucaggggcagaagaguguagaagaaauagagaaccuuuaauauguccccuuuguagaucuaaguggagaucucaugauuucuacagguaauaauuuugaaaugauacggauauguuuaauuuuuaaaaauuucucagugugguuugucuuaauuuuuuuaaagcaaguuuuguuauuuuucauuuuagccacgaguugucaaguccuguggauuccccuucuucccucagagcugcacagcagcaaaccguacagcagcagccuuuggcuggaucacgaaggaaucaagagagcaauuuuaaccuuacucauuauggaacucagcaaaucccuccugcuuacaaagauuuagcugagccauggauucagguaaguaguucuuuguuuuucauuucucaaagaaauauuuauagaucaauuaauguauuugucuccuucccucaguuguucauaauuuaaaaaaacacuuuuacuugccuccaucaugaccuucauuccacuggaaauuuuaauguuacuuuugguauuaauacuauacugcuuauuguacagcuucaacuucaaaacuucuugugguuucacuucacauaucuagaaacaucucuuccugaacuaacggacauacgggguuauucaaggauagaaggauagaaaccagaacccuucaaugcuaacuuuucccaauguuuaauccccgugccugccaagaauuuuuaucauguuucuuauuugcugccauuuaaaauuaauuucucuuuucauauccuaauggcauacaaugggugcuuaauaauugcagaggagaugaauaagaaaaaaauaugugaugguuaccuugaguucaucauuuuuauuuguaagaacaguuucccaucccuuuaccaucucuucugauugaauguuuuuucauccucaguaaguagggcuuuuuugucaguugguuuguaaugauuuucuugguuguugaaugcucagucuauuauuuuuuaaauguaggaucuaaaaccagacgggucuccaguagacaauaauaaaguaaaauaauuauuuucaauaaucuguuaaauucuguugaauuaaauuugugaacaggugcauuaacacauugagcuuauauaucauuaggauuuguuacauuuuucuuuugugaccauuacaguccugcagcuuuggaauucucuuagcauauuagcaacccauuuaugaaucuaauaaaaucugcaaaaauauuaaacacauucuuguaccuaguucauuaaugaaauuuaaugaacuauuaaugaacauaggcccucaccugcccuuucaugacccaucaaagaacucucaaguugauucugagcuguuagaguucauucuuucaagcauauggucuaguuuguuuugccuaagcuuuaggucagacuaggcucuacauuccuagcuuuuuauuaagcauguuagguaagacaguuaaaacauagguagugguacacuacuuaacaguaccagaagcucacuauauucuaguugguucauucucccauaauaucccuuuauaacaaaacauauguaaauaaguauguuaugaucuguuuuucaaaaguuguguuuauucaucuuuaauauuuaggcauuuuucacauaaugaauuaucuuagguauuaagcuuacuuuuagcuaauuggcccauaaugucaagaccauucacccuuuccucacuguagggacucuggcuuuuggggcaugguauugacgacgauaacagcauauacuauaauucuacgucuacauuuauccuuugcuuacucgaacacaagcauuuuuucuucaguuguuugauuuguccacuccauucguuuuacaguccuaccuguuuugucuaguuuuuuaaaccuuuuuauacagacaaaaaccaauuaaauguguuuugcuuauugcucuugucuguaagagaaauacucuauaucucuugaaaccuucuccuggugcuuuuuuugauuuguuuuuuguuuguuuguuuguuuucuuaaucuugcuccaguuuuucucuuuaaacuaccuuaauaugaauacagaguugagguuuucacaguuuuuuggcguuuugguaagcaugugggacaguagaggcauagaauguauguauagccaucuagugacuuaauggagcuuauuauuaauuuuaccugagcuaauaaauauuaaugacuuuggauaauuaucaguuaaacuugaguauaaaauucuuccuuaugaugcuuaaguggcuggauauauuugaaguugugaaggaugguaaagauuucagaaauguccaguuuuuacguaguaaucaaaaaugaugcuaaacucaaaaugcucuggguccauaagcuuuucuuuacauugaauucaucguguguguuugauacagguguuuggaauggaacucguuggcugcuuauuuucuagaaacuggaaugugagagagauggcccucaggcgucuuucccaugaugucaguggggcccugcuguuggcaaauggggagagcacuggaaauucugggggcagcaguggaagcagcccgagugggggagccaccagugggucuucccagaccaguaucucaggagaugugguggaggcaugcugcagcguucugucaauggucugugcugacccugucuacaaaguguacguugcugcuuuaguaaguagcuuuauuccauaaucauaucauuauggguuugggguuuuuugaugguucguagauaguguuuuuaagauacaauaaagcuacuuuaccuaauuuuggaaaauccaaauuuuauuuuuauuccauaauuccaggaaauuacagcuuuuguuuuguuuauuugaauuuuacugauuuuuaugauguccaagguuucuuauauaacuguuuuacuuuuuaguuucauuguuuuaaaggcuuugcagggguauccaagggagagaauauagucaugguuucuuaguuucuguuugggccaguaaagcuccuuccucauccuccuuuuccacuuaccacuagagacagacuaaaaaccauggcuucaggcugcuaaagccuaaaacaaaacaaaacaaaacagaacaacaacaaauagggugagcuagacaagcuugcuaauuuuuaaagauuuuuuuaaugucuugcuguucauaucuguacauuuuucugagcagauaccuuauacaugaccaaauuaaaaaugcuuuuugggauggcagagucaucaacguuauucugauuuuuuaaaaaauuuaucagauauuaaggaagauauguuuuuaauaaacauuuugauugauuuuuaauaaacauugucauguggagauucaaaagccuuuucaaagaaaaggguuccaugacauagaucauugaguuguuuuccaguuuaaccuguuaaaaguucuuucauggguggaauagagugacaaggagguaauuuaggagacuaacuggacuuucuccauucugcguauaugucucuuuagggcuucucagccucaguacuauuaacauuuguuagauaauuauuuguuggaggguggggggagggccagggauguugucauguguguacuguggcagcaucucuggccucuacccauuagauaccaggagcaaacccacccccacccgaucaugcccccaguuaugacaaccaagaaugucuccaggcauugccaaaugucuccaguggucaaaacugcccccaauucagaaucacuacuuuaauucuuaucuagucuguucuuaaaauucaugagcagucuguaggcuuccucccucagucuuuuucuaaugcauccucuaccgauugggccuaaugaaucuucuugacagguaauacagcaugacaguuacgaacauggguuuggagucacaauugagugaucucauaauuuaucauuccaaccacaaugcuugcauaaugugcugguuaaaguuggacuagccuaggcaaucugaacacaugaucaagaucauagagacagaccuggauucaaauucugguucucccuuuuacuagcacgauggcuuuaugaagguuacuuaaccucucuuaaauaaacuucaguuuucucacccauaaaauaaugaaaauaccuuuuagguuugaaauuagauuauguagaaacuuucaaccauaugccuggcacauuguaagaacauuuaauauuauauaauaguuaucauuauuucuuaaacacaacuuggauuaucccccaaaucauuuagaaaccuuuagagguuucuguuucuuugacauuccuaaagcauauucuguggaaguuuggcaggguugugaaaaguucccugaagaaagaaucccguauucaguuaagauuggugaacacuggauuacacaaggauaacuaggucuguugacugaaaggcuucuaggauccuucaguaagcuaauguacauugugaaccuaaaggaucaaaggauagaaugcauuguuucccagaguuauuuugcuacaccuuguuuuuucauguagcaucuggagggaccagcauacuauagaauaaagaccaauuggcccaauauuuugccucuuacuuaguauuuuccaacacaaaccuucaggcauacuugacuaaauaaaauccucuuuuugcuaguuccuuuucugcaaagccuuugcuguguuacucuuuuuguacacaccguaacugccuuacuguugugguuguuucuucuuaaguucagacuguuucccaacuagcuuaugagauccuagagcacaaagauuguauaaaggauaccaggcuccauggaggcagaaauggcuccugcuguuaaggcucacccuuucccuuucucuuaucuccccuuccucugucucuuccuuuuuuuccucucccucccucugcauauauaauuuuuuuuuuuuuuuuugcugaaucguuugagaguuuuuugcagcaucaugacacuuaaauaugugucucuuaaaaccaaauacauaauuccauuuauucuuccauauacagucagcacauuaacauuaaucacaauacuguuuuguacuauaaaguucauacucaaaucucuucaguugcccaacagugcccuucauagcuaaacugcagacuuuauucagauuucaccaguuuuucugcuguugucuuuuuucuguuccaggauccaauccaggaucccacagugcauuuagucaccauguccccuuaaugucuucucauccaugacaguuccucagccuuuccugguuuuuaaugaccuugacagauacuuucaaaguuuacuggccaguuauuuuguagaauaucccucaauuuggguuuaucugauguuuucucaugauuagauggaaguuacguauuuuucacaagaacgccacagaggugacaggccuuucuuagugcaucauaucaguggguacauaugcccauggcuuuuauuauuggugaugcugucaguuaagguaaugucuaccaaguuucccugcuguaaaguuaauauuccuaaauaucuugugagaguuacuuugagauuaugcaaauacccuauuucaccucaaaauuuuguccacugauuuuaaaagcauuuguggaucuugccuauagcaguuauuacuacaccauuaaaaauggugcucucuugggcacagggaggggagcaucacacacuggagucugucgggggucgggagguagaggagggauagcauuacaagaaauaccuaauguagaugacgggucgauggaugcagcaaaccaccauggcauguguguaccuauguaacaaaccugcacguucugcacauguaccccacaacuaaaguauaauuuaaaaaaugguguucuaguggugauuuucuauuuuccucauuccuucuacauuaauuaauuggaauuauucuauaaagaagagcuucucuguuuauauaccuauucaauuuuuaauuuguauugguguaggcuccuggguauucauuuuguucuguggguugcaacccaguacuaccaucauuuguuuuguugcucuaauuauuccagccuugaccauugggagcucuuucagguuggcgccuguucucauuuucuuuuuuaaaauaauuuuuuuuaacuuuucaucuugaaaugaauucagacuuuuaaaaauugcagagaaaagaguucagaaaauuccuuccugccccauucauuuauuuuguuaguuaguuguauuauuacagaagcauggaauucuuauuuuauucuauggguuauaauccauuccugucuacuuauuuuguugcucaaauugucucaaauuaggccauuaucucugaugcuuuuuaaguguacauaaacugaccuucagauuuuuuuccuuagaaaacauugagagccaugcugguauauacuccuugccacaguuuagcggaaagaaucaaacuucagagacuucuccagccaguuguagacaccauccuagucaaaugugcagaugccaauagguaaggcuuuauugaugaaucacuucaaacccucuugucuuaaaagugccucgcagcaagccucacaccuagugugaauaucugauacauuuuauuaaaugagucuuugaacauugucuuuuaaugugagauuuaaaaugaaaaugcagcauaaagcucuuaaggacuggcggaaagaacuacuggcaaguaaaagccaggcaaacaaacugcauggaucuccacauuauuguauugugauuuacucucuuuaguaacauucauaaucugaagaccagucgauaagaacaguaguugacauuuauaucuauaaguuauaaucucauauuagaguauggguuacacagaauaggaaccaguaagaucauuacaccugcauaugccuuauuaucaggauaaaaaauuaacaaauccaucucauuuucaguguaguggaauuuuacucuacuuaugacaguuuugucaaaaaauuuuuagauuuuuuauauuccugcaauauccuuaaaaauugacagggaacaagaauaacccuaacuggaaagaaaaauaugaaguagagaauugagguacaaugacaguaaagaugaguacaagccaugcuuuuuucagaccaaugguucucuuuuauuuuccccuuccauaaaauaggaggaaaagaucaauuuucauuuaauaaucacagcuacugugaacaguuauuugguaguuccuauuucuuucuaucccagcagaucuugguuagcaagaaguguugaaucucccuucuguugccucuuccauuucacccauuuagaguucucucaguacaaccuuucucuuccucugcaagucauaaugacuuaguuugcacaggaucucaaaaauuagguaccuaccuuuaacgaauuucucauaucaugaagucugucuuuugccucuauuguuuucucuauagauugaaaauauuggauguuuccuuguugcuuagagaaaacauuguauaucuguaaaauauugcaaauuaacaaguaauuugcaaaaugcauaggaaaaaugucauuuuuaaauauuagaauagguauauuucugagaauucaguguucucaugguauuuguuaugcugcucacuuuuugaaacuccaaacuuagguuguuuaccuggucaccugaaugacugaacauaagaaauacuguagagagauuuuauaauauucagaccucauuuuggcuauguaaggaaauggaggguuuuuggauaggaagguuuuguuuuuaauucaagagcuucuuagugaaaguucagaaaucaaaauaucaagguccuuguuuuuucuuuuaacaaaauauaagacuuuuaucugauuugguauuuaaaucaguacuugcaaagagccauuguugaaaauucugugcuuaacauaggggauauguuaaauuuacgaaauuagaccuaauaaaugaauauuacuacuuauggugacauuguuaauaugauuuuagugguggaaaaguaaacacuccugaaaacauuauuucuccacuuuuucacaaggcauuacauuacuccucuaauauuguauaguguuuuagccaagauccaggauugauguugcuuuuccuuuguuuuuagccgcacaagucagcuguccauaucaacacuguuggaacugugcaaaggccaagcaggagaguuggcaguuggcagagaaauacuaaaagcugguaauaacuuuucacuuaaaaggaauauagcauauuuuaucauguuccugagcagccuugucuaaucucauaaucucucaugaggcaguuuacaggauuuugaaguaauuuuauaaauugauucacuguguuacaguuagaaaugugaauuacucugagagagaaauucuuuaaaauaguucagaauauuuuuguuggccuuacaccauuuaaucaugucuuguuuuagauuuuaauaucacuauuuuuuaaucauuuauuuuuacuuuccuuuuuguaggauccauugguauuggugguguugauuaugucuuaaauuguauucuuggaaaccaaacugaaucaaacaauuggcaagaacuucuuggccgccuuugucuuauagauagacuguuguuggaauuuccugcugaauuuuauccucauauugucaguacugauguuucacaagcugagccuguugaaaucagguaauuuuucuucugaaaauguauuacuuguaucuuccuacccucccuacacccuccucaagaaugacacauuuuagauuuuugaaagacucagagcaugaauagguugcugauaccuuaauauuugauugacauaugaaaacccaaagucugggcucuuuaauuaaaaauucauagauacuuuaugcugaaaugguuuuugaaguauacaugcuguaaauuacuaccauuuuuuaaguuuccauguauuuuucaguaauuggaacuuauaugguaaugaauguuuuuuucuuucagguauaagaagcugcugucccucuuaaccuuugcuuugcaguccauugauaauucccacucaaugguuggcaaacuuuccagaaggaucuacuugaguucugcaagaaugguuacuacaguaccccauguguuuucaaaacuguuagaaaugcugaguguuuccaguuccacucacuucaccaggaugcgucgccguuugauggcuauugcagaugagguggaaauugccgaagccauccaguugggcguagaagacacuuuggauggucaacaggacagcuucuugcaggcaucuguucccaacaacuaucuggaaaccacagagaacaguuccccugagugcacaguccauuuagagaaaacuggaaaaggauuaugugcuacaaaauugagugccaguucagaggacauuucugagagacuggccagcauuucaguaggaccuucuaguucaacaacaacaacaacaacaacaacagagcaaccaaagccaaugguucaaacaaaaggcagaccccacagucaguguuugaacuccucuccuuuaucucaucauucccaauuaauguuuccagccuugucaaccccuucuucuucuaccccaucuguaccagcuggcacugcaacagaugucucuaagcauagacuucagggauucauucccugcagaauaccuucugcaucuccucaaacacagcgcaaguuuucucuacaauuccacagaaacuguccugaaaacaaagacucagauaaacuuuccccagucuuuacucagucaagacccuugcccuccaguaacauacacaggccaaagccaucuagaccuaccccagguaauacaaguaaacagggagaucccucaaaaaauagcaugacacuugaucugaacaguaguuccaaaugugaugacagcuuuggcuguagcagcaauaguaguaaugcuguuauacccagugacgagacaguguucaccccaguagaggagaaaugcagauuagaugucaauacagagcucaacuccaguauugaggaccuucuugaagcaucuaugccuucaagugauacaacaguaacuuuuaagucagaaguugcuguccugucuccugaaaaggcugaaaaugaugauaccuacaaagaugaugugaaucauaaucaaaagugcaaagagaagauggaagcugaagaagaagaagcuuuagcaauugccauggcaaugucagcgucucaggaugcccuccccauaguuccucagcugcagguugaaaauggagaagauaucaucauuauucaacaggauguaaguauagauucuuuaagagguuagaaaacuuccuuggggcugggcacagugacucauaccuggaauuccagcacuuggggaggcugaggccgaaggauugcuugagcacaggaguucgaaacuagccuggucaacaaagcaagacccugucucuacaaaaaauuuuaaaaauuagccaggcaugauaguguacaccuggggucccagcuacucaggaagcugagguggggagggucacuugaaccugggaguuugaggcuacagugagcugugauuacaccauuguacucuagccugaaugacagagcaagacacugucucacagagagcuuccuuggaccauacuaaaauaaaccuaauucagaaaugcugcuucuaacauucagaagcagaguuuuccacauaaaauuauuacuuauacaacaauaauguuuguacuguuuaaacagcaauaauucuugccuaugggcauuuccgguuaauuguauaauggugauuacuuuugcauuugcugucggucacaaauaccuuccauucagaggucacauuuauaggugguuugggaagccagacugaauaagaauaauaucuugcagacuaauuucacaaaaucuuacuccuuuaacaguaaaaagauugcuuucguuuaauauguagacaccagagacucuaccaggacauaccaaagcaaaacaaccguauagagaagacacugaauggcugaaaggucaacagauaggccuuggagcauuuucuucuuguuaucaggcucaagaugugggaacuggaacuuuaauggcuguuaaacagguaaauaucuagugagcauauaaaugaaaugacucaaaucacaaaaugaagcauguucaguaaaaagaauaaaggauauguccacguguguguacuuuaguucuuuaaacuuugagaaacuuaguuucaaaguagauguuucuaaagcaccagaaacaucaugaauucuguuauuguuaaaaguugaggccacgcgugguggcucacaccuguaaucccagcacuuugggaggccaaggugguuggaucauuugaggccaggaguucaagaccagccuggccagcauggugaaacccuaccucuacuaaaaauacaaaaaucggccgggcagggugguaggcaccuguagucccagcuacucaggaggcugagacagaagaauugcuugaacucaggagguagagguugcagugagccgagaucgcaccacuguacuccagccugagcaacagagcaagacugucucaaaaaaaaauaaauaaaaguugaaguaugauuauuguaagacuacaauaucaagaugggccuuacaaagguuuuuuugguuuugcuuuuuguagguaguagaggugguuuucagguacuucuuucaacaguguacuugugcggugccaucuugggguuucagugguuuacuuuuuauuauaacgagcauacuuaaucaggauaggaaaauuauuaaacuuucauuuuuaaaucauguugauucuucucccauauuugggcuuuucucaucuuuacucugagacuauuggaauauugacuauaucccaauauuuuugucauuuuucugauguuuacugcugcuuaagcuagauucuuaguguuuaaaagaguuugacuuggguuuguuuaaaguacauugcauccauaagcauaaaugccaucuguugcuaauaaagugcuaguuugcauuuguucauuuuagaucagauugcuagugaaaauaugcaaaacuuugugaacguguuuauuugaaacaggugacuuaugucagaaacacaucuucugagcaagaagaaguaguagaagcacuaagagaagagauaagaaugaugagccaucugaaucauccaaacaucauuaggauguugggagccacgugugagaagagcaauuacaaucucuucauugaauggauggcagguauguuaauguuuuaaauuacaaaauaguaguacguggauuuaacuuucugcaauuuaggaaaaaccaguuuaauuaaaauuuauuucuaucaaauaguuuggguuucuaaaaacaaaucaccccaauauauuaguaugaaccacaaauacuucguuuuguauuucauuuacuauaaaugaaauauugacuaccucuaccuuuuaaauuuuuccaguguguuuuuaaaugauuguguagcauuguuguuuuuaauacuugauauguauaagauauguauauuuccagguagccaugauaaauuggacagaugaggaaguguuuuaacauaacaauauacaaacaaaauuaacauauaacuugaaaacuuacuacaaguaaacuagcacugaagcauaaaguugaaccuugucaucugcugaaauaaaugaagacugaguuuuauuuuguauuauacaauguauacaauaaaauuaaugaccugaugugaugaacagauuguuugguuuaacuucuuagauuuguguguguauuuaagagugcauuucucuuuaccagucaguucuuaaguauguuaucuguugguuggucuuaauaaagauuuacacuacaguagauagguugacuacuauaaacacuuuuaaaagcggcuaaauuugagacauguuccaggucagagcuaguaaaugguagaauaugacgccuaacucuggguuuucuguuccuccucccauucuuuccaccuuuuacuacauaauauguuaacauuguuuacuuuagucauuaauaaaguuguuuuguguauuuugagaagacagagaauugaauuguacauuucagaaauaguuuaauccgaaauuguuaacuuuuacagcuuucugaaaucuugacucuccaauaaacugguuucccuguggguucugugaaaaugucuccuaauuaguagguuuuugagaugauacaggaauauguuaguuuugaaauguuuuucuucuguuucagaugugaaugugaguucaugcagugaaaacuuuagaaaccaaaguguaauaaauacuuuuaauucugucuuaaguuuaugauaauuauuucuauugucuuauagggggaucgguggcucauuugcugaguaaauauggagccuucaaagaaucaguaguuauuaacuacacugaacaguuacuccguggccuuucguaucuccaugaaaaccaaaucauucacagagaugucaaaggugagaauucuucuaauuauuaucuagugacaauaaaaaaauuaauuuuaaaauuuggggccaggcacaguggcucacaccuguaaucccaguacuuugggaggugaaggcagguggaucacuugaggucaggagcucgagaccagccaggccaacauggugaaacccugucucuacuaaaaauacaaaaauuaacaggguaagguggcgcaugccuguaauccuggcuauuugggaggcugagacaggagaauugcuugaacccggaaggcagagguugaagugagcugagaucacaccacugcacucuagccugggugacagagugagacucugucucaaagaagaacaaaaaaauggaccuuuguugauaguuucuaacagugggauuuuuuucucugaguaauucagaauauuagaacugaaaugagccuuagggaucauuuaaucugccuuccucguuuaauagaaaaguacauugaauacaagagaggcugugccuuuucuacaguuuuauugcuaguuaauggcagaaaguauacaacacaggucuccagauucccugucuuggccucaugauacgcugacucccagaaaguuccuuuuccugguuuuauuuugaauaauugggauauugggauaucaucaacuucuuuuaagaaaaauuccuucaaauccuuuguaggucccauuauuuuccuuauccuuuucuuuuuuuuggagacagguucucugucacucaggcuggaguguaguguugcaaacuuggcacacuguaacucauuuccugggcucaagugauccucccaccucagccucccaaguagcuaggacaacaggugugcaccaccaugccuggcuaauuuuuuauauuuuuuguagagaugggguuuugccauguugcccccaggcuggucuugaacuccugggcucaagcgacccgcuugccucagccucccacagugcugagauuacaggcgucagccaccguaccuggccucaguuuauuuuucucaagagcaaauuugguuuucugucauuagucuuuuuagcuaguauuugacauaauguguugaaguaauuuuauaacuuuuuaaauuaagcucuaauuaugaauuuagcguacgcuagagagagcugugugccuuuagcaagaaugaagugaaaggaaaagagaauaacuguuugcaccucugacauguaguucacuucuuucuuuugucauuguccuaguucauuaguauuguacugggcuuuuaucuguccuuauuuuuguuuuuaacauacaaggucauuugcuguguuuguugacaggugccaauuugcuaauugacagcacuggucagagacuaagaauugcagauuuuggagcugcagccagguuggcaucaaaaggaacuggugcaggagaguuucagggacaauuacuggggacaauugcauuuauggcaccugaggugagaagcaucuuugagugugaugacagaaaauauuuuggaauucuguguaacagcauuauacuaaauuaucuugcagugguauccaguauguacuuaccaacuagaaguccguggcccuuaaaauacgguuuuaauaauaucuuucagacccuuauucucgaccuuucuuugccuuggcaauauucaaaaaacagguuuuaauagauuuacuuaacggcuguuacuaauaaagaauucugggguaauuuauagcaguuguuuuguaauaaacucaaagugcacauaagaaauuuuuaaaaauauucucucucuauucuaaaaggagaugagcauacagaggcagcuccugucuguaguggaaggaguuuaagcauuguucuucugacucagcuucuucugucguguucauaauucuucauguucauauguaguaaugaucuguuguccucuugccacauaguuugcuaagagcaaaauucugugaugggacucugcuucagaaucucacaauucuccaaaauauuuuugugcuaccuggaaaauuaagcucauuaaugaaauaaauuagauauuagguaguccacagaauuccuguuuguaccaguuuucucccuaaaguaaggaaguagaaucuauaacuacaaaauggccuucucuuuuucaaaugaguccuauuuccaaauuaacucugauuuauuuuagguacuaagaggucaacaguauggaaggagcugugauguauggaguguuggcugugcuauuauagaaauggcuugugcaaaaccaccauggaaugcagaaaaacacuccaaucaucuugcuuugauauuuaagguaauugugagauaaaaauuacuucuuugugcuaaaaggaguacagcagaauuuggcaggaggcaaauuuugauggguucucccuaacaaucuagcaugaagguaaauaaauagucuguauauuuauucagagaggauuugauauacaaguuuuuuacuuuaagauggugcaaaagcaauacaaauuugguaaaaaccauacuuugaauuuugauuuuugucugagcuagcaauaugugcuaugauacacuggugaugcuaggcaguggcagcgagucacagcucccagucagccacacaaucacgagagugaacaaccaauacucuauaguggacuguguugucagaugauuuugcggaacaguaggcuaauguagguauuauaagcacauucaagguaggccagacuaagcuauaauguuuggcagguuagguguauuaacugcauuuucaacuuaaaaaaauaucaucaacuuaaaagggguuuaucacgacauaaccucagcguaaguugaagagcaucuguguauguguguauuuccaggaguugauauugucaaugguguugucaauguuagugacauacauagucacuucuuguuauuugagguaguuaugcucuguuaaguugcuacaaauauugaauuagcaaauacuaaaacacugcuucuagaagaaauauguaguguguuuauauguauauguauguguguauauauauccauccaucacuuuaaaaacgugaaauucaugcauuuuacauaauucaaaaaucuuaaaaucuaauuuaccauuuucuuuuguucguuuguuuuuuguuuuuguuuuugagacagagucucgcugcagugcccaggcuggagugcaguggcacgaucucagcucacuauagccuccgcuucccagguucaggcaguucuccugccucagccucccagguagcugagacuacaggcacgcgccaccaugcccagcuaauuuuuguauuuuuaguagagauggaguuucaccauauuggccaggcuggucucgaacuccugaccucaagcccaccucagccucccaaaguacugggauuacaggcgugagccaccacuccuggccuaauuuacuauuuuguauauuuuaaaaauucacacccaagucaguucaguccugucugccuuuccuacuuuuuuauaacucacaaauccauucucuccuuuuccaccauagaauaaguaaugguugauauucuuagcuuuucaguagaugugaugguugaaaucaugggcuuuggagucacacugaccuaguuuuaaacccuggcucuaccccuuaauggccauguaaucauaggaaaauuauuuuuugugucuacccuccauuuucucacauguaaaauuggugcaagaaccccaugaagcauguacuucgugggauuacuaugaagauaaacaaaauuauaccuaggccuuagucaagcacucagcccacacagucagcuccaccugccauaaccuccuccagugcuccccacacuuauuauauaaccuccucagucaccucucugacaauaccuguuuuguauuaucaccucauuuccucuauucuuucagacgucccauguccguucucuacgugguucaaauucuuauucucuuuaaggcccccauuuugugcuucuccugcuugggcacccccuuuuuacucauuccagauucucauagcauuuuaguacauacuuguuucugacacuuuguuucuuguuugcuaguuauguuccuaucuugcugccucuuucaaacuaauucuccuugagguccauucaugucugauucauuuucuucuucccagagucuuauacagaaguugcucaauaaauacucauggcuaggaucaauuugaaaguuugauguuauuuuaagaguuuugaugagacccuggaaacaauuguaaauaauuuucaaauuggcacaguucauauuuuaacagauuucauugcauucuccuuccuagguagaguuuaaagagaauuguacuguaacauuuucaguuuccuuaauuuggaguaaauacuuugagguuuuuggaagcaccccaaagcuuucucaaacacuuccauacccuguuuaugguaguauaaauugccauagcacguuuuuuuagagagugauuuggcaauaucugccagaauuuuuaaugcacuuauucuuugacucagcuaugcccauuguuaggaauuuacucaagauuaccucuagaaguaccaagugccaaguucaggauuauucacucuacucaagaaaguaauuaaauuauccacacuauacagaaauuaaacgaguaugaagcuguugguguugauuuacaaagugcuacaagauacauuaauaagugaaaagagcaagguauauaaagugauccuggccaagcacaguggcucaugccuguaaucccagcacuuugggaggcugaggcaagaacaaaacuugaacccaggaguuggagagcagccugggcauagcgagaccccaucucuaccaaaaaaaaaaaaaaauuagcugggcauagugagacgcaccugugcuccaggguacucaggagguugaggugggaggaucgcuugagcccaggaggucaaagcugcagugagccauguucauaucacugcacuucagccugggugacagugagagcgagacccugucucuaaauuaaguuuucucuuuuguagacauuuuagaaaaucuuaagucugugaauauauuggccuuuuuuccuccacaaaacacacacagacacacacacaccccccccccccacacacacacacacaaaucaucaguaaguuacauuuggggaaaagaaggaagagggacuuuuuuuguuuuguauuuuuccuuuuugugguguguaagauguguauauaucagcugaguauaucaugauacaggaucacagaccuuagaggauuuuucuuuauauuacuuugcauuuuuuaacccaaagcauuuaugaaauuacugggguagggaaaagagaguuuucuugugauuaggaguggauaggugaguuuaaaguauucagacuugauauuagcccuuugucagaugaguagauugcaaaaauuuucucccauucuguagguugccuguucacucugaugguaguuucuuuugcucugcagaagcgcuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuuuuuuauaagguguaaggaagggauccaguuucagcuuucuacauauggcuagccaguuuucccagaaccauuucuuaaauagggaaucauuuccccauuucuuguuuuugucagguuugucaaagaucagaugguuguagaugugugggauuauuucugagggcccuauucuguuccauuggucuauaucucuguuuuggcaccaguaccaugcuguuuugguuacuguagccuuguaguauaguuugaagucagguagcaugaugccuccagcuuuguucuuuuggcuuaggauugacuuggcaaugugggcucuuuuuugguuccauaugaacuuaaguaguuuuuuccaauucugugaagaaagucauugguagcuugauggggacggcauugaaucuaugaauuaccuugggcaguauggccauuuucacgauaucgauucuuccuauccaugagcauggaauguucuuccauuuguuuguguccucuuuuauuucauugagcacugguuuguaguucuugaagagguccuucacaucccuuguaaguuggauuccuagguauuuuauucucuuugaagcaauugugaaugggaguucacucaugauuuggcuguuugucuguuauugguguauaagaaugcuugugauuuuugcacauugauuuuguauccugagacuuugcugaaguugcuuaucagcuuaaugaaacugaagaaugcuaaagacaagaaggaaccaaagagaaaagacaaauuacaagaaaaaaaauugauaacaauuauauggauaacagaauacagcagcaacaagagaauucaaaagacaaauuguaccuucuagugauugaaauaaaauaacaguuaaccuaggauuucauagcuagcuaaaugaucaucaaaaaauaagaaugaaauagagauauuuucagacacaugagaauuguggaaguuuaccuucagcagacacucacugaaaaaaauuauuuuuaggaaugcauuucaagaagaagaaaauugauaccacaaauagggagauaugcaagaaagacacuaucucugccuggagucagcucugauucauaaugggugcucaaaaauuguuagaaaacuaauacuuuuuuuuauauaugacuugaaauuaaaauaugguuauugcagcacaaauuuuagaauguaaagaguguaucacaauuuaaaaauaauuaucagauuuugaauuuuuuuagaaaaacuacaaauaagaccaaauaaaauuucuuuuuuuuuaaaaaaaaaguauucagacuuacaauuuguuuauaaaaaaguuauucuucauaguguauuugauacuaagaaucagaauuuguccaacacggaaggaaaaaaacaaugcaguuguguuuucuauguauuaaauugacucuucaguuuuagucuuucuuaaucuaaauagcucuguaugcugaagaaauagaaaacgugcaguaagaacaaaccaucucggagauugaauaugaggacagcagaauucauuugagugaauacuuuaucuaccugaacauuuugauguacuuagccuuguugauguaaauaauaaggaauaggauauauuugaucaaauccuaaaauccuaaaauuugaaagauuguuagagaaaaccucccauccaguggaugaauuuuuucauagacuuuuugauagcagaaaauccucccacuucugcuucaguuccucucuguucaggauguaaauguaaggguuaugaggucuaugcacauguguuucuguaucagaaguuacaguugugcaaagcuucaacacuggcuuuuucuccacagauugcuagugcaacuacugcuccaucgaucccuucacauuugucuccugguuuacgagauguggcucuucguuguuuagaacuucaaccucaggacagaccuccaucaagagagcuacugaagcauccagucuuucguacuacaugguagccaauuaugcagaucaacuacaguagaaacaggaugcucaacaagagaaaaaaaacuuguggggaaccacauugauauucuacuggccaugaugccacugaacagcuaugaacgaggccaguggggaacccuuaccuaaguaugugauugacaaaucaugaucuguaccuaagcucaguaugcaaaagcccaaacuagugcagaaacuguaaacugugccuuucaaagaacuggcccuaggugaacaggaaaacaaugaaguuugcaugacuaaauugcagaagcauaauuuuauuuuuuuggagcacuuuuucagcaauauuagcggcugaggggcucaggaucuauuuuaauauuucaauuauucuuccauuucauauagugaucacaagcaggggguucugcaauuccguucaaauuuuuugucacuggcuauaaaaucaguaucugccucuuuuaggucagaguaugcuaugaguagcaauacauacauauauuuuuaaaaguugauacuucuuuaugacccacaguugaccuuuauuuucuuaaauaccagggcaguuguggcucauugugcauuuuacuguuggcccauucauuucguuuuuggaaauuaugguuuuguauuuucauguuuauuuacauucauuuuuguuuauucagggaaagcugaucuuuuuuucaaaccagaaaaaaaaaaugaacuagauaugaaguagaguucauuaaauaucuugcuauugucagaguuuuuaaaauauagacuuaauuuuguuuuuuuaaauuggaauacaauaaaguacuaccuacauuugagucagucaccacucuuauugugcagguuaaguacaaguuaacuaaaaauaaacuguccucucuggugcaacucacaaccaagaucaagauuaccuuaaaauuuauuugaauuuuuuagauguuuugguugucaaacuguaggaaacuucacaacauuuaagucuuacucuguauguaacaauccaucauucaccuucacuacugguaguaacauagagcugccauuuuccuuuuaccaugcaucaucucuuuacaguaggccuggcagaucauuuuuuaaaaagauuauucaacuaccaaucaguaauguuuuuaaacaguacauuugcuuugaacuuggaaaauguguucagaaagaaaaauggaauugaauuucauuuauacacuaauuccuuggauuuugcacaguuaccuaacgguuuuagucuggaguuaaauucagaugcauggaauccugaaggaaaaugguagcuuuuuaaucuuuuugugugugugugagucuuuuaaaucaaguacugauuaacuauuaaguacaacuuugagauuuuaguuuuaacucuucagaagccagugugaaauagaauugguuauucucaaagacucaggauaaacuaaauaagcuauauauagaguacauuuaaaauguacaacacaaauuggaaauaaaauaaguuacaagauaaguuuacagggauauauugcuuacaauuuuuaaaaggcaguuuguuuuuuaugugaauauguuucuuagugaaauuuuacauuccuuuguuuuggaagauuggcgauauuugaagaguuaaaaauaguacagaaaugugaaguuugguaucucuaaauguguuguacuugacuuucuuuuuuauuuuguuuuuuuuuuuuuuugacuacuuagaauuuucacaauucuaauaagauuguuuccaagucucucaugugcaagcuuuaaaggaugcacucuugccauuuuauguacuggaagaucauuggucagaugaauacugugucugacaaaaauguaaacuguauaaacugaggaaccucagcuaaucaguauuacuuuguagaucaccaugcccaccacauuucaaacucaaacuaucuguagauuucaaaauccauuguguuugaguuuguuugcaguucccucagcuugcugguaauugugguguuuuguuuuuuguuuuguuuucaaugcaaaugugauguaauauucuuauuuucuuuggaucaaagcuggacuggaaauuguaucguguaauuauuuuuguguucuuaauguuauuugguacucaaguuguaaauaacgucuacuacuguuuauuccaguuucuacuaccucagguguccuauagauuuuucuucuaccaaaguucacuuucacaaugaaauuauauuugcugugugacuaugauuccuaagauuuccagggcuuaagggcuaacuucuauuagcaccuuacuguguaagcaaauguuacaaaaaaaaaaaaaaaaaaucucuggguuaagaaaauuuggcuuaaauguauccuuuguuauuuuaaauauauugagauauuuuaauuaaaauuuuuaccccauugaaccgauuuuauaguauuuguaccuauuuugguguuuuugucuuuauaguaaauaaaaguuuuugaacaaauguug

SEQ ID NO: 17414 - RNA, 1966 nt, Homo sapiens
cgggcgggcgagguggacugggaggcggagggggcgggggcggaggcggaggcgugggcucccgggacucugcgcgcugcacgcgccgcgccgccagguagucccggccgcaccggcgacaggaggagccuuggcggcagcgcugcgccgcuuccucucggcaaucucggcccggcaccgcggagcucgcgggaggggaguugcaccuuccgaaagaaagaauuaguuccaacuuggguuucuggugcuugaaggggacgcaggcgagaggguuuacagucugucauucccacugcccuuugcagugggcgucgggggacccgggcguggaccagccucccaccgacgcgcagguggcgcccgggaccgucgccugcugcaaagcgaaagcaagucaacguucagcagacaggcugccgcggaccagaaaaauaaaguuuuguuuguguuuucuuuugaaaagaaaacauuccuucucuauugucccaccccugucccugugcuacagauaacaaaacuucaaaguuuucuguaauaccuuacauccugaagcugcugauuugggacaacuacccccuacccucaccaaguccccacagccucugagaaaccguuggggcgaggaagggaggcggguguccccgucgaucuuuaguuuuuccuuggcugucuuugggaaaggcagucccguacagaaccacauauagcgcguuuggggaggggaccagcgcugugccaggaagugcucgguaaugucacccucggccaggucccggcccuccccgaauccgaugcuucucgccgcacguccuucuucccugcagggucgggccaccggccggguucccucuguccccacuccugcagggccuggcugcccaucgcugcguugugaguccuccuagucccuggacucuacgugagaaggugcuuugggauggaaaaagcaacauuuacacguuaaugauuuuugaccuuuugucaacugaggagaacuucuguguugcguuuauuucuuccuuccuuuccuuuccuccagcugguuuguuuaggauggggaaucucccaaaacccaggaggaacgucuauagauuuacuuugugaaacaugauuaaggaggggggagguuggggugggggggugcggauucucacggagauagucuugucagucuucacauauuuagacaaaagccugaacuauuuacagaauaauuccauugacuucuggagacuagguaaaaugaaagccccuuucccagauacaauguuaacugcguaaccagguuagaucagagggguuuuaaaaaguccagauuucauauuagcucaaugauuugaaaacugcuguaacaucucccauaagauaguuuuagaucguuacacccaacgguacaaauuuugaaaguucagauaaaucuguuaaaaauuaagucuacauuuaggcuauaauuauaugcuauuuuaauggcagucaaauguaucauucaaaccaaacagugguuauuucucaggucuuccuggguugccacacccaccaaauccuaaacugaaacggauaaacuuuccuuguuccuauuuugaucuaaagacuuuuacauuugcacgcacauauucagguaccuguaagugagaaaaguaaguggaagacuuuagccagaguagcagaguaaaaaggagauuccagcaaaacugauuuuugacuguuuguacagugguugaaacuggggaucaaagggagagggcuacccagcgcagcacuaugaacuagcuacaauucucucacuuccuccauccaccacguauuaccauggagaaaccuaaguguugguauuuucccacaguuuuuguugcuuugagucauuuuuuucuuuguuuacguaaauauucagguugucauuaugcaucugcauauggacacacugauuucuuaaagagagaaucaaaggacaugcuuaacugaaaag

SEQ ID NO: 17415 - RNA, 702 nt, Homo sapiens
gggacuccgagggguagcgauucccguaacgcggcucuucgcgucccggauuccgguggcugcguccgcgucgccucucccagacuagaucgaaggguuccccccaccuccccucugugggcggaaagagcggaauguuccauuuuucuguggaauaacggggucaugaacuggagcccgggugcugcccgccgcccgcugcccccgcccucccuucucgccagggcgccugcggccucucuucgcggccuuccccgagggacucagagccgcgagggaccgccuagcucccuuggggauggggaaggcgugggagccucuuggggaaagugaagagcucgguggccgugacuccgcacgagacugcggcagauuguggcggcggcuucucuccaagacuuacguaaacgagccuugccacaguacuuuuuuaaauuaguaaaugaguuugggugcgauugaucagugagccccagaggugguggcccaccaagcgacuaguguuucuuugcgguuuguaccuccccguuuaugauaaaaaauaccggguaaaaaccuauucaucccgccuccgccccccccuuucccucagaaaauggaccucaaggcucaugauguuuguuucuccccaaaggaagaugagaaucuugaguuaaaagauaaggcaugugcgugcgugcguguggggugugugcgugggug

SEQ ID NO: 17416 - RNA, 12278 nt, Homo sapiens
cacaguuguaagguauuuuggaaagcccugagauauauucauagcuguggcuguacaaacaaaagauuuuuaauuaaaauaaaagcaauaauagaaacauuuucaaaaagaggguugguuuuuuaaaaagccaaaugucuuugucaaauucuaacugggauaguuccauguguagauuguuuucuuuuccugugacuucuuaucacagauaauuaauaagaauuuguggaacacccacucuguucagagcacaauaauaguacugccacuguuuaggguuuaaagcaaguugccaauucaauaaacccaguaaaggguuucuuuuuuuuaccccuuuguaacaaccaucuuuuaucugagagauugaauauauuucaaugguagaaucauguggcaucauauaucaugauuuaucauaaauuugcaguugaccuaucaagugagauugaacuaugauaugaagccaccauagaaaaaguuuuucucuauuucuucccucuucagucuucuaauggaaguauaguuugaguggugagagaaauguuccaagaacaggcagaugcaacaucagcaucugccacaauagaaaugaguaaugaagucucaggauaauuuucuguuuuuguuuuggcaauaaaaacccgacuuguguuuuuauuacucuucucaaucacuucuuaagccaguaaaccugauauaggcaaaucaauuaguucagaaaugucuucaauaaugggauacucuuagagaaugggcaagugacuucgggaggcccaagugggaggaucacuugagcucaggaguucaagaucagccugagcaacauagugggaccccaucucuuuaaaaaaaaaaaaaaaugagagagaaaauaggcaagugauucaagcaacucauuauuucaaccacagucacacagcaggaagauauucaaaaccaaauaaaugccccagaacuugcauaagaacaaacacacagaaagaaaagauaagacucuguggaaaccaguuggauuucaucuguuacuucagccguugggcaagaucuguuugacauguacuucuguaaaaguuucuuaucuauggaaccagcuaaguucuuugaaauaucacuucaucuugauauuccuaaugaugaugaaagauuuguuugcugagcuguguccaaacacaagcugaaguggagauucuagguacauaucaagaugauuuggaccaaaaggagcucuuuugauaauuuggagcccauuucacuauguuucacuuucguugagguuuccauaguggaaugguuaucauguuuacugcacacuuauguuucacuuucaguaacugggauuaaauggacagacacuaaacaauuuguguugugucugggcaugguggcucacgccuguaaccccagcacuuugggagguugaggccagccugggcaacauagugagacccuaucucuacaaaaauuacaaaaauuagccggacaugguggcaugugccuguagucccaucuacucaggaagcugagguggaccaaucacuugagcccagcagguaaaggcugcagagagcugugagacgugaccacgccgcugcccuccagucugggugacagagugagaccccauuaaaaaaaauuuacguugcuucaagcuuugcuuuugggauaguuuugggauguuuugggauaguuucccaaaucuuucaaaauauuggauucauuaaguuuuuuguuguucaggaggguuuuuuuguuuguagaaauguuaccauuuucuauaacuaugguauaauaucacaaucagccuguugauacaaucagcaauuucauccagauuucccaguuuuacuuguacugggcggggggggggggguggggugggggggcggugguguauuuacacaauauuaucacuuguguaguuuugucuauccacccuacagucaaaaugcagaacgguuucaucaccacaaggauuccuuguguugccuuucuggaacaauacacacaccccucccaccccacaaacuguauuuuuuuuuuuuuuuuugaaacggagucucgcucuguuacccaggcuggagugcaguggcgugaucuuggcucacugcaacuucugccucccggguucaagcaauucuguugucucagccucccgaguagcugggacuacagguucgcaccaccaugccaggcuaauucuuuguauuuuuuaaguagaaauggguuuucagcauguuggccaggcuggucucaaacuccugaccucaagcaauccaccagacuuggccucccaaaaugcugggauuacaggcgugagccacugugcccagccccuguauuguauuuugaccuaucaguuaguucuccauguaggcuggaaagucagaugauagcaaugaaaagcaugggcucugaagcaucacugccuggguuuggauccaggaucuaccaccaugcuagguaauuuauauaacuuaucuaauuuaaugcucacaaaagcccugugaaauagauauucuuaucccuauuuucuuuucuuucuuuuuuuuuuuuuuuuaagacagagucuugcucuguuacccaagcuggagugaaguggcaugaucuccgcucacugcaaccuccaccucuaagauucaagcgauucuccugccucagcauccugaguagcugggauuacaggucugcaccaccacacccgucugauuuuuguauuuguaguagagacaagguuacaucauguuggccaggcugguuucaaauuccuggccucaaggauccaccugccucggccucccaaagugcugggauuacaggcgugagccaccgcaccuggccuaucccuauauucauaugaggaaacugacccuuagagaaaugaaauacaaugcaauauuugcucagaguaacacaaaaacagacauuccaacuaagauacaaaaccaggauugucugaccccaaagcccaugcuuuuccccaacagcaaacauuaacuuuauaagaauaaauaaaugcaccuuugugcauuuauuuauuuuggugcauuuaucuauuauuucauaaaggugcaccaaagaugcaacuuuguacaugaaaauuauuuuucuagaguagaguuguaaauuauaucuguuggauagaaaagggaauuccaggccaggcacaguggcucaugccuguagucccagcacuuuaggagguggagguggguggaucauuugaucccaggaguucaagaccagccuggguaacauggugaaauccugucucuauuuaaaaaaaaaaaacaaaaaaacaaaaaaaaaacuagccaggccuaguacugugcgccuguagucccagcuacucgguaggccaaggugggaggaucacuugagcccgggagauugaggcuacagugauccacugugaucuugccacugcacucuguccuguaacagagugagacccuguauuuaaaaaaauaaaagaaaagagaauuccagaguguauaguuuuauuacccuacaggacauuaaacaaguuuuuuaaaaaaaauaauagaccuuuccuuuuuacaaguuuuugauuugcugauaaauuaggcagauuguacagacaguucccauauauccucucuuccuccacucuuacccccacaguuucuccuauuacuguauuaacaucuugcauuagugugguacauuuguuauaauugaugaaccaguaccgacaaauuaucauuaacuaaauuccacaguuuacauuaggguucauuauuuguguuguacaguuuuacaggucuuaacaaacacaaaaugucaugcauccaccauuacaaugcuauacagaauauuucacuauccuaaaaaucuaaugugcuucaccuauucaucccuccccugaacuccuggcaaucccugaccuuuuuauugucacuacaguuuugccuuuuucaggaugucauauaguuaaauuaauaauauguagccuucguggauuggcuucuuuuacuuagcaauaugcauucaagauuccuucaugucucucuguggcuugauagcucauuucuuuuuaaugcuauauaauacuucauuaaauggccaauaucacaguuuguucaccuauucaacuauugagggauguuuuuguugcugccagcuuuuggcaccuauaaauaaagccgcuauaaacuuuggcaugcagguuuuugugugaacauaaguucugaacucauuuggguaaauaccuaggaguaugacugcuggauuauaugguaggaguauguuuaucucuauaagaaaccaucggcugggugcaguggcucacgccuauaaucccagcacuuugggaggcugaggcagguggaucaccugaggucaggaguucgagaucagccuggccaacauggugaaaccccaucucuacuaaaaauacacaaauuagcuaggcgugguggcgcacaccuguggccccagcuacucaggaggcugaggcaggagaaucccuugaacucaggagguggagguugcacugaacugauaucgcaccacuacauuacauccugggugacagagcaagacuccaucucaaaaaaaaaaaaagaaagaaagaaacugccaaacuaucuucuaaaaugacuguaccauuuugcauaucuaccaaguuuuuuaaaaaucuaauuuaggugcaguggcuccuaaauuagguggcuccuaaagugacuguaccauugugcauaucuaucaaguuuuuuaaaaaucuaauuuaggcacaggugagguggcucacgcccguaauccuagcacuuugggaugccaaggugggcgaauugccugagcucaggaguucaagaccagccugggcaacauggugaaaccccaucucuacuaaaauacaaaaaauuagccagaugugguggcagguaccuguagucccagcuacucgggaagcugaggcaggauaauugcuugagccugggaagcggagguugcagugagcuaagguuacgccacugcacuccagcgugggugacagagcgaaaaaaaaaaaucuaauguaguaaucuuauuucuagauuauuucuuucauaaauugcagauauucagucucuugaauucuccugugaaccaguuucaccaucuugauggcuccccaauuaacaagguaaguaaauauuugacaugugcuuacuuaaauauuuguguuaagggccaugcuuuuuacuuucuacaaauuauacuuugaaaaugauaaccuaccauauuucccacaugaaagacauaaccuaacacacacuacaggaagaaaaucuuuugucauuuuucuagccaugguaaugaacuucacagucacacugagauuuccuaaggguagacucacauguaaacuggcucaauaacccuuuucaaagcuauuauuuuaccagugcaaaagaguaccuguagggguggguugccccuccacaccuguggguguuucucguaaggugggacgagagauuuggaaaagagaaagacacagagacaaaguauagagaaagaaauaaggggacccggggaaccagcguucagcauauggaggaucccgccagccucugaguucccuuaguauuuauucaucauuuguggguguuucucaaagagggggaugugucagggucacaagacaauuguggggagagggucagcagacaaacacgugaacaaaggucuuugcaucauagacaauguaaaggauuaagugcugugcuuuuagauaugcauacacauaaacaucucaaugcuuuacaaagcaguauugcugcccgcaggucccaccuccagcccuaaggcgguuuuucccuaucucaguagauggagcauacaaucggguuuuauaccgagacauuccauugcccagggacaggcaggagacagaugccuuccucuugucucaacugcaagaggcauuccuuccucuuuuacuaauccuccucagcacagacccuuuacggguguugggcugggggacggucaggucuuucccuucccacgaggccauauuucagacuaucacauggggagaaaccuuggacaauaccuggcuuuccuaggcagaggucccugcggucuuccgcaguuuuugugucccuggguacuugagauuagggaguggugaugacucuuaaggagcaugcugccuucaagcaucuguuuaacaaagcacaucuugcacugcccuuaauccauucaacucugaguugacacagcacauguuucagagagcacgggguuggggguaaggucacagaaucucaaggcagaagaauuuuucuuaguacagaacaaaauggagucuccuaugucuacuucuuuccacacagacacgguaacaaucugaucucucuugcuuuuccccacaaguacccguugaacauuccagggaacugauccauaaauuuauuuccaaaauguuuuaacuugggaaccaauuacuggauaaaugcuaaguuacccugguauaaaucugauaaaagugaauuuuucaagccacacggucuccuuuguucaguauauuuuuaauuuaguggucucucuuaagggaggaauugaaaucaacccucugcaacugggucuuaggcuuaucuccaagaaauaaaaucucacaagguuuugaggccuacagucugaauucugacacugcacagaacuuauacagacaggguagagacaggagacuuacaggucugguagugagggaggcuagggugcgugguuugaaugucaagggcguucuugggcuugcugcaaaccucauucugauucuuccauuuuuuaacuguugaacugaagucuauuucucugcaggguuaaguuauuccagaccaaggagagaaugauucgcucuugccacccuccucagauguggagccaccgggcagaugguuggcacugugcacauggcacuugcauacacacacacacacaugcacacacgcacacacacucacacacaccucaacuaauguaaaggucccaacauaaacauuaguucucacaagugcuccaaggauuuuaaaggcuuuggugcugcaaaagauauugagucagcuugugacagcuacaauccugcuccuguuucagguuuaagaaaaaaagaaagaaagaaaaaaggaaaccauacucauuucuuccuuccacagcucagugaaauuccaaaaaauuaguaagaaucccuuagcuugccucauugguagaaaugucugguugggacauuccuuuggccacuuucgcugaaaacugcauaccucugggacuaaagcauccccacuccagucuccugucucaaaacugacugagaauugucuacaaagauaggaggacucugugcaaaaaccccccggagaaaacaacacaaaaccacaccugacccugcauagagcuuguauuuccagagagaaaacacagucucugagauaguauuagguuggugcaaaaguaauugcguuuuuuauaauuacuuuuaauggcaaguuaauauuuuuuagcaucccucagggccucuuuuuauuuucccugcugagcagguaaccaccuaaggaguguuugucccuguuuccaucauagucaaggaaaugugggacauucuuuugccugugaaaugggaaaguugucacugcgauacaguguuaaguuucuccgagagcccaucuuugcaagugaagaggccuuccuuauaggaaauagaaaugcugaccaggccuuuucuaucuaggacacuugugcuccuggucauuuuacuacagcaguuuguguuuaauuuguuguuuuauuuggcaauaagcaagcaaggaaaacaaggguauuaauaaugauaaucgucauuugaacuuccuggguacaacauguacuuguacccaagugcugaauacaauuuuuaaaaaggauuauuuguaugugugcacaaaugagacuaaaaauugccaugaacuuaaaucauucauucuccuuugucccagaaaaacacauuuuugucuccguggcauuugaaucaacuuuucuuuccuuuccuaauuuuagcauuugaaaagauuuuaugucaugaaacgacuuuauuuauguauucugcaacccuugccacaaagccuuaggguguaccaauuaaaaacaugaguuuuacccagcaaagaacugaagcaauuugaugauuuuucaucgaugaaacaguuuccauuagcaagcuccuugcaaaaugauaguucuauuuggcgacucaaaugccauaaaucugguugucuuucugguuuugcggcgaaucccgccugccugccguggucucuguuguugauuuaggauuuuggcuuggcgacccuuuguucuucccucucaucccuccuuuguuagaaagguggaaaaucagcaagggcuguaagcgcugagaaaacagggagucuccuagcaggagucucuugaguguaguuaccauuuauggauuaugaucuaauaauucaaauuccagggcaacagaagaccauugcagaaguuuucuuggcauauuaaaaucugcccgcaagagaguuuaccagaaaaggaaucucugaggugaggaccugacguccacaucuuugcguuggauggccaaaauuucugagaaacacuaagcugugaggucuucugagaaauaagcugaugucacaggguuggacggaccuguugccacaagaugcuaaugcucuggaaaccugccaaauguauugccuguuuaaaauguacuccauagaacuaccauuugauccagcaaucccacuacuggguaucuacccagaggaaaagaagucauuauacgaaaaagauacuugcagcugggagugguggcucacaccuguaaucccagaacuuugggaggcugaggugggcagaucaccugaggucaggaguuugagaccagccuagccaauauggugaaacccugucucuacuaaaaauacaaaaauuagcugggugugguggcgggcaucuguaaucccagcuacucaggaggcugaggcaggagaauugcuugaacccaggaagcagaaguugcagcgagccgagauugcaccauugcacuccagcucugggcaacagaacaagacuccaucucagaaaaaaauaaaaaaagaaaaagaaaaagauauuugcacacacauauuuauagcagcacaauuugcaauugcaaaauuguggaaucaacccaaaugcccaucaaucaaugaguggauaaagaaacugugagauauguguguauuuuuauauauauaucauauauauguuauauauaugauauauauauuauauauauaucauauauauaacauauauaugauauauauuauauauaucuauauauauaauggaauacuacucagccauaaaaaagaauuaauuaagggcauuugcagugaccuggaugagacuggagacuauuauucuaagagaaguaacucaggaauggaaaaccaaauaucguaugcucucauugauauguaagagcuaagcuaugaggaugcaaaggcauaagaaugauacaauggacuuuggggacuuagggggaagggugggaaaggggcgagggauaaaagacuacaaacugggugcgguguauacugcucaggugaugagugcaccaaaaucucacaaaucaccacuaaggaacuuauguaaccaaacagcaucuguaccccauuaaccuauggaaaaauuaaaguaaaaaauacauaaauaaaauggacuccagagagaaguugguuaagggguauaaaaauacaaguggauagaaggaauaaguucuaggccgggcacaguggcucaugccuguaauccgaggacuuugggaggccgaggcgagcgaaucacaaggucagaaguucgagaccagccuggccagcauggugaaaccccaucucuacuaaaaacacaaaaaauuagcuaggcguaguggugggcgccuguaauuccaguuacucgggaggcugaggcaggagaaucacuugagcccaggaagcagagguugcagugagccaagauugugccacugcacuccagccugggugacagagcagggcuucaucucaaaaaaaaaaguauuguuuuauaauguguuauaaauugacuugcuuacuauaaacaauuuacauacagaagugaauaaaggagaaacuagcauuucaaauaaucccaauccuacagcuaacuauugugaaaaacuugauauauauguguacauauaugacauauaguaucuaauauauaucuauuacauuuuaucuauuauuuauuauauauacugauuuggcuuuuuuuuuuuaaccaaauggcuuacacucuacauucuacucuguaauuugccuuuuuucccacauaacaaaacggccagacaucuuucaaaguccagauacguauaucuacucuauuugguuuuggguuuuuguuuuguuuuguuuuguuuuuugagacaacagggucucccucugucacccaggcuggggugcaguggcgcaaucuuggcucacuacaaccucugccuccugaguucaagcaauucuuccaucccagccuccaaaguagcugugacugcaggugugugccaccaugccugaauuuuuugguagagauggaaucucaccauguuggccaggcuggucucgaccuccuaaccucaagugauucacccgccucggccucccaaagugcugggauuacaggcgugagccaccaugccugaccuaucuacuccauuuguaaaaugacuacauaguauuccauugcauggguauaccauacuuuuccaucuaauuccuacuggugaagauuugugguuucuaauuuuuugcccuuauaaauaaugcaaugggcauccuugcauauguaucuuugcacaccuguuugggaaguagaacuguuggaucaaaggauauuguguauacauguuuaaauauaaucauacuagugccuguaaucccagcacuuuugggaggccaaggugggagaaucacuugaggcuaauaauuugagaucagccaggcaacaucauagaaagacgcugucucuacagaaaguuagucgagcaugguggagcaugccuguggucccagcuacucgagagacugaggcaggaggaucauuugagcccagggguucaagguuacagugagcugggaucgugccacuguacuccagccugugugacagagcaaaacccugucucuuaaaaaugaaaaauaagccaggugcgguggcugaagccuguaaucccagcacuuugggagaccgaggugggaggaucacgaggucaggagaucgaggccauccuggcuaacacggugaaaccccgucuuuauuaaaaauacagaaaacaucagccgggcgugguggcaggcaccuguagucucagcuacucaggaagcugaggcaggagaauggugugaaccagagaggcagagguugcagugagccgagaucacgccacugcacuccagccugggcaacagagccagauucagucucaaaaaauaaaaaaauaaaagauuauaaguauaucauaugcaauugugcccuccacuucagcuaaauauaucauuucgugauauuacaugaacuuuguaaguaucauuuuaauggcugcauaauaucccauucagugaauuaaugcuucuaagucacaugaauaugacuaaucaagucauuagaacuuuuuuuuuuugagacggagucucgcucugucacccaggcugaagugcagugacacaaucucagcucacugcaaccucugccucccagguucaagcgguucuccugccugccuccugaguagcugggacuacaggcgccugccaccaagccuggcuaauuuuuuguauuuuuaguagaggcgggauuucaccauguuaggcaggauggucucgaucuccugacauugugauccgcccgccucagccucccaaagugcugggauuacaggcgugagccaccacacccagccaagucauuagaacuuuacuaauccugcaaacaguauacaugagacgcuuaucccucacuguuuuuaacugguaaaacuaguggcuguguuaaagccacaaaacacuaguggccuuaaacacauccugagugggacucaauguggcuaaaaaaugugucuugcuggagacaaauaucuaagugauuuuaaauauugcaaaauauuuguaaagauagaauaaagaucaaaaagguaaaaguagaugaaagggucacauuccauaauuuuaccaagaaaauaaaccaauauuucaaagaug

SEQ ID NO: 17417 - RNA, 3705 nt, Homo sapiens
cuugcuugccgacugagguugauccggcaguuuuccguuuuguuuugagcgcgaaagcguggcuggcugguggagcuccaaucuauuccgcagcacaaacggcccuucugaggcucugcuccccgaggcuggcggaaggaagggcacuggcuacuccgguacccaccgaaacaaaaccgacaaacgcaaccgaauuaacacuauugcuuguuugggucacugaagaaaacuuuucccgugucgacagaauucuagcccgacuuucguuuggaacucaggaucagaccuuuacaaaauuaccgaccuggguuagaggugcccgcacgugucgagaccaucuggccaaggacagagagaugcccccugggagaauguuuuaaccggcgcagcggagccgcuuggcugcgcccgccgcagcccuacucccacuccgugcaccgggcuccgcagugacccgggcuccgcagugacccgggcucccgcagcgacccgggcuccgguugcccagguaacgcaggacgcaggcgcgaaaggcgggugccuggcgcgcgcugcagcucccccuccccccggcgggccgcggaggcgacgcgcugccugcgcccugaggcgagugguucuccagccggaaaaucgcggcuccggugccgcucugggcucagccagugagaggccgggggugugguagagagaaggagccggccggguacuuaggaccgcgccagccucugagcccggccuccuucgcacuuucgagugcgcguuugcugcccgccgcagcccgggcguugaagguaguaaagcggccacccggccgcaucauggugacccccugucccaccagccccucgagccccgccgcccgagcggggaggcgggacaacgaccagaaccuucgcgccccggugaagaagagcaggcguccgcgccuccggaggaagcagccgcugcauccccugaacccgugcccgcucccgggagacuccggcauuugcgaccuguucgagucccccagcuccggcucagacggcgcagagagccccucugcggcgcggggugguagcccccugcccggcccggcccagcccguggcgcagcuagaucuacagaccuuccgcgacuacggccagagcugcuacgccuuccgcaaggcgcaggagagccacuuccacccgcgggaggcgcuggcacggcagccacaagugaggugcugguagagccagcuccacgccgccgcucuuccucuccucccaggcucucuccucuccugccggcucggcccuccgagcgcccgggcccgcgacagcccaggucccgccccgagucgaagcacaaggggccguggaggggcgucaccggccucauuuuacagauggagaaaaguggggcguagacggcuugagggacuugccccgucccaagcuggcuacuggggcacgguagagaggaauucguuuccggguugagucuggacuccuaccgaacucgggcaaguuauuuaacaccccugagcuucuuucuucaucugcaaaauggaaccccuccccuuccuuugaauugcugagcccauuacgcgagguaacguguacgacgcucucugcacagcgccaggucccaaucccgguguuccggcucagcacggcccacgcguuucccaguuuccauugcguuucucuuucugaaaucuucuugccccucuccugggaagcuccccgauucuucuuggcccuuccuucccuuccacagucccucuccacccuaagcccagcgggcccgccuccccccuccuucccggcaggugacggcggaaucccgcuguaagcugcucagcuggcugaucccggugcaccgccaauucggccucuccuucgagucgcugugccugacggugaacacucuggaccgcuuccucaccaccacgccgguggcugcagacugcuuccagcugcuuggggucaccuccuugcucaucgcuugcaaacagguaccugggguaucaaacagguacacgcggcaucuggggacgcagccaaacucccccgccacucccuggccgcccgucuuuccagcgcgcacgauucagugcuggguucccagaacucauuuuaucagacauuugcauacgcauauaucccuuagccuuaacuucacaauuucuccacaaacgaaaaauccugucacucggcuuccaaagaaauagccuaauagacuaauagcuguaaucagucccaaauagcucuuuuggcaccucuagucuagccuccgaaaaagccuucaaaauuucccaagcuuuuuuuuuuuaguuggacaguaguuagaucaacugcgcuggaaguacgcucuaggucacuuacguggaagcaguggagaggcagagccccggcugucucucuggaagggauggggaaaguccgggcgucauacuggggugggccuggggcccgggaagccgcaaagcgggguugagugcgcccuguguugcagguggaggugcacccgccgcgcgugaagcagcuucuggcccucugcugcggcgccuucucccggcagcagcucugcaaccucgagugcaucgugcugcacaagcugcacuucacccugggugcgcccaccauuagcuucuuccuggagcauuucacgcacgcucgcguggaggcggggcaggcugaggccuccgaagcucuggaagcgcaagcccuggcgcgggggguggcagagcugagucuggccgacuaugccuucaccagcuacuccccuucccuccuggcgaucugcugccuggcgcuggcggaccgcaugcugcgggucucgcggcccguggacuugcgacugggagaccacccggaggcggcgcuggaggacuguaugggcaaguugcagcugcugguggccauaaacaguacuuccuugacucacaugcugcccguucagaucugcgagaagugcagccugcccccgagcucgaaauaaaacagauccuucguuuccuuuuagucccuggcccggcugcuggaccucucccguagccucagaagagugcaguacugguccacagagaaggcuucaggaccugcuuggucagcugcagguuguaaauaguguacgauacuagcaucugguauuuuauuuauuuugcagcgagcacaugaggaagcugagucuuucaccaauaaacaguugugguuugucuaaauccugcaagugucugucugcggggagggaaggugaauucagcucaggaauggugguuggcaacguuugcgggauuuucccuucccucuggguccacucuguaauugggaucucuguggaaacaccaggucaggugagguccuggauacugaauuccagagauuaguggagucaggcuuaccugauggcuuggguccugugacccucgaauagaaccucuaugcuguccagaggguugcacuugcuggugaggcagauguggggcugggaagcuuuggggaccacacaggcacacaagcagaagugggggaaagccauauccaggcaugagaaaucccguguucaaauggagcauguuggaaaccaaggauuugacuguggucacagccauugcagguugagcccauuuacccugcaaucacgugguccaacuguucaugcuacgacaugugagcccaaaguaacuggcauaauagucauaauggcuauauugagcauuaaguauguccuaag

SEQ ID NO: 17418 - RNA, 3927 nt, Homo sapiens
gggaaucccacccgggcucugacgacaccgcggcgccggccaauaagaagccggcgagggggauucccgcgccgacugccgccccgccggcuuuuuaaaugguacccuggggaacaccuugcagcggcggugggaggagugggggaccuggagggagguggugaaauagaaugguccugggggacgggacuccagggguuugacgauuaggcgucaagacugacuuagaccugggaagaaaaccagaggcagucgagcagagaggccaaacgccaggcagggcgaagucagccggagauggaguggaaacuggagcgcaccgcgccucggaggguccgcacggaagaggagaugcugugggugaguaacacccuuuucugcauucucccuaacucucuaaugcggggccgaaggccccguucauaauaucuguuuaggaccaagaggugguacgaaacucuaagcccuggucguaaauuugagugauguaauuuaguuauauucugaaggugccuaguugccaaaaaaaaaaaaaaaaaaaaaaaaaaguguaaucugacaagcacaagaucuagaaaaauuccacaccugaaauuaugauuuuccuaaauaguuucucccucaauauguuaucuguguuuucaaaggaaaguaucaugcgugugcucuccaaagacuugaagcagaagagaagucaagauuccgccaacgugaguccagggcuuguucuuguucucuguuuuaauucugaucuugaacaaacgaauucuugguaaauaauguauuuguaggaaguuugagcuggucugaaaauaugagaauuuuaguaucuuauuacauacuaaaaaaaauuucuuuaugaaacugaagaucccagacaaauaaugcaaucguuugcaucugaaucguacuuucuaguuucugccuccacagcaaaggauaaagcugggaugugucagguaggcaguguauugcuagcggcuguuaaugauuuuaacaguugcuaguugcacuccucucuguugcauucagaagcacgccccccaaagaaauggaaauggugccaucuuguggacaauguggagaaguggcauaaaccaugguucuuaacgugagcaauuuaaaguugauccaauguaguaccuguucuccuugaaagaccaaacccaaaggucuuuagugucuccuguaaucaguguaaaaggaaacaaauuuaaaugguuuuauaaacguguuucauaaagagccuucaucugcuuuaaaucucugucaccauuuaccaugcuucucucuaggcucaauaguucaucuuccuuugaccuguacgcagagauucuaguuccaaauccaccaccauuuuaauagauuuuucuagaucuuauauaaauuuugcaacuaggcacuguggcucaugccuguaaucccggcacuuugggaugcugaggcaggaggaucacuugaggccaagacuucaagaccagccuggacaacacagggagaccuugucuuuauaaaaaaacugcaaaaauuagcugggcaugaugacaugugccuguagucccagcuacuugggagccugaggcaggaggauugcuugagcccaggcguucaaggcugcagugagcuaugauugcacaacugcacuccagccuggaggacagagccagacccugccucuuaaaaaaaaaaauucaguauucaagugguaacauccuauauugaauacauaauugcauuuucagaacucgauuacuaaugucauuucuaguaggagaaaacuaauugcauuuaagcccuuacauuucuuaaauacuuuaauguugauuuuuucccccaaacacugcugcaguuuugugucgugcacagcuuauguauuaucacgacuccuagauauuuuacugucuaauacagacaaguagucuuuggaucaguaaacagaagugauuugaaaagcuauaguuaaguaacuuuuuauuuauuuuuuugagacagagucucacuuuguugcccagguuggagugcaguggugcaaucucggcucacugcaaacuccagcucccggguucaagugauucucaugucucagccuccugaguagcugggauuacaggcagcaccaccacgcugggcuaauuuuuguauuuuuaauagagacgggguuucaccauguuggccaggcuggucuugaacuugugaccuuaggggaucagccaaccuuggccucccaaagugcuggcauuacaggcauaagccacugcgcccagccuacaguuaaguaacuuuuaaaauucauuuguacuguagaacauauuuuuauccaagcauuuaauuuggaaaaccuaaauguaaguauucugaaaguuuuaaaguuuuuguuuaacuuuuauguuuuugacuagauucaagcaaauauugauuuuauuucuuauagucuugaaguaauacauuuuguguauaaguuuucuuuaaugugacuauuaagauuagaguucugccacuauguuucauguuacaaauuuagccucagugacugccugggccacgagaaucggcagugaccugaaucagguaggcaguguauuguuagcuggcugcuugggucaagucagcagccacaacuacccugccacuugcuucuggauaaauucuucuugucaaugaagugcucuggauaccugugugugaugagcuggcaguguauuguuagcugguugaauaugugaauggcaucggcuaacaugcaacugcugucuuauugcauauacaaugaacaucagaguguaacugaaucuguaauuaguguguguuuauguguacuuucugcuaugaagcaagccacuauuuaccauaauauauuauugccauuagcuuauaauacaguaauacuuacaaugcacaguuuuauaaugguaaggaaaguauuacaauuacuuaaauuuuuuccuuuuaagaaaaauuuacuuaugccugcuuuuccauaacuaaaaauuuuuaagaaauauuuuuggagucuuuggagucuuucggaguagacaguguuuaaguauuuaugaaauuacauguuuuuaacuauaagguuuagaauguaauaacaauguggaauggaccuacaauguguccccagauuuucagugaagucuuuaggauucuuucugcauuauuaguuucuuucuuuuuuuuuuuugagacggagucucgcuuugucgcccaggcuggaguacaguggcgcgaucucggcucacugcaagcuccgccucccggguucacgccauucuccugccucagccucuggaguagcugggacuacaggcgccugcuaccaugcccggcuaauuuuuuuguauuuuuaguagagacgggguuucaccguguuagcugggauggucucgaucuccugaccucgugauccacccgccucggccucccaaagugcugggauuacaggcgugagccacugcgcccggccucugcaucauuaguuucuaaauacagcauuagaauugguuucuauagccaugacuguguguguaccaacugaagggaaaguugagguaauuuuccagaugagucagucaacuaaaacauuuuucacuugaaauaucaagaauauuggggauuuuuuuugggugggggaugguuuacauuuuuuuggaagaucuaccucaauccuuucacuucauuuucuguaaaaucacagguucaugaaauauuuggaagacagcaugagaucuaacaacuugugaagugggaagaacugaccauacaauaugaccuuaaauauauucucauuaccuuggaggcauuuugacccacgaaguagcauagauaugugcuggcuuccagacaugcaguauucuugugcggacauuugcagccagucaguggaacugacuuugguggugccaucaguuaguuaagccauagaug

SEQ ID NO: 17419 - RNA, 4584 nt, Homo sapiens
uuuuacauuuuucaacauuuguguuuuauuccauuaacauaaccauuuacaguuauuccagaaauuucagucauacacagugcucuugaauccaaagaguggucuaguguguuggcauuuucaucaaguacaguccuagaaaaugucaaguugaacaauaagauauugaggcacauuggucacuguguauucugaauucuuuaguauggucagaggaaguaguuaauauauuucauguugauucuuuggcuacucuugauuuuugcuuuggguaacauccucauccugggaacauucauuaccacuuaauagcaagauaacauuaaaaaaaaauccuucauugccacauuuaauagcauguuuaaaaaggcagagguugcaaugagcugagaacgcacuacugcacuccagccugggugacagagugagacacugucuccaaaaaaaaaauguuuaaaaugagaccaaacccucauggagacauuucucuguucuauuagaaacgcaauggcauucucauagauccucuuucuuuuuuaugaucacuugucuaaccagagcugcuaugucaggccugaugacuucaaugggcuccucuggcuuccagaacuucacaacuugacccucaggguugacaagauacuuccaaaaauuccaccuugguuccuucuuugaagaaucuaaaauauccagaacauauuuucaugagcauaauuuuauucuuugucaagauuuucacuucuauuaguaucugcauaaaugauaacuuuaguaucaaguucuaggacugucauaauauaaaaaacaaaacacccaaacgaagugaaacucaagguuagaguaaccagauuucaauauacuugaugacuucaccuaugagucuacucaucuaguaugugaucuuaguaucaagaaaugaagcaaaguaggcugggagccguggcucagucuguaaucccagcacuuugggaggcugaggcggguggaucaccuaagaucaggaguuuaagaccagccugcccaacacggugaaaccccaucucuacuaaaaauacaaaaaauuagccgggugugguggugugcaccuguaaucccagcuacucgggaggcugagacaguagaaucauuugaaccugggagguggagguugcagugagcugagaccacaccacugcccuccagccugggggacaagagugaaacucugugucaaauaaaauuaaaagccaaaaaaaaugaagcaaaguuguaaucccaaauugcugggauuacaggugugugccaccacaccaggcaaauuuuuguauuuugaguagagauaggguuuuggccucccaaagugaauaaucaccuuauuuugaaaagcaauaacuuuuuuuuuggcagggucucgcuguguugcccgggaugggcuugaacuccugggcacuaaagugauccuccugucuuggccucccaaagugcugggauuacaugcaugagcuaccaugcccagccaugauauccuuuugauaaaucuuaauuuauguaagaaauguagauuuuuuuucuauuuauaccacucaagauuuauguucauuuuauugacuaacaugaggaaaaauauaauaauuauaacuaaaauuuaugaagugcuuacuaugugccagauuaauguacgcuccgugcuucaaauugauccucucuuuuaaucuuacagggacccuaugagguggguauuauuaucauccccguuuugcagaugagauaaauggaagccuagacacaaggucacguggcuaaugagugguugagccaggauugauauacgggccuuuuacuccagagcucaugcucuuaaccuuugggcucuaugauccuuccuaucuaaguggaaugacaccuuaacucacuguuaccuuuuugauuacacaggcuaagaaggguuuuagaagguuuguagugauaaagagaaauaaccuaugagcuauugcacccacguaucuggcugcuguaacugaagaaugauuaguucaauggcaugugcuugggcuuuucuuuccucaguggaccuucaaaauaagaggaauaaagaccucacugugguugccauuuauggcguuaggcauuauaucaacuuucccuagaaauuaaauauaauguuuuuagaagauucugacuucacauuuaugugaaauauuauagaucacuauuugguuuguuggauuagaagcuugauugccugagugagguaauaguuugaucaaaacucaacuuauuuacagugaaaauaggacugaagaugucaucagaauaaguuagaugagagaacauuagcuaauguccuuuauuuauuuauuuaagaugcaggcuugcucugucgcccaggcuggagugcaguagcgcgauuucagcucacugcaaccucugccucuggguucaagcgauucuccugccucagccuccugaauagcugggauuacaggugcccaccaccacaccuggcuaauuuuuguacuauuaauagagaugggguuucaccauauuggccaggcuagucucuaacuccugaccuuaagugaucugccugccucggccuccuaaagugcugggauuacaggcgugagccaccgcgcccggccuuuuuuuuuuuuuuuuuuuuuuugacuaauaugguuuagaacagugucuggcacagagcaagcaguguauaaguacuuuauuuuuacuauuaacagacuuaauuccaaacaaucuuaagaaggcgguacuauugauagcccauuuuacaaaugagaaacaggcacagagaaguuaagaagccacauagcaaaaacaaaagagcagggguuugaacccagguagcuugaggccaaagccuaugcugucuguaugccucaugaccuuugugcuaagugaccuuggcaagucuuuaaacagauuucuguagcuagcuuaauuggagaaauagccuaacacuacugcccucugaaaaaaccaaguuauauguuuuuggauuuuagcaaaaaucugguaagcugacauauucaucuuugagaauauuguuucagauaagaaagacaacauaaaauuagccacaaacauauguuaacuaauaaugcccagcacuauucaugagagcuguguggcuauaaugacgggaagggacauuucuccagaugcuaguuacaagagaggagaauuaagauauuuugugaaaauagccaugggcacacuuuaaguaaauucuucaggaagaugguaauaaggaauaaaauauauuggaauagaauucuuuuaccaucuaagaagcuaaaacauugauuucaggggagcauaacuccuagaaguuacaaaggaugagauucuggcucuuugaugauaguuuuaugaagcuuucccgauacaacguuucaaaugaaauaggaaaguauuguccugguauaauuguuuaaaaaugaaaagcaauuuaaaacagcauaugcaaggcagauauuuaccaacaagaaaucuaaaugcagguucuccuucagauccuagaaucuuaaucuuguggaagauggggaaaguuacuccguaguuuuuucuugcaaaagauucuacuuccuugcuugggcggggcuccgauucuccaaacugauugcagggaaaagccaacacgcugaagugggaugguccaaacucuuugugcaguuccuucagcccuaaguaauuucugucugugaguuggcagucacuggccacguuuacaacuagugaaaccucccggaaaaagaaaaaaauccaaccggaaagugaagcaaaagauuuuaaaaaauucugcaaguaguuaaaauccuaaacaauuugggggggacuauaaccucugauugauguuuuuuucauauuuuuggacauacacaguucuauugaaaacuguaaccuagaugccuggguuaaggcccugaaauaguacugccauuaaaaaagcauuagauacucaugaaaguuuauuuuuaaauuaaagauaaaacuaugauccuugauaaguucuuuuuaaaguuauuagauuauagaaccaauacuuuuauuaauaaaugucaucauguucacauuacuaacuauaaguauuuuccaaacaacuuuacaugucaauucagcacaaaauuaaagcauuuuaaagaaaacgagauaaucggaauuuauuauuuagaagcaaacuaucagaacuguaauaacuaaagugauguacuaauaccauuacucugaagacuaaauuccaacuuaugaccauguaacagcaaaaaauugauuuuauuaagaggaauaaacagagacaaggaaaaaugauaacaauaaaaaucagaugaugcaacuuacuuugccuuuauacuuuuccagagaaacaguucuuccuuuugcauccuucacuucaaaggcauaaaagcuguugauuuuagguuugaggaauuuuaguuguagaagaaauagcguuacugugcauagaacuauagacagcaaaacugcaaauaccuuugcucugggcccggaacauuuuagcggguaagcugcaagaggcuccauguuggaggauucuagagggaagucucagcagccuggaauuca

SEQ ID NO: 17420 - RNA, 4584 nt, Homo sapiens
ugaauuccaggcugcugagacuucccucuagaauccuccaacauggagccucuugcagcuuacccgcuaaaauguuccgggcccagagcaaagguauuugcaguuuugcugucuauaguucuaugcacaguaacgcuauuucuucuacaacuaaaauuccucaaaccuaaaaucaacagcuuuuaugccuuugaagugaaggaugcaaaaggaagaacuguuucucuggaaaaguauaaaggcaaaguaaguugcaucaucugauuuuuauuguuaucauuuuuccuugucucuguuuauuccucuuaauaaaaucaauuuuuugcuguuacauggucauaaguuggaauuuagucuucagaguaaugguauuaguacaucacuuuaguuauuacaguucugauaguuugcuucuaaauaauaaauuccgauuaucucguuuucuuuaaaaugcuuuaauuuugugcugaauugacauguaaaguuguuuggaaaauacuuauaguuaguaaugugaacaugaugacauuuauuaauaaaaguauugguucuauaaucuaauaacuuuaaaaagaacuuaucaaggaucauaguuuuaucuuuaauuuaaaaauaaacuuucaugaguaucuaaugcuuuuuuaauggcaguacuauuucagggccuuaacccaggcaucuagguuacaguuuucaauagaacuguguauguccaaaaauaugaaaaaaacaucaaucagagguuauagucccccccaaauuguuuaggauuuuaacuacuugcagaauuuuuuaaaaucuuuugcuucacuuuccgguuggauuuuuuucuuuuuccgggagguuucacuaguuguaaacguggccagugacugccaacucacagacagaaauuacuuagggcugaaggaacugcacaaagaguuuggaccaucccacuucagcguguuggcuuuucccugcaaucaguuuggagaaucggagccccgcccaagcaaggaaguagaaucuuuugcaagaaaaaacuacggaguaacuuuccccaucuuccacaagauuaagauucuaggaucugaaggagaaccugcauuuagauuucuuguugguaaauaucugccuugcauaugcuguuuuaaauugcuuuucauuuuuaaacaauuauaccaggacaauacuuuccuauuucauuugaaacguuguaucgggaaagcuucauaaaacuaucaucaaagagccagaaucucauccuuuguaacuucuaggaguuaugcuccccugaaaucaauguuuuagcuucuuagaugguaaaagaauucuauuccaauauauuuuauuccuuauuaccaucuuccugaagaauuuacuuaaagugugcccauggcuauuuucacaaaauaucuuaauucuccucucuuguaacuagcaucuggagaaaugucccuucccgucauuauagccacacagcucucaugaauagugcugggcauuauuaguuaacauauguuuguggcuaauuuuauguugucuuucuuaucugaaacaauauucucaaagaugaauaugucagcuuaccagauuuuugcuaaaauccaaaaacauauaacuugguuuuuucagagggcaguaguguuaggcuauuucuccaauuaagcuagcuacagaaaucuguuuaaagacuugccaaggucacuuagcacaaaggucaugaggcauacagacagcauaggcuuuggccucaagcuaccuggguucaaaccccugcucuuuuguuuuugcuauguggcuucuuaacuucucugugccuguuucucauuuguaaaaugggcuaucaauaguaccgccuucuuaagauuguuuggaauuaagucuguuaauaguaaaaauaaaguacuuauacacugcuugcucugugccagacacuguucuaaaccauauuagucaaaaaaaaaaaaaaaaaaaaaaaggccgggcgcgguggcucacgccuguaaucccagcacuuuaggaggccgaggcaggcagaucacuuaaggucaggaguuagagacuagccuggccaauauggugaaaccccaucucuauuaauaguacaaaaauuagccaggugugguggugggcaccuguaaucccagcuauucaggaggcugaggcaggagaaucgcuugaacccagaggcagagguugcagugagcugaaaucgcgcuacugcacuccagccugggcgacagagcaagccugcaucuuaaauaaauaaauaaaggacauuagcuaauguucucucaucuaacuuauucugaugacaucuucaguccuauuuucacuguaaauaaguugaguuuugaucaaacuauuaccucacucaggcaaucaagcuucuaauccaacaaaccaaauagugaucuauaauauuucacauaaaugugaagucagaaucuucuaaaaacauuauauuuaauuucuagggaaaguugauauaaugccuaacgccauaaauggcaaccacagugaggucuuuauuccucuuauuuugaagguccacugaggaaagaaaagcccaagcacaugccauugaacuaaucauucuucaguuacagcagccagauacgugggugcaauagcucauagguuauuucucuuuaucacuacaaaccuucuaaaacccuucuuagccuguguaaucaaaaagguaacagugaguuaaggugucauuccacuuagauaggaaggaucauagagcccaaagguuaagagcaugagcucuggaguaaaaggcccguauaucaauccuggcucaaccacucauuagccacgugaccuugugucuaggcuuccauuuaucucaucugcaaaacggggaugauaauaauacccaccucauagggucccuguaagauuaaaagagaggaucaauuugaagcacggagcguacauuaaucuggcacauaguaagcacuucauaaauuuuaguuauaauuauuauauuuuuccucauguuagucaauaaaaugaacauaaaucuugagugguauaaauagaaaaaaaaucuacauuucuuacauaaauuaagauuuaucaaaaggauaucauggcugggcaugguagcucaugcauguaaucccagcacuuugggaggccaagacaggaggaucacuuuagugcccaggaguucaagcccaucccgggcaacacagcgagacccugccaaaaaaaaaguuauugcuuuucaaaauaaggugauuauucacuuugggaggccaaaacccuaucucuacucaaaauacaaaaauuugccuggugugguggcacacaccuguaaucccagcaauuugggauuacaacuuugcuucauuuuuuuuggcuuuuaauuuuauuugacacagaguuucacucuugucccccaggcuggagggcagugguguggucucagcucacugcaaccuccaccucccagguucaaaugauucuacugucucagccucccgaguagcugggauuacaggugcacaccaccacacccggcuaauuuuuuguauuuuuaguagagaugggguuucaccguguugggcaggcuggucuuaaacuccugaucuuaggugauccacccgccucagccucccaaagugcugggauuacagacugagccacggcucccagccuacuuugcuucauuucuugauacuaagaucacauacuagaugaguagacucauaggugaagucaucaaguauauugaaaucugguuacucuaaccuugaguuucacuucguuuggguguuuuguuuuuuauauuaugacaguccuagaacuugauacuaaaguuaucauuuaugcagauacuaauagaagugaaaaucuugacaaagaauaaaauuaugcucaugaaaauauguucuggauauuuuagauucuucaaagaaggaaccaagguggaauuuuuggaaguaucuugucaacccugagggucaaguugugaaguucuggaagccagaggagcccauugaagucaucaggccugacauagcagcucugguuagacaagugaucauaaaaaagaaagaggaucuaugagaaugccauugcguuucuaauagaacagagaaaugucuccaugaggguuuggucucauuuuaaacauuuuuuuuuuggagacagugucucacucugucacccaggcuggagugcaguagugcguucucagcucauugcaaccucugccuuuuuaaacaugcuauuaaauguggcaaugaaggauuuuuuuuuaauguuaucuugcuauuaagugguaaugaauguucccaggaugaggauguuacccaaagcaaaaaucaagaguagccaaagaaucaacaugaaauauauuaacuacuuccucugaccauacuaaagaauucagaauacacagugaccaaugugccucaauaucuuauuguucaacuugacauuuucuaggacuguacuugaugaaaaugccaacacacuagaccacucuuuggauucaagagcacuguguaugacugaaauuucuggaauaacuguaaaugguuauguuaauggaauaaaacacaaauguugaaaaauguaaaa

SEQ ID NO: 17421 - RNA, 79211 nt, Homo sapiens
cguauuccuuuaugcucuuacaccaagccagcucaccaccagugaaguuugcagucauugccagggcucucugugguucaccuaccaccagugacaguguccuaauuaccauuugaguagugguugguccagcugcaaaucucaucuuaucaucugcuuuuucagaccacuuccaguaccaauugucacagguugggcuucuggggaggcagaaucugaaauggaacuuagcaugcaggagguuuauuagagagagcucauaggaucaacuccuauggaggggaaagaagcauucugggguagauggaggaguugaauuguaauuucaucucaguugaaaccucagcuaccucucuugagaguugugaagagggaaugaccguucagagcuuuccagaguuggggugagagaacacugagccuuuuauacacccaugucauaucucugggucaccccaggaagcagauaaggccuugggaaaggcaacuuucuucaccaggaucagucccugaaaagagaugauaauauaagguggaauagucauugcauaauaaauuuacuaauauauuucuuuuguuauuuuccucuuagcaucuuuuuauggugaaagcuauguggaguucaacaucauagaaguuuccucugagcuaucucuucaauuaaaauuucauaccagcaaaccacagggauuacuuuugcuugcagcugggacaaaugacuauuguauaauagaacuuaaaucaggaaccuuauguguaugauuuuaaaucuugaaaauacauauaagcauauaauuacuggagagaaaagcaguugagagagaaagagaacaaaacagcuacauguauugauugcuguuauuucauuagaauaaaaugaugugccauuuguauagguugggaucuccuucgguuuuacuagcauggcuuaaauauuccaacuuuaaaauuuccugaguuuaguauguaaucuauaagcaugggaagaguuuucaugugcaaauuucucucuucuuuuucuuuugugaaagguccgauuuucucaauaaaacauuaugaaaugaaaagugagaugagauugauuaauuaugauucuuuuucaggugagaguaaauuuggguacaagugaacaaaugcuccuuucugagcagagacuucauauggaugaccugguuuggcauuugguggaacugugcuauguuaagcauaauauuuccuuuguuauugacaaacguuaugagacaacuggccaaauggcagcuggugggaugcauaauuugaauuuucaacauggaaucuauguaggaggccgcagggcacucaauguaccuuaucuguacggaaagcuccccaauuuuugaggauguaugaaggaugugguauuuaaccagagggagauccuuacgucccuuagaucuuacccugguuuuaagaagguuuaugaggugucacuaggaugcaaugacgaguuuuuuuugcaggggaggaugaagccaucaauuucuuuagcuccagauucucugucaguuuuccagaauggaaagugcaaggguaaacacuauuggaauuuacuuugcaaacuguaacucagcaagccuugcuuucauuucaguuggguaaggaaggagauuuuguugcuuuguaaauagaugaaagucuauugaaggcuuauguaggaaggcauaaaaguaaaacucagcuuucuucuuuuaguuuugucagugacaacaaguggcauguuauucaauucaaauucacaggggaguaucuggaccuaacaguagaugaaaaaaagguaaggaagucacugccuuugcaaagcaaacauuuguaucugaaggagcccuuuuugugggaggucuugauaaccaaaugugggaagaaguaaagagguuagaacuugccucugugccugggaaauuugcucgaggaaccucuuucaaagggugcuuaagaagcuuggaagccaauucagaaaagagagcguuaagggaugcccuuguuuucaaagauauuccuguuguuguaaaacugagaguguugauaacacaaauccuuccauaacagcgauagaaaaucugcaucagucagaaguuuuccuuuccacugccgucccugaggucaucaagccuuuucuucaagaugagaguagcgauuucuugguuuugaauaacuugcagguccaagaagguggaccuuacugaaacaaaggcacaugaaacuggaugugaaauuuaaggauuuggguauccaucauucucaaauacuauuuaaaauagagggaaggccuauucauggguuccuucaauuaaauguaccaccugagcaaguaauggagacagcuuuuaccauguuagacuuauggcaaggaaaaguuugauauguccaugaugguucagaagaaccuauggauuauuuuacauuuuugguuucucccaauagcaagaaagaaaugccauuauaucugcaagaacguguuccacauguguuuaacauuauugucauuccagucaaugaucccccauaccuuaagguaccagaaggaaacuugcuucuucuauuugagaacucuaagaaacaacugaccccaaguaugauagacaugucagacccugacacagauucuuugagucuuuguauuucaguucuuggcaacuucaauucagaugcugggguuuuagaaaaugcaagugaucccgggaaugccauuaaucauuuuacacaugaagauuuaagagauggcaacauuuucuaugugcacaggggucaucgaaacucucagauuguucugagagcaagugauggagagcugguuaguaauacagcagugguguggaacauggcuguuucuugggacuuugcaguggccguuagaacuggugugguuguagaacaggguggcacuccucugauuacauggaguaacuugucaguggagguuaauggugaauggcaugagauggagacccgcucugacaucacucauccaccucaguauggccagauucagcggugagggucaagugggaaauggaaacaaguuaguaccuuuucucaguguucuguugauuggagucggguccaguacuauaguacauugaaagaauugcagcuagaaaauguuacagaucauuuuaaauguaaaguuaacauagaaggaaaagucagugaagagcugauauuuccaguuacaacacaauggcugaaguuuauccugaaaaauguuccucuagagaugagucaacuaaacaagaacauauugaauucugaucauuugcaggcugcaacagaggguguggaaguagcugagagggaacuacauuuuaaguuauugaucccaucuaagaaaggaaaauugguacuuggcaauaaaguucuaaaaacaaacucaauuuucagccaaaaaaauauuacagacucuaagauaaguuaugaaccucaggagaggccaagggaagacucacaggauacuuuuagguuuuugguuguugcaaaauacauagacucaaaagauuauacuuucagaaucaacuuuaaagcagauaagacauacuuuauuuuaacuaacagaggauuauuuguaaaagaaggagaaggaaaauuaauuacaaaaucagaacuauuuguucaaauuuuggacaaucagaucuuccaauauaaaaucuccaagggcccucaacaugggaagcugaaacugcuuaacuugucugauucucuggaaaguaaugacaauaucacuauguucacaaaucaagagagagugagugaacaggugaucuauguucaugaugacucugagacugagucugaugaguucuuuuuuguggccuucaccaaaggaccaggggggagcagucagggaucuugacucacagcauucaucuauggaaauaaaagucacacuuuccguuggguuaaagaaugaugagaaaccaguacgcaugauagauaaggucuuucauguugugcggaauggccagcgcuuauugacccuggcagaucucuguuaccauaacccugacuuagauuuugauaaugggcaguugcuguacacccagcggggcaucccaaauggggauuuagugugagccagagaccccacucagaaacucuaccaguucaggcaagaagaccugcaggaagggcacgugcuuuucaggcaucagggugcagacuuggaucgcuucgugcuguuugugacagaugguguccacuacacaucaucucuucucaaggccagugugucagacccuuauguccagauagccaacaacacggggcugcucauacagagaggaaaggauggcagccucacaguggccaaccuaagugucaccacaaaccaaaaugucagaacagaccacaagauugaauuccacauugugcagggccuaaagcauggcaggauccuggucaaucauucuguuucccacucauuuucucaggaugacuuguugaugugugauuuauaggcacgauggcagugaugacuuugauguauucaaccugagagugaaaguuaaagccacauacuuagaggugagagugggugucuauguucaagugugcuuggaaggucacccacaucacacgcagguucugcacaucgagacucuaguaguugaagaaagaaaaccaguaaaacugaauacaggaaggcuccagguagguaauuauccuauccacagcacuaagaauucucauucuuacaggugcuaauaaucuguuugcuucugaaagcuauuuuuguguugauuucuccccugguaucaggagugaauuuuuaaaaauauagaugccauugagaagaaaacuuggaaaguuucaugauuuugaugcuaccaauuuuccuacaguuggaaauggaauguaagcaaugcucaggcuuauuuuaaaguugggcucacaugugcauacaugugcaucauauauauguuuaguacaguaaaaacuuggacuaagggagagagguauauauuaugguaaauuaagagaucuuuuauucauuauccauagcaacacugccaauauuucauuugaucugaguuauauuuaugaugugcugaaugaagcacaguauaaaaacuuggaguaauuuaacaaauguaagaaacauuccuaagauaccagcaaauacuauauuauauaguuuguuuaggucugaauguggccuuguuuaguauccugaaagugaugguuaaaacuagccuagaccaguggaaugucagaggugagaccaaaaaucaccugguuuucugggccucguacuggaaacuuccagcaggcacagccaugcugaucagaguuuggaagggguguucuuuuuuaggguaaugcuguguagggugugggauguguaagcugcgauuuauaacaacuggccacaaaugcaggcuauucugaaucuacccucgggacugcaaacaaguuugcuuuuuugcuagaugcagccaauaaaauuaaguaaaaaugaauucaaaucagaauggguuaaauacuuuugaauaagacuuugaauagugaguuuggaauaagaaccagcuuuuuuguucuuuuucaagagcuuauauuuaaguuucaccacaagggggcauaugcaguccaaugacuauacaucaguuauaaucagauuugagauggaguucccggaauaaaaaaauacguauugaaagugcugagcgaguucaaaugggggaugauaacuuuccucucaaggucuuacaaguuuacugacccaacugcugcgucuucuaccaucuuguauuccuucuccuuacacuaccauuuuauuucuuucaccucaaccuuggaguccuggguuuuuuugcugcugugaaugacacuugguuaauacauuaguagcuacuuagguguugcugaccauuacuuuuuuuugugaccagggccaauauuaaaaauauuggcaugggcaccaaaacagacucaggcuuaaacuguguaucaacccuaaguacaacuuaagccaauuguggauguuaauauaagacaaugugguuuucaacagucuucacuucuacauuuauuaauguuuuucuuuuugugucuauauauggugugugugaacucaaggcugggcaugaagauaauauuccuucagaggcaguguucauagucggaacuccaccaaugcauggauaccuccaaaaauuuauaccagaagaaggcagcuugggugcagaugaaaagucccuuugacuuucacacaaccggauguggaggauggcaauauccuuuaugugcagacaucccccaaccaagaacaggacuguuuuucccuggaugugaugaaugguuuccaaguugugagcagagucgaaaucuugguggacaccacgccuaaguggauuuuucugcagguacagaauuucacaguucaagaagguggcuccagagaacuucuagaagacuaccucaaaauuccaaguaaauauuuugagggauuugacugugaauuuguucuacuuauuaaaccacugaaacacaguuauguuaaaaguucuaauuuuccaagaggaaagcuaauaaaauuuauugggaaacagguaauaacucucaguuuauguaauugggaauguuggguaggagaaaaaaauggcuauuuauuauuuagauuuauggguaugauggugugucuagcauugguggguucuuggucucacugacuucaagaaugaagccacggacccucgggugaguguuacagcucuacagcucuuaagguggcgcaucuggaguuuguuccuucugaccuucggauguguucggaguuucuuccuucugguugguucguggucucgcuggcucaggagugaagcugcagaccuucgcagugaguguuacagcucuuaagguggcgcgucuggaguuguucauuccucccagagggcucguggucucgcuggcuucagaagugaagcugcggacuuucacggugaguguuauagcucaugaaagcaguguggacccaaagagugagcaguagcaagauuuauugcaaagagcgaaagaacaaagcuuccacaggguggaaggggacccgagcggguugccacugcuggcucgggcagccugcuuuuauucucuuaucuggccccacccgcguccugcugacugguagauccgaguggucuguuuugacagggcacugauuggugcauuuacaaucccugagcuagacauaaagguucuccacauccccaucagaucaguuagauacagaguauggacacaaagguucuccaaggcccaccagagcagcuagauacagugucgacuggugcacucacaaacccugagcuagacacagggugcugauugguguguuuacaaaccuugagcuagauagagugcugauugguguauuuacaaucccugagcuagacauaaagguucuccaaggccccaccagagcagcuagauacagaguguccauuggugcguuuagaaacccugagcuagacacagggugcugauuggugcguuuacaaaccuugagcuagauacagagugccgauugguguauuuauaaucccugagcuagacauaaggauucuccaccucccuaccagacucaggagcccaacuggcuucacccaguggauaccacacccgcgcugccgguggagcugccugccagucccgugccaugcgcccgcacuccucagcccuuggguggucgaugggagugggugcuguggagcagggggcggcucucaucgaggaggcuugggccgcacaggagcccauggagggggugggaggcucaggcauggcgggcugcaggucccgagcccugccccgcgggaaggcagcuaaagcccggugagaaaucgagcgcagcgcuggcgggcuggcacugcugggggacccaguacacccuccgcagccgccggcccgggugcuaagccccucauugcccggggccggcagggccggccggcugcuccgagugccgggccgccaagcccacgcccacccggaacuccagcuggcccgcaagcaccgcgcacagcccagguucccgcucgcgccucucccuccacaccucccugaaagcugagggagccggcucuggccuuagccagcccagaaaggggcucccacagugcagcgguggacugaugggcuccacaagugccgccaaagugggagcccaggcagaggaggcgccaagagcgagcgagggcugugaggacugccagcacgcugucaccucucaaugggaccuuggagggugucuaguccaccucccaacagaugcuagaagcccuuccacaguauuccuauagaaagguuaucuagccagugcuuaaacaucuucagugauagggaacuuacuacuugcugagaugagcccuuccaauguaaauacgcuccaauuuuuagauaguuauuuaggcugagcugaaaucugccauuuaaaaacuuuuucuccuaggcgcuggcucuaguaccccagauuuauucuguaccagagguaccucugguacagaauaaaacauaugccuccuagauucauucauaguaugauucuccuagaaucauacuauucugguacagaauaaaucauacccauccuuucaugaaagcuuuuuaaguauuugaaagaaaagaugaucagauuuccuugaauuuuaucuuucuuagguuaaacaucccuagcuuuccagcuuuugcuucuaugccauggguuuccugcacgauccugguugcccaguucuagaugagugccacauugucacuggcccugucagcaauaucgggguaaugcccagguauuuaacacaaguaugcuuuaaucauugguggauuuuuuuauucauucauuuucucauucaaccaacagaugcuuacaugguacguuuuccauaucauacccuaugaugaacauaagcucucgaaaguuaaaauaguccaggcccugcaaucagggagcuggguacaauugccaauuuggcauccaaucagcauaaaauaaccaaggacaacuccgggcugcugucacguuucuuuacuuuggguuagaauggucuuauuguuagacuuuacuuucuuaucaugaaugaaagaaugauuuccacuacuuucuuuuuaaauguugaaaaguaacuugcagguccccaucauuuccuuuauaagacccuaggaacauacacucuccagguuggaaaccauuaacaaccaccuaccauuuuagagugucuuugucuagucagcuaggaacacauguuugaugcuucauuugcuucuaagaauuucaacucauccauugauuugaaucaauuuacuaaacaucuuguucgaguuacugugugcaguuaccauggucaguaaaacauauuucucgcccucaagaaauacugcugagcaaucagaggcaccagguuuaauauaaggugcacucuucuugccucucacguggcauuuucacagugguauggugggaauaaagauucuaacugaaaagcaugaggaaaccuucacagaggaaauaauguuucagcuagacuuugaggagagagugaaagagcagggagauaacagaggaggaaacagagaaaagcagggcaagcaaagggaacagcauggccaagggcauucuagagggauggggaguuguccaggagguggaggaguggcagaguguacuuggagcuaaucuguggaggaguccuccccuuugaccacaggagauguaaccugaauuacacgucaagggggcuagacuuaaccaggggauuuggggagcccuggggagaaucagagaaugcugaggguuggaaaagaccuuagacaucagugcuucucagcgggggucccagggaaggugacacuuuagugaccucaugcagguggggucccagggaaggugaugcuuuagugaccucaugcaggugucuuucagucauggcuucucccucaaaggcuggacaaaccaucuaagaccauuucaaaccugcucugcugugaguugaauugaauaccucucuaaaaauaguuuguaaauuguagcccuaucuucugagcacuaaauuuugguccgauccuggucaauucagugguuaauuguguuguguaagaggcguguauuuaagaaugacugguugaaacguaugugucgagaugcagguguucccugugcaucugcugugacaacaugcuguuuauguuaucauguagccuuauucacagagaagagucaaagucaugggucccugauuucgaggcgaccccuucacauugucucucccuagaugacuccuggggucacuaaguuuugagacauggucauuuucacuuacagugacucuaaccucuaaaaacuaguggcugcagccuuuagugacuuggagagggagauucccuggccauucuugcccuucauucauucagcaaauaguuuuugaauaucuauuuugugucagggaugccaguucuagguacuggggauaaauuggugaacuaaccaggugauaaucccagcccauagggagcauuuuuccugaugagggaaagagagaggcaggaagaaacaauaaauaaaauaaauacaugaaauaaauggcauguugaaugauuugugcuauggagaaaaauaaagcaggaaagggagcuaggaagugcugggaucuuuaauggaguguguguguguauugacguucaauuucuaauagaguggugaaggaaggcaccguugagaaagcagcauuugagcagaccccggaggaggugauggauaggugagcuaaguguauauuggaaaaacauucaggcagaaggaagagcaagagcaacagcuuuguguggggagcaugccugguguguccgaggagcagcaagucauccaguguggcuggugcugcaggcgugguggggagcacagcagaugagucagcagaucaggugugggagggcccgaggcuucaccuuugaccuggaguaaggagugagaggggagcacugggggaugagaaggugugagcagaggagcgccaaagaugucccugaacggaguuggugacaggggaccaaauacuuuugaaucugucaagauuuuccauuaguuuguuguauccuuuaauuucaggccagcagguauuguucugguuuuagaagucuagggauagacaaauccccaacauacccucucuuugccuucagauuaauauuauuaaauggcaugucauuuugggaagugccacuccauuaaagaaaugauguauuuuuccgggagaaauacucugaacaugacugguauuuaaagguuacauuucuaaagugcauuaaaacuucucccacauucugcuuagagccaucuuccauguuuguuuucaaauagcuuaagacagcauguuccaggagcacaugcacaggccaugagcuggaauucuucugcccacagaacuccaaagaaauucucauagcaccucuguacgaguggacacaacuuucucuugagacccuucaugaacuuuucaacucuugucagaaacaccucugaaagaucaaaagacuuuacucagaggaaguaugccacaggaaugcgugaacuugaacuguuaaaaauuuuggcuguauuuuaucaaaauaaacacaaucccagauacuuuuucagaaguucagcuacuccuuuugggguuugggaguucucugcuguacguuugggucacagacucacugcagcuaaguucccuuuuaguuuuauaauccucuuggucucugauuuugauucugugcucuucaauauuuccaucagaguuuuaaagacaugaaaggcauuuugaucaaaguugugguuaugacaaauccaagaggaauaacuaauucucuggaggacgauuucagagcaaacauuaaaaggaugaaaucugaccagccugggcaacauggugaaaccuccucucuaccaaaaauacaaaaaaauucccugggcaugguggugggugccugucuucccaacuacuugggaggcugaggugugaggaucgcuugagccugggaggugaagguugcagugagcugagaucaugccacugcacuccagccugggugacagaguaagaccccaucucaaaaaaaaaaaaaaaaaggauaaaauaugacaaaaguaaaaguaaaugcuugcauuuggauuauuauagagagggagaucugugugguugauuucaguguaauucaucacagucuguccacaggggauguauguuagguaguuacggguagcauccuuuauuaguugcacaaaaaccuauuguauucugaaggagaaggagcaggauuauagaaguauaaccucaguaggaaauauaaccucacauacaaagaacaguuaaaggaccaacgcauacuuaguuuagaaaagagaaauuugggcaaacuuaauaguugcucucguccauaugucucuaaaggagaaacucaagcaauggaugaauagaaguuucagagcugaaaucuaacaguuugaauugucaaacaaagcgauuaccagccucaaaaauuagucacuaacaacacacuuucauguuaagguagcacuuuuaccucagaucuucugaugaucaguccagcauucucucugcuacaccacauugcucaaucgcuuuguuccuccuuaaucuuuuuuuuuuuuugaggaugcacaggaagcauuuaauaaauucaagaggaauucagccucacaaauuaugaaauauugggaaaucauucaucauguaaaaacuggauauaaaaagaaaucuuuccucuaggagauagccucuucaaaaaauaaaaaaaaauaaaaaccuacagccaagccaauaaaauggagcacauaucucagcagaacugcagacaauuaugcugauauuacuacuuuuaguugguguugugcugcacguugaaaucaguccaguaaagcaagaaaaaguauauauagagagauaacuaaugacugaaguggaaaaauaagagucauuauuuacagauuaugugauugccuauguggaaagggaaaagaaucauauuaaguacuuuggacugaaugauaacccccaaaauucauauguugaagcuccaaaucccagugugacuauaugugaaaauaggaucuuuaggaaguaucaugaaauuauguugagagauggcaggggagagagagagagagagagagagcgagaagagaggagcgaaagacagagagagagacagacugacugaccuauuuguuggucuccaucaugugaagacaugaggaagugggcauuuacauaccaggaagagagcucucaccagaagcugaccaugcuggcacucuggucucagacuuccagccuccagaaaugugagaauauaaauuucuguuuuuaaccuccuuuauuuaaaauuaaaugaauuuguaagccauuuggucugugguauuuuguuaugguggccugagcucauuaaggcagauuuugguacugagaagugagguauugcaauuaaaaacaaagaaacaaaaaaacuaaaaaugugaaacagcuuugaaacugacaaaugaguacaggcuggaaaaauucugaugugcaagcuggaaauaagguugguaagggugauucuggugaagugucacuggggaaugaggaacaugcuauugggaaaugaggaaaagacaacccuugauaugaaguggugaagaacuuggcugaacuguauucuagcauucuguggaagguagaacuugagagagauaaaauuggguauguaucacuaagaucugcaauuaaaguguuaaaggacacaggaaacuucauucuuccugacugcuuacaggaaaaugcaaaagaggagacuugaauugcaaaagaaauuguuaaggaaaaaggaaccagagcuuggagauuuggaaaauucucagccuauccauacugcaaaaauuagaaaacuugugcugaagagaauccugaaaguguggcugaacaaucaucugauaaauagaucaugagugagauucauggacuauaucagccaucuuaacagaaaugaggugaaagacuggauuauacuagaagagacacugccacuuagauugugccaccuaaaauauacaaggcagaacaggcaaggcugucacacuucuuagauuuuacaagaaggggacacagaaauaauuagcugugaaagugcacuggcaguuauggaugguuuaauuccugccaugcucugcaggauccgugggaauagaagagaccuuugaaggagcaucuuuuaacaauccaccucugggaccuacaucaucuuggcuucugguaaauuuugacaugaaugugccacacuggcagccacuaaccaacaggggcugggaccagucugcaugauuuaucucauacagaacuuguuaaugcuaugaucuuaggaaucuaaucaccaagguaaggcagccugaaguauugaccucaccauccaugacccuucuucacagaugcucagacuuaggcauccaugaagaaguuguauucagaaccuguaguuuuaauuuuagacccucaggauggcaucuaaggccaauccacgaccauuaaaccuccucaaggcauuuaggacaaaucugauaaucuuuggugucauugccaauaauuaaagauggcaaccgaugggcuaaaugguaacacucauacccuuacauucauaggguuucuccccagugugaauucuuucaugucuacuuaggcgugaggaaacagcaaaugcuuucccgcauucuuuacauacgaaagguuucccucugguaugaguuugcaggugaacauuaaggcaugaggaauacagaaaugcuuucccacauaucuugcauacaaaggucuuuucuccacuaugaguuuucaaauguuuacuaugacgggaagaaguaaugaagguauucccacauucaacacauucauaaggcuucucuccugugugaauucuuguauguugaauaaggcuuguggacguagugaaggcuuucccacauuccuuacacugauaggguuucuuuccacugcgauuucguauguguauagaagggcccgaguacugaaugaaggcuuggccacauuccuuacauucacaggguuguauuccagugugaguucuuacauguucaauaaguugaguugaucuagugaaggcuuucccgcaguauguacacuugcgcgguuuuauuccagugugaauuugaaugugaucauuaaggcaugaggaauuucuaaaggaccuuccacauucuuuacguucaaaggacuucucuccuuuaugauuuuucacauguauaaaguugagaaaaauuagugaaggauuucccaccuuucuuagucuuuuuagauuucuuuccuguaugaacuguuacacacugcuuuagaugugaggaaacugugauggcucucccaccuuccugaaauucacagaguuucucaccaguguggauucccaugugauuaucaaggcuuacaaaauacuuaaagccuuuuccacauuccuuacauuuguaggguugucuugcauugagaauuucaagaugcacagcaaagccuggaguuagaguguagacauuuccacauggguuaaauuuggaaaguuccuguccaauagaagcuuccuugugcacacugaggaugucuuuuccauaacaauuacccucagaaguguucccuccauucugagcucucaugugugucuuaaggcaaaacuguucacugaagaccuguccacaauucuuacagucacacaguucccauccacuguagccucuugucauuuguaucccauugaauauuugauucuucaaaaaacccugcugaagugaugaccguuugguucuagguuguauuucccauucugauaaccaauugccagguagucuaccaccauccuuucuaccuuugucuuuucuucaaaagggcagauugguucccuggaaaaaaacccacgggacaaaucaauggcugccauccucugaagcugauggugcgaugugccucaaugcucccuuccuugaugccaagaucgccucagggcagcuuaugaaucuagguggauagaggcaaucuccauuccucuucguacaggguuauuugcgguccacagcugggauggacuccacaaccacaaaggcgaaacugcacugaccaaguggagccagcacuggaaaagcuguuccuccuuaauuguauuucuaggaugcaguaucauuucagaaaaacuauaccauccaucacaguuugcacuuugauugucagacugaaacuucacaggaugaggaugugcuuuuguguuuuagagagacuuuaaaaauugggauuucuuugauugccauuuguucauauuuuuaagucacacuucagcaaacuggugacuuugugguuuguuauagguggaaaaugaauugacuuacuaugcucaugaugacagcgagaagcuucaugacaauuucaccaucuuugcgaauagcucagagcuuggaaaacagagucugccccaaacucuuuuugugacuguugaaucuguaaaugaugaagcuccauugguaacagccaauaacauccuucagguaagggcuacuucuuuugacuuaucagaagauccugagggcuaccaauuugauuuucauuuauauuauuucuaaugauaaauaguaagaccuaugacucuguguauauaguugacaaguucccacugguuuuaaauaaauauuacuuauuacucagguguucugcuggguacuguugggagaugagaaggaaucacaaugaguuaccuucacauuguguuucauaaguggcaccaccaugagggauggcuguuucaaggcaguugagggaggugcaugcaugugggcagcuccugccaggcuggcagcgucguaguuaagagaacagcucuguaguggauagguagaucuggggaugaguccuugcuccccuguauuagcuacaugaccuugggcaaguuacuuagccugcuaauuugcucucauaugaguggggggaaguggaggcagagcugugaggauuaaaugauaaaaugaugugaagcucucaugcagugcuugaugcaugguuaaggcuaaaugauagcucuuauuacugaaaaaaaauacuccaaggcccuaucaguuuuuggguaaaauaaggccacuacugagucaugggacaguauuucucugguuuugggagccucagucucccuuugcucucagaggaucccccagggcuaguucccaagugcucacaauaaguacuucuugguugugcagggugucugccauuuuacaccucuccugagcaggagcccugagguaauaacugcugcuguggcuucuguugcccacacagagaggaugaugugcuggaagccuccuaacauggauggcuccauuuccugcuacacuagcacuaccagcauugaagcuggcaaacccuuccaugccaauuuacacucaaguauccaaaaaccuccauuuaauagauuuucaugguuuucacguacccuuucuugcugucucuucuucuaagaaccugggcaugaauccauaugacuggcuuguaauuaauauaacaagugcucaaaaaauaaguauuugcuguaauuaugugccagguacuucucuaagggcuuaaaccagcugagauaugugcuaccauuugucucguuggacagaugagggaacugcaugacugcugagcaacagguuaaggauggaaggacagcauggaagccugauggcucauacaugccucuguccauggucuccagcagugccuaacacagaguaaacaggaaauauuuguugaaggaaugaaugaauggagauauaaaccaucaauucccccagcauuggcccauguuuucuagaccagguuucugucuuaacucucuuacuuuaguguggcuuuuuuucugggagaagccuuagccucucacacaaaugagccccuagugggcucauucgucaaguaugucaagacaugggaaucugaauguguucaacuugaaauuugguugagacgaauguucccacauauauauuucgcaauuucagccuuguuuguacugcucaugagggucaauaguuaauaauagauuauuuagaaggucagaguuagagguuguaugguuagaggugcagaaaagauggacaugagaaagauuccgugguuccaucuggcaauggugccuccccuugggugguggagagcuugaauaugugguggggcacuuuuguuaucacauugacuggaagaugcuacuguauuuagugccugagggccaagguuguguacuauuuucaaugugugggcuaauccuacaaaaugaagaaaugacccucccaauguguugauaguguccuguugagaaacacuccagacagggaacuugggaauuacaguacacaggccccaucaggcuugcucccugcuuguuugcaugaucuacaagcugagaaugguuuuuauagaugaacauuugcagucaaucaauuuaauuauaggaaacauuaacuuugaagcccauguaagcaaaauguuuucccucaaaaaagaauuccauucuucucaguagcaggcuucuauuacaaaaacaaauuacauccaauuauuauuauuauuauuuugagauggggucuuacccugucagacaggcuggagugcaguggcacgaucucagcuaacuguaaccuccaccuuucagacuuaagugauccucccacuucagccuccuaaguagcugggaccacaggcauacgccaccaugccuagcuaauuguuuauuaucacuuuuuauagagguggggucucccuauguuucccaggcuggucucgacuccugagcgcaagugauccuccugccccagccucccaaagugcuggaauuacaggcaugagccaccacaccuggcucaauuauuauuauuauuugaauuuuaucgguaaaaauuuugugaaaaaaacuuuuuucuuguuauguaaguacccauaaaauauccucuguuuugucucauggcccccaaaaccuaaacuuauguucugguuuuucauagaaaguauuugccaacccacauauauaccauggaauacuaugcagucauaaaaaagaaugaguuaauguccuuugcagggacauggaugaaacaggaagugauuauucucagaaaacuaacacaggaacagaaaaccaaacacugcauguucucacugauaagugggaguugaacaaugagaacacauggacacagggaggggaacaucacacacuggggacugucggggggagggagaucauuaggacaauaccuaaugcaugaggugcuuaaaaccuaguugacagguugauaggugcagcaaaccaccaugacacauguauaccuauguaacaaaccugcaugcucugcacauguaucccagaacuucaaguaaaaaaaaaaaaagaaaauauuugccaacccuugcuguagaccagcacuauccaguggaacuuuguguggugauaaaaugugguaucugugcuuccaauacaguagccaccagucacaugcagcuagaaaguaguugaaauaagacuaguaugauuaaggaauggaauuuuaaauuuuauauaauuuaaguaguuuacauuaaauuuaaauagucccaucuaccuaguggcuacuguauugaacaauaguauucuaaacaguaagggauggggcagauucugguaggcagaggcaagaaugugugcaaaacuacauuuacagggcagggagaaaaucagcccacuagaguagaagauccauguuucacagcauaggcuggaaaugaaggccuuggauucuaggaaaugauuuggaugauuuuguagccaugggagaacaugcagauauauucuaucuguguggaguggcugagggaacauagagcuuccaaagccacuuuagccucaugauguuuaaaaaagaaaagcauaauauuguuuucuucguuugagcaauuuucuccguuuccuucagacagccuuucauucuuucagugcgaucccagauugacuuuuaaaguacaucugcauuuauucuuccucccucuguuucugaaguucauuacugucauggcuaaagaauaagaaauccauguaagucucugacuggccauguggcuggauuuaguuuuggcaguguugccugauagccgugcauguaucagguuggugccaaaguaauugcgguuuuugucauugaaaauaauggcaaaaaccacaaucacuuuggcaccaacauaauagaucaacugaucuauaaugaacacaucuauguauuguguauucuauaguauauauacuauuuucauauguauuuauaaauguauaaugaguaugcauauacuaauauaauauaauauuuuuuauguauaaucccucaguuaaaaagaagaccaaauguuaucccuaaccuuguuuuacaggugaggaaacuagaacccagggaguacugugcagccuaaggugcuauaacugguugguuguagggucuccugacuucuauuuugagaaaucugugaccccgcuuucuuuacugugcuuuuuuuggggggcuauuguggaggauguuaaaaauggaccauuuuaauuaacaaaacaaugguuagggcuaguauuauucuaacccaauagaucucaaaaguuauuuucuaaguugcaaggaugaucuagaccaccaagcuacagauuggaacagcagaugcaccaucucugggugguggugauacagacaggaaaacagucuuuggugagagugguggccaaguaggugacagggagagacaggaugacagcagggagaauagcaaagaaauacgaagcaguaaaccuuugaucuuaauuuauaaagcacccuaaggucaauuaaaugauuggcaggcauagccaggagccccccagaggcuaauguaacuagugcacuuuacaugguuaaaaaucguaaggguuuuuauuuguucaaaacaauuggaucuagaaauaggcuuuuuagugcuuuuaguuaucuuagagcuugauucauuauucagucucuauauuuuaagugaaaaauuuauaguguuuauaccuuaagaacuugucacguuaucauuugacuccacaguuacuucuuagguaaucugggauggucuguuccagcuggucacaauuuaggcugccccacuguuuucagccacaucucccuaucccacagauucguguuguaguaaugccuccugaacccucccugcaaagugaucugggaaauagguuggcagcuacaaagaggaauuuuaggugucaauuguuauuaaauacaguuauagaaguuuacauuuauugugugcuuaccaaguaccgggccucuucuguaacuggugucauuuucacagcccucuaaggaaacuucuaugauucauaaccuuacuuauacuacaggaacaccgaggcauagagagguaacaaaggaggcguggacuugaugccaagucugucugaaccugacauuuugcccccacacucugccacuuuucccugcuccucccgacugacucaagcucuuucaaugcauccagguugucagagggugucuuuauuagcaagaaaaagaaaaguaccaaagcugcugugccucuuacuucuacugaaggggcuuuuaugggauagagcuguagcaguuguuaucagcauguauggauuuacccaggaaccucaguagaggguuugggcauuuggcuacaugguacagaauugcaggaugagagaaaugcacgagagggaauagggaggucgagauguagaaagauacuggagaagcgcuagaguugaccaacgaaggagaaaaccaaaggauaaauaguaaacucuuaggcucuuuaggaauugaagcuccauuuuggguucggcuuucaguuccuaaguaucaauuauaagaugcaccaucaacuuaauaucaacuuuaugauauuaaauauacuugucaaauuaggauguucagaaacguuaaaaugugagagggaaaacauguacccuagacuuugucucuguccuuccuuagaauuagggaaauacagucuccaucagacacugcagcguugcuucaguggucugcccagacugucucucuccaaccuugauauaaggguguuuucugucaaggaaaaaaggaagacuaauuguggccggaggacuguuuccuuuauucuuaccuuauucccuggauagucuggauccaguucaggaagugcacgacuccccaguuuugaaggaugugucauucaauacuggcucuuucugaguuuauuuguuuauuuaucagauaagaaacuuguuccuugccuugaagguuuuggauuaaaauuaggagaaugaaguuuaagguuuguaaacugcucaugugaacuucagcaaaaucucucugggcauuacucuccuuaauagcaaaaccccagggagggggcguuguuuuacuuggugaucucucaacccucccaguucuaaugcccugugauucuauggcuguaaagcuugucgauauucucugguugaagcuggacuuagacagauggagaagcaguagagcugccauuuuacauuggauggacucacuuuagucuagacuagguggagguuuuacauuucagaugaaccauuucucuucucuuugagaaacguacaaauaguuuugguuuuaaagucagugugucuaaagucucaaggugacuagguacuauugugggacaugcuaacuagucauguaaagauguaggagaaguuuugggaggacuuucuugauuuuuuuuuaaaugaaagaaaucccaauaauugguuucuugaauucuaaguaauggucauggcgugcuguucaaugaaagucuucccaaagacuuuuagcuuauuugcuauauaaguuuagcuuguuugcuaaauaaguuuuagcuuauuugccaaauaauuuuuuauuuguuuaaauuaugacuauuguggauaaugccuuuuggaauuuuguugauuucuagucauaugauacagaauuuaguuagagggcuucccguuaaguguggauguauuaccuccucugggaagguagccugguuagacuauggcuccccaagccucuagaugugaugcucucaaaagaggccuucucuaaccaccccagaagaaauagcaccaucccauccuuuauccccggacucuuauuuauuauauuuuuuagugcccaccacccucugauauuaaacaaauaaacaaaucuauuuugugucuccucccauaaauguaagcuccauuuggaaggaguuuuaucugucuuuucccugugguguccucagugccuggcaugguaucuggcacauuauggaggcucaacaaauacugagugccuaaugccuucauggaguuuauguucgguagggaagacaauacaauuauuuuauaaauggaaugagaucugcucuacucuucaguaaagcaguugaggagauagagaaugauugugauuaaagaauaccgaugcuacagagacggugguccgggaaggucuguucaagguggugauauuugcauggaggcuuguguguggguggcuccgaagaucucccccacugauuugcaaggacucauaggauuuagcauacucauggcuaagauuuauuacaguaaaaaaugugaagcaaaaucagcaaagggaaccagcacauggggugaaguccagaggaaacugggucaagcuccaagaguccuuuuccaggaaagucaccuaggaugcacuuaaugccuccagcaacgaguugucaugacacaugcaaaguguugauacaagggaagcucaugagauacugagugcccaggauuuuuacugggagccagucagguagacacccucugcuuaguauguacccaaaucccuggcccccagaaggaagcagguguccagcauaaaucacauuauuuauacaagcaauuuagacacagcaagccucccuuauaauuuaggggaaguuuuauauuagcaugggaaacuguuuaauagccgaguucccagauaccagugcagugccaaccuucugagcagggcuuucucaggacaggcaaccuucagccugugaggugaacucuuuucugaguaaaggugggaagcugggggagggugauuagacugggaagugaggagccauaggcauguuagagggaagagcacucgaggcagaagaaugauuaagggcaaagacagugagucuggagcguguuugacgacauggaaagcucaugugacuggagcagauggagggaggaggagagugaauagauaucucuccauggugagaguugauuucugggcauaaggaccccccagcgccagacaguuuuguuccacaggccuuucagagauaaugacagggaagcaggccagcacuuauugacccccugcuaagacucaggcucaguucuaaaaguaucacauaaaugauuaaaugauuucucguuuaauucucucaaugacucuugaaauaaaaugaagacugcaacagacuuggggcacagaaagguuaaguuacuugaccaaagucauaugguuagaagagcgggcgggucuuguggccaggaugucuuugcccagagcccccacuugcaaccuguggcgugggcugugaaauuaauugagucagaaccaauuuuuuaaaaaauuaaauagaauggguaguaucagaauguguuguguauaaugaggguaaauauuguuuuuugugaaaauuuugcuucauauauauagaguuuuaaacacacacacauaagaauauauauaugcauacuagguugcuuugaaaaauguauucuuuaguuuugguauuaaugaaaaaacauuguaagcuacugaccuagcaaagcuagauucuuuuguagauaugaaucacacauuuuuucaucacuccaccuguuucugggauaaucugggauaauaauguuuaugggauugagucaagucccagaaguucaucuacuagaacuucuauccaccaggacacuagaaacugguacuauagaguagugcuagaguugacacagccuauaacaagccccaagucccgcuuuaucaggauacauuaccacacguaagagggcucuguguucuagguggggagucagguuuguugcccucagcuuugaagucuccuugugacuccucaaggucccagcccugccugcugguuaacccugacugcccuugacccugcgccucugccuuguucguuucagcaggaaaggagguugggauggaaguaccagccacacugucugcaaaccugacugauccacuuuauauacugcuguuguggcccaaaguuaugaaggaagaaaaauaacacauuaugaaauuuuaaauauuccaagaaaaagggauguagauuaggguguauaaucacaguguugcuuuccuugugucuacaguauaaugugaaugaaauugcugucaggauuuuagaaugaugaagucuugugcacugaaauuuuaugauuuaaucacaauggcuauuaacaaugucaacauaauuuagacuugaugaaaaagagccaagaggcauccaggaauuggccuugcugauuuugauagccuguguaggcaauuuaugacauuuaagacauccuuuuauuauuauuauuauuauuauuauuauuauacuuuaaguuuuaggguacaugugcacaaugugcagguuaguuacauauguauacaugugccaugcuggugcgcugcacccacuaacucgucaucuagcauuagguauaucucccaaugcuaucccuccccccuacccccacuccacaacaguccccagagugugauguuccccuuccuuuguccauguguucucacuguucaauucccaccuaugagugagaauaugcgguguuugguuuuuuguucuugcgauaguuuacugagaaugaugauuuccaauuucauccaugucccuacaaaggacaugaacucaucauuuuuuauggcugcaugguaucccaugguguauaugugccacauuuucuuaauccagucuaucauuguuggacauuuggguugguuccaagucuuugcuauugugaauagugccgcaauaaacauacgugcgcaugugucuuuauagcagcaagauuuauaguccuuuggauauauacccaguaaugggauggcugggucaaaugguauuucuaguucuagauccuugaggaaugcucaccaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggcgauuccuuaaaacauccuuuuaauaucugccccucauuuuuuauuggagugugguaucucuuuuauccacuagaauguguaauaacaauggcaaaugagcauagaaacuuucuggaaagacuguguguauugaucaauugcagaguguucucauaaauugauaaccuuuaacauuauuaaauaauuuucacacaucagguguguuuacuuuuuugugaaagcuaauagauauagcauaugcauuuuaucaacauaguagagccacgagaaugcaguuuucaauaacauaguuucuccaaagcuaugguuaccaguuacuucuuuccaggcaaaguuuuaaacuuaggagauuauuucagaugaugauguuucuuauuucuauauuucagagcauaucaaacaguaauaauaacaaccauuuacaugguccauuacaugguccuaaugauaguuauuacuuacauaguacuuacagugccuggcauuguucuaugcgcuuuacauuuacccagugaaucuucaacaacucucugggauaugauuuuuauuuuaaagaugagaaaucugcaaugcagagaggcuuugacacuucuccaagguccaaagcagaagggcugcugguggacagcaaguggcagagcuagaaugcgaguuugaguuuggcaccacaguguucucucacuucuuccuucauaguuagcgaagaagcucaaggaccuggugaagcagauaaagagaguauugcucuuauuccaauuuuaagaagguggaauuaaagaucaagagguuaagcgauuugcccaaaauaacaaaguuaguggcagagucuggggcaaaggcaguuaugcaaaugcaaaugugauaaagucuucagauucagugcuguuucugacuuuucaaacagcauguucucaagacauucggauuauccugcaugaugacucacucucccuacuugucaucugggccuggaggagguggcaagaaagucugucugcagccuaagugggagaagaaggugggagcgugggggauagaguugcugauaacaucucagacucuggagggaguucauagccagcaaucagaauguuaaccucugugucccaccauuuaaaacacacuucuuucuccugacaaauuaaaacauuuccuuaagccacaguucuuucagcugaucuccaaggucauucaaugguacaagagaucauuugugucccaacaaacuggaauugggaauuggaguuaggccaucuugggugaauccuuugcauuuuacuuugaaauauauucuacugaguauuuuuguauucaaauaugaucagugaauuuugugcauaucugauaaaacauauuuuuguccacaagggggcuucauuuuccuauuuuucaaguuccucuuucaguaauacuauacauuuuguuuuguuguuuuuauacugaaaauagaaccauuugcuugcuuuugagaaauacuugucaucacuaaaaggagcuuugagagcuggucacaguagaagaauuaaggcagcaaaguuugaaaugccaauugaagcucucgggggaccaacagugggagagugaauucaugagcauuucacaucccucguaugaaacgcaacaaaggucuaggcuuuguuguuuuuguuuguuuguuuguuuguuuguuuuugagacgaagucuugcucugucacccaggcugaagugcaguggcacgaucucggcucacugcaaccucugccuccaaaggucugggcuuuuaaauauuaaguuuacaacuaggauuaaaugggaucacaauuagguuucuaaauaccacuaaacucuucuuaaagcuaaaggucaauuuaaaaauuauuauuccagguuuguguuauuuucugauauuuaugcuuugaacuauucuuuuuugggcuuuggaucacuuuaaaaucugaauucaaauugggggucuuuguuuuccuucuccucaucugccugaaguuuccauuaccaagcacugggcacuaaaucaggccuuaccugaagcaauggggucguuaauugaacuaaauuugguuugaguggaaaugagaccugaggcuacuagaucuuguuuugaguggcagguuuuccauuuguuuuggaagaugguauauuucagaggcgagagggagggaaagcaguguuccauagcagaguagcugcaguggaaaacaugcuuuguccagccuugguguguauggccuuggaaaaaaugauuguuucuacaagucacgagaagagaaauggcagcacauuuccaagucagcuggagcucuagaagaaaugaggaugagauauguggauggauuaaaaaauguaaaaagugaaaaaccagaaugagugggcuuggaauuuuguuaaacaguccaacuugcgcauuuuauuauagccuuucuguggguuuaaaugaaggccaaaaccuuauuauuugaacguuguauugauucgcauuucugguagcuauuuaaaagcugauguccuuagagcuuagugcugcaaaaucuucaguaggcauauucaaauggcaagauauaggcauguccaucaacaacacaauuauuaaacagauaaacuauucaccccaaguuaugaaagaaugcuggaagauuaaacaaaaucugcaguacauguuauagaauagccucaauaauggcaauaaucacacucuaagugacuuuuuggaaauacuaaaaagucacaucuguccucaaagccaaaucugaugaagaagaugggucauauaaagcuaauauuuauugaaugcuuacuaugugccugaugaaacaguucuaaacacuuuucauauauuaagucacucagucugugcaacagcucuaucauuucuaguuuacugaugaggaaauuaaggcagagagagguuaagaaaugugcccaagguuauauagcuaguaagcaacaaagcagugacccaaacccaggugguuuaacuggacagaaacuaaaucaagcauucuugaacaaccugaaaauauuuaaaagaauuucaaguagugcuauuguuauuggcacauguuauuuuucaacauaacuacuuugaggaguuaaacauugguuuggcaguguaaguucgugugugugugcaugcgcauguguauauauguggaguauguggguauuuauuuauguauaauuacuuuauggucucaucuguuaacuuuuaagaaauuaaaggauaauucacaaaguaguuuuuuuuccuguguuaucaguaguugguguauuagaaggaagcagaauggauuaucuuccagccccauuaugccugacaugaaaacauaggaaucuuauauacuuucugaguuuccugucucaaguucuguuuaguuauuagaugaugccauccaucaucuaauuggaguaaguuauuucacaaacugcucuuucuacugagggaaaugguucucuuuaacuggagagaucaucuauuaagucauuuaggacugaauuuuuaaacaaguuaugaaaaagcguagaagaugauaaaguucuuaugcauggguaugugcacaugguguuucuguggguaagaaaaauacauauaaauacaaauacagauauaaaugugaaauuugaguuagugacaaaacuacuugucuuuaguguuagugaaguauccuguggcugcaugauuagagaaacucaaaacagccaaauuccaucaaaugugauucaguguccauauaaacauuuuaaacccauguucaaaacugaacuccugaucuuacuccccaaaucuacucuacauucagcuuuccuuaucucaacugaugguaacccuguccucguuucugaggcccaaaccauagagucauucucaccgccuuuccuucuuucacaccucgccaaauugaaauagccagaagcucggcugguuuugucuucaacagacacccagaauuuggccacuucccaccaccucugcaacuucuggggccacucucuucugucauccuucucuggaauuauuguagucaccuccuaacuggucucucugccucuaccuuguaccucccagagucuauuccugauacagaagccaaaggauucugugaaaacaugagucugaccaggucacuccucaccuaaaacucugcaaugauccaucauugcacucaaggaagaaccagaguuuuuacaguagcguucaagaccccgaacaauaugacaaccuucauuauguuucaacucaucuccuuuuacucuucaucuugcuuauucugcuccuuccaacugaccgauuuccuagucucccaacagaugaggccugccuuugggcuguuuccucugccuguaugguccuccccuagauauuuacauauucacuggcucccucuucaccuccuuccagucuuuccucaaacugaaccucauacuuaacauuugcucacuccugaggccccccuuaucuugcuuuauuuuuucuuuuuuuucauagugcugugacuuuuuuuugacacauuguuuaauucauuucuuuauuaugccauuguuucuucucugugucccuuugucccuuccugcuggaauggaggcuccugagaacaggacucuuuuuuugguuacggauguauagcaaacacccagaacauugucuggaagauaguaaaugcucaauaaaugcuugaugaaucguuaaauuaagauguuuaggcaauguaaauagauuuuaaauguaauuggaaaauaggaacuaguacucagauacaauuguagaugugugcuaucagcacagcaaacauugcaaggccauaagaacaagauauuuguguucuugcaagacagguaggacaaauaggauagaaaaauaugcaguguguguguguuuuuuuucccucaaccauuuaaaagcuagugaaauaauuugcgucuuacagcaaugaauggaaauccuuaaaucaauccuaugagauagguucugaauuaucugagaccccauguagaguauccagcaugugccaugcacacaaaaggugcuuagucaucaucaauuuuugguguuuuucuacauuauacaaauguacaugcacuucacauaaugaaauuggauuaauuaugaauccuauuucuuuauugaaaccucauaaaccucauaaauuaacuaaacacuacuucaggcuuuguauuucaccugacauuuaauuauacaucuguuucaaaugaagaaacuucaugcuuuaaaaacucuggugaauugcuuuggauuuuaaaucuuuguccaaggagacaggacgucauugcuauccaguuuacuaaugugaugugauugacauugguccucaaaagaucugugauucucuucuuuuuaagguguugaugaauucuuucacugagaugaccaguggugaccucugugcagaagauggggacuccucuccacaggaccuggccuacugggucacuacacccagcaaugggcauuuggcucuuaaguccuuucccagccaaagcauucagaacuucucccaggcacaaaucaaugagggccagcuaguuuuuguacaugcugcuauguuauagagaaaaacaaugugaaacuaaaaugcacuuuaaucagugguuaaugugauggucauaugacugaaaacuacaggccauguagaaacuuuccaggcacuggacucuuuaaaaaagugacauguuuuaguaaggcuaaugauagcaaauauuagcauuccuauaacucucauuuuacuuacucaaauugucaaauuuaaguaaguaaugugcucaaauauaagcuucucugagagccuuuuccugaacaccacuaaaauagcaucccuucucugccacuuuccaucccuuucccagaauaccugaccuuauaguauagauugaauuggauauuuguuuguugucugucuuucccuauagauuauaagggcagaaucuuuguuuuguucauuguuguauccuuagcaccuagcagugcuuaauaaaacauaguaggugcuuaauaaaaauuuguugaaagaaugaaauaauauugaacaccuauuauguauccaguuauauguuccagauguuaggaauacauuaguaaacaaaacaaagagauauuuguucaaugaaugaaugugugaaugaaugaauuaauuaauauaacuuuaauuuuaagagauccugacuuugaaaggccuugucuucuuccuccuguucaucaauaaaucaauaggccaaaugacugcuguaaaucugcugaaggugacccagccacucugcaaggguuuguucuccccugucagaggagaagcaggccauuccagucugcagcaggaaugggagggagcaugagcuaggagggcuggaugagaaaguuaaaaaagcucuguuuucaguuauuucaaauuaucuucuuugaaaauacagcaaagaaaauaaagguaaaauauccucuaaauccaaaugaaguaauuuccugacuaccuucacaguuaaugcaaaggauccccaaagaaucggaaaauaauuuacuaugcgaaugcucucaccuaguaguuccaaaccuguagccuggauucguggagguuagcuucauugccacaagguccuaaaucuaccuacauauguaccaaagcauaguuucuagacugaaugguauuuuccacauacauguuucuguuuuucaaaugugugaagaugugcugauuaaauacaauacaguucaucugaagaggcacugaauugauaggaaguuucugccaauuauguauuguuaguauuauauaaguauuguuaggugagggccuagaaaguuuuucauuuuuaugaaaggauuaucauauuuucaaaauggagaugacugcucuagagacuugcacaaaagaaguuuugguuuucuaaaacugugaaauccacaauagaaaggaaucauugacucacuaccaccugucaggcaccacaggagaugcaguucugccauccaugucuuuucaucaucugaaguccucugggccauaggaaggaaugacuccauuuucgagauaaacugaggcaggcggaucaugaggucaggagaucgagaccauccuggccaacaugguaaaaccccaucuguacuaaaauacaaaaaaaaaaaaaaaaaaaaauuagccaggcgugguggcggucgccuauagucccagcuacucaggaggcugaggcaggggaaucgcuugaacccgggaggcaaagguugcagugagccgagauugcgccacugcacucuagccuagugagagagcaagacucugucucaaaaaaaaaaaaaaaaaaaaaagaaaagcugaggcucagaaagauuaaguuugucagaccuuaaagcugggcuuucuccacuagcugccacccauugaagggcaaaguagguagaagaacugaaguuacuauuuucaaugaaggguugaaacaaaaauuagcuugcuggauugauuuauuuguccacuaccaggucaauauuugcuuuuggugaguagagaaaauaauuucuccuagaaaaguagcaaagagaguuaaaggcaagcuaaacgugagagccaauccauuacauuuucuaaauggauauggaggcaacuaauaacccucaaaguggcugcagcccagcugcagaugaggcuguugcugaaaccagcugguucuccccuggugcaucuguccaucaucagccacaaacaaagacuugggcuuaaguagucucucuuagccuuucauauuugcaaagugcuccaccauuaauugaauucauuauuccacauaacaaccuaaguagguugauaaaaccaagaugugggaggcuaagugauuuacauaaggucacccuucuggaaggucuaucaggaaaaaucugagauuguacaguagaaaaugcacaggucaacccugcuguuuguguuucccucuuuaucuuuauuuggucauagucuguuagagcacacccaguacaaaauucuauauucguuuugaugucauucuuuugauuccaucuccauuuuguuuccggauuaaugaagaguucaaagugucuaauggcagaaaauguucccuccuuaauugcguguuucauuaaauacaacuuucaaagugcuauuucuaguaaaacaagcaaaugaaaaagaacauuugguuuuggaccccuguuaugaaucagacucagacuucucucucucucucuuuuuaaaauggugacuuuugaguauauugggaauuuuuuuuaacagucuguaaccuuuugugugugugugugugaggaaucagaacucucaggguuugcuuagauaacaaggaccugagagcuuguuaugcuauugaccuaccuuuuauuaaaucauguuucuagggaguacuuguacagaauugcagagucugacuaugucuccuuuguucccugccacguggucccugaggguaacaaagauacauuucuacccauuccaugaugcaaggaccugugggccuccaaauguacugcuggguggacguuuucaggggaugauguggauaugaacguuaggcugucugcauaggaaucuugccuggugcuuugugagucagauugguaaagcauuccugggaacuggaucgauaagcggauccaucucaauuucagcuuugcacauaaguuaauuuauaacuuuacugauaucacuaaucccuugauaggagcgugggaguagaauucucuucuuguagaaauuucacaaaagcagggcugggucuuucccuuuuucucuuuccccucuuagcagaguauagcuagcuugagauagugaaauaauuagaagugcagguaauuauugugugucuuuauaguguuuuauauuguuuaucuauugcacuggguugcuauaaggauuuaaaugagaguauauauaaaagcaaauuuugguccuucccauuuggcagauaaaaaacauggaguuagcaaggugugguggugugugucuauagucccagguacuugggaggcugaggcaggaggaucacuugagcccaggaguuugaggcugcagugagcuaugauggugucacugcacuccagccuggauggcagagagagacuuugucacuaaaaaauaaaaaaauaaaaaaaaaaaaauuaaauuaaauuaaauuaaauaaaaaccauggaggcuugggaaggcucaaggucauguaacuaauagggauccuaaagcucaugacugagugcaaacuccgacuccaaaucccauucuugcauggggccgcuccucugcuguaugucugggcuggugucccagggcugucucugcuguagaauguugguuuccugagaaugcggccgucaugguagcuguuuauuuuaucuccuucucgauauuacugaagaauuuugacaugcacaaccaggaaaauauguauagcaauuuaauaagcagcgauuauguagaaauucuguguuuuacucuccuucguuagggaaauauugcaaccuggcauuagucaacaaauuuuuuuugacucacauuuauccccuacuagucagacuuccucuaccagcuuguccaacuuuggcuauuucucuuuugcuuccuucuugcacccagccuuaaaaaguggcccuagcuugagacucacagaauuugcaugguaagccaaaauaauuacuauaauacuuaguauggugaauguuuugagguuaaccgugacuucuaugcccugacaaauuugaaaauuaucugucaaguugcuuauuuuaaaguagaaggauuauaguucuaaaugaacauuuuuuuaugaacuaagaaaaaaauuuacccgaaguguauuuucguuuuguuauauuuuauacguauauaaauugaaacacauucuauuucuuccuguaaacuuuacuccccagaaaggaguuuuauaaccaguuuuucaccuugaaugcugccauugauuuuguuuguuuaucuuugguggugguguguuggaauauacuguggcuuuaggaccuaguuuuucuacuuauccaaauuguacuuggcuuuuuuaaaaaaaaguacuggggagggauugaccuugagaguuuuguuuagaauggucuagaauacaggcuuacauagacccagaguuaagcagcccuucaggcaagggucuuccuggaaaagucugugacuucaaucucuggucaugagauagaaggagcuacaucucaccaccagcugucugucguccauggcaagaacugaaggagaaaagaaaggagagggacucacaguguguuacuaaaggguuuagagcagggauuuguaaaccuuuuagucaguggcucuugaaacacugaauuguauauuguaagauuuagugggagguaaccaagaacuaugagaaaagauugucaauccucaaggaaguaauuaaaggccuauuaauuggugaaaugagagcucuacacucaggaguacacuaaccauguaaaacauauaguaaguguccagugagugguacagaauggguaagcugcaggaauucggaggagggaaauuuccccuagacugcaagggucaaagggagcuuguuggccaagacaagccucgagcugccccuucagaaugaacagcauuuugguggguggugucgaggaggggagggcacuccagggacgacagcaagacuaugaagugaagacccagggaaggaaggauagguuuggaagguggggaggagaauaagucagauuucuugaaugguuaaucacauuguuuccugacucagauaucauuucccccauugaguucuaaguagaagaguauagaugagauagcgucaacuuaaaaauaaauacucacuucugagucagcgagacuuacacuugacccucaaggaauuugcuuaacugugcuaagccuuaucaucccuucuuagugaugaggaaacaaaugcauacuucuuaggguuaugauaucuaaaagagaggguagggcugugucuuguuagaucucugcuucucauuguagggccuuucacauauuagguaccugauaguguuuacugaagaaauaucuaaggcuuccaagccuagugcccaugaaaaccuggcuaugguuuuucuugaaacaaacaugcugggauacaaggauuuugagaaauccuguguuuauaaggagaauaaaacagauuucuuuacuccaugacuucucagagacuucagaauauagauuugcuuuuucaaaucuccauaaagggcauacagagugaagucuugccaaacagaugugguuucagagccucuuaugaccauacccuuuauuaggcaguuauucuauggauauagauuuagguaggaccuuagagaaauuauuuccaaauuaaaugccuggagcucacugaugaaaauaugaacugcuuggaugaaaugcagugggcaggagggaaaugaugcuugucuuucagagaguugggcugggucauaagagaggcuugucaggcaauugcaaccaggggugagcacuagcuuacugaacauguucagagugacugcugaguaggaauuaaaccuagauacccuucuggcuuagguagcuggagaagagguugaagauugagguauuauggcugagaaaaaagcacucuuggccugggacaacucugguggcuccucuacuccaaaaggcugagauaaaugaaauaauauguauuuuaaaaagaguccuaccugccaaaggcaacucuggacaugauggaacaagugaauuauaaaucagugcccuuuauaagaaaaaaggcacaguggggaaagguuucuaagaaaaacugaagauggacaaguuggauguugggguggccagagaccacacacauuagagacauaauccaucugauaggaaggggcauucuacuuugacaggugacaaaggaagguccccaguauggcuuuauuagcauagacugagggcacagaaacacugcucuuagucucgcuggagugaccucugauucuagccucccagcuccagaagccagagguuggcaaugacugcaaaaaaugucagcagcaagaagugaaaggaaugcggguggcaguuaccagcaucauaugagcauguuguguaauaaacaaacgugugccaagacaguccugaacuuggcgcggagcuguguuccugggcugacuugcccaggcacucuuaccuucacccccaaggagacccaggaccgaguguccaucccaaaguucucagacacuauaaauggagccuccaaauugaaggcuuaggacaauccuugcaaguuuggaaaucuugcagauacaaugcuggugucuccuuggacuuagccagugccuaguguaguuugaguacuaugguugauggcccuugcucucuaagacuacaauggcugagcaaggaaagcaaaacaggaugucauucaggaagcuuaguuauuguuagauaguuaacucaacuucauaaacaauuuauaaagugccuuuucagagggcuauccugcgaaggccuaaugcuaaaaccuuuagcaaaggcucaaacaaacgagaugagagaagauucugggcuggaagaaccacgugagucaauuucagaccugccauccuguaagguuagagauguuccccaaaucauugcaaaguaaagggauauguacuccaacucugugcuccucuaaaugugguccacgggccuuccagucugugaaccaauaagaaccgaaagcaacaggaaguguuuagaaauuuguauagcaaguugauguugcuguaacauuuuuauuguauuuuauaaaauuauuuguccauggugaauuagguaacacugauccuuuaccacagagcauuugaacguucccaagccucucuggcucuaacuugaguguccccaagucucucuggccuuugguuacuaaugaggucacagcacacaaagccaugugucacugguucuuccccccauggcauucacaugugcccuucccuccccacaauguccaugcauuugucaggguccccaggagaugucucacguuuguucaagagccaccgucugccccuagauaucagcagaugggcacuccauugagcaccuacagcugccaucaggccaggaccccucuacccauccuccaaggggagagugcuaucuccuguguucucggcacuacacaguuugcuuucccuuucauguacugggagcugagccuggggccacauagccaggcauugccuucuuucucuagggaucagacaccuaggccugggcuggggguaauaagccuguuucaucuggggcccuaguagcaaauuauguccacagauagaugccucagggaucacuagaaucuuauagcccaguuucaaguuagagcuagccagugcccccuauuacaaccaaguuauaaccaaguguuuuccagagaguuuucagggaucuauacagauuauuuuguuaacuggcagcuuuucugugcuuuauacucauauacauguuuuaaucuucacuuagguucugugaagccccuuucaucucaugaccugaaagcugugaccaaugauguggacagugcgggaaacagaacuauaacuuuuccagugguaaguuccccuagacucaggagguuggugagacugaacucugacagcagcacagaggaaguuucuguuuuuacccaauaucuggugaguccugacgucugugcugcugagccgggcugagcaucucugcgaggcgggccucucauuugucugcauccuguuaaaccaagcaggugugacccuuugcccaggcaauuacucauuucagcugugcagguuuuaaaacuggacaaucuguagggagcauacaagacauaaugguuagaaaacaccgagaaaauuuaaacuguguauuuaauaaauaaaaagggaucccuuuaucacugaagagugacuuaaaauccaaagcauaguugcaggaauaaguccugcaggauauaaguguuugcguuuauauuuaauauguaauaucauauacauuauuuaauauauuauaagugugucuuuauaaauauguguguguauaaucuguacuugaagccauuuguuuuaaacuucacuggugcuuaccacuacuaccaccacauacuuucuuauuuaacuggcuaagccuucaaacuuuuuuuuuuuuugcauucuagccaggaaucugacugaccagacauguuuacuuacaugugauuuuauuuucuaaaaaucuauguuuccaaauagucuucuugaauacaacucuuucacuuguuugccauucaacuuucuuuuuccauucugaaacaguauauacaugcaucugagagcugauuuggcuauagcuuuacacaacuaaggaauaaaaaaauccaaaguuaagcuuagaggaaauagcaaguguaaaccauaugucugccauuaaccuuugagccauuucucuccaguaugauguggcaaaguugaauguggcuuuugcuuugcaauugccuuugucugggaugcauuuaagagaacuggucaugacuaguuaaagcucugaaugugaugccgaaaagggagguaugaauucucuagcucacagaugcacccagaagaggaaaaaaaggauuagaauuaaaacuccauuguucgggggagcugaaauguucccaaggacaucaaaacauguccagggucaguuugcauuuagaauacugacaaaauuucuauauacagucauauaaagauuucuuuauacagucauauaaagaagcuuuggcuguagcccuaguuuuuuuuuaauugaauacaaucauugcaagcauuauuuucaaauacuuuugcaaauauaugauauuuuagaucaauaugauccaaacaguggacacaguagccaggauccucuagauuaugcugcagugacaaacaaaucucagcagccuacaauaacaaaaauguaucucgcuuaugucauccauucgugugggcuggcuacgggucugcucuacaugucauccuuauuccagcaucugaguugaaggagcagcccuucucuugggcauugcuguccuugcagcaggggggaaaaagugaugguggaaccagagcaggcgacguguuauauuaagguucagggccacacaggggugucuaggaugaaaggcucuugauugcugguccauauggagaugggagaaggcuucugucuagaagcacaaccugggaaguccgaugagugaaggguggagagagaguuuugcucuccuuccugaauagacugagcgucuggcuuuucucaccacacacccuuuccucucccacauguacaccugccacaccagggaccugguccagugcuuacacucaaaggacagaugagagauuguuuuaucauguacaacauuagaauguuuauaaggcuuuuuauacaaggcacacacuccuggguaugacaauuucuuucuccugaaaggaacaucuaagauaaauuuacagucuauagaaauucagcacaguaacccacacuuucuacaccuuuagugugugaugggcagagagagcuuauaauuuaggaaucaggcacccuguugcugcucuuugaucuacugcugacuacuuacugacugagcacaaguuccuuggccucuaaagucagaaggucuggauuaguucugugacuuagggcaaauuacccaugcuuuaaaccuuaguuuccucaucuguaaaaugggaaaaauaauagcaauaauaguugacagcauuuugaacauuaaccauguaccaagcacuguucuaagccuucuauuauauuacuauuaucuccacuuacagacuuagauccuaaagcacaggaagguuaaacaacuuguccacaggugcucagguuauaaguagcagagcuaggauuugaacccagggccccugacucuaggucauacuccugucaacuaagccaugacuuccuucuaguguuuaaauguggaauaagacagauaauagauguauagauaacaaaugcuugacacauuuccccacauauagcaaacacuaaauaaaugguagcuaaggcuuauguuauuaucuuuucauucuuggaaaugugagaaauuccuuuccucuccuaauagcugaaagucgaguuucacaggcgaaggcaauuuucuaggacacugugcuuacccuaaugugcuacaguaauuuaaugaauggaaaugaggccguuagaggacagugacuuuugcuucaccuaauaacccacuuacuguuccccuuuggguagagccccugguguucuccaauacauuucccugagugaugaugagaggggaaggcugagaaaaauguaauggggucucaugugggaaucgaacacuucauuuucuggcauagcaaaggcuggaggaggaaugaagccuggggcugggggagcuccaagaaccucaucccagugggucagagcagcugagagugcuuuagcuaaauuaagguguuuuuacaaaagauguuugguuaaauuucugugaaugucauugaaauacugucuccccuuccacuuuaauagucauaaagaacaucaauaauguggggaggagagggggugugcagagagaauucuguaaggauauaaaccaaaaugcuaacucuggcucuuucaggggaguaaguuaucuuaauguuucuguguguguguguguguuaguuucugaguauaaaaauaauacaugucuauuaugaaaauaagauaagaaaacauuaaaacauuaaauuuauguugacaaagcacagaacaucacccauaaguacaguacaaugguuguuaaucugaaggcauuccaauucugguuagcuuguguguucaaaaaugcacguauuuauuugugacuugggaagaguaaaaacuuacuauuaaucuuccuggcuuucccuuuuccagauccugccuccuuuuucucaugcgaauagaaugugaaucuuuuccuaaaguuuacaguuuuauggccucugucaaauaagacccuggucaacucucaguuguuuuaugauggcucauauuuauuauccagcaccuccagaacauuuugggaaggaaaagaaaccugcagacagguuauggaguuggugaagaugaucaaaacauuuuaucugaaaugcuuaaugaagacacuuauuaacacauauuauaacuaguccucuucaaucucguugaugaaaaaaaaauaauacccaggaaacaauuucaauuguaaaagaaguucagaacuauuuaguugaguauaaaugaucaaauggauuugauuacuauuuggcuuccuugauaaguuuuucuaauuucaagagucaauucaagccaauaaccuacuaaguugggagaguguuuuaggcaguugaugguugagugagcuuucacaccuuuaacugaaagcgcuaaauguucccagcccucuaccgcccuucacugggggaggcaaaaccaccauaucguuugcaaauaaaacucacgcuuggccaagcacggcagcucaggcuuguaauuccaauacuuugggaggcugagacaggaggauugcuugaagccaggcguuugagaccagccuagccaacgcaguaagaccucucuccacuuccgccccccagucuccaugaaacauuuuuuaaaaacccaauuagcugggugugguggggcaugucuguagucccagcuacucgggaggcagaggcgggaggauuguuugagcccggguguucuagguuacaguaagcuaugaucaugccacugugcuccagcccgggcgauauauggguggauacagcuucugaaagaaaccuccacucucuauuauacuuaagaucauacuuuggcaaaauaauugugaggaaaauacuuguuauggcauaguccaaaaauacuuucuuaucccagaauaaauuuacuauuuuucuaaaccauaccaugucagccuacccaagauaagcaagcaacaucuuuguccuucaccauaaauuauaucugccuaaaugggaaaagcuaaaccacaaaaacuuuugcucaaaaucuuguguccugaagaauuaagcaugugaguacacagagaagguaaaucaucggauuuuaaaauuaaauaaaaacuuuuaacaaauuuagaaaaauuauuguucauuucaaagaauguauaaacaaaauaaaaauuaaauucuauaaggcacugauuucuuccaaguacagcaugaagcuaauugaaugauuuuaauuccagugcuuguugaaauaauuuagacucauuaaaaagcaaaguguuccaguuugagauuuauggugccuggcccuuuugcuuuuccauaaagccaguaauugcauuucagccauuguacuguugugggugggagaucaacugucuuugucucugcuugcugcugcaauauggacacagguguccagggccacauuuagaaaaugauacaaucaauucuggguuaugacuuuugucuaauuaccuauucucccagaaucuugauuuauugaccaagaaaacacauuuuaagaaauugugaaaacacuucccauaggauagaaauuaacuuauuacaacuuaauggagaguacaaucaacugaauguugauucauacauaggauaggauagaaauuaacuuauuacaacuuaauggagaguacaaucaacugaauggauuauuaaacuuuggucccugaauauucugagcagggaaggcucagggucuugcuguuagugauuacuccugcccccaccuccacugcugcuuucuugggaucuuuucaguaauaagcuuaaugacgacuagacauagaaguuauuucagacauuuuccacuaguuuuuguucuuuugggcuaauuuuggcuuugucauuacacuucauugaauuaugugcuagcauauuuuuccacauauagaaauuauuguauuaucauuuaaucaccuguucauuguucaagcuggaaauuggcugaugggcccgggcccaauggcuuugaauaaccaaaaguguuucuuucuuuuagaacuguuggcuauuucuuucaaaaagcggauagaacaaaaucccauuucugugaaagugcuuuguccuuuuuucuuccauucauuuccuaugguugcugugauaaauugcuacacauuugguggcuuaaaagagcagaaauauauucccucccaguuccugagaacagucugaacuccauuucacucggccaacaucaaggugucagcagugccgugcaaccucugaaggcugugaggaggaguuuuuuccuugccucuuucccagcuucuauggcugcaggcauuccuuggcauguggcugcaucacucccaucucugccuuuguggucacacugcuuucuccuuuucugucuaagucucccuccgccucccuguuguaaagauucauuugacugcaguuagggcccaccugaauaaucuaggacgaucuuccaaucucaggaucauuaacuuaaucacauuugcaaggucuuugccauauaagggaacauucauagguagcuuucagaaauuagagccugauaucuuuggggggcaauuuuuagcuuacuacacucacauauaacaaaagcaagaugucucauacugccuucugcuguuuccuaauaguaaccuuuuauaugaucucauuugauaguuuuauuaaaggucuauacauguauaaugguacaaggcauaugagaaucuauguuuaggucuauauaaacguggauuuggacuucucugccagguagggcuauagauggauaucuugcugugcuccuugaaaagguuuuuauucuaguugguuucuggagagacugacacaguuauggaagggcaugagccacaacuccuggauaguuauuuggguuagguuuucaguuguccauuucuagcugcagauuuccaaguaacaccauuuuggaaccuagguuuuccaaaaugccucuucuauccacucccacuaagggaaauuauuccugggacuuaacucagccccacuuuguuuagccugauuccuggacacucucuaagccuuggcacccugggcuucccgggcuucugaucucuuccgggaaccuugaauucuguauaucuggcugcucucuguaaccauggugaugucagucugguggaagagagaaagggcaaacagagaggagcuguuucuuggugcucaucuuucaggaguacagcaucuugguaucuuuagaauguuagcuuuuaguacuuuuugguuaauuuucauggaccuuugcagacuuuacccucuugaaugguuuggcuuucuguagucucuuuccccauggauaucuguuuggcauagagauuucuuucuucuucuuuuuuuuuuuuuuggccaguucucuuucucuuccuccuucuggccaacgacuguccaguccagagaccugaaccuuggacaaaaccauuguguuguggagaauuaagcaaguggauucaugucuccaucucuucuuuuuccuucucccagcugacuuugagauaauuugguuacucucuucuccagugggaauuuaaaagcuacuuuuaagccccacucugggaaggaucaguggaaaggacucaugcucuggcuuucuuaucagauuuguagggagcuguauuuacagacacccuuagaaugaagauauucuccagaguguucuagccuugccuuuuggucaaguuugacaauugugaucucauuacccccaguccugucccguguacuucuguagaccuguagaaugccuuuaggaaaaaaaaaaacuguauuccacaguugacccccguccacccaagcauaguacaucugagcuccugcuucauccuuggguucauccaaggacacucauagugauccuuagcucucuggcuccagguuuuaaaagcuuagccuugagcaggcagguaucugucagucaccuuggugcccaaacaggaauugcucuugggaaaaacuccucuuucuuuaaucccaaugucuuuucucuuuaauacaauaaugagauuuucucccugaucaaaaauggcaguagugccuguaaucccagcauuuugggaggcugaaguggguggaucucuugagcugaggaguucaaaaccagccugggcaacguggugaaauccugucucuaucaaaaaauacaaaaauuagccgggcauaguggcacacaccuguagucccagcuacucaggauguugaggugggaggauggcuugagccuggaaggcagagguugcagagagcuaagaucaugccacugcacuccagagugcagacagagugagacccugucucagaaaaaaaaaaaaaaaaauuguauaguauaguauaguauaguauaguauaguauaguauaguauaguauaguagaaugggaaugcagccuuucuuuaauuugccauuuguaauaaauacaauacauaaaaugagccauguauuugagucauuacaagucuggacaagcccuggccaauagugacuauguuguuuucaggccagaccaaaaaagggcacuagucugcccuacucauacuugcaacugacuuuccacauuaccaggguucuuggaguuggagagcauaucuugugaaauucuuugcugccuagaauuucacugaauuuuccauacuguaggcauggcuccuagguaaucaagaaggugugaacucuggagucaugcagggcuagguucaaaacuaggcucuccaacuuauugucuaugcaugaauuauaaauuauauaaagcggcucauagagcaccuggaauuuguguuuaggacucaauaaaaguuagguguugucuaggugauuuuguuaaauaaaugaguaagaaauaugcuagauggccuuaauucuucuucaugauaaaaaauguauauacuuuagauuuguauggcacuuuuaaaguaguuuauuuguccauuuggcaaauauuuuuagaauagugaacaaauacuuauuuacaaagcaaccagaaguaagcuuuugcaaugugccaagauuuuagcuuauaaauuccuucauuuuuaugggaaaauauuuuauuaggcauauuuuagaacuuucuaauugcuuaauauucacauccaugauucaguauaaaaaagacuauagccucccaucuuaaccagaauccucugauguuccaguaaggaauuggcuggugagaacuuagcuuucuugaaagaccuagaaaugcccagggccugcauuuuuuugaacacugauaugcaauagaccaauuuagucaaaugcauaucuacaagugaguuauuauuccauauuuuaaugcacaaauugaggcucagagagauuaagugacuugcacaaaggucacagagcugaaaacuggugacauuuauacuugaauuuagaucugaucaauccaagauucaaaaucuacccugcauuaacaaaugguuuucuuugugguucccuagacaucaaggauaugagauccagagaguuuaaaucucagagaucugagggauauuauaauauugccccuucaaaugaaagcacuguuagcaguggaagagaucugagucaccccaaaucacugguggugaaucuguacacauuuguggcaucuuuaggccuugccuccucagaagaaauaauuugacugaggggcauaaaacagaaaaagagacugaggcaaguuccagagcaggaguggaaguuuauuaaaaagguuuuagaacagacaagaaaggaaauaaucuuugaaagagauccaagugggcaccugaaggucaaagagagaaaaaagggacacuuaccuugauccuagggcucuauaggcucgccucuuucccauaauucuuuccuuagggugggcuuccugcauguguagucccuuccuuacccuugggaacugaacacaugcagugugcuuaggaaguuguacccauguccaucugaggcuuuuuuccuuuuugugguggagugcccugaagaccauacuuugccauuuuugucucuuaauaugcaugcccgggaaguuucuucucccugggaucugcuuuucuugaacacuuuaacauuaacagguguggaccaucaggaaauggccucucccuggugccagcugccaauuuaucacuuuuagagaggcaaugcaauaauugccgagccaucaccuggcauuucuaguggguugucggggagagcccucuccugccccgcuaaugccuaacuaccuguaacagcacuacucugggaaguuguaggauuuggaaccacauauccacccuuucauaggcaaggcaggauuacagccucguuaaagucuuagugaaauggccuagguuagaggaggcagcuggguggugguggugagauggggcagguauggggaccaacuagacccuauaucuugaucuuaaaauuacuuauugauuuuuaaguguccaaggcauuugugagugggucucccucccccauucugcauacucugagucaucagagaagagggauuacuugucccuucuugaaguugaaguugauguaguaaaacauuaugaaguuuacuuuuuaaaguaucauguucuaacuauuuugaaagagcuucagacuuacagaagaauuguaauagaguacaaagaauucauguauaauauucauccauauuccccaaauguuagcauuuaaccacauuugcuuuaucauuuuucucuuuacauacacaaacacauuucggagacuuugagagccaguugcugccaugccccuuuaucucuaaauauuucaguguguuuuuucuggaaauaacgccauucucuuacagaaucacaguauaauuuucaaacccaugaaauucacauugccacaauacuauuacauaauuuauagaccuuacugaaauuucacaaguuguuucaguaaauuuuuuucuagcaaaagaaaaaguccacagcauaaaacguagcguuuaauugucccaugucuuuauguuaccagaaagggaucccaauccagaccccaagacaggguccuuggaccucgagcgagaaagaauuugaggccgaguccauagaguaaagugagugcaaguuuauuaggaaaguaaagggaugaaagaauggcuaccccauaggcagagcagcagcaauggcugccugacugaauauacguauaguuauuucuugcucauaugcuaaauaagggguggauuauucaugaguuuucugggaaagggguggagaguucucaaaacugagggccccuccccuuuuuagacuauauaugguaacuucagacauuucuguggcauuuguaaacugucauggcacuggugggagugucuuuuagcaugcuaaugcauuauaaucagcauauaaugagcagugaggucaaucagaggucacuuucauugccaucuugguuuugguggguuuuggccagcuucuuuacugcauccuguuuuaucagcaaggucuuugugaccugugucuugugccgaccuccuaucucauccuguggcuaagaaugccugaccuccugggaaugcagcccaacaggucucagcuuuauuuuauacccagccccuacucaagauggaguuguucugguuugaaugccucugacauuuagucuccuucaagcuggaaucauuccucagucacguucccuuucaugaacuugccauuuucuugcuagguacaggacaguucucuguagaauaucccucagucuggucuuaccugguguuuuauccuguuuccuuaugaucagaucuauuuagguugugccuuuggggcaggaauaccgggagagcugcuggguucucagagcuucccaucagaggcccuaaggcucacuuugcccaggacugaggauguuuaccucugucacuuggucagguguugcuuucagguuuauccacuugaagguacuguucuccccuuuguaauuaauaaauaugugaggagacauuuggaaagauuuaaauagcuuguuucucaucacauuuucacccacuaguuuuaggauucuugccugaaauguuuauuguugcagagguugccaaaugucgauuuuucucauuuuguuuuuccuacuauguuuauuaguugaaauccaacaccauugguuuucuaacaacauuccagaaagauuucaucuguuaaagagaaaauaucugggcuaaauuaaauccauaagaaauaaaaaccucucuucucuccucucccuaaccccagagcccagguauucagcuaaguggcuuaucuauccauauuuaauaccauggaaauauguagagcuguuggaaauuguuccuaaggccauuuucuauuuuaggugacaaaauuccuaauccucucuuagauccuucucucuucagguuuacccuauacuuuuucuccugaagucuuggucucauucugccuuuccuggccuucuccuuaauacacacacaccccuuggaaccuggcucuuaaagcugcagaaggaaaagcucucuucugaacauuaaagaaccuacucaccugcaaaccucuuucagggcauggccagcaagugcacauuccacaggcacccuuagucccuuuuauuucuagcucagcacuuucaguaaugcccuauccagucuuaaaguccagauacucaagaugcaucuaauuaaauucucucugucacucuccaggguaaaauuaggcaauuaguuauucacacuuaauuucauacucuugaaaugccuuuuuaaaaauagaaccuauaacagaucucuccuccacuaggcuccugaaauacaaagcuauguuuagaacucuuccccaaucucuucccucagaagauuucugacuuucaucucaauugucugugagcacuaucccuuuccugggacaaucacucucuguaccacggacgucggaagauccuuagauuauucuaacaacuucuuauauauuuuucagggaagcuaauuuucacuuauaccaaaggacaagguugaccagcuuccaagaaaaucuuucuuccugguuaauagacuaugcuacuuuucaucuuagggaaauggaucuuuuuugcuuuauaauaugaugccucucucaagcugaauaaaaagcauccucugguccaaaauucauggcacagucaccuguuucugggaggggaaaugcauuuaugacuaaccauaaaucuuaagcuaggaauugaaaugcuagggcugccaaauaaagcagacuuucuuucccaggaacugcuggggaacugaaucacucauuaguaccagaaauugcuauauuuggagaaacuucaauuucuccugaguaaccuuguuucucuauaagguaauguuuagagauaauauuuuucuuucuucuucccauuuaaaacccucaaaagacagcauuuccuugccucauucuugaaugggcuaagaaugaaagaacuccucaccaacaguuuuuggcuacuuugggacagggagcuuaucuuccauggaaacucaccagaccaaaagccuuucuagaacucgagaugaagauauagccucuguaucaguauugagccaaagcaacauauauucagagacccaaacuucuguuaguuacuauagcauuucuagauauugauugaugagguggacucaacugcucuguaaauuacaugauaguuuaucuuaggcauguuugaacuggacauagaauaccuugacaaaacacaucuguaaacucagaguauuauaauagcuagcaggucagaaaaagaagugacccauagaaacuaagggcuaaauauuuugucuguagccuucccuucugugauuaaaguuugguacauaaagggaaagaaucaagcauuuauccugucuuuccuguaccucacuauaaccaaauggcagaugaaggaaaguucuuucuuauaaaagacuuccagauaauaaagaagaaaugauaaaagaauaucaguguuuugccacugcaacaauaauggauuuaggcaaugguaucaaugacucuuuaaaucuauuaggugacaggcuaauggagaaccuuaaaauagaaggaccaaccugccaacacuugaaucuaccugucaaucuuaacauauccaagagagaagcaaccuaauauuuugcuuugcaaugagaagcaagagaaaauauaaaauacaaccuguaaaauacucuuauccaaaaguugaaccugauuccuauuaagucucuagauuuaacuaccaguacguaggaaauacagaggcgagaggaaaugcgaaacaacaucccagggauggagucagcaaaauccagaaugugggaaacucucaagacagacagcccaauuucuucaacaaacaaauuccaagaaaaauuagagaagaggaacccauagaugaaaagacaucuaugagaaguaucaaacaaaugugauguggacuuaggauccugacucaacagugcaacuagugaaaaaaaaaagacaaguacuagauuaccagauacauuugaacauuuggauauuugaaaauacuaaguaauuauuuguaauauuuuggugugaucaugguauuaugguuauguuuuuaagagucaucauuaaccaauacuuacuaaagcauuuauugaugugucuuaguccauuuucuuuuuuuuuuuuuauuauacuuuaaguuuuaggguacgugugcacaacaugcagguuuguuacauauguauacaugugccauguuggugugcugcacccauuaacucgucauuuaacauuagguauaucuccuaaugcuaucccuccccacucccuccaccccacaacaguccccggugugugauguuccccuuccuguguccauguguuuucauuguucaguucccaccaaugagugagaacauacggucuuugguuuuuuguccuucugauaguuugcugagaaugaugguuuccagcuucauccaugucccuacaagggacaugaacucaucauuuuuuauggcugcauaguauuccaugguguauaugugccacauuuucuuaauccagucuaucauuguuggacauuuggcuugguuccaagucuuugcuauugugaauagugccgcaauaaacauacgugugcaugugucuuuauagcagcaugauuuauaauccuuuggguauaugcccaguaaugggauggcugggucacaugguauuucuaguucuagaccccggaggaaucgccacacugacuuccacaaugguugaacuacuuuaccgucccaccaacagugugaaaguguuccuauuucuccaccuccucuccagcaccuguuguuuccugacuuuuuaaugauugccauucuaacuggugugagaugguaucucauugugguuuugauuugcguuucucugauggccagugauggugagcauuuuuucauguguccuuuggcugcauaaaugucuucuuuugagaagugucuguucauguccuuugcccacuuuuugaugggguuguuuguuuuuuucuuguaaauuuguuugaguucauuguagauucuggauauuagcccuuugucaaaugaguagauugcaaaaauuuucucccauucuguagguugccuguucacucugaugguaguuucuuuugcugugcagaagcucuuuaguuuaauuagaucccauuugucaauuuuggcuucuguugccauugcuuuugguguuuuagacaugaaguccuugcccaugccuauguccugaaugguauugccuagauuuucuucuaggguuuuuacgguuuuaggucuaacauguaagucauuaauccauguugaauuaauuuuuguauaaggcguaaggaagggauccaguuucagcuuucuacauauggcuagccaguuuuuccagcaccauguauuaaauagagaaucguuuccccauuucuuguuuuugucagguuugucaaagaucagauaguuguagauaugcggcauuauuucugagggcucuguucuguuccauuggucuauaucucuguuuugguaccagcaccaugcuguguugguuacuguagccuuguaguauaguuugaagucagguagcaugaugccuccagcuuuguucuuuuggcuuaggauugacuuggcaaugcgggcucuuuuuugguuccauaugaaguuuaaaguaguuuuuuccaauucugugaagaaagucauugguagcuugauggggauggcauugaaucuauaaauuaccuugggcaguauggcuauuuucacaauauugauucuuccuacccaugagcauggaauguucuuccauuuguuuguauccucuuuuauuuccuugagcagugguuuguaguuaucccugaagagguccuucacgucccuugugaguuggauuccuagguauuuuauucucuuugaagcaauugugaaugggaguucacucaugauuuggcucgcuguuugucuguuauugguauguaagaaugcuugugauuuuugcacauugauuuuguauccugagacuuugcugaaguugccuaucagcuuaaggagauuuugcgcugagacgaugggguuuucuagauauacaaucaugugaucugcaaacagggacaauuugacuuccucuuuuccuaauugaguaccuuuauuuccuucuccugccugauugcccuggccagaacuuccaacacugcguuuaauaggaguggugagagagggcagcccugucuugugcccguuuucaaagggaaugcuuccaguuuuugcccauucaguaugauauuggcuguggguuugucauagauagcucuuacuauuuugagauacaucccauuaguaccuaauuuauugagaguuuuuagcaugaaggguuguugaauuuugucaaaggccuuuucugcaucuauugagauaaucaugugguuuuugucauugguucuguuuauaugcuggauuacguuuauugauuugcguacguugaaccagcuuugcaucccagggaugaagcccacuugaucaugguggauaagcuuuuugaugggcugcugaauucaguuugccaguauuuuauugaggauuuuugcaucgauguucaucagggauauuggucuaaaauucucuuuuuugguugugucucugccaggcuuugguaucaggaugaugcuggccucauaaaaugaguuagggaggauucucucuuuuucuauugauaggaauaguuucagaaagaaugguaccagcuccucuuuguuccucugguagaauucggcugugaauccaucugguccuggaauuuuuuugguugguaagcuauuaauuauugccucaauuucagagccuguuaugggucuauucagagauucaacuucuuccugguuuagucuugggaggauaugugugucaggaauuuauccauuucuucuagauuuucuagcuuauuuguguacagguguucauaguauucucugaugguaguuuguauuucugugggaucaguggugauauccccuuuaucauuuuuuauugcaucaauuugauucuucuuucuuuucuucuuuauuagucuugcuagcagucuaucaauuuuguugaucguuuguaaaaaccagcucauggauucaucgauuuuuugaaggguuuuuugugucucuauuuccuucaguucugcucugaccuuaguuauuucuugccuucugcuagcuuuugaauguguuugcucuugcuucucuaguucuuuuaauuguaauguuagggugucaguuuuagaucuuuccugcuuucucuugugggcauuuagugcuauaaauuuccuucuacacacugcuuugaaugugucccggagauucuuguauguugugucuuuguucuugcugguuucaaagaacaucuuuauuucugccuucauuucauuaugcacccaguagucauucuggagcagguuguucaguuuccauguaguugagagguuuugagugaguuucuuaauccugaguucuaguuugauugcacuguggucugagagacuguuauaauuucuguucuuuuacauuugcugaggagugcuuuacuuccaacuauguggucaauuuuggaauagguaugggguggugcugaaaagaauguauauucuguugauuugcgguagagaguucuguagaugucuaucaggucugcuuggugcagagcugaguucgauuccuggauaucuuuguuaacuuucugucucauugaucugucuaauguugacagugggguauuaaagucucccauuauuauugugugggagucuaagucucuuuguagaucucuaaggacuugcuuuaugaaucugggugcaccuguauugggugcauauguauuuaggauaguuagcucuucuuguugaauugaucccuuuacuauuauguaauggccuucuuugucucuucugaucuuuguugguuuaaaguauguuuuauccaagacuaggauugcaaucccugccuuuuuuuguuuuccguuugcucgguagaucuuccuccaucccuuuauuuugagccuacgugugucucugcaugugagauggguuuccugaauacggcacacugaugggucuugacucuuuauccaauuugccagucugugucuuuuaauuggagcauuuagcccauuuacguuuaagguuaauauuguuauguguuaauuugauccugucauuaugauguuagcugguuauuuugcucguuaguugaugcagugucuuccuagccucgauggucuuuauaauuuggcauguuuuugcaguggcugguacagguugugcccuuccacguuuagugcuuccuucaggagcucuuguaggacaggucugguggugacaaaaucucucagcauuugcuugucuguaaaguauuuuauuucuccuucacuuaugaagcuuaguuuggcuggauaugaaauucuggguugaaaauucuuuucuuuaagaauguugaauauugguccccacucucuucuggcuuguagaguuucugcugagagaucagcuggcagucugaugggcuucccuuuguggguaacccaaacuuucucccugacugcccuuaacauuuuuuccuucauuucaacuguggugaaucugacaauuauguaucuuggaguugcucuucucgaggaguaucuuuguggcguucucuguauuuccugaaucugaauguuggcuugccuggcuagauuggggaaguucuccuggguaauauccugcagaguguuuuccaacuugguuccauucuccccgucacuuucagguaucccaaucagacacagauuuggucuuuucacauagucccauauuucuuggaggcuuuguucauuucuuuuuauucuuuuuucucuaaacuucucuucucgcuucauuucauucauuugaucuuccaucacugauacccuuucuuccauuugaucgaaucagcuacugaggcuugugcauucgucacguaguucucaugccaugguuuucagcuccaucagguccuuuaaggacuucucugcauugcuuauucuaguuagccauuugucuaauuuuuuuucaagguuuuuaacuucuuugccauggguuugaacuuccuccuuuagcuuggaguaguuugaucgucugaaggcuucuucucucaacucaucaaagucauucuccauccagcuuuguuccguugcugguggggagcugcguuccuuuggaggagaagaggugcucugcuuuuuagaguuuccaguuuuucugcucuguuuuuuccccaucuuugugguuuuaucuaccauuggacucugaugauggugacauacagaugggguuuugguguggauguccuuucuuuuuguuaguuuuccuucuaacagucaggauccucagcugcaggucuguuggaguuugcuggagguccacuccagacccuguuugccuggguaucagcagcagaggcugcagaacagcggauauuggugaacagcaaauguugcugccugaucauuccucuggaaguuuugucucagaggcguaccuggccaugugaggugucagucugccccuacuggggggugccucccaguuacaccacucgggggucagggacccacuugaggaggcagucuguccguucucagaucuccagcugcaugcugggagaaccacuacucucuucaaagcugucagacagggacauuuaagucuguagagguuucuguugccuuuugcuuggcuaugcccuccccccagagguggagucuacagaggcaggcaggccuccuugagcugagguggucuccacccaguucgagcuucccagccuggccacuuuguuuaccuacucaagccucagcaauggugggugucccucccccagccucacugccgccuugcaguuugaucucagacugcugugguagcaaugagcgaggcucugugaguguaggaccuuccaagccaggcacgggauauaaucuccuggugugccauuugcuaagaccguuggaaaagugcaguauuaggguugggaguuacccaauuuuccaggugccaucuaucaccccuuucuuugacuaggaaagggaauucccugaccccuugugcuuccugggugaggcaaugccuugcccugcuucggcucaugcuuggugcacccacuguccuugcugcacccacuguccugcacccagugucugacacuccccagugagaugaucuugguaccucaguuggaaaugcagaaaucacccaucuucugcaucgcucacgcugggagcuguagacuggagcuuuuccuauucggcugucuuugcuccuccccucucuuaguccauuuucuauugcuuauaacaaaguaucugaaaauggguaauuuauaaagaaaaagaauuuauuacaguuauggaggcugagagguuuaauguugaggggccacaucuggugauggccuucuugcugguggggacucugcagaauuccaaggcagugcagggcaucacaucaugagggagcugaguguucuagcucaggucuuucuuccucuucuuauaaagccaccagucccacuuacaugauaacccacuaacccauuaacccauuagucuaugaauggguuaauucauucaugagagcagaaccuucaugacccaaucaccucuuaaaggccccaccucucaauacugccacaauggggacuaaguuucaauaugaguuuuggaggggaccaacauucagacauuucauagcaagaugaaaugauaugaugucugugauuugauucaaaauaaucuauggggcagaaaaguggguaggaguauauaugcaacaagacuuauucugaguugauuauuguugaaucuucuggcaaguuaaguacaaguuucuuauaaacuuucuauaauauuauacaaauaccuuagacauuaguugucucaaaaucaaugugcuuuucuuuuucuggugaauagaucauuuuuauaauagaauccccuagguuggaaaaauaaguuacuacauuuuuaauguuucugaauuuagauggcuaugugcaauaauuugagcaugaguaaagugaacucucaaaggacauguaucucuuccaguuaggauauaugucaauccuuguaucaccccugaaaccaggagcuaauuucucuuacuguuuggucaggucagugaaggguugauacuauaccagcacguagacugugagaacacuggcuggacugcggaagauuccuuuacauucacggccuccuccccaucagcagcccugggacccgaggaauucuguauuacuauuucauaugauaucaaugagccuggucagcagaguugucugcuugcaaauacagguaaugccaccacgauaugagcagugccuaaucuauaauuauuaaaguagggagaguuuggaaauaaaucuuucccuuguuaauugucaaugccaugauaucaaccuuugaaauaaagcuuaaacaguuauaaaacauuauuucuuuacacguccucuuucuccaggucucuucuauuuuaucucauaagcuuaaacaguuguacugggagaaggaugacaacuuagcuuuaaagaauuuuauuugcaccuccaaguggggacuucacugugcccaugacagaaaacuguggauagaaaaugaaaaugacaaauaggguaaguucuuaaaaggaaagggguauugaaagcugcauguuuccauggcaagagaaaguccgguaguagauaaauuaugaaauuaacauuuuauaaaugaauauaaaagauuuuaaagcucaguugccugaaauguuggcuuaauugugugugaauguguguauuuaaaauguauuuauuuaauaugccuuggguagcaaugcuaauucaaguacuugagcaaccaaaguguuacaaguaauccacuaagacaaauuugagggaaaaagagcuuuacaguugucaucuaaaaguucuaaugaaaugccaauuuguucuuucuguuuuaacaggagcuucugucaaggagggagacaagguucuaauuggccgauuuaaguuagaugccuccaaccucuuauuuaaauugccugaaucucagugcucguccugugaaauuugguuccaagugacaucucuuccucaccacagaacaauuaugguuggaaaaagaaauauuaccaaagguaaacccaguuucuaccaguauacaacuuuaaagcuaaguugucauccuucucccaguacaacuguuuaagcuuaugagauaaaauagaagagaccuggagaaagaggacguguaaagaaauaauuuggaauuacauacauucaugaugacucugaaucacuggcugauaauuuuaccuuugucguuuggccaaaccaaaagagcaaguccacccaagccagaagcugacuuucuugaagagauguuuaauaucaccaucucuccagguaauauuauuauaaugaccaggcaccagaauuaaagacaaaggggcuucaguugaaaguucugcagggcaguagguuggcugugggaccugaacaucugaaaauggaagaucuggacaguccuccagaugaaaucagauauaugaucauccguaauccuaauaauggcuuuuuggcaauggcuuaccuucuggacacagcuguucaccauuuuacacaagcugacauugauaacucucaggugugguucauacaggauggaagcccuucuucuggaauguucuacuuuagugugacagauggugcacaccacacccucuauaaacucuuccaccuggaugucauucccaucuccaucagcauugugaaccuuacugaccuacuucucccacaaggccagacaaccauccccaucaccaaugcucaccugucagccaugaccaaugggaggaacccccaaaucacuuacaugauaacauggccccuccaacaugggcaccugcugauugaaaaccagguggucaccaacuuuggacaggaagauuuggauucaggaagacucuuuuaucacaugacaaaucucacugccacacaggaccagcuacaguucucacuguuuacaucagaaagcaaccugacaggacaaacacugaacaucagagugcagccuuuacugcggguuaugccaaaccugaaaauugccgacagaguggcucaucagcugagaagaagggaccuagaugcuaccguguugcaggaagucagggaccccgaacagagggaccggcugaagccauggcagaagaacauaaauugugaagauuucauggacauuuauuaguuccccaaauuaauacuuuuauaauuucuuacaccugucuuuacugcaaucucugaacauaaauugugaagauuucauggacacuuaucacuuccccaaucaauacccuugcaauuuccuaugccugucuuuacuuuaaucuccuaaucccaucaucuucuuaagcugaggaggauguaugucaccucaggacccagugaugauugcguuaacugcacagauuguuuguagagcauguguguuugaacaacaugaaaucugggcaccuugaaaaaagaacaggauaacagcaauguucagggaacaagggagauaaccuuaaacucugacugccagugagccagguggagcagagccauauuucucuucuuucaaaagcaaaugggagaaauaucacugaauuucucaaggaacaucccugagaaagagaaugcaucccugaggggagaccucugaaauggccacuuuggggaugguagucuuucauggucguagcugagggaugaaaucagcccccaucucccguagugcucccaggcuuauuaggaugaggaaauuccugccuaguaaauuuuggucagaccgguugucugcucucaaacucugucuccugauaagauguuaucaaugacaaugcguggccgaaacuucauuagcaauuuuaauauugcccugguccugugguccugugaucuugcccugccuccauuuaccuugugauaucuuauuaccuugugaagcgugugaucucugugacccacacccuauuuguacacucccuccccuuuugaaaaucacuaauaaaaacuugcugguuuuauggcucgggggcaucauggaaccugcugacaugugaugucuccucuggauacccagcuuuaaaauuucucucuuuuguacugugucccuuuauuucucagacuggccgacacuuagggaaaauagaaaagaaccuaugugaaauauuugggaugaauuucgcccgauacuaucgagcuugcuaauaugacugacagugaucccaaauuugaagugacagagcccccuguacauagaaggcugggaugaagagggguucuacagcacagugauagaagaggcuacuguauucacucagaggggcauugaccaaggguggcugguauuccacccacaggcguggggaugcugaaugacuucuucacuuucuugcucaggccagaucauguacagccagugauauguuaucuccccuucaccauagugccgccugaccccucacuuuuccaaacauuuacaccagguguuccuuuauuugucacuggagacaaccuuguaaccccaguucucucucaggaaaagccuaugauuuccucaagacuuguggcacagacagaaacuuuagggaaacugacccagaccagauggcagaaagcagaucccuggggacagcacaguggugaagagcccaguguggauggcagaguuucugccaucaaggucauuuggccaccagccaccacuaauagucagcuuuugggcacccacacagcccagagagagcaguuacccucugauggucaucauacccuuggcugccguggucuucgugcugaaaguggcugcaguggccaugugugucugguuguugagccagaagguagaaaaggcaaaaccccuuaucaagccccagaccaauccggaacacacaaccccaagucauaggccacaaaggagcauaaaguucccacugucacagugacaccccuucugcaaagcuccagcagccccccagucugucuuuucagggcccugcagugugaacaaaugucuucuccaguggccgagccaguggacaaaugugcugcuugggagacauggaugaaccuggucaaacucugccgacaaaccaacccaacacugaagcacaaccaguaccggguguagauugagggcucgcauuucuuacugaccaccuaccaugugucaggcacugggauaggcauugggauauaaagcaaauaaaugcugguuggaucaacugagaaaagucaggcccugcuagugauucaauguucaauccuagcuccaugguuagauguugcggggugguugauugugacuuguacaacacucaugggcuuucugcaaugggcucugugugucaucuucuggaccugacuuucucaguauacaucaguuggucaauauuuaaacccuuuacuaagguaguacagaacauguuagccccacugagaaugcuaguauuaaccuggggcauagaguuaaaggaggaaagcuuugaauauuuuacacugagaauucccucugagugagucagcaggaaguacaagaacuauuucagcauguagaagagguaauuuaucacaucaaugaguauguuuacguaauguuuuucuguaaugucuuuuccucauuggagucucuagguuugauuuccuagugcaggaaaugccucagugcucuagguaguguugggacagucuggccccuuuugaaauuaucuacugaauacauuguguuucaucaggaggcuuugucuauuuugauuuauaaaaucaagccuagaagaaacuaucaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggauaugaacagacacuucucaaaagaagacauuuaugcagccaaaaaacacaugacaaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugacuauaaaucaugcugcuauaaagacacaugcacacguauguuuauugcggcauuauucacaauagcaaagacuuggaaccaacccaaauguccaacaaugauagacuggaugaagaaaauguggcacauauacaccauggaauacugugcagccauaaaaaaugaugaguucaugucguuuguagggacauggaugaaauuggaaaucaucauucucaguaaacuaucgcaagaacaaaaaaccaaacaccgcauauucucacucauaggugggaauugaacaaugagaucacauggacacaggaaggggaauaucacacucuggggacugugguggggaggggggaggggggagggauagcauugggagauauaccuaaugcuagaugaugaguuagugggugcagcgcaccagcauggcacauguauacauauguaacuaaccugcacaaugugcacauguacccuaaaacuuaaaguauaauuaaaaaaaaaaaaucaagccuagaauagaaauauuauuugaagcccuacgggacagaaaaguuuguugaauguuuuuacgaugccucaauuuggcuuaacuuuacaaugaauuaaaauaaugguccaggcccaguggcucaugccuguaaucucagcacuuugggaggccaaggcgggcagaucgcuugagcccaggaguuugagaccagccuggacaacauagugaaacucuaucucuacaaaauaagcaagcaaacaaacaaacaaaaaaauuaaccaggcauggcggcaugugccuauaguccccagcugcucuggaggcugagguggguggaucgccugagccugggaaguuugggcugaagugagcugugauauacgagauucugucucacaaagaaaauaaauaaauaauguaauaaugacaaauuuguauuugcauugucuaauugagccuacuauuggccaagugaagcuucaguuucuguaauuuuaaaaugaagauauuaguacuuguauuaggaaugcuuugggcugcaaaccugcaagacauccucuauuagugguucagguuggagacuggcaagcuuuuucuguaaagagucacauaguaaauauuuuaggcuuuguaggacauauauauauucugucauacauucuucuugcuuuguuucuuuuuaacaaccuuuuuuuaaaaaaaaguaauucuuaguuauuggacuuggcccacauaccauaguuugccaaucauugauguagguaauagauguguugaauuaucucaaguaaugaacaugcugggggugggcauucuaagaccgguucaguaguucaagaauggcaccaaggacugagcucuucuguuccugcugcucuaccuuccuuaagcuguuaacauuucauucuuuuauuuaauuccuugcaauuguaagauguuugcuaaagcuccaagcaauacaacuacauucgaaggcaggaaucauaguggaggagagagagauagaggauggcaaaaugguuuuuuaaaagaguuuuuuaaauuuuuuuuuauuuuuaguagagaugauauuucaccauguuggccagacuugucucaaacucuugaccucaggugauccuacaccucggccucccaaauugcugagauugcaggggugagccaccaugucuggcugagacucuucuauuauuauuauuaucaucaucauuuuuaaucuuguaagaggaguuucucccuaaacuuuuguuuuaugucucauugucuagaaaugggcaacaugacuuccaucccuugaccaaucacuggcaaaggaaaaugguguccucauaacugacagucucucccagggcugagggaggagucuaccaacucagagaucaauggaucagccuaccauguaauuagggaaggauggggggauagcaauucgauagacaaugaauagguucuauuaaaauacucuucaaauagugacauacuugggaaccaaagauuuugaucuuucaaaucagugucuuauaucuccuuuucauguuuuaaggauuuuucuugaagccagaggccaguuuuucucaauaggggugggaaggccgugaugggggugugugugaggggagacaugccacccagaguacauuuggcaaaggcuagggacauuugugguuuucaaagcugauaggggaaggauauuucuugcaucuaguggguagaagccaaggaggcugccaaacaugcaaaaaggcacagaacagcucucacaacaaagaauuaucagguugaaaaugccaacagugcagagauugagaaacccuguuuaagucacaaugaagaguuuuccuguauaaccaaugaaggauaaacuuauuaccaagucuaggcaaaaaguauauucuaaaaacuucaugguaaagugaaaaucccacgguauauuugaaacucugauuggcuagugguauacauggacauuuaaaaaagaggauguauuaaaaaccaagcaaaacuugacagcaggcucauuucuucauauuacucaucuaaggaaaauauuuugccuuguguuaacagguggaacacaucgggagaguaaaaaugagacagaaaauucacaaagguaaagaugaggucaaaguguccccagaagucugaugccucuaauauguuucauauggaaaagguuuuguucucaccccaucucuuuucuguucgucugagucacacuucccucccaacucaauuuuaacugcucuuuaggaaaacacaauucacaaccuacagaauaaaugaaaucguagcauguuugggccuagagaugacuacccaugccuuaaauacuuggaucuaaugccauggacaacuguugcugaagaacauuucucuacucuucuuccaaaagugcuuuuauccagugucuguacuucugaaucguauagucccuuucaaguguuuuguuuaaaaggaggaggaaugagaggcuuaacccaagcuuggcuuggucauuaugcaacucaagaaucguucuuaggccuguuuuaauccaggcacuuagaaggaguaggauggcagugugugccugaaucugcacaugcaggggaggucgaggagcaucucuaaauccaguaaguggguuuuguuccccaucagcugggcagggagaaugccugcucuuuguggaaaagccagacauacuuggcucagugaguaugugggccucuuccuugcuucagccacaaugucucuggagcuaggauuaccagccuggcgaaacaaaacagucuggcuuccccuccucuuuuuccucuuaauuuugcaacugcacacauaaaauugguguccauauuggaaggagauacacacagauauuuaacaauaauaauucauguuauuguuugugagugugccugcuggagccagaauaucagugugagauccagaugucaaaccucagugauuaaucaaguaauuaacagagaguuuggaaaguuuucuucuagaggcucuggaauauucuacugauuuacagauggguucaauuaaaaggaaauaaugcuuaccauuuggugcuggcucaaacugugaaagaaauauuuuuggcaaaacuucauuuaacauugaaaauugaaguuuuagaaauugaaaaaucugccugaaauggcuucucccauaugcagaggcauaacggaauaguuuugacucuuugucauaacagagucacugcuucuuaacaaaugacuggugaauaaauaaguguauagcagagguuaguaucagaagacuggcagguuuuugcuuaagagaagguauacucugggcuaagcugggaguggagagucucucuuuuuuuuuuuucaccuccugaaaacauuuuuucauauuaagaggucuuggcagauuccaaccuuuagcggucccuucucaaacaucuggguacauuuccuuauaguccugcauuaauuaggugaggugaaggugacacagaagcuggcuuuacucucugguucuucagauuucuggagcugaaguggacacauuuggaggguagauggaaggugaugguacauaucaggugauggauccugaauuuuggaugggacugagcuauccacuccugcaucauucagaggcaucauaauuaauaaugagguuuagcccugcgcgagaagaggcaugaggaugagagugggcugggagcccacuguuuggccugcugaaugauggaucuuuugcuuaugauacacaaaaacaccauuggcuguuucauagagaccggguugaggcugccuucucauagagaucuacaaacauuuauaaggcgccucauguauaugaaaugcuagguccucccccuggucugaagaugcaagaugguaucccucaaggaucuuuuuggucugcuucuucuaguaggcccuucuagagucacacuagaagugccaggacagaugaggauaugggagaaauaggacaaagacacgcagagcuuaggacagggcuuuguguuuucacuucgagugcucauaagugagugcugcccauccagaggggcagcaagaguuggaacacaauggcccacucuagugugucccccacccuccauguuucuccgcccagcuuugcacucccugucccuuggugugccccaggucuggugacauggcagaauggguaaauaaucgacucugggucuguuuuggaucauagcccucuauuuccuagaagugugacuuauucaauuucucugaacuuaguuucaucagucaaaaauauggggauagugauauuaguaccuaccucucuggguuuuguuaggauuuagugauauaaucgccugauauuaauagaauaauaauaaucauacaguauuuucaaugcaucaggcagaauuuucuuaccuaggguuuuaaugcacuauaaaagaacuaaucuaugaagucucugaauaaaccagaggcucauauucuacccaaagugguauauuacugguaguagaauuucaggugaacgauuuaggauagaagagguguguuuaggaagggaacuucccaaaugcucaaacucuaccugccaugcagggccguuuccuugguccuuggauggggacuugguaagaaaauggaugaaggaaagagcacaccaggaacauuuacaaggggcagacucaagcugagagagauugagaguucuuuaccuugcagagggggcugaaccacugauaaaauacccugcccuauucgcuuccuguucaagcagggaucacaucugcacaaccccguccuggaugggaaacccuuaccugcucuucccuccucccaacccgguuggucucaggcuuucaucaauugguaauuuauuuuuuaauuccagaauuaacaaaggacugucacuuaaaaaaauuaauaucccuagcaaaauuuaaaguauccaacuaucaccguaauuccauuuuuuaaaguaagggcagaaucuuagaacaaagaacuucauggugggaagaacagauuuuuaugaaaaauucucuuuguccagauuugacuuuggccugggaaaaccucaggacacaucaucagggucaggaguucaccgcuggaggccaugcuuaugggugcuuugauuagagcagaggcagaagccagggcagaggggaauucaggcuccucaauguuggugcucuuuagaagguguggccaggugucccugguacauguguacauaugcgguaagggaggaaugggagugagagugaggggcaaauuugcuacuuaagggucuagagaauagcaguuccauggauaugcaaccugugcagccauacagggcccauucucagagggcuuuggguuugguugaaugcucugugucacaucuugaaauuagaauaauuucuuaacaagaggccccacauuuucauuuuccacugggccccacaaauuaugcagauguuucugaguccucauagaauuuaauugauagcugcaucagacaccucuucagcacaguuuagaauucucucaacuuugcaucuggcuccagccuuagcuguggcuacaaguuccaagcauguuugcagccaugagugugcacugugcccugcacuacccaccugaaggcuccucucuuuccacugcaugacggugggaacuugugcuugcaccacccagaaguauggcucugguccaguggaaaacugaagccuauggauaaaugcuuccucguuucaucucccaagugaacgguucugaaauucauucucugagacuucucagaacauccugaagauugagcacaauacauugguguguggacucuuuuccuucccuguuuaucaucccuguuccucacuccugcucccacucacagaugagucuuugcuuuugaggaaacccaugcgaagacaauaguuuacauucucccugauugugaccccuacgauuacagacucuggggcuggggauccauugccuauugacucuuccaugacccuuaggcacacaguuacgccugggucacuugucuccaggaccuacuuucugcuaggccccuugccugcggcagcucaggucuguggagacacugcuuucugcccacaguuggcagccagggacccuugugcccaugaggagacucuggcccaaggcucucuuuuggaaucauguugaggggacaggcauucacugaaccaucuucuagccgaacaucuccuuacucuucagugcacuuucucugcugaucauguugggucccagaaacaauaaccuuuuuaccccaacuuuuagcaagaccaagauuuauuguauuuuguaauauuuuagaaaggcuucuuuucaugcuuuucauuucaacaugguuccugccucuucaaagacuacaucagcucucuucuuuaaaauaauagcuuuauugagauauuuauauaccauaaaaucuacucaauuaaaguauacaauucaauaguuuucaguauuuucagaguuaugcaaucauuaccacaaucaauuuuagaacauuuuuauuacccccaagaauucuuguacccauagcagucacuuaccauuuacucccaguuccucuagcucuaagcagcuacuaaucuacuuucuguuucuauagauuugccuauucuggguguuucauauacggucaugugcugccuaacaacauuucagucaauaacagaccacauauauggugguggucccaugagauuauaaugaagcugaaaaauuuuuauugcacaaauaccuaccauuguguuacaacugccuacagcagucaguacaguaauauucuggacaggguuguagcccaggagcaauaggcuauacaauauaaccuggacauguaguaggcuauacaacuuagguuuguguaggugcacucugugauguuuguacaacacugaaauggccuaacaaugcauuucucagaauguagcacuauccuuaaaugacucaugacuguguauagaaucauacaauauguagucuuugugaucaccuuuuucagauagcauaauguuuucaagguucaucuauguuguggcauguagcaguuccuuuuuauggccgaauagcauuuuguugcauggguauaccacauuuuauuuauuuauucauucaucaguuaaugaacauuaggguuguuuccauuuuuugguuauuaugaauaauucugugugaaauauucaugugcauguuuuuguguggauauguauuuucauauacguaugaaaacaugaaguugaagaaaugaaauugauugguucauaugguauuguauauguuuaaucaucugagcaacugccagacuguuuuccaaagugacuaccauauuuuccauucccacaagcaguguaugagggcuccaauuucuuuacauccucacuauaccacuuuuuuauuuuagccauccuagugggugugaagugguaucuuauuguggcuuugcauuucccuacuagcuaacaauguuuaacaucuucucauguucuuacuggcuauuuguaugucuucuuuagagaacugccuauucagaccauuuggccauuuaaaaaauuggauuauuugucuuuuuguuauuauuugucuuuuuguuauuauuugucuuuuuguuauuauguauuuuggauacuaaccuuuaucauauauauauauauauauauauauauauauauauauauauauauaauauacaaaaauuuucuuccauucuguggguugucuucuuacuuucuuguugguguucuuugaagcacagaaguuuuaaaauuugguaauguccaauuuaccuauuuuuuuguuucuuguacuuuugauauuauaucuaagaagccauuuccuauuccaaagucaugaagauuuauguuuaugcuuucuucugagaguuuuguaauuuuagcucuuacaaugagaugcuugacccauuuugaguuaauuuuuuauauaguguauauagugugagguagugauacaauuucauuguauugcauguagauaucuaguugccucagcaucacuugucagaaaaacuauuuuuuuccauuuaauugucuuugugaccuuucaaaaaggaauugaucauaaauaugagggauuauuuguguacucccaauucuauuccauugaucuauaugucuaucuuuaugccaguagcaaccugucuugauuacuauaaguuuugaaaucaagaaguaugaguuauccaacuuuguucuguucauuuucaagauuauuugggcuauucuggauuccuuuaauuuccauaugaacuuaagaaucagcuugucaauuucugcaaagaagguaacugagauuuuguuugggauugcauugacacuguagauaaauuuggagacuauugaauuuuaacaauauuaagucuuuucauccaugaacauaauaugucuuuccacuuauuuaggucuuuaauuucuuucaauaauguuuuugucauuuucaauguauaagaccugcacuuccuugguuaaauuuaucccuaaguauuuuauucuucuuauuacaaaugaaauguuuucuuaauuuacuuuuggguuguuuauaucugugcagaaauacagcugauuuuuguaauauugagcaucccuaauccaaaaugcuccaaaauucaaaacuuuuugagugccaaccugaugcucaaaggucaugcucaaaggaaaugcccauuguaguacugugaauuuugggauuacggaugcucaacuggcaugucuaugcaaauauuccaaaguucaaacaaauuuccaaucccaaacaauucugaucccaagcauuuuggauaagggauauccaaccuguauaacaaucuuguaaccugccacuuaguuuaaauauuuuauuaguuuuaauuguuucuuaguggauuauucagaauuuuguacauacaaggucauguccucugcaaauaaagauacuuuuauuucuuccuuucuagucugagugccuuuuauuuaucuucuugccuaauuacccuugcuagaacccgcaguacgguguugaauagaaguggugagagugggcuuuugugucuucuucuucaucuuaggagaaacuuuucuuucucucuccauuaaguauauuccuagcuguggauuuuuuuauaggugucuuuuaucagauugaagaaguucucuuccauuccuaguuuguugaauguuuucuuuuaaucauaagggguguuggguuuugucaaaugcuuuuucugcauccauugagaugaucauguguuuuuuuguccuuuauuuuguugacauaguguauuacauucauugauuuuuagauauuaaacccaccaaucucacuuggucaugguguauaauccuuuguauauacugcuggauuuugguuugcuaguauuuuuuuguguggauuuuccccccacuauuuuaucacucuugcuauaaaccucugacuuuagggacaugaacucaagccaaagaauguguguugaauagacaucaaagauuuuuaaucuaggaagguuguugugaaacagaaguagaauggauuggggcauuuaaaguguuugagucuauaaagagggagcugagauauuuugucuugguuuagugcacagaucacauuuagaaugguagcuggcauuugaguaggucucuggggcagaaguaucuaccagaacuaugauggagguguugcccauaugcuguucuacacuauuuggcugugucagcugcugccccugucucagcccaucccagaugagagucgaaguuuagguuuguucuagcaaguugggaaagccaggagggaucaugcaagcuuuguuugcuuugaggauagaacaugcaagcauugcaggauguuaacauggaagagucugcugaaauaguaagacaauagauaucacaauucaaagcaagggucuucaguacaauguaauauuucuaaaaggaaugauagaaaacaggcuagaugacccuuaaaccccucauucacauuuugaauggagaagacucaggaauuagaagcuggugaagaaaaguuuagagaaaacugcucuuuugccuguguguuaccccaccucugcccucaaggaagagaugggagggcuuggacuuuaacuuaagcuuaggaaaagagguuucaaggggccuacauggagaccuuagugugugucgccugcaucugaggaacacagaauaaucuaagggcaagagauagacugacuaguugcuugauaguggcacaaugaagaaguguucaugguaggaggccagaucuucuggggucugucaggccaaugagagaauauguggauguuuuauuuaaaccagaaauccagaagccagaguauaagcuggcauagagucaucuuagaucccauugaagagagugguccagagagaagccaggugacugcuggauuucuaggggaugaguacaaagaaagcaaccagccagagaacaguugcauuuguccugccaaggaaauuuuggaugaaagaucuccagaaucucagaggaacuauguuagagcucacaagaaagucagcuuucaacaucugcaaaaacagagauccaaaauucuaaccuuauggaagcaccaguugaguagaaucuucugcuccccuaaccuacucauccuuacugagcuugaacccugaagugguugaaacugucauaagccaaaggaggaaggucaaauaggagggaagagagagucuuuccucccuugacagacccaaauuauaagagggggaaaagccucaagcuaaaagcaaauuugaaauuuugacuauuacaugaggcuggacauuuuaaugcuaaucugaaguuguaauuuaugacuugaagugacccuagaacuguggguacuggaucagaaaauucuugaggacuuccucugucccugucugaaacaguaggcuugguccugcagagcugacugaaaggggcauugggaggcaaaaauuguuuccugcuuacccucuguccugcuuguucagcaugauguuuacaagagaaugauucauuucuauuuaguaaaaucuuaccucuccuacagggcugagugccagaugcuguugauuuucauuucaaaauuugauuucucuaaaauaauacccuaucuacauuuuacuuccuccagagguccuugucugaccacuucaguuagaugugaucucagccaccauaaugaauguuugcccuuuuuggccacugagcaucagaaccaccgcccuaugucuaagaaaugucuucuuuaugagggggagccagcauccaggaauagaaagugaaaugccagguacucccauuccagccuccuugcaucucaugugcaaacauguugccuaaaucagaaaccagcaguagaaagaagcaggggcuguccacaaucuauauucuggugacaggcaguagcagaagcuacauccaauuuccagaggcaacaaugacagagaauagugcccagaguuguuguuggugaagcuugcaauauuugugcccagugguggccacagucuuugucagaccaguucugcgguaugaauuugacaguaguuacuggaucuguagccaccaagaccauagucaucagauaauuuuggauuuacaaaaaaaguugcaaagauaguacggagaauccccagguacccacacccagcuuccuuugauguuaacaucuuguggaaccaugguacaguuaucagaacuaagaaucuacuauugguauaacaguacuaucuaaaccgcacacucuauuuggauuuccagcaaaaccacaaucuugaacauugaacaccagggcuagcaacaguaggaaguuguuacuaccgcucauucagaaaggauaaaaggaaggauugguuccuggaucguggagaguauggcugcugggagcugugaccuucagcagauagagguagccagccuugcuagagcacgggagggagggagcuggggcacagguacucccaugucacccucaggccuuuuucugaucuccugcccauggccuuuauugacugaacccaaccagaagccauagggccagcuugcucuugauucagcccacagacagcagcuucccaggguagacagcaggguagacaguggauuuggaggugcacauggaaggcauccaguacaggacagacagcugauguguggccaaguaacccuagaagcccgcuuuccugacuugaaucaucaugcuacuucuaccucaccacacuguugccuucucauuuucuccucucuaggcuaagguucuuuuuguuacagaugaaaggaaaagcuuagaguuuugcaaacugagaggggcucauuuuggucuacauuccacacacuguaccauacagaaaguccugggccuucucuccugcuuuucuuggguuuccucccagcucuggaagccagaagucuaucuugggaccccuccauccugacucccgguggcccuacuucuagauagagggcuuugcugagcaguuccuccuaaugagcacaggaaagcccccaauaauuuuugugcaugugugcaaugg

SEQ ID NO: 17422 - RNA, 28123 nt, Homo sapiens
cagcgcggcagucggcgcugcgaaguggaggcgcugcgagcggagccgcgcggagggcgcgaccggcugguccgggcagcguggguuugccgccuucggggcuccaguccgcgcgccagggcucgagcaguaccgcgggccccucaggugggccucggcucgggacgccgggagucgggaccgccagucggggcgccgggaccauggcgcugcgcgcccgggcgcuguacgacuucaggucggagaacccaggagagaucucgcugcgagagcacgaggugcugagccugugcagcgagcaggacaucgagggcuggcucgagggggucaacagccgcggcgaccgcggccucuucccggccuccuaugugcaggugauccgcgcccccgagccuggcccggcgggagacggcggcccgggcgccccggcccgcuacgccaaugugccccccgggggcuucgagccccugccugucgcgccccccgccuccuucaagccgccgccugacgccuuccaggcgcugcugcagccacagcaggcgccgccuccgagcaccuuccagccgcccggcgcgggcuucccguacggcgggggcgcccugcagccgucgccucagcagcucuacggcggcuaccaggccagccaaggcagcgaugaugacugggacgacgagugggacgacagcuccacgguggcggacgagccgggcgcucugggcagcggagcauacccggaccucgacggcucgucuucggcgggugugggcgcagccggccgcuaccgccuguccacgcgcuccgaccugucccuggguucccgcggcggcucgguccccccgcagcaccacccgucggggcccaagagcucggccaccgugagccgcaaccucaaucgcuucuccaccuucgucaaguccggcggggaggccuucgugcugggggaggcgucaggcuucgugaaggacggggacaagcugugcguggugcuggggcccuauggccccgaguggcaggagaaccccuacccguuccagugcaccaucgacgaccccaccaagcagaccaaguucaagggcaugaagagcuacaucuccuacaagcuggugcccacgcacacgcaggugccggugcaucggcgcuacaagcacuucgacuggcuguacgcgcgccuggcggagaaguucccggucaucuccgugccccaccugcccgagaagcaggccaccggccgcuucgaggaggacuucaucucuaagcgcaggaagggccugaucugguggaugaaccacauggccagccacccagugcuggcgcagugcgacgucuuccagcacuuccugacgugccccagcagcaccgacgagaaagccuggaagcagggcaagaggaaggccgagaaggacgagauggugggcgccaacuucuuccugacccuuagcacgccccccgccgcugcccuugaccugcaggagguggagagcaagaucgacggcuucaagugcuucaccaagaagauggacgacagcgcgcugcagcucaaccacacggccaacgaguucgcgcgcaagcaggugaccggcuucaaaaaggaguaucagaaggugggccaguccuuccgcggccucagccaggccuuugagcuggaccagcaggccuucucggugggccugaaccaggcuaucgccuucaccggagaugccuaugacgccauuggcgagcucuucgcggagcagcccaggcaggaccuggaucccgucauggaccuauuagcgcuguaucaggggcaucuggcuaacuucccggacaucauccacguucagaaagguaaagccuggcccuuagagcaggugauauggaguguauugugcaggcugaaaggggcgacuuugacagcaguaccacuguggguuucagaaucauauucuacaggugaggaagcgagcagagacguggacgccugggucuuuucccuagaguguaaguuggauugcucgacaggcagcuuccuccucgaguaucuugcauuagggaaugaguacucuuucucgaagguucaaagaguaccuuugaugacagugcuaucauuuuagaguuugaauaguugaguaaugagcugcucaaaucuguaaucuugagacgaggguagaauuagaaggggaccuaaaccauguuagguaucuguuugaacacugcacugucacuuaguggugaguuucaaaaagugaggaaauaauggagaagaacggaugucuguaaauagaaaucugcuuucacccuuccacaccucucaaucucugcuuugguagaggaauuaagaucaauucucugaguuuaagaaauuccugcaaagaauucuugccugcaaccuuuacgaagugaaguaauuucaggaaaagcguacucauuuugaguuugaaaucuauuaauguacugaaauugagaacguuguuuaggaaaauuguuuagggaaacuacauagaaugaauauaaucugaguauuggaucugagagcagcguugcugguaucccagugaguuagcuguccaacuaucagaguucaugaguuauuaauaguuguuagugucucugaccuuugcuaaagcaccagaauuugcaaauuaaaaaaauauauagcaguagugcuugucuuaacauuucuuacuaaugugcauucucauauaaugccuugauugagagaauggggaggugugggaguuagggaggcagucuugccugugaaaguccaguguaggggcggcugggcagggaaaccuacuccugagcagggaaaccuacugucccuguuuccucagcgggucuggccuuuacuggugaagugcucacugccuuucuggugggccaguccguuuaugagcaacccugaucucuggcaugucuuuucuuguauugaacugaaguuugccucccuugauugucuuucuguucccugggaccgccuucagacauuuggagacagcagucucgcuuccuuccucucugcuucucuccuuccccuuccaaaugcgugacuggucuucugacuccuaugggggaaggggcuugcugggagaaugaucaaacguuuucagucuuguugcugccgcugaaagggaguacccuggacaucaguacuaauuuuaguagacaguaguaacuuucuuggcaauuugcgauuuguaaaugcagucuaauauugaauucguuuuuugugcaaucauauugcuguuggccuguauuaaaccuguauuuacauuaccuaugccuuuuuuuaaaacauaaauuguuaugaaucuuugacuuuuuugacugguguugguggaacugccuuugugagccuuuaauggagggauuuagcauuuaaauuccauuguguuacaucauucuggaccuaugcuggcugcccuuuuacacauuucugugaguuugugcaaauuacuggugaacaguugaaaggauggaaccaaguacagacacuuggacaugugugcugggccgcuggugucugucuacuuuagguuggcaucaguucauucacugucaaucacaccaugcacucaggcuuugucaaauggccugcuuuugaaauuauauauuagaaaagguaugguguguguucuaauaucuauuuugaguuuacagcaauggucuacuuagucuauuaaaccaucugguuauggccagggucacgccuguaaucccagcauuuugggaggucgaggcaggaggauugccuuaaggccaggaguucgagaccagccugggcaacauagggagacucccuugucuacaaaaaauaaagaaguuagcguggcaugguggcucauaccuauaguccuagcuacuagggaggcugaggcuggaggauugcuugaggcuaggaguuaauuugagguugcagugaggcauaauugaaccauugcccuccagcuugggugacagagcaagacccuguguccaaaacaaaaaauauauagcuuauuuacuucuuuauuuauuuuguagagacaggugucuugcuauguugcccaggcuugucucuaacucuugggcucaagcaauccuuccagcucagccucccgaagugcugggauuacaagcgugaaccaccaugcccggccuaguuuaucuuuuuuaaauuauagaacuggauuugucucuagucacuugggauuugaaaaacuuccuucauuaaaaccaguaucauuuuauguggcuuaacagauucaagagcacuaaacauaaucucuaggaacuuuggaaagaacagcaguugauauucaguauaguuuguuucugcuguaaccuugguguguaauguacagugaaccugugucccuggaugacacaucuuuagaaaauacuaccauuuaaagugacagugugcgauacauaaggcuaaaagcauuugccuauaaccaguguuuaucaaggaugcuaguguaggccauuuuuaggaguauagaugagacaaacaucauaagccaggauaaaagcuuucugagcguauucaggacuugugguuguaaagagcaucucaauuccgucaccuccccaaccccaacuguuacacacuugaaauauggcuaaugugacuaaggaacugaauauuggucaacagaaaugauagaacuuuuccaucagugcugaaaguucuauuggacagugcuguguuaaacugcuggcugcaguuuaacuaucaaccccaucguaaguuucuccagcaaauuauuauauuuuaauauaguuuccugauagcuuuauuuuuacuuggucaucucauugcaccuccuccuucccauauaggcuuaauuaauaaaaacugggaagggggaagcaaguccugcuagauucuucuuugcugaauuucccaagcacucaaccugagugacauuucaguagcgugagcaucucuugcagugugccuuuaugucccauucagaaaacacauugguuacgggauggaugucugaggccauccuggugagaacccagcugcaaaaugaggguggaaaacucaaauacucuuaaauguuggugggcugaaauuuuccugacuauacuaaauacugaacccauucuuuaaacuaauaaugguuuuaguguacauacuuucugcagaagugaagaaagcgauauacuuccuucagccaaaagagaauucuggaauuuugauuuuuuuucaucaacggauggagucuaacuauuuagguuaauggaguugagcgaagaaagacgguaguuugcuguagucugcgguacauuagaugggaauucagaaucuauuggaauuuuauuuguguuuugcuuugaccuaauaggaguccuuuaaguucuuuguucauagguagcucaucaaucccugacuaggcagugugcagauguuugucacugacauguaaccccuguggucuugauuuuuuuuuucuuaagugauagcauuuuaucuucucccuccuuaucaugccugucugcaguauaccuuuauaguguugauguugaggaguuuggguaguacugaggaauauauuuuauuauuaguuucuuggcauauucaguuuuguuuccaaagauaugaucaaucucuaauauuuaauaaagcuaaaucuagguggcagcaaguugagguuuaaaagauuuagguuuaccucuugcgacuauugcuaaaaggaagacuguaaaagauuaugagaaauacugguuucauccuuguuuaggaauuuggacuaaauaaaaauggcuagagggaguuccuuuaagugaaaugucuuucuucuagagaaaagguguaaaauaguguuaaauugauuugucgauuugggcugugugaagcagggaggcaggacuagauaaguaaauaggcaguccuguuuucuguacucuuaaauauacagacucuacuucaucgcucucuaaauguuccagauggagccuuuuuucaauaaaagccccaggaccucaggaaugguauaccaguagugggccugucagucuugcuggguagaauuucaccauugugcuuccuuuuaccacuaguagaguuggccugauguccuucagacauuaauuaaagauagcuggagucccagcagggcacacaagguaaggcugggccacacggagacccuucccugucugcuccccauucuccuguagcuaaaaauagcccugaaaggguggugccaggaauacagagaaaagcucuaagaaguuggggcuguuugcaaauucauccuuauuuuugaaaccucugggcuagaaauugaggcuguucauucuuuuuguuuucacuccaucuuuaguugaacccauuucuccucuccccugcauuuacccccagcuguucucuaaaaagaccucaugucucuaaaaagagaacaggucuggggcuuacccuuugccccaguuuguguuuucuuagugaaaauaaggugaccguuggugcuuucgaaauacacgacucaguuccuugguuaaaauauaaaugugacugcccaaggacagucuugggcacgaaacugggugugggcaccgcucauaccacaccgucagggguuucucagacuucuuuuuugagccacauagccuucagagucaugccgaccacagugggaccgaagggaggcagaggaccugcacucccacccuccucccaguaacucagggagccuaugagguuuccuuguucagcaauguuguccugucuggccaucuuaggacuucuaagcauaaugccagaacccaaacaagugagaaguucugugauucacuuacaaacacuucccuugaacuauuuaauauguuccuucucuuugggcugaauaaaaaacuauuauuguauuaccccauguauuuuuaaaucaaaguuuaaauaucaaguuagauuuaauuugccauauauuuuugaagcucuguaucauuaacuaaaggauuauaaaguggcagaguaaugcugagcucuguuugacaagauuauauccggaaggcagacguguaucaugucucauauuuauacaacacagacuagaaucuggccgcucugccggugucugcaggagggcuggguaggccucuggucuuaagugaguuauuugacuagcuacagagacaggucagccagccucggcaguuccuugugccaggauucugagagccugguggaugggccagucugccccaggaguugcaccaaggggugggacugagcugggucugcugaggaagcugugccagugaaggggcagcaugccaagccaagaagccgugggugcagagccucaucgcagugggagcuggccugucgggaccagcaugggcucuggagggccagugugugggcauggaggaguuuuggacaagcuauuuuaaccugcguaacgcucacuuaucuuuggccaagugggggcacuuccucacgaggucagcaugagaauuaaauguuauaguucauaguagcuagucacuaaauguuuauuuuugaaaaauagaugggugaauuuaaaaggagaugacaaccaggcaugguggcacauggcuuuaauaccagcuacuugagaggcugagggaggagaaucacuugagcccaagaguucaaauccagccagagcaacacagugagaccuugucucuuuaaaaaaaaaaaaaaaauuaagggcgcucuccuuugaaggacaauuccaguaaucuuaucaucccuccuggcaaccuauugccaccagaauuguaggcaaaaguacaaaagcucaaggagucuucagucuagcaauuaaauaucugcuuuaaucaguucgcccuguauugcacaccggaaguaauggcaacugggauaaauguagauguuguuuggagucaaucguuuguuguuguucacauugaagaguguauguaaacugucuccuccuggcuccccucuaacccaaaucacguguucuggugcagaucacuuaauguuucugagcuucaguuuccucaucuguaaaagugagguucauuauuuccuagguacuauuuuguuaguugacuuuuuuaaaaaaauaagaguagucuuaaguauccaggaaacuuuuagacauuguuucaggcugauuuuaauaguguucucugucuacuuaugugacuguuuuacgggagcaugaaaagcccuuaucaguugaugugaaagaacauuuaugcacguuuaguucagaucagcaaucacgcauugcaggcuuaccucacuaggaacuucgaauguaaaagugauuaauaccuggccugcugcugccuggugaggguucccggguguucugaagcugugguaugguagacagcuggagcgacuucucucugacccaaauuaauaggacuaccaaagagauaaauuaugacaguuuuuuaaagauggagucuugcucugucaccuaggcugcagugcagugaugcgaucucggcucacugcaaccucugccucgcgaguucaaaugauucuccugccucagccgcccgaguaacugggauuacaggcaugugccaccaugcuuggcuaacuuuuuuauuuuuuuuaguagagacgggguuucacuauauuggccaggcuggucuugaacuccugaccucaagcaaucuacccaccuuggccuuccaaagugcugggauuacaggugugagccaccgugcccagccucugauauugaucuuauagcuugauuaaacuuuaauuugaaugaguuuuaguucacuugucauuucuguaccuuuucuuaugacuuaucugucacugugauuugacuuuccucuucugcuaaauaaauuguuauuuagcagguaaggggacagugaaggaaggggagauaaaaucauuagauuuauucauaggacccucuaaaagauaaacuagauuuuauucaacaaauacguauguacccaucaucguccaggcacuauucaagaugcuaguguugcaucaguggccaaaacaaagauccccacccuuguggagcuugcagucuagcaggguggagacacucaaugaaaaacaaacacaggagguaaguuuugauguauguuggaguuugguaugugcuaggagaaaacaguagagcagggaaagagggcaugggaggcaggaugaaguacuaguaagagugcucaaaguaggucucauugagaaagugagauuuaagcagagaccugaaucacucuggagucaggagagucguccaagcagguaucucgggggagagcuuuucaggcagaggguuuagcuaaaguaaggcccugggguggacaugugccaggcagguugaggaacagcaaggccaggugguugaaguuaagaggauccuaggagaugaggucauggaaagucagauuugcaaggcuuugcaggucacuguuaggacuuggaaugaaagcccgagucagauggaagcaauuacaggauuuugagccaagguaugacauccaacuggacauauuaacagacuuaguccagagcaaugagaauagaauggcguguggcagucaaagguggauggaagcagggagcuaguaggaaauacuccaguaauccaggugagagaugcugguggccuggaccagaguggagacaacagaggugguggucggggagccgggggggggggucccccuccagcuauauuuuggagguagaaucaacagguuuuccugagagaugggauugugaaggaugugacaugcaagagaaaggggagucaucaagggugacuguaauuuuggccuguuuggccuggccuacaauaagaauugucagaacagggguggggagcagcaaucaggaauugaguuuucuccuuuuagguagaucaggcucaugcauucugcuccaugucuccccaccccaacacaagcacuuucuagcuucaggucuaguccccuuccuuggaguaucccccuuggauuguaguccuuuugugaauaauugucugugcggugcucaguuauuaguguguggguuauguuuuuauguuccuguguuguauagcuguuaacuacuguuuuauacaugcauagcaaguacuuaaugaaugcuugcugaauuaaugaaguaggcacucaguagcuacuugguugaucuugaaauagauuuauaagauguuuuuguuuuuccauuuauaugaugauggauaacagucuaaaguguacaggaaauaaagauagaaucuagauguauuuuauggaugaagucauuaacaugugagugauuuaaaagucuuagaguuuuguguuuaugaaaugacuuuacauaauucauuggggaggggaggggaaguuugaaaaugcuuaaagugccagagaauuaauauuguauaccucaugauuucacuuuauauugauucuugguguuuaaacuuacgcaugcauacacgcacauacacacacacacacacacacacacacauuuuccucauuaguaaguuuuaguuauaacauguuuacuggggucucguuugcuuaauucagagcacaagauccagagaauacauucaccuuguugcuugacuuggauacacacggagcacugagcucauguguagagcaguagguacuugcccucauggaaggcccacucaguuccuugagagagguagaaugugugcacagaggacugaaauaaaagguagauuuaacuuaguacugcgaauaagacagugcaugggaguccaggugauagagaggaauugucaguuuguguuagaggcuugagugggcagcauuugaauucccccuuugaaacauggucacagugugacuuuuggaggaguguagguggaaagcgcacuccugaucuugaaaugcuuuaggauagguuugauaagcauacaguaauugauaagcaagguacccggugcucaggucagugaagggaacugaagugaggagcugucacuguaccguaugacacacagucguggacaugcaccaugaugugaaguaggacagaaggaggaguaauuaugggcaguggauaggaagguucagagguggcuucugccagucucagucuaagaagaguuuugaaaacaaguggaaguuugccaagccggcagagucggggaagggcagucugggccgaaccauaugggauccgucuuggcugccucucagaaccagccgcugaggggauacagcagaaaauggggccccacccuggaugugaaucggaaugucugugcugccuagacauugguguucuuugaaaagcuccucacaugcuuuugaugugcugcuggguuuacagcugcuguuggaggugauagcggaaacacggaagaucaaauggggugccgacauggccaggccugcacuuaagauggacagguccugguggcagguguagaacgugguuggggguuaagugaaauggagaguaauucaguaauucagacaagacgugauaacaucuuauugggggcaguguccguggcggugggaggagaacacagaaggggcugcuugccugcagaguaggguaagggauagggagaaguacaaaauggccugcagauuagagucucugggucaccaauagagaugccuggagauggccuggagcggggucugcagacuacagcccacgggccagauucacccaggcgccuguuuguuacagugcuugagcuaagaaugguuuuuguauuuuuaaaugauucuguguuuaaugguuguauaagucccuacauaauaaccucaauuuucccucuugaccugcaaagccuaaaaugcuuacugucuggcccuuaaagaaaauguuugcugacccuugacuuggaugacaagcagguuaggggaguggguguggcuacucuuuauugaguacuuacuacgugauaggcaguauuccaagcauuuuauauauguccuuuuuuuuuuuccacuagaaaauucagaagcgauacauugucuuaauucuaugcaggaguggguaugacagcagugugguuguuggcaugggcuaaaaccagauggguuugaguuccugccagcuucacuguguaaccuugggccacacacuucuuaaccucuguuuccucauguguaacauggaguaacuauguuauuaauacaauagcugauaaugcugaaaaauauuuuucagcauuaauuaucagcuauuguauuaguuuccuguggcugcuguaacaaauuccuacaaacugggugacuuacaacaacagaaauggguucucuuagaguucuagagacgagaagucuggaaggacaguguggcagugccaugcucccuucagaggcucuaggagagaccccucccuugccucuccagcuucuggugguugccagcagcccuugguuuucuuugcucugcagcuguaucaccucagucugugccucccuccucacguggcauugucccugugugucugucucugugccuucucuuaaggacacccguuguccuagauuuagggcacacccuaaccuagaaugaccuuaccuuaacuaauuacauauucagagacccuguuuccaaaaaaggucacagucaaagguuccauguagauuuuagggggacacuauugaacacagcgcaguuuuuaacucccccaaaguggugucaucucauuugguggcugugaaaacugaggcucagggaaguuaagugauuuccaggcucacagagcuaaugaggagagcuaggauucgagugcauuauuugccuuaaguugagacugguauuucuuacgcuacaauauauaacaugcuuguuagaaaauugacuuauucuacaggcagucagcagccacuaaagguuucaaaccaaagagugacguuuaaucauaaucaaaauagcuaucauguuuugaagacuuccugagugccaggcauggugcuuuguguuuuauauucauuauaucuauuuaagcuucagaggagcuuaaaaaaguauuuaccucaaaaaagcugagguaaauacucuucuuauacccauuuugcagacaggagcugaaccacagaaauuuuuuuuuuuuuuuuuuuuuuuuuugagacaguuucgcccuuguugcccaggcuggagugcaguggcgugaucucggcucaccauaaccuccaccuccuggguucaagcgauucuccugccucggccuccugaguagcugggauuauaggugcccgccaccacacccagcuaauuuuuuguauuuuuaguagagacgagguuucaucauguuggccaggcuugucucaaacuccugaccucaggugaucuacccgucucggccucccaaagugcuggaauuacaggugugagucacccugcccauccaaaccacagaaauuuaaacugcgaguuccuggaagcauccuucacuggugcacccuggcucccugaggcagggcuuuuggaaguuacuccuguugguugggcagagaugaggaggcucuuagaguacuccaggggaagaguuggcuuuggaaaggaacaggugaacucgagacaccugccagguaucauggcaggaccuggugaggcgcuggcucuccugaggaaucuaguguuaccuuagagguuuuaaguuugggugguagaaaguagugaagccagugauagaagagguaggcagacugagaagaggagcaggacuaaaaggaaagacaaggaauggggcugaagggagucuuagaaaauccuuuuucuuuuauuguguuuuuauuguguuuaguuauguugacauuugcgauuuucaccaaagccacguguugucuacagcaagacauuuuuaacuaaaugcugauagauguuaguguggauaaucuguaaauuuucacguuuuaugauuuguauuucacauauauuuuaaaacuugauacaauuuuagaugcuuuguucugucuuuaguugguuauuuaugauuucauacaaggauguccggauguggucagaguaaagacucacagccaccggacaccugggcccugccagugcgaggcagcgggaaaaccacaggagugaggcguguccuuacauuuaaaacagcugaguuaggaauuaucuccacagccucgugaucgugaagggaugugaagcagcacucaggauaacgaagagugcuugugcugcucaccagucgguaccaccguggcauacauggcaauugggacaauggaguuuacaauuucagacaaaaacuggaaaauuacuugaaaacgagaaaugcauuauuugcagauauucugcuaacuccagcaugaaccacagugcacucagauagggucccauaagugcccuggcucugcgugugugcucuaucuugccuugccuuggcuucucucguaaagagcaggggccacuuuacucucuuccuggccccaucuagagggacuucuguuuagauuuauuuuagcagcuucuauuuagauuuauuuuggcuugggucucccuuuaucuuucuagaaaaaaagaaaauaagguuuuaccuuucauuaaagguacuuucccaaguucacucuuugguacagauaugcuuguuguaugucacgugucgaaaguguuggcagcuugcaaacauaucuauuguugcuuuuuuuuuuucuuuuuuuuuuuuuguagagaccaguaugcgugcacaugccucagguaauuaaagaacugggcacugcagaccugaggccccuauuuguguucucugaauuugaaccauuauauggguuuuacuuuuacaaaguuaguuuuuuaaaaguuucauuguauggucagcauuaucaaggauaguaugucuaccuuauuuuauuaagauucuguggguaucagaucuuuaagaaaagaaacaauacaugguuuucuuucuuacucucaaauuuuaaagucuucaucuauauuugcuuggcuacaggcaaaucaacauugccaccauacccaaaaacacuucucaaauaaagacacuguguuuucagaauucuccugaaacuaucacccuaguaauuuuaucacguuuaauauucauuaugggcuggaacacaagaaccuuuauguauauaaaauuaccagcaagaaacaguuuuaccaaauaaaccacaagagguacaaucaugugauuucucucuucauuuuuggaaugagguaaacuguaugacuauauaugcauaguaacuaaaauaaucaucuuuuaagguauuuauacgcaagugaauauuuguauucaaacugaaugucauucugccuuuagacauuaggugauugcugaaugaagcuauaagaacuacuuaauuagaauauuauaacaaugcuuuuaccugaaacagacuaaugauauuuucaggaugaaaucaagcuuagaggccugaauucuuuaagugauuuuuuuuccaucaagugaccagguuuuuuucuuuuugcaguugacuaugcuugucuugauccucuucccuccuuuucaaaaugguucaaaaguucucuuugucauuuauuauauuuaugaauuaaaaagugaauuuuaaauuaccuuugaauuuugauaguuauuagcuuuagggaccuucauuaguccauucagaaaauugcuuucccugacuugaguucaguauuaauuuuguacccuccaggguuuauuaauguggucuaaaccuggaacccacuuaguaugaauccaugcaggaauaguauuuagggucuggaggugguuuguggguugcucaucccuauguugguggcauaggcuccuaggaggcguuggguacugguguagugugcugugcuuugaggccgaucuauggggcuuugcgaucgccauggguaggguauccccccuugggccacauacaagggaauugccugaguugggcagacccagguucacaugcagcuggacacugaguaaaauuauuuaguuucucugaguuucacuuucugccucugaaaaugguggcaaugauuacuuuuauuucacgguuaaagagaagaaaaugagacaugcgaagugcagagcacaggugugcacagugcaggcgcuucucugugaugaucaaguggcuggacggcugcccuaguucucuauuuuaaguggaugcuggccuuugcuuuuugagacauuuugcucaaaacaauaugaaaaaguaaauauuagagcagagagggggaaggguaaucaacaaguagguggagaccaacagggaggaaggaaaggggaggggaagaaguuaauggggaguuaguagggaaggccaggguguggaucccagcaaugagaggauaagaacccaacaggccacgcugaccaaauuagcauuuucuuucagcauguuacgugugccagggaaugaagaaaaacaggccgaguccagucuugagcgacuucuaagcagcugucccugcugcccuucagccugucuccuguucuuucccguacaccauggcuucuguuuccuggggaagggccccuggaagacagaaaucgaguuaauguuuuuggcacauucaugauuucaaaauuaaauaaggugcuuucuuuuuucuuuuuuuuuuuuuuaagggagaaaauguagccuuuggauuccuguugcuuagugacugggccuuuuguauaauuagucuuagaagagacaaaacauacugagaauaagagauuggauugaggaaaggaaggcaaaguucagguacaaggacuggaugggguuggacugggagcucuuggagccauggcaagcccuguggggaccugaguuugggggcaggcagaaagagggaaaacgguaaggaggccagacagcuucuuuaaagggagggcagggccuugccugguuaaaauggcugaggcaguacaguguaugagggcuuuuuuuucuuucuuucuuuuuuuuucccccugucucacuuugaugggucagaaguuuccaggaaaguucugguuaaaaugccugaggcaguacagcguaugaggauuugcuuuuuuguuuuguuuuuuuuuucccucugucucacuuugaugggucagaaauuuccaggaaaguuguucucccugcaaaugagaagcagaggaacauggaacagagaaguuuagugcagugcaaguacaucugcuagugugcugguugaguuucagcuugcaguguguucuuaauaugugcucaugggcuacaugacucgagagauucacuacucucauacugucauucuagaaaaaaauuggcauugaaauccuaaguguuagcguuuacugauggaaauaguuuaaugauaugcuguguaaauacugugaugcuuuugaacauggugcugauuucuaauucauaauuuauaaaugauuuuuaaaaauuugagccuuuuaagguaauauuaaugaaccuugucacaugauuaaauucuuuuguuuucauuguuuuauauucauugcaaacaugaguaacauaauuccucuaaaauugagaauauauguauuauaaacaaagacauaguuauuucuugcuuuggucuuuucagccugagcauccuuuagaacugcgagauggcuuacauugguuagauacaaagaaaaaagguaggaggggauagaagugaauuuaggacauucgauuucucuggagcuaggacuggugauggagaaguggggcaaaguaccuuucucugagcuugggaaauugcacugauaugaaaaugagcccuguugggaauuuuccagguacagaaucagcgugggaaucuaggagguuuuguuaauaacaaauccuaaagcaaaguaaaaauauugguuuaauuuuccuuuuaacucucaaaacauagaaaggaaaggacccuuuucaacaauguaguagggucaagucuccaucucaggccucaauacacuaauccacucaaucugugcccacaaagaggguaauaggucuccugaaugaggaugcccugcuuggaagggagaaugggacgugccagggcuggcaggcauguggagguggggucuuugccaugaauuagcugugggacuuugaacaaguagcucacccucuuguuuguagaauggagagacuuguauaaaaacucuucuaagaccuuuuuagcuuuauuaaaaacaaaaauuugagagccagcucugcccuucuuaccugggagguagcucugccuugccuuccccagagggcaucuccaggacuggagugugggaaggugcccuugggcuccugccucucauuuaggaauuagaccucaggguuauuaguuccugagugcacuuucuguccuguggaagaauucgaguaauccaccaaacuaauucaguaauuaaguugaacucucaaccaaaacuucacucucaacagguaaaccuagagcuuacucuaggauccuuccugccuccuucacagagauccccugaagaagaaauagcugcaguguguuggaggcucagccuaggcggcacucugggcuccuuuugccuguucgguaucacuguauugggaugugguugaaaucgauugccucacuuuaaauaauuauuuuuccuguacuucaaauucauuuuuuuuuuauuauacuuuaaguucuaggguacaugugcacagcgugcagguuuguuacauauguauacaugcgccauguuggugugcugcacccauuaacuagucauuuacauuacguauaucuccuaaugcuaucccuccccccucccccaaccccacgacaggccccggugugugauguuccccuuccuguguccaaguguucucauuguucaauuccaccuaugagugagaacacgcaguguuugguuuucuguccuugcaguaguuugcucagaaugaugguuuccagcuucauccaugucccuacaaaggacgugaacucaucauuuuuuauggcugcauaguauuccaugguguaugugugccacauuuucuuaauccagucuaucauugauggucauuuggguugguuccaagucuuugcuguugugaacagugccgcaauaaacauacguguguaugugucuucauaguagcaugauuuauaauccuuuggauauauacccaguaaugggauggcugggucaaaugguauuucuaguucuagauccuugaggaauugccacacugucuuccacaauaguugaacuaguuuacaguccuaccaacaguguaaaaguguuccuauuucuccacauccucuccagcaccuguuguuuccugauuuucuaaugauugccauuguaacuggugugagaugauaucucauugugguuuugauuugcauuucucugauggccagugaugaugaacauuucuucaugugucugucagcugcauaaaugucuucuuuugagauguauuuuucaggcugggcgcugcagcuuaugcuuauaaucccagcaguuugggaggcugaggcgggcggaucacuugagcucaggaguuggagaccggccuggacaacauggugaaaccuugucucuacaguuuaaauuaaauaaagagagagagagagaagaaaauuucuuuucaguuguguaacuuggagaggcugcacuacuucauguaugaauaguguuuucuucugaauuggaaacgguacuacuuaauuguuagguuuuuuaaagaguauauucacacuggucuguauugucagccgcuuuuuaaaucucuauuuaaugugcaccugcacuuucuuuucauaauaaaaucguaauaugcucaugcuauuccagaugcagcuaacuaaugaagcaguuucaguuuacagugacauugucguuggaaaauguuuuucccucugauuauaccuguuuauuauuuucuuucaucuuaaagcuguuccccuaacuaugaguacugugggaucuuuuguuuguucuaacagugauguuuuugaccuuaaacuucauuauauaauugcucccccauucuuucauuuccgucuucuguuuugaaagcagagugguggcaauaugauguuuaugaggggagggggcuggcaagggggcauguuccuccuaaauuagccacuuaaaaagcagagcuuucaaugcuauugccuguuuucauauugauuccaucaugaaaaauguguaguccuuguguuauuuagauucugggcaacauuuuuaguuuucauuuacacuccucggguuugguuaaaaaacaaugcaguacagccaugagaaugcuuuaaaaaugcugucauacuuuguuacagcucugcagcugguuguauuguaccucugcaguuguuucuuaggcagcuacaaauuacuuaauuucuaaagcuauccuagaaguagcaagucuaugaugaucuaacucugcuccaguaguuuccgcuuccaacaugcuagagcugaaaauuuugcucucugccuuucuugugauauuuaaaauuuugaauaugaagauaauugugaagccugaaaauauguacacauaauucccaguuugagcagugucagaucaacuguaagaacccaaucauuuguaacaaaacccagauucuacuucuaauaauaauacuauuucacucacaucuagccaacacuuguaauauuguuucuauuggaaaaauauguuuccacuuucuuuucuagugaacucagagcuuaggagcucagugggcagaggcggguagagggaagcuuccugggaaccccagaaagugguucugcguguuaguccccaaguguuaaacacucaugcucucugucuguggaucacuugagcuguuuaaaagaugucauauuuuuuuuucuguuuacuucuagucagaacuagucaauugacuuccauaauuagcuuaccguuuucauagggaggaaagcacugauaccuuuacuguuuguuaaaagguguacagaaaaaacuaauuggaaaguugugagaugaauuuuuuaaaaaacaaauuacuuucuugggaaaagauguauauauuuuaaaacuuugcaaaguauuuuauaagagucaacuuuuuuuauuuggcuucagauguuggaagacccuuggcauugucauucugaacauuaacagccauucgcuucaauucaggauauaaucaggaacucucgauuuuuaauuuguuuuaaguauauuacuaucaacuuguuuuauugcuaaucaucuuuuaacuuucuuuugaagguggaucugggaaaaaaucaauuuaguuacauuucaguuaaaggaaguuauuuuuguuuuuuaaacuuguucuacauuuguggguacaauuuuauggagacauaaucuuccuugauuacacguagcucuccuuacucuuuaaauuuguacauuuaaaguaugcuauuuaauaccuucauugaccauuuuauauaguuuuuauuuuuuaauuuuuuagacagggucucacuuuauuacgcaggcuggagugcaguggugcgaucauagcucauugcagccuggaauuccuggacucucccgccucagccuccugaguagcugggaguacaggugugcgucaccacaccuggcuaacaguuucucuucuaaauaguuguagugcuugcuuugaagucaguuaugcauucagaucccaucucagccuccugcuggguuaccuggaugacugucaggcucaaagauguugaguaacuuccucaauuuccuuguaguaaaacuaggaguaaugucuguuguaaaguuguagugaagauuagaaacaguagauggaaagugccuagcauauguuauuacuauuucuagcagcuaccauuuacuguucagauauucuauucccugcccuccacccugccaccauccauagugcagugcugggcauguagcaggcccucugagcauuuuccguugucacauuggucacguuaucuuggagaaagccauauucaacucccaugcagaauugugcuucauggaccuauuucacuuugcgucaggguagugugccugcccugacggugcuuuguggugugucuccuguuugaaucucccuguucuaucagugugcucuauacaugccagccuuuccauaaauguucacguuaaaauucucacccuggagcccaaccuuuuggggacuuuuaaaaauagcaacauuuuguguuauucacuuaauaaauucauacuugggaaaaaaugagucuuuggguuuuuuuguuuuguuuuguuuuguuguuuucuuguuuuuuguuuguuuuguuuuguuuuguuuucuugagauggaguuucgcucuuguugcccgggcuggagugcaauggugcgauuucggcucacugcaaccuccgccucccggguugaagugauucuccugccucagccucccggguacuugggauuacaggcgcccaccaccacaccuggcuaaaaaugagucccaaauucuucuuggcuccucuaguauguaugcuuaggaagcuugaagauauuacaugcuggcagauccuggggccucaaagagauguuaauacuuauugcuguaucugagacuuuggaaaauguaugcugauuuaauaaguuguaaaaacuuuagacuuguucuuuuuuuuuuucuucuuugagauaggguuuuacucugucaccuagcaggcuggaggugcagugcugugaucacggcucauugcagccucaaccuccuggacucagaugauccucccuccucagccuccugaguagcugagacuauagaaaugcacugccaugacuggcuaauuuuuuguauuuuucauagggaugggguuucaccauguugcccaggcuggucucaaacuccugaccucaacccaucccccugccucagccucccaaauugccgggauuuuaggcauaagccaccguggcaagcccuggacuuguugauuuuuaaauugguuguuacggauggacaucuguaauucuauauaacacagugcaguuugucaaaauauggugaacuaauuuggaguuugacaagcugcaacuuaguugacaaucacccaauucaaggccagguuucagagcuucucuauacuggacucuguucucuaugaugaaaagcugggcucuaguaauuagagcaaguaauacuugcagaauauuaccagugcaggcaacaacuguuaagacaggucaggaucugagcagggaaggauccugcguacugguccuuagcauuugaacaugggacuggcuuccuccaguaccuuggauugaaaucagaugaaaauauagucaaaucacuugagauuuuucucuuuuaauuuccuauucucuuuaucauuauaaaacauguauuuuaucgcuacacauucucagucuuucugaauuuuuuuuuccuuuaguuuuaccuguuacacuuuccuggucuuuucuuuuuuuucucucucucuuuuuuugagacagaguuuugcucuuguugcccaggcuggaguacgguggcgcaaucucggcgcaaugcaaccucugccuuccggcuucaagcgauucuccugccccaaccucccgaguagcugggauuacaggugcccgccaccacgcccggcuaauuuuuguauuuuuaguagagacaggguuucaccauauuggccaggcuggucucgaucuccugaccucaggugauccacccaccucagcuucccaaagucuuaggauuacaggcgugagccaccgcgcccggcccuccuggucuuuucaacuucaauuucuguauaugaaaugugaaaccuguacaaauauaacaaagauaaauguuuugcaauaaauuauuauuaauuuuuuauguuggggagaugucuuucucuucaagcaggcaaauguuagugcuuugcugauacugucagccacaguagaaauguuuaaagggcccuauuuucagagugauggcuucuuaguagaacugggacaggggucuuccucugucuagcagagugcauuucucugccauggguuagguggaagugguguggguggggcaugugugcucugugcaccugcaguacauguguucuuguuucaggacuuugcugcuuuucacuuaaaggucucauuuagaauaaaucaaugaaaauaaauguguacauaugugcacaccuacacguacauauauauggaugaaauuugcuguuggugcuuuuucauuucucaggucuuugaacuaugccaaaaaagcauacugcuuuacguuuaaggguuuuguuuaauauuauauuauucuuuaggagauuugaagaaauuuagaaauagggcaucuucccuuguauauuucacuauugggcaaaacaacauuuccgaaacaaagucucucaguuucuguaccuccuccuacucaagguuccugguucccuccucaguaguacuguguucucagacugccaagccaggcacucuagcuguuugucucuguguucugucuugccuuucaguaugguuuaguggaaugagugcuaggcacagucgggaaaucugaauucuuaagcuggcuuuguucaagugauuugagcuuuauuacuacucauuccuaagaacucaggaauagccuauuuccuaccccuaaacauccucaaacuuuugugucuuuguaugacugugcuuucgggggagggccugcguucguauggcaccugccggaguggucaauccuucacccccaccccugcaacacccucuguugauacuucuaggcaugagauuauggaaccgcuggcaucauuccuaagucaucauuagggcagaguuaacacucaccgauccuuauagucccaaaaaaggggcaaauucuuauuaaagcccuuguacuccaggugugggucucccgaugcaacgugaagucagaaucagacauguguucgcaauucaccccuucaccaggcacuuucugugugcugagcacuucagcuagguguuuacucuggaugacaagauaaugggcuaggccagcccucaugagggugaccuccaauuguagacuggcaacauugccaagcacccuccaugacugugacaugauuccaaaacacaaccuguguugguacuaacuuguuucagagacugguucuagagucugaauuauuuagugagacuuucugaggaaguggguuuggauccuuuaugggauguuuuuauaaacaguauaauucucuuaauauauguggaaauaaugaugucacaccuuuugagccugugaaaacugcaguuucuuguugugucuuuuuaaggacauuuccuugcaguuuauuaucaguuauguauagcaucucuacuuggaagagaugggauacuacagauucuuggucaauguaacaaacacuaguuuuugaagagaaauuuuaacaaagggaguguuuucagaaacuuuaccagauuccuucuuuuuuuaaaaugaguaauuaugguccucacuuuaaauuucaaagguauugaaaauaguuugggcaacuauuuauaaugcccaagauucuguuuaauauguaguuauguucuugggauauguggauauauagguuuuuaauuaauuguuauuuuuaacuacaggagcucuuaccaaagucaaggagaguaggcgacacguggaggaagggaagauggaggugcagaaggcugacggcauucaggaucgcuguaacacuauuucuuuugccacuuuggcugaaauucaccacuuccaucaaauucgagugagagacuuuaaaucacagaugcagcauuucuuacaacaacaaauaauauuuuuccaaaaaguuacccagaaguuggaagaagcucuucacaaauaugauaguguuuaaugacuggacguuggauuauggacuuuuucaguucaaggauaauuucuacagcagaauaaaaacugcugucaaagagcuauugccagcuaucaguggugguacaaggacgguuuuguguucaucugaaacccagcugaauuuauaauuauguaggaaauaaacaguuaauaugguuauauaauagaaacaguaccacacauuguaacuaaauuauacuauguaugccuacacuaccauuguaacuuuuggaauaaugauuauacuauuugccuuauugcuuuuugaaguauggguauuuuagugcauacuuuguagaccucaaaacccaugaagggucucaaagaagcuggcuggauacaagccugcuguggaugccuuuuuacucucauagauugggauuaccuaaauucaaccuauucucuguuuacaaacuccaacuagagcagcuaugcgaccuugugccuuuagacucuugguuuuucauuucuccccgucccuuccccaccuuuuuaaaguaagccacagcuuuucugauugaaagagugaaaggccagugcauauaaugacaaacugaugauaaccuuauauuggcaguaggggguggggggggcgguggggugggacgaucagcugucaucaauuugcacagcaaguauuaucuccugauaagaugcuggugaaugcaggggagugagauucauugcucaucuuuggauaugaagucuguuagggaagaaacagugccacuauucccuuagaugcaacaguagcauagccucuucacccaggcgucccaaaagcuuggcgugaagauuucagcaaacaugucuuacaacaugaggaggaggagucuaaaucagucaggggauaaaaguaucgaaucauugacaacacacacuuggcuuuaguucuuaggaggguuuuguuuuuguuuuuguuuuuagguugaagauuuucuuuuaauauucaguuuuuugaaaaaaaauggaucuacacuguuaacugauugagacuccacugugauucacuuguuuacuuaaaaacuuuucagggaugucuguaaauuucaguguuaauaugucaugaaaagugguguggauugaucuaaggagggaccagaaauaauuuuugcuauuccaaauacugaaggaaaaagauaauugauuuauacuauguuuuaaaaaaaaaaaagguauugaugagccccccccccccaggacauuuaaccuuaaaauuuauuuuaaauguauucuuuuauuauuauaagggaaauacagauggcugauaaauaccaaaaagauucaaaagcagcuuaauuuaaaaagcacaaagagauucuggcuuacagugccccaaucucaauguuuuuauaguugcugagcuaacuaaugugauuauugaguuuacagauuuaaaaauugucacuguuagaguaucuacuguuuuuaugaagucaaacuuaugcugccucagaaaucccuggguacugaaaugguaacauggaagugaagaggucacuuugaaauauuggugagucacaaagauuaaagaaaaggaucaguuugcagauacucagaaaagguuauugaaauaauuacugaacagcacauuuucucucuaaaaaguaguuucauauggguuguauuuuuaagaucagauuaucauuuugauauuuggucaaaauuuuguaccuuagguuacuuagagccagauuuaacaucaugaacauuauguggcuuugucuuuacuacagauauguggaacuguaaccaaauauguugucucuaaaacuuguugauugcaaaauacaguucuauaaacaaaacccauauguauauauaaauguuaauuuugcggaagucuggaaauuauaacuauagcauuuaaguuugagucuguauuggacaaauaagcaccaugcuuuucaaaugauuuaaaaauuacuuuuauuugccucuuuauuuugauggugguuggauuuuuuuuuuuuuaauaguaaaaucacuaaacuugugcaaugguagcauggaaauuaucugagguauauuguaugauuguacuuuagccaggguggacauagcuuaaauuauaaaaacuaaagaugaaaguacaaggaaguauaaguuauacuuauguaaguauaaauucaugcugccuacuucuaagagaaauuucauucuucauaaccacauaacauuauaaugccacugauucauacgggauuuacauuaauucuaugggggaggacacuagaauuauuaguguucauuuucaucuaagaucuuuauucucuaacguucuugguccuauugaaacauugcaguaugcaaaacuacugcaauguuaaacccaagagaaaagccauuaucauguguaugcuggucaucaugaucagugugguacaauuuuuaaaaauaaacuaucaugcccuucaugccau

SEQ ID NO: 17423 - RNA, 6732 nt, Homo sapiens
uuggcuuuuuaaaauuuuuuuauuuuuucacucaucauuuauuuacaaauacacauuauaacuuuuauauacauugcacauuuacaugguagaaaaguacaaaacuauauauuuaaaugaauuuauauuuuaacuugccauguuugaaaauauaaaauugcaucagaaaaaaguauuaugaaaagcaagaaacuugaacugauaaagcuuugauauaacuuuuagugauauacugguugaaaaagaacuaauuuaaaagguacagcugaguagcuuaaaggaaacaccuaacaaaagguugaauguguagccuucaacauccuuuagucuccugacacccacaucauuucuuuguaucuguaacaucuuaaaaguacauuacuagaauucuaaucaucuccucucucacaaaugucuucaucauaacaaaagaacugaaguaggaguuuccucaaagaugcuuaucuucuguaccuuguauuugagucagaguuauaaugccuuuuggucagucaagguuccuuguaaacaaaacccgagggaucauguauguacagaucaggcagcagagaauccaauaaauaaacaugacagaaacugacaugcaaguuuguugaaaguggaaaagagucuaacagugaaaugaagggagacagaugagugagugaauaguaaggaauggacuuaaaugguuuacaaggaaaaaaagcuuuuacuuuacaagcaagagaccucacaauaaauaacaacugcucuuccuuucacgaauaaauuucuucaaaaacaagguauacagucaaccagacauuuuauguauaaauuauaaaacaugacacaguauaaauaaaugucuacaagucucaacuaugggccucauccaguagaccucacaaugaaugccucuccguguccaaugaguaacaagguggccugggagagagcuuuaggacaaagguccuuuaauguauaguuuuccccccaaauaaauaagcauacacuuauuuacaguauggacaauauauuuuucuuuuuuucuuuuucuuuuuuuuuuuuuuuuuuuuugcacaaaggcuaugucaacacugaacacuuauagagaguuuaccacucuagaauagaagauauaggaaagcuguaguccuggucuucaucuuccuccucuuccucggugucuuccgaaauggcuagaugggggaauacaggggagcuguuguuuaaauacggacaacaacagcgcagaagcagcucaguguauguuuucaaagcccucugauacagccauauuacagcguugcauuuuuaugugacuugcagugagaugcuuuuuuuguuuuuggcaucugcuguuaugcaauaaguuaaaaaaauuuuuuuaaagcauaaucuaugaagucaaaaacugcagaaaguucugaagaaucaauggcucagguuuuacgggcagauuccugaaauuagauaaaaagcgcucuuguguucuagguauaacugcuuuggguccuuaauucagaguuaguagaggcaacugcaaaaagcagcagcccaugugugauaauaugaagcugucguuggaaaaaaaaaaaaaaaacuuuugaagcaguuaguuuagacucaaauguuaauaaagcaaacagcaaagcacacuaccaaaacacaagaaauaggggaaaacaacuggaaauagauuucuagaggcaaccccauugaugaucaccagauaaguccuaaaagccaagaaacaucgcagagaauuuucuguggauuauugaauugcuggugauacuuagcagcuaccuaauuugaacagaaauggauuuaugggagaucugcgugcuuuguaaguguccauucccuagggauugccugggaaagccuuaaauggcagcaagguuaaaaaucgcacuuacaguugcaagauccggagugcuuuacuuccaguagcacaccugaggagcaggcagcuuccuucauggcacacucgcuggcauaaguggcauugucacuggcacagacaggcucauccgacuuacugucagggcacagcucaucacagagggaacaccggccucucccaaccuugaaaucccauaaacauuuuuucccaccagugcacuggauaucuucacaggacuuugcuucuaggauauaauacaucugugaugaguaaacugauuuccccauaucccccuuuucucccuuucucuaguccucuaucaauaaauauaaacauaauuuauuuuauauaaacauaauaguaauagccuauuacuaauggggguaauggagauauuaugcaaaaaugcuggauaauaaaacugaaacucaaaugcacacacacauacacacgcacaaaaccccugcaguuucuuacauacuacauuagugcauuaaaaggguauuuuuuuaagaacaggauuuuacaauauucucaaguuaaauauguaucuuauuauuucccacaagugggaucuuuuacaaaagaaagaauuccauuaauuacuagaaucugacaacagauuucuggaacugcuaaguaauuauuuuucgcuuccagcaagucuggcacuuaaaaaaauguguaaaauugaguaaguucuaaguuuucuaagacggaauacuguuccuugcuuccugcuggcauuugaauauaugugucaaugccuccagaagacaaugguuuccaugaggaauacuguggucacaacacuuuccccaaauugcagcguauuucucccuaugguguuuggggacgccuugggcuuuacuuauuaguuaaccccacaguuuaauaauagaacuagccuguuuucucuuuuuccuuccucaauccagaauaccuacugauacacuuucccucauaggcuaauccaauagaucugcccagcaggcagguagccuuucucagguggcaggcacuggaguaggugacuccaucauucccacagagauauugcucagaggaagcaggcucugggcaaauccgauuacaggucacacaguaggcauuauuggucugguccaccacacauguggagcugccuggacagaaaacaucccgacaagucucuggaacaaagaaggaaacacacaugaauagguaccuucuaguccuuagggagugagcacuugaaguuaccaaggaaaucaugacacugaagcauccagcuuucaaaaggcacuuagggagcccuguaguuuucaagagagaaucuaugacuagguugguccccucaguguucuuaaugaaucucuagagguuagaaaaggacuccuuuauuugguuucaguauuacuauuaucaggcucuuacugcggacuacaccaucccccaagggucuucuagagggucuacuuuagguacaaagcuggaggaggggacagauccagucuugcucaacaggguaggaccuacuuuuacaucugccuugguacuggacuuccaguucuggcugcucuuuacaucuugccuuuaggagugcacauucauugcgguagguuuucccauccagcccgcagacuggacccuuccaggugauguuggaacaauccggggcgcagacgcagcgggguuuguucuucuuguucauucggcauuuuuucccagguccacaguccacguucucacacguuucugugaguuagaaacaggcauggauuaaaaccagagccaggcagucugcaggucagccaggagggcuucgggugccuugcgcaaucaugcagcccugaguuugcgcuggaggggccccaggcucucuccuggaauauugggaguuggugaaagaguguggaccuugggcugugccccacacccagaucucucucauuaaggagcacagguugguggguuucaccaccacacuuggcuaagaagucuggcguguauucccuacagccuguaacaggcagaauuagagucugcacggcuuaccagggcaagggacaggaaggggaagcccaggaacaaagcucuccuacucccaaaccccagucagguaguggggaagcuaaggguaagacgcccucuacugagggccugcaaguugggaagaaggaguccuaccuuuacaggggaugcaguugggggcgcccccguugaaaaucauccacuugaagaguguguugucauucacguccuccucgguccacgaggugcucagccggccggugcugcagcacuccuccuugcucaguucggucuuguacaggaccuggcagcggccguucuucgcuugacggagccagcaguucccagcugugaagagacaaggguggggaggugggugagugagcagugagcgguggcagggcagggagagcgagguggcuagcgaaggagacccggcggggauggggagggggugagcguggaggaggggaagugagagagacgcgggagaaaaguaggaaauaaaucgaaagggguggagggguggaaaaagaaggcaguggagggggaagcccugaucacagagaugggaggugggcgagagggagggagggagagagggagaagacagggcgccccagccauaucaaugucaguuaccagugacccagacacaacacgugcagcuugcauugacuuuuacuagacuguuuacuuuuauucgucccauuucauaaccugcagagacucgaagagcagauuaaagaaccugacaaaaacaggaugcgacggauguuuuuacaugcugguuucauguaggcggguacaggaauuauuugugacagggguuaagaaaguaagagaacgagagagaggagagaggagagauggaggggagagagagggagaaggaaagagaaagaaagaaagaaaagaaagaagagaaagaaagaaaagaaagagaaagaaagaaaaaaaggaagaaagaaagagagagaggaagaaagaaaagaaagagagagagagagaaacagaucaagcaaaaggcacuucugaaaaaugaaagcaaaaaagcaacccggcccagcccggagcuaccccgcgcggccuccaggcgcagccagcccgacgggcccguuuugcaauccgccagaccggagcacgcccgcggccaccgcgaucuuucgaaaucuccgagggcugcuuuccuccgcgcccacguccgggcaccaggcagagccucuccucuaaaggcgggcaacccagcgcagugccaugcagacggcgaggggcagugcccaggagggcaguuuacaacauacuuaaaauguuaacgcugaagcagggaaaguaaugccuuaagguggggggaggggggagucuuccuaccauuucacgguuauaaguaccuaucucauaccuagcaagaaauauuugcaagugauuucucccucuucccccuuuuuaauguucggauuugggucgagaagacuucucaugaaucaccaauaugacuuuaacaaucauuggaucgcaagcugcuauuauuauuuuaaacauucugcccaaagacuaauugaaauaaacaaaucuauuuuuaaaaggcaagcuucagaaauuugcucuuaacccauuucagaauuuaagucaguuaugggcugcucacuguuuuacagaaagcuaagggucagaaagaagaaugaggcagaggggaaaaaaacuguaaagugcucaaagcacuuugggguaauaauuuggcuuuuuuuuuuuuuuuuuuuuuuuugcgagaaugggggaugggguuggaagaagcauccacuaggcagaaagcuacuucccuugaaaaucuucagcacccacauuuccaaguuugggcaaaguuucugaaaccacgucccccagccaccaaauaaaauucaguaucucucccccaaacccccagguuuucuuuucuuucuuuccuuuuuuuuuuuuaaguauccaaaagaugugggagggagagagaugagacugcaaaugggucgacugaaaucuccaggcuacuacugauacuuguucccuucuucagagccaaacagaggagaucacaucuaaaguuaucauggccagaacuuggagcauuuaacccuaacuacuaagaccccagcucgcucccuuuccuuuuucaagauaaccgagcuccaaacucaguucccaguccuaaagugucauugccuacaauuuucccacuccucuccaucccggaguccccaaguugguucaacaucuuccgagagcagcguugcucagaacagaccaaguggagaccacagaaaagucgaccccccuguccucagccaagccuccccagcgcauccccacucgcuuacccugggcacugcgguccuccaugaacuggcagagcagcagcagcaggaggcaaagcccacccggcuggugccucgcgcggaccauccugggggcaggcgcggggcgaggagcgcagcggcgcggggagccggcgcggcggcggguggcucgggcgagcggcgcgcgucgcagaggccagcggcggagggcgcagcgaucccggcgcagccccgcgcucgccgccggccgcccgcgcgauucaauggacgucagaagccgggcgcagccgcgcuuuaaaucuagacgggggucuccgcgguuugcggugggcggucucccaguguguggggcugugggagggcggccgcgagcgagggugugcgcggcuccuuggggguggggagcuuucaaaaguucagugugaaucaggugacauuucccaccuucuggaaacccuucccaauuaucuuucggaggugcccgaaaucaaaacg

SEQ ID NO: 17424 - RNA, 6732 nt, Homo sapiens
cguuuugauuucgggcaccuccgaaagauaauugggaaggguuuccagaaggugggaaaugucaccugauucacacugaacuuuugaaagcuccccacccccaaggagccgcgcacacccucgcucgcggccgcccucccacagccccacacacugggagaccgcccaccgcaaaccgcggagacccccgucuagauuuaaagcgcggcugcgcccggcuucugacguccauugaaucgcgcgggcggccggcggcgagcgcggggcugcgccgggaucgcugcgcccuccgccgcuggccucugcgacgcgcgccgcucgcccgagccacccgccgccgcgccggcuccccgcgccgcugcgcuccucgccccgcgccugcccccaggaugguccgcgcgaggcaccagccgggugggcuuugccuccugcugcugcugcucugccaguucauggaggaccgcagugcccaggguaagcgaguggggaugcgcuggggaggcuuggcugaggacaggggggucgacuuuucuguggucuccacuuggucuguucugagcaacgcugcucucggaagauguugaaccaacuuggggacuccgggauggagaggagugggaaaauuguaggcaaugacacuuuaggacugggaacugaguuuggagcucgguuaucuugaaaaaggaaagggagcgagcuggggucuuaguaguuaggguuaaaugcuccaaguucuggccaugauaacuuuagaugugaucuccucuguuuggcucugaagaagggaacaaguaucaguaguagccuggagauuucagucgacccauuugcagucucaucucucucccucccacaucuuuuggauacuuaaaaaaaaaaaaggaaagaaagaaaagaaaaccuggggguuugggggagagauacugaauuuuauuugguggcugggggacgugguuucagaaacuuugcccaaacuuggaaaugugggugcugaagauuuucaagggaaguagcuuucugccuaguggaugcuucuuccaaccccaucccccauucucgcaaaaaaaaaaaaaaaaaaaaaaaagccaaauuauuaccccaaagugcuuugagcacuuuacaguuuuuuuccccucugccucauucuucuuucugacccuuagcuuucuguaaaacagugagcagcccauaacugacuuaaauucugaaauggguuaagagcaaauuucugaagcuugccuuuuaaaaauagauuuguuuauuucaauuagucuuugggcagaauguuuaaaauaauaauagcagcuugcgauccaaugauuguuaaagucauauuggugauucaugagaagucuucucgacccaaauccgaacauuaaaaagggggaagagggagaaaucacuugcaaauauuucuugcuagguaugagauagguacuuauaaccgugaaaugguaggaagacuccccccuccccccaccuuaaggcauuacuuucccugcuucagcguuaacauuuuaaguauguuguaaacugcccuccugggcacugccccucgccgucugcauggcacugcgcuggguugcccgccuuuagaggagaggcucugccuggugcccggacgugggcgcggaggaaagcagcccucggagauuucgaaagaucgcgguggccgcgggcgugcuccggucuggcggauugcaaaacgggcccgucgggcuggcugcgccuggaggccgcgcgggguagcuccgggcugggccggguugcuuuuuugcuuucauuuuucagaagugccuuuugcuugaucuguuucucucucucucucuuucuuuucuuucuuccucucucucuuucuuucuuccuuuuuuucuuucuuucucuuucuuuucuuucuuucucuucuuucuuuucuuucuuucuuucucuuuccuucucccucucucuccccuccaucucuccucucuccucucucucguucucuuacuuucuuaaccccugucacaaauaauuccuguacccgccuacaugaaaccagcauguaaaaacauccgucgcauccuguuuuugucagguucuuuaaucugcucuucgagucucugcagguuaugaaaugggacgaauaaaaguaaacagucuaguaaaagucaaugcaagcugcacguguugugucugggucacugguaacugacauugauauggcuggggcgcccugucuucucccucucucccucccucccucucgcccaccucccaucucugugaucagggcuucccccuccacugccuucuuuuuccaccccuccaccccuuucgauuuauuuccuacuuuucucccgcgucucucucacuuccccuccuccacgcucacccccuccccauccccgccgggucuccuucgcuagccaccucgcucucccugcccugccaccgcucacugcucacucacccaccuccccacccuugucucuucacagcugggaacugcuggcuccgucaagcgaagaacggccgcugccagguccuguacaagaccgaacugagcaaggaggagugcugcagcaccggccggcugagcaccucguggaccgaggaggacgugaaugacaacacacucuucaaguggaugauuuucaacgggggcgcccccaacugcauccccuguaaagguaggacuccuucuucccaacuugcaggcccucaguagagggcgucuuacccuuagcuuccccacuaccugacugggguuugggaguaggagagcuuuguuccugggcuuccccuuccugucccuugcccugguaagccgugcagacucuaauucugccuguuacaggcuguagggaauacacgccagacuucuuagccaagugugguggugaaacccaccaaccugugcuccuuaaugagagagaucuggguguggggcacagcccaagguccacacucuuucaccaacucccaauauuccaggagagagccuggggccccuccagcgcaaacucagggcugcaugauugcgcaaggcacccgaagcccuccuggcugaccugcagacugccuggcucugguuuuaauccaugccuguuucuaacucacagaaacgugugagaacguggacuguggaccugggaaaaaaugccgaaugaacaagaagaacaaaccccgcugcgucugcgccccggauuguuccaacaucaccuggaaggguccagucugcgggcuggaugggaaaaccuaccgcaaugaaugugcacuccuaaaggcaagauguaaagagcagccagaacuggaaguccaguaccaaggcagauguaaaaguagguccuacccuguugagcaagacuggaucuguccccuccuccagcuuuguaccuaaaguagacccucuagaagacccuugggggaugguguaguccgcaguaagagccugauaauaguaauacugaaaccaaauaaaggaguccuuuucuaaccucuagagauucauuaagaacacugaggggaccaaccuagucauagauucucucuugaaaacuacagggcucccuaagugccuuuugaaagcuggaugcuucagugucaugauuuccuugguaacuucaagugcucacucccuaaggacuagaagguaccuauucauguguguuuccuucuuuguuccagagacuugucgggauguuuucuguccaggcagcuccacaugugugguggaccagaccaauaaugccuacugugugaccuguaaucggauuugcccagagccugcuuccucugagcaauaucucugugggaaugauggagucaccuacuccagugccugccaccugagaaaggcuaccugccugcugggcagaucuauuggauuagccuaugagggaaaguguaucaguagguauucuggauugaggaaggaaaaagagaaaacaggcuaguucuauuauuaaacugugggguuaacuaauaaguaaagcccaaggcguccccaaacaccauagggagaaauacgcugcaauuuggggaaaguguugugaccacaguauuccucauggaaaccauugucuucuggaggcauugacacauauauucaaaugccagcaggaagcaaggaacaguauuccgucuuagaaaacuuagaacuuacucaauuuuacacauuuuuuuaagugccagacuugcuggaagcgaaaaauaauuacuuagcaguuccagaaaucuguugucagauucuaguaauuaauggaauucuuucuuuuguaaaagaucccacuugugggaaauaauaagauacauauuuaacuugagaauauuguaaaauccuguucuuaaaaaaauacccuuuuaaugcacuaauguaguauguaagaaacugcagggguuuugugcguguguaugugugugugcauuugaguuucaguuuuauuauccagcauuuuugcauaauaucuccauuacccccauuaguaauaggcuauuacuauuauguuuauauaaaauaaauuauguuuauauuuauugauagaggacuagagaaagggagaaaagggggauauggggaaaucaguuuacucaucacagauguauuauauccuagaagcaaaguccugugaagauauccagugcacuggugggaaaaaauguuuaugggauuucaagguugggagaggccgguguucccucugugaugagcugugcccugacaguaagucggaugagccugucugugccagugacaaugccacuuaugccagcgagugugccaugaaggaagcugccugcuccucaggugugcuacuggaaguaaagcacuccggaucuugcaacuguaagugcgauuuuuaaccuugcugccauuuaaggcuuucccaggcaaucccuagggaauggacacuuacaaagcacgcagaucucccauaaauccauuucuguucaaauuagguagcugcuaaguaucaccagcaauucaauaauccacagaaaauucucugcgauguuucuuggcuuuuaggacuuaucuggugaucaucaaugggguugccucuagaaaucuauuuccaguuguuuuccccuauuucuuguguuuugguagugugcuuugcuguuugcuuuauuaacauuugagucuaaacuaacugcuucaaaaguuuuuuuuuuuuuuuuccaacgacagcuucauauuaucacacaugggcugcugcuuuuugcaguugccucuacuaacucugaauuaaggacccaaagcaguuauaccuagaacacaagagcgcuuuuuaucuaauuucaggaaucugcccguaaaaccugagccauugauucuucagaacuuucugcaguuuuugacuucauagauuaugcuuuaaaaaaauuuuuuuaacuuauugcauaacagcagaugccaaaaacaaaaaaagcaucucacugcaagucacauaaaaaugcaacgcuguaauauggcuguaucagagggcuuugaaaacauacacugagcugcuucugcgcuguuguuguccguauuuaaacaacagcuccccuguauucccccaucuagccauuucggaagacaccgaggaagaggaggaagaugaagaccaggacuacagcuuuccuauaucuucuauucuagagugguaaacucucuauaaguguucaguguugacauagccuuugugcaaaaaaaaaaaaaaaaaaaaagaaaaagaaaaaaagaaaaauauauuguccauacuguaaauaaguguaugcuuauuuauuuggggggaaaacuauacauuaaaggaccuuuguccuaaagcucucucccaggccaccuuguuacucauuggacacggagaggcauucauugugaggucuacuggaugaggcccauaguugagacuuguagacauuuauuuauacugugucauguuuuauaauuuauacauaaaaugucugguugacuguauaccuuguuuuugaagaaauuuauucgugaaaggaagagcaguuguuauuuauugugaggucucuugcuuguaaaguaaaagcuuuuuuuccuuguaaaccauuuaaguccauuccuuacuauucacucacucaucugucucccuucauuucacuguuagacucuuuuccacuuucaacaaacuugcaugucaguuucugucauguuuauuuauuggauucucugcugccugaucuguacauacaugaucccucggguuuuguuuacaaggaaccuugacugaccaaaaggcauuauaacucugacucaaauacaagguacagaagauaagcaucuuugaggaaacuccuacuucaguucuuuuguuaugaugaagacauuugugagagaggagaugauuagaauucuaguaauguacuuuuaagauguuacagauacaaagaaaugaugugggugucaggagacuaaaggauguugaaggcuacacauucaaccuuuuguuagguguuuccuuuaagcuacucagcuguaccuuuuaaauuaguucuuuuucaaccaguauaucacuaaaaguuauaucaaagcuuuaucaguucaaguuucuugcuuuucauaauacuuuuuucugaugcaauuuuauauuuucaaacauggcaaguuaaaauauaaauucauuuaaauauauaguuuuguacuuuucuaccauguaaaugugcaauguauauaaaaguuauaauguguauuuguaaauaaaugaugagugaaaaaauaaaaaaauuuuaaaaagccaa

SEQ ID NO: 17425 - RNA, 12567 nt, Homo sapiens
ggguuacgccugcgcuccgggugagcccgcgccugcgccuuugcggccgugauucggucccgcuguccuaggcgggauggugccgcugugccagguaaggguggcgggugugcgugcgggccugggugcggagcccuccucgacgugucucucccgcccuuucccuccacauacccagccuuggucagucggaccuccccacuagcccccaaccuggccggcgucuuggguucgggggcgcccccgcccccgcccccgggcccuuccugucuccgggcuuuacugcgacugccccagcagaagucggguccucuccgagaacucuugucagcucacggcagcaaggacggacucguucugaaggcgccuccaccuuuuaugaccaccucuuucccagauuauucguuuugaugaagcuaaaauuuuaaucuaaaaagaaaugcaccucauggagaauucuugugaagaacugugcuucaucuguggauuucuacacccuugaucauuugcaaaccuguaauuauuucguaaagaguuguuugcacggagugacaggugccuauuuuacuucgucggaucccuuacauaccaggcugcuggcacaaguuuguucuagcaaauuccagucugucguguguuucaaaccuacuugcuucuguaaaugucagauuuacuauguugcauaacuuaauccuuagcgucuggggacgauguuauacagaccggaaucuaaggucauuugacaaccgugagaaacagguuuuucgcuuauuuauucauuuauuuuauuuguguaacucaucucuugacucaaacauuuguucuuugcuuacauauuuauaaaaggugcuauacuuuuaugucaauuaaggcaggcuuaacauguuuuccuagaagauaaauacuuaggauuuuaaugauggcacacuuaaguuuguaaaacuaaaaggcauccagaaauuagucugaauuguauuuaaaacaacaaguuuucagaauuugaacuuguagguauacugaaauuuuuuacggguuauuuaauuuucuuuauaaaauuugucuuugauuaaagcaauacauuuggaaaaugagaaaacugcucaacauugacagucagaaaacgaguaugaguuguuauuaaaagcauuuucuuuacuuucagguugaaguauuguauuuugcaaaaagugcugaaauaacaggaguucguucagagaccauuucugugccucaagaaauaaaagcguugcagcuguggaaggagauagaaacucgacauccuggguaguuaaaaauuuguagaaugcauaugaguaacacuuagauauuuucaaaauacauaaaugauaaaaguaaaaagguuaauuucgauuuccgugcuuaaugucaaaaagaaucguuaguuguauuuuuuuuggaacaccugaaaaacucuaaaugugcaccguauuuuaagaaagguuaaagauauuuuaccccaaaacacagugaaccgcagagggacaugauuauauucucuuugauaauuuacaaaacacugcacaugucacuucugcaauuuuauaacauuaaaugaaauuguuacaaauucuguuaaaaaugugugcuuuaaacauuuuguucugccccucucuuuagagagcucaacauagaaauuucuaagauugaaagaaaaaugaguuacaacaaauccuagaugcugcugaauuugaguuuuuguaauauuuaauuuuuuuucugguucuugaaaaaccuauaauuuuacuuaugucauucccacuucaaguucuuuuuggaacaaaauauaaaagugacuuauuugagggugauucaggaauauuaaugguguuacuuagcuuguauagguguuuaaccuggaaguccuaguucuguguaaaagauacuccauaauaaguguuuaaaagcaaaccacuucaugauuucguaucuuuuaaguugcucuuacaguggccugauaaucaauaaaacacaguggggucucccauucugcuuuaccuggagggagacagcaggucuuguauacguuuucacugugccugaaaagaaagcuuaccauuguucagguauaaaggaacagcuaauaaagcuguguugcagguggcuuuaugaccuaugcuaucuuuuucaucuuucuaagcaacuuaauccauauucgaguaggauaauguguacaggcauaguuugugggcaguuauacuugugcuugaacacauggauagaaggacccuggaaaggccauguacugauuggaaacuuuucuuuugaccugguuugaguguugccuccagucugguggguuuuuugugcauuuuuuuguuguuuaauuccccaaggcauacaacauccaauaaagaguugacagcaguuuaacguaucuuugugguguauaaguauguucuucaguggauauguccuuucuccauauacuauguguaaauuuaauugguaauuuugcaggugaugcuuuauauaauuauaucuauguaauaucucuaauugcagcugaagcgauuugaggucuaucauagcguugauacuuugagucauauuuuuuccccuuuagauuggcugauguuagaaaucagauaauauuugcuguucgucaagaauaugucgagcuuggagaucagcuccucgugcuucagccuggagacgaaauugccguuaucccccccauuaguggaggauagugcuuuugagccaucuagguaugugagauuuguuuuucuuaaucagucguguggggaaggaucauacagaugauaaaguguaugugguuugcuguuaauguauauucuuuguaagucugucuguaccaaaucuuuauugaugcagcaacucuucauuggugccaacagauuuaugaauaucuagcaccauuucugcaucaagucuauuguaagcaguuuaauuacaauaaacauaucaguuugauauguuucauuuaacaugguuuauugagaucuuaugugucaggcacagugacauauuaauauccauauuuugcagguaaaaaaacaaauucagaagacuuaaaaaacuugccuuugaucacauagcuaaucacauagcuaauaagugaaagagccaaauuaaaaagaauuuauuuaacuuuuaaguucaggggaacuuguaucauggcgguuucuuguacagauaauuuugucacccagguauuaagucuagugcccaucaguuauuuuuucaaucuucucccuccucccacccuccacccucaaguaggcuccagugucuaugguuuccuucuuuguguccauguguacucaauauuuaucucccacuuguaagugagaacguuugguauuugguuuucuguucccgcauuaguuggcuaaggauaauggccucuagcuccauccaugucccugcaaaggacuugaucucguucuuucuuauggcugcauaguauuccaugguguauauguaccacauuuucuuuauccagucuaccacugaugggcauuuagguugauuccaugucuuugcuauugugaauagugcugcagugaacagacgugugcaugugucuuuaugacagaacgauuauauuucucuggguauauauucaguaaugggauugcuggguugagugguauuucagucucuaggccacccugucuuccacaaugauugaacuaauuuacacucccugcagcaguguauaagcauuccuuuuucuucacguccucgccagcaucuguuauuuuaauaauagcucuucugacuggugugagaugguaucucauugugguugggauuugcauuucucuaauaaucagugauguugagcuuucuuuucauaugauuguuggccacauguaugucuucuuuugaaaaguuccuguucauguccuuugccuacuuuuauugggguuguuuuuucucauaaauuuuaaaaaauuccuuagagaugcugauguuagacauuugucagaugcauaguuugcaaaauuuuucucccauucgguagguugucuauucacucuguugauaguuuccuuugcuaugcaaaaacucuuuaguuuaauuagaucccauuugucaauuuuugcuuuugcugcaauugcuuuuugagucuucuuugucauuaaaucuuugcuuguucuuauguccagaaugguguugccuagauugucuuccaggguuuuucuaguuuuugguuuuacauuuaagucuuuaauccauuuugaguuaauauuuguauaugguauaaggaaagggcccaguuucagucuucugcacauggcuagccaguuaucccagcaccauguauugaauaggguauccuuuccccauugcuuguuuuuguagguuuguugaagaucagauaguuguaggugugaagcuuuauuucuggguucuggguucuguuucauuugucuauguguccuguuuuguaccagucccaugcuguuuugguuacuguagcccugugguauaguuugaaguuggguaguguaaugccuccagcuuuguucuuuuugcugaggauucaagagguuuucaaaagacagcauuugaacucauauuauuggacugucuguguacuuuuuuccaaccacacuuacuaauacuagauaauagcucucccggccauggaaaauguagaaaaauuucacagcuaauaaugccugaaaagagagcuaaucauugcccaggacuaaaggaauagcuuuauuguuauggcuguguugcagguggcucuuugacccaugcuaccuugucaucuuucuaaacaacuuaguccauauucaaguaggauaauguacaagaacauuguucaguauaguguggagagaucaggcuucuuauaaguacagacagaaugaggcuuaauuuauugucagcugaggaacaaacaguagaaauuaacagucaucccugaauaaaaacucuugguaaguuaggaaugaaagaagacuuucuuaauuugauaggauuuuuauucaaaaucaggaguaaauaucauauuuaauggcaaaaacuugguuccauuaaagaaaggagcaagccaaggaugccuuuuuaucuuuuuucacccauuuuuuccccacccuccuggagggcagugccacaagaaaugaagaaucaaucuguaaaacagauugccucucaugucaacacuaggcuucuuucucaggccuacuaucuggaaauaauagaagaaucucuugucagauauguaucucaaugcuauuuagaaacuguggucaccauaucaccaccaugauuucaggagguucuaaaaaugcaguuuuuuggaauuucgaauuuauucagaaaacuauaggcuaccauuaaagggauauuugugguaauuacagcuguucuuugaaaagguuacgaagauuacucaaaagcauuguguguuacuugaauguguuucgcaggacugguauuaugcauuuuuaaaaccugccagcuagguuuuaguagucucguaaaaucagaaguugugggaacucaguaugguuugaaacucguagaccauauuuauauuaccuauauuuuauugcaagaaaaagagguggaagacacuuaggcggcuuguguagcagaugaaaaauccuggaauccagugguauauaaagaauugugcuguuuccgugguggaaaggagauaggaaaaagaacauuggcuuaacuaguacuccuugguuggaauuucagcaccuugagugaguuccuuaacuucucugagccuucuuucucucgucuuucaauucagaugaaaccuuacaggauuaauaauuauauuccucauugccugcaagauucuaccuaccuguccagccucagccugcccaguucucuccguucguucuagguucuggagcacaucacacccuuucuugucccagugccuuggcauuggccacucccucucucugccugggggccugugcccugguuucuuuacaagacuuccuccuuaucuuucaggucgcaacuuuucauagaggcucuugagagaaaucucccccagaccccagguucugucucugaagccuauuuacuuccauaaguuaucccuauuuguaauucugaguuucuccuguaaugcuuuguuucuccuauuugaauguaagcacgcugaggaaaggagcuugagcuucuuucuccccugauugauaucuagugccuggcccuagucucuggcccuuagugaguauguaguaauguuugaggaauuaaaugagaaaugcauggcaaagggcuuugcacaauaccuaguaaguaagugugcaguucauucccuuauuuccucaguuacuuaccugggguuuugccaguuugugaagggaacccaguuccaguagaaucacugucacuucuguucuuccuuuuuuguuggauaaagaaaaagacagcuuuagguguggugcuugguaccauaguggugagaggggaugggcauguaggugaaaguggcaauaccuccacuguaucuugaugggagauaugaauagcaguuacagaauuuggaauauauuggcauugagacagauuauauuuuagugaucauguuaauaauggauuacuuuuuaugucaugccugauucauuaugaauauuuauacacauaauugaguuuuguuaauuuuuacacuugcuuauuuuuaucauucagaucaaaucaugccuccuaacacauuuaaugguggggaaaaaaagaaaagaaacuuuuuaucugaggaaugugagcccgucagauaaaacauuaagaggcacagaaaggcacuggaaugaaauggcagucaugucacuccccauuaagcugcaucauuaccuuuuuuuucuuuuuuuuuuuuugagaugggguaucacuuugucgcccagacuggagugcaguggcaugaucaguuucagcucacugcaaccuccaccucccaagcucaagcaauucuccugccucagccucccaaguaguugggauuauagaugugugccacuaccgccuggcuaauuuuuguauuuuuaguagagacgggguuucaccauguuggccaggcuggucucaaacuccugaccccaaaugauccacccgccucggccucccaaaguggugggauuacaggugugagccacuggucccuugaagccacuuauuaugagggcugcagacuagcugaagcuaagaaaccauaaaguccauaugcuggacacucuaacuuguacccacccuauaguucaacaguguacagccaaucagugaucaacauuaucucuguaugccagugagaauucuuggugaaacuuuguaucauuguaucagcccacuuuuuguucccuuugccuuuacaaaccugcuugcaacaaaggccgagggagugcuccccaaaggaacuccccaagguaucuuagaagcauccugggccacuguccuugauuugacucauguaaacuauauuuugugccacagccucuuccuuuuacaucgacauaauguagaaaaaaauauaaauugaaagagccuauaaguuguugaguguuuuaccccuaggacuucuguuaagguuuguuaauguauuauuucuaggaaagauauggaugaaguugaagagaaaucuaaagauguuauaaacuuuacugccgagaaacuuucaguagaugaagucucacaguuggugauuucuccgcucuguggugcaauaucccuauuuguaggugaguuguaauuuucauugcaucuaucacuguauaagacaauagaaauuagcaugugcuuuccauguucaguguuaacggaggaguuugaaauacugaacuuuaaaccaagauuaccgaugaugguggguagacuuuuuuuuaguucuuguuuuguuuuaguaaccuucaaauuaaccuauauuaaauuacaaggcauuuugaaaaguaggauaaaagucauuguuaggagagagaauucuagauuuuccaaaauugaagguaaaaauguacuugauaguccugggaacauaaauauuuuccuuuuaaguaucuauuagucagaagaggaauauugcccgguuugccaggugaguguuuuuaguaagcuugcuuaaucagugcucaucuuugugaagaucuguuuuauuuuccuaaucaaauuuuguuuuuagaagauuucaaaguaguuuuagaagaauugguaugcugcuuguuuacuauuaauuuacuauuaaaaauauuccuuuuuuauuaacgugcuauuucuuuuguagggaaaaaccuuauuuuaauuguuuucuuuuucuuuuuuuucauuuuuaaagggacuacaagaaauaacuuugaagggaaaaaagucauuagcuuagaauaugaagcauaucuacccauggcggaaaaugaagucagaaagauuuguagugacauuaggcagaaauggccagucaaacacauagcaguguuccauagacuuggguaugauuuccuuuaucacucuaaaaguuaaguguaauuguuuuccaucuuuguacuaacucugauucuugaaucuuucuuaguaauucuauauuaccaugagaggaauauucauguauuauuuuuggaggacaauagggauggcuguuaguaccuuuagggacugccuagugaguuuugauauugggagagcucuuguugccucuguugcuguaacaaacugcaguugugccaagacuugcaggcccuaugacaaucugugacagauucuuuuugauauaaaugccucgaaagucauuagagugguuugccuuuuuguaccccuaaaaagagaagaguucuuggcuuuaaaaagaagccaguaauugagacuguaucuaucauacucuguuaguuacuaguuuguuauuaauaaccaguaguuuuauuaaugguuauuaucacuccuauuacuugauauguauuauuuuaaauuuuguauuauacucguuaggacauaacuuuguauuucuaggcauuacuuggcacugugccuuguugagucagauguuugcucuaucaaugaaaggauuuuccuuggugcccaucaggaggguuuaguggauagauucuaacaaauuagcuguagcaucagccucaucuacugccucugcugaaugcuacugcaauuaauuacucuuuucuaacuguauguuuacguaaaauagaacuacaguauaauucuaagacugcauaccuggauuuuuuuucaucugucuagcagauucuuuaacacguagauucagagaugauggugauuuuuuuuucucuucaucuuguuaaagcuugguuccagugucagaagcaagcauaaucauugcuguguccucagcccacagagcugcaucucuugaagcugugagcuaugccauugauacuuuaaaagccaaggugcccauauggaaaaagguaaguuaagaaaauaacacauuuuagcauguggaccugauuuuucucaggaauuuuuagauaaauccccccauauuuauggacuuuuuacugacuguaguaucuuguuuucuuuaucugugaaauaucuucuuuccaagauuuguuaagcaugaaaaauaugugccccaaagaaugcauggcacacaguaagccucaaugagugauaacagugagaauuccuagucuggacuguuggagggguucauacaugaaguuauuuuccuuggauuauaauucccuugaauuagagggucuuucuguuggagagugagaauaaugcauuagcuauuuagguaauggcuaaaauagaaauucuuuaaagugaaagaggcuuuuccuagagguccuuuuuagggaagaaaaaaaaauggugagauauugcucccucugagaaaaugcagugaguggauuuaaaaacagaaauaggaacuucuggcauguuuucugucaauaagggcaaguaauucucugguuaaauagagcauucugaugggaugaaaaggcccaacucccuaguuucuccccugguguaguaacauuaacagugggauuguucugugguugcacauucaaugucuagaauugucuagaauugccuacagcguugugguugacagaaagcugaggaguuaaugaacagcucaguagaugaaaagaccagagcagagagccagggcuuuuaaagggcacuucuccccuccuucccaggggaccugccucagucagugguagaaauaagcaaguuggacucauaaccagggccugggaaauuugaugaccauguuuucagaauaaaauugaagcccauuguuagaauacguagggauuagaggauagaauaugugugaaaggaaacuuagugaagcucagauauauuguucccuugcugugaacaaggcugacacaacaggaggcaggcccccagagagcgagagguaggaagagcauucuaagaucagcugcaagccuggaaggcagggguagcuuucuucaccagggaggaaagggugcacagucaguggacagaaaguagaugggagcaaccccagaaauacagguaaugagcaggaguuggggcauauucuuguuuucaugcuuugaggacuaguugggcuucguauuuugcuuuuguuuguccauagagaguccgaggaagugcaggaguucagaggacaguugaauuugaauuccucucccuacagaaauggaaugugacuagagagugagaagagaaagugauauguucuccuuaccccuccuuuccacaaacuauguaacuucuagucugguucuagucucggccugugcuuugagaucaucugugauauagggaaggguggcagguagguagagugcauaugucaaagaacagcucauaccagagggcagcucaaacuuguuuaggaacuucugagaggugaccacuuaauucaacagcuaaugaagauaucugccuuuggaaaagcauauuuagaaauguugaaguaguagguauguuuggaaagaaaaaaaaauguuuaaaacuaaagacuuucugucuuccccuauguaaccuugcccaugaugucucucgucaugauuguuaaaagaggagccauugaaauagaugugauauucauuugucugauuuauucaaauauauuuuauauucguauaguagaauggucuauuuuuaauaccuguuaugauuuuguuuuuuaggaaauauacgaagagucaucaacuuggaaaggaaacaaagagugcuuuugggcauccaacaguuaaucacuuauguuuuuagagcaugcaaucuuaacuuuguuaaacuauuauuauugaucacauuuugauuuuuuucucuccacaucaggauaguuuacugaagcacaaucucuuauacuagugggacaaaagggagaaaaaggaagcaagauaaauggguauguaggaugaaggguuauuuaaaauggaacuaaagauagaaggaggacuguaggaagaaauggaauaauuuaaaugugaggaaagauaucugugguagacauguccuuccaugacuaauuucuaauuguaacucaacacacauugagguaugggcccuccucagugacuuuaacuagcucagaaacguacucccccaccaaccccaccucaccgccccccaucccgguucugggagagcauuguuauuaaggaugcaugacaggaauguuggcagaacuggaaaguauuaaaaaagcauuaucagacagucuugauauuauacauuuucagaaauauauuaaaaauaauaaacuaaaacccaugauuucaaaaguuuaaaaagaguauuuucuuuuuuuuuaaauugccuaaaauaguucucauuauggagauuucugggauuucagaaucuauaaucuuaccagaaaacuuuuuguuguuuuuuauuaguuguuaauuuuguaucaauauacaaaucagcacaaaauugucauaaagcuaacuagcaacaaggugguuuguguugaaauguuuagguaaacaaugccccaauuuuuaacugguuaagcuuuauaguauuuugauagacuuguacauauaagucccauauaguucuuaaauuuuuuuuuccagcuuuauuuagguauacuugacaaaaauuguauguauuuaaaguauacaaugugauuuuugauacacauauacauugugaggugauuaccauaauccaacuaauuaacauauuccucagcucacauaguccccucuucuguguggugagaauauuuaaggucuacucucagcaaauuucagguaaacacauagcucauaaaauaauaaaauacaggcaaaauuugggcagucggcaucaucacaaaauuugcauuaugcauauuaagaacaaaagcuauacuuucagacacuuagauugaaggauuuuuuucuuaugucugggacaaauaagaaacguaguaauccuauuuguuauauguagugaaaacaucuuuuaccuaaggaacccauuuauucaacaaauauuuauugaaugccuguuuugugccaggcacccacccagugaucuuuuucugccaaccuaaaauaccuugaggaacacucugcaucuuaucuguggcugggacccauaggacagccacacugacuuuag

SEQ ID NO: 17426 - RNA, 3224 nt, Homo sapiens
cucccuuacugaaccacucucccaccuccuggugguaccauuauuauagaagcccucuacagccugacuuucucuccagcgguccaaaguuauccccuccuuuaccccucauccaaaguucccacuccuucaggacagcugcugugcauuagauauuaggggggaaagucaucuguuuaauuuacacacuugcaugaauuacuguauauaaacuccuuaacuucagggagcuauuuucauuuagugcuaaacaaguaagaaaaauaagcucgagugaauuucuaaauguuggaauguuaugggauguaaacaauguaaaguaagacaucucaggauuucaccagaaguuacagaugaggcacuggaagccaccaaauuagcaggugcaccuucuguggcugucuuguuucugaaguacuuaaacuuccacaagagugaauuugaccuaggcaaguuuguucaaaagguagauccugagaugauuuggucagauugggauaaggcccagcaaucugcauuuuaacaagcaccccagucacuaggaugcagauggaccacacuuugagaaacaccacccauuucuacuuuuugcaccuuauuuucucuguuccugagcccccacauucucuaggagaaacuuagaggaaaagggcacagacacuacauaucuaaagcuuuggacaaguccuugaccucuauaaacuucagaguccucauuauaaaaugggaagacugagcuggaguucagcagugaugcuuuuaguuuuaaaagucuaugaucuggacuuccuauaauacaaauacacaauccuccaagaauuugacuuggaaaaaaaugucaaaggaaaacagguuaucugcccaugugcauauggacaaccuugacuacccuggccuggcccgugguggcaguccagggcuaucuguacuguuuacagaauuacuuuguaguugacaacacaaaacaaacaaaaaaggcauaaaaugccagcgguuuauagaaaaaacagcaugguauucuccaguuagguaugccagaguccaauucuuuuaacagcugugagaauuugcugcuucauuccaacaaaauuuuauuuaaaaaaaaaaaaaaaagacuggagaaacuagucauuagcuugauaaagaauauuuaacagcuaguggugcugguguguaccugaagcuccagcuacuugagagacugagacaggaagaucgcuugagcccaggaguucaaguccagccuaagcaacauagcaagacccugucucaaaaaaaugacuauuuaaaaagacaauguggccaggcacgguggcucacaccuguaaucccaacacuuugggaggcugaggccgguggaucacgaggucaggaguuugagacuagccuggccaacauggugaaaccccaucucuaauaauauaaaaauuagcugggcguaguagcaggugccuguaaucccaguuacucgggaagcugaggcaggagaaucacuugaacccgggaggcagagguuucagugagccgagaucgcgccacugcacuccagccugggugacagggcaagacucugucucaaacaaacaaacaaaaaaaaaguuaguacuguauauguaaauacuagcuuuucaaugugcuauacaaacaauuauagcacauccuuccuuuuacucugucucaccuccuuuaggugaguacuuccuuaaauaagugcuaaacauacauauacggaacuugaaagcuuugguuagccuugccuuagguaaucagccuaguuuacacuguuuccagggaguaguugaauuacuauaaaccauuagccacuugucucugcaccauuuaucacaccaggacagggucucucaaccugggcgcuacugucauuuggggccaggugauucuuccuugcaggggcuguccuguaccuuguaggacagcagcccuguccuagaagguauguuuagcagcauuccuggccucuagcuacccgaugccagagcaugcuccccccgcagucaugacaaucaaaaaaugucuccagacauugucaaaugccuccuggggggcaguauuucucaagcacuuuuaagcaaagguaaguauucauacaagaaauuuagggggaaaaaacauuguuuaaauaaaagcuauguguuccuauucaacaauauuuuugcuuuaaaaguaaguagagggcauaaaagaugucauauucaaauuuccauuucauaaaugguguacagacaaggucuauagaaugugguaaaaacuugacugcaacacaaggcuuauaaaauaguaagauaguaaaauagcuuaugaagaaacuacagagauuuaaaauugugcaugacucauuucagcagcaaaauaagaacuccuaacugaacagaaauuuuucuaccuagcaauguuauucuuguaaaauaguuaccuauuaaaacugugaagaguaaaacuaaagccaauuuauuauagucacacaagugauuauacuaaaaauuauuauaaagguuauaauuuuauaauguauuuaccuguccugauauauagcuauaacccaauauaugaaaaucucaaaaauuaagacaucaucauacagaaggcaggauuccuuaaacugagaucccugauccaucuuuaauauuucaauuugcacacauaaaacaaugcccuuuuguguacauucaggcauacccauuuuaaucaauuugaaagguuaauuuaaaccucuagaggugaaugagaaacaugggggaaaaguaugaaauaggugaaaaucuuaacuauuucuuugaacucuaaagacugaaacuguagccauuauguaaauaaaguuucauauguaccuguuuauuuuggcagauuaagucaaaauaugaauguauauauugcauaacuauguuagaauuguauauauuuuaaagaaauugucuuggauauuuuccuuuauacauaauagauaagucuuuuuucaaaugugguguuugauguuuuugauuaaauguguuuugccucuuuccacaaaaacuguaaaaauaaaugcauguuuguacaaaaaguugcagaauucauuugauuuaugagaaacaaaaauuaaauuguagucaacaguuaguaguuuuucucauauccaaguauaacaaacagaaaaguuucauuauuguaacccacuuuuuucauaccacauuauugaauauuguuacaauuguuuugaaaauaaa

SEQ ID NO: 17427 - RNA, 3094 nt, Homo sapiens
accgugaaugguggccccacuggcuccauggagugugccuucacgcgggggaauguccuuguccaacacgcuguaaucuacuccaugggaacugacuguccugcuuuucacaacauugagaaacaggcccagagccugucucaugugccaggugcagucacauuauuguuaaaauaaaguggcuucugacaaaucaguuuuucaaaauagcauccuauguacuuuucauuucuuccaacaacccucaggcccccuuuugccaguuuucucccccaggggagauuuucaagacuacuggagaaaaaucuguuaauaaaacauuugcucugaguaccagcuucagugacucaaucauuuauacaggauuucaguguuuuguucugcagcgguguucuaaaggguucacauaguauaauggaggagggacaaagcagaauauacuuccaagcuggaacaucuuuaagacauuuacaaacuguuaugggacacuaucagcaacuacgccuggggaagcuagcaggauuuagcucuucaauggcccuccaaaugcacccaacaaucgccaaccucacccauggaaaucaucuaaaaaaugaaaagaagggccuuaaaguccucacauggaugcuguauuuauaacuaaaauguacaguuuaauucuaaauagcaggcuuuuaaaugcaaacagcuuccaggugaguccucuggcugccaaucagacugcugauucuaaaccauucucacacagaauuucugaaaccaacaccagguauuaauuguuaacugcagugaaaggaaaccaaggcacauuacaaaaggcuaaaugcugcuguuucuaaguggaagcacuguugaacaacacucuuagguggaauaagaaaauuaggguuaaacuguaacauuguaaucggacgaacaaaucagcaucuuugauccucagguuaaaauuuaaucuuaaauuuagaaauucaaaguaacagccuuuaaccauuaaccuugaggaaaaugugaaguagcaucuggagucucuuaagccccagcccuguuguccccuacagcaucuccacccaggaaguccaguuccuaacuaaugggaauggauccuuuucccauuauaaagggccgaugcuuaacccuugaacccacuacuguucuuaugccccaagaucugcaccuuacaucaggcacccgggaaugcuucucauugaaauuuuaccauaccaaaaaauauguaagggugacucaucacuccuaacuuuggacuccuugcuuugagaucgguauuuuuuucucucucuuuacauauagcaaaagcuuuccccaguagcugaugaauuuagaacuuuauacaagacucccuagcauuuuccuccucccacaggcuggagaauuucagugcuaugagacugggcaguaggagccagagccaauuugcaggaucucuuuuccuucugccuuccaguuggcuucucuucucagcugcgugguggggaugauuugggguuuccucagcaaggccauucucugccuugugcccauagcagggccuuggguggugacauguuaucuuuguuggugagcagacacucagagauccuuuaauuaucugacacaccagggaaaucuuggcaaucaacuaaggaccugugacacucauaacuauguuuacauuuggcuuuagcauauuucagguaauaucuuuaugaaaaaaagaugaaguauggaauuguaggaacucuuuugcaauagacugagauccaauguuuaaaucuuuuuauuucaguuugaucugugccuuuagauuggggacaaaauuuuaaaaacaaaucuuccaaaugacaccacaaugaaagccaguuguggucuugaaaaaucucucuauugcauuacuuauccucacccuuguuuuuuaagagguagagagagauuacugggaagcagugagccaacauaauuguccuuuccucuacagaauagcugugcagaaggggaccaccacacuuaggaccagugccaggugacaaucuuuccgucaugcugcugcagcauuuugcaccuugagagacaggaaaaaaaaugggggugagggaguggaagaugaugaaacuauuucucuuuuaugucuacauccuuacuccucaaaauacuuuaagcucacucagaccccauauacccugcccacaauacuaacacauguacuuugcauaaguaaauuguugauuaaauaagagcaaaacuauauucuuauguguagauuaaccaaggcuaauuuccuggaguuuaauacacuuuggauucaaguaaaaacaaucacuuaaugcagcaacaucucagacccucuucacucuagaaccguuuuauacaagagaacucaacauuuacuguuuuauuucugauauugccugccauuacucaggaugcaagagaugcucugcauuccuuauuaggaaaaauuggccuguaaggagaaugguauacugcguauuacuacugugagacuguaaaauuguuaauggacaguguaaagaauuguauucauuuuauuagcaagaaaaauauugcauacaagaacuacugcccugaaauauccaucacuccaaugaacuguucugccugaucuaacauaaaguuauauuucauugcucauuuuuuuuugccucacuaaaaugacuaacuuaagggaaugugcauuucuacaagacuuuaauuggauaaacucauuagaagaaaauguuucgauugcauucaggaacaaagaagcauaaccuuuguugacucuuguaauuuauuauaugcuucauuuaaacccauuuuguaaagaaaucagguaacagucauuuaaucugauauaauuagaaauagcugagagaguaaaaaagcauuuugaauguccuauguauggcauauccuguacaccaauugaaggucagagcuuugguauuuuuguauaauucugucuuaucuggugcaucagcuguguauuuuacgucaagguaaaugagcauccuguuuuauauguuaaauuuuaaaaaugacuuuuucaaagaagaaugugauugcugugauuuuuaaguguguauauuuuuuccaaaau

SEQ ID NO: 17428 - RNA, 965 nt, Homo sapiens
uacccaauucugaaggaaaacuuaguagagaugagaaauauaaggccuuacgaaauguauacucaucaacgaggcagcuauucauaauugaauccuagaagagaugguuggauugaaucuccuucauuuaaucccugguagcauuacaggccucagacaugaacucugauuucacuugcaaucucucuagauuucaaguucugucucucacuaccaguggaaaauauaguuucauaacugcauaaugucuuuaaguuauaguuaaggaaguauccccuaagauagguaauuucuugagauaaauaauuucuaccuugagggaaauaucccucaagauagaaauuuccacacugggaacuaccaaauugcauuuuuaagaucaagggaugcauuuuagauuucacucuaguaauucuaagucuaaacagacuacagucccauuucaugucuuuggagauugcuuguucaaauaagauucauugcauagaagccaccuugucaagcugauaaaugugagccuagggaaagagaugaaaccaacaacuauggauuaaggcacauguacaugcaaacuugcugagaaaacuugaucagaauguuacgucugucacaagaauccaugcuaacuacaucuuuuagauguaauuuuuaauuaugaccccagaugcuuaucacagggcugucugauauuccaaagucaaaguaucucugacaaucuugacauucucucgaauauuucuucuacuauagguaggaaguacucccuaaaaguuuucuaaagccauguugaacuacauccuccgcacucacaccugacccccucuguuaguuucuaguaauaaacuacccuccucaaggcaaauccuuuccugaaagcgaaguaugcaaacugacaacaaucugcuaagcuaagucauagcuaaacccauuagagucaacaucuucccaggaguuuuccgcuuucc

SEQ ID NO: 17429 - RNA, 471 nt, Homo sapiens
cucuuccagggaugcugucuacaggcacucagaaugguccagcguuugacauacauuguaggcuuuccuacaauacagccucuaacaaaacuaggcugucccgaaccaaaacuaggcugucccgaaccccugguaauagaauuguuuaucuuuauaccaagaaguuugggaaagcaccaaaaucugcauguggcaugugcccaggcagacuucaagugguuccugcuguaagaccuaaaguucuuaugagauuguccaaaacaaaggaacaugucagcagggccuguggugguuccaugugugcuaaauguguucgugacaggaucaagcaugcuuuccuuacugaggagcagaaaaucguugugaaaguguugaaggcacaagcacaaagucagaaaacgaaauuaaaaaaugaaacuuuuuugaguaauaaaaaugaaaagacuuaaaaaaagaaagagaaaaugagga

SEQ ID NO: 17430 - RNA, 4262 nt, Homo sapiens
cauuuauuuuaguuuaauuaauuauuauuuugacaacauuacuuggguaauaucuauauaaugguagauaaccaaucaguuagcuuaauuaaucuaagcuauuugaauucagggaaauauuagucaaaucugcuguuugacuaaauacaauucaaagcaguguauuugugacuuggaauauagaacacaaacaaauguguaacccaucugcaguaugcauucuuccauuuuaccaccacuaaccauugaggcucauacaauuuucaagcaacaagcauugcuucccaaagguaaaauaaucaggaauauuucuauaguaaauggaguuuuuaauuggcaauacuguuuauuuuuuucuagcaaagacaauuuaucucaguaaccuuaaauaggaaaaguacucaaaaauuaaaguugacuuuuggcuuuuuguagucucucuggaggacuuccagaaaauuaccacuguuggauuuuaaucugcuuccauuaaccaaucuuacagagaugauaaaugaauuaacuaauauugaccaaauauaaauugacugcaaauaauaagccgcauaaaaguugaaguaggaaaacuacuccaaguuuauauauuaggcaccuuggggaauucucuuagucuuuccagcuaacaaggauuuucagcauaauaaguagauuuaaugauggcauaaaauucccagauacuuucauauacauuuuuugccaaaguguaaaucuucuccuuuugcagucuuuuuguuauuaucccaacaucuagcugcucaggcccuaauuuagaacucauucugauauuuucuucuucuguauuaauuaauacuuaugggucaugaaucccugcuccuuugaccuuuuuaauagcucaugaauccaucccauugccuccccaacucugcccacaccugcugcaacacuaaugccuugauuuuccuaccucagucuccuuuucuauuaaucccucuuuugcguggcugccugaguccacuuucucaaacacaaaccucacuaugcaacuuuggaaucucuguaggcucaccuuugccauuucuuaauauugcauucuccaaauugcuaaucucuauccagucucuugaacuagacuuggcacauggagauuccgcucagaaagugcucuucacacuucuaccugcuugacuaaccccagauuaucuuucaagacuuuaaucugaucuugugucuuagagaagcccccauaccugguagagcauguaccaucuuacaugcuuaaauaacuccacauuuauuuguguuuauuacucuguguuauaaauauacauuuguuggucucucucuuggauuauuuuguuucuuuguccuguaacuaccacugaaagggugcaauacagcuuucuugaaauguguauugaacggaugaauguauaaauaaaaauuaaauuuuguaaauuucugcuuauucuuagaaaaagaaucuaaauugugacaaaucagaauugaaaaaaguauucuaauaaagaaaaacaagcuuuuauaacuucaguauuugcuucuuuuacuuugaaaaacacauagaauaguauaaagguccagucauauuuucuguaauagugaauuagugucuugugagcaaaaugaguucuaauuccuaaacuauuacacagauuacguugcuuucaacuuauuuaaauuucccuuguucuucauguuucauggacaguacaaaugcaaaccuuauuuuuauccuuuauucuaauaacauaaugcauugauuuuaaauguaaagaauuuuaggcugcaugguggcucacaucuauaaucucagaacuuugggaggccaaggaggauggaucacaugaggauaggaacuugagaacagccugggcaacauaguaagacccugucucuacuaaaaauaaaaaagaaauuagccaggcaugguacuugccuguaguuccagcuacuuggguggcugaggcgggaggauuacuugagcccaggaguuugaugcugcacugagcuaugauugccacugcacuucagcccgggagacagaggaagacucuguaucuguuccccccaaaauuuagugauuguauuucuuuacaucauacuguagagaguugauguuuguguucacuccacuaaccucauuccacuuuccccugccaguauacuucagaauaucucagauccaauucaaaauuuaaucuuaaaagguauaauuauuuucacaguuucauaguuuaguuuugaucacugaaagcauuucuuucauuuugucuaaucgaacaaauuuaugcaaagaauuggggacuuauuccucauuaguauuguucaucuauagguggaaauaaguucaaguauguguugcaguauuaauuaaaggcaaagugaccuacuuguacuauauucugaauaaauacuuauugaaugaaugaaaaauagaagagugacucaauuauuuuagaaucuuaaguuauacagauuuauguaaugucuauuuugauuuuuauuaauuaaccaugaauuuauccuacucuaguauugagaaaaagaaaauggaacuauagacccuucuuucauaugauacuuaggaauguaucugcacuguauccagaaagucaguuacaugcccuguuuaccaauugaauucugcuucacuaaggauaauaauaacugacauugagugcauggcauaugaugggcacugugcaaauugcuuugacauguuuuguucauuuaauccacacaaugguccuaugcuauaaaaacaguuaauaucuacuuuuuuaauagaugaggaaacugcagcuuagagagauuagguaagcugccuuaagucacccugccuguaaguguuuagagcugagauucacauucacggaguccuccugaagaaccuaggauuaaccaccacguugaacagcuuuggccugcaaguuacaugcuucuuagaaaaugaggcuauuaucuauaaucuguauuuuuuaauaucaauuuuauuccuuucaacuggucaguuauaucauaaauuccauggaauuuuuauggaauccaugcuuugccacucuuguaucccuauaguggugcuggggaaucaagacacauuuauuugccuuagcacucuuucuuucuuucuuuuuuuuuuuuuuuuuuuguaauuuuacuuauaaauugggaggguggccauaaaauuuaucauccaaccacugaaagugaaagaaggugcuauuuaugauuuccccaggacaacaggcagaaaauagucucuggucguacauuuagccugcagagagaauuuaaguacauuauggauagucugccauagacacagcaguagcaucugcaacaaguaaaugauaaacaaaaaucaacuuucagggaaauagccauuuuuaguaguaaacauagggaaauagccauuuuaaguaaaugucaggagagucucacuauaaacugccuauaaugagacaguuuaguaagcuuaaaguuuuauuaauuuccaaaagcaucuaauagguugagauuuauuggcauucaaaaguaugauucacagauuguaagagaagcuggcaaagaaagucauguuuuugcuggccuauggaaugcacucgagaauucuuugggcuugcauaucuucugauucaugugucauaauaauaaugucugugugauucucagugaaucaugaaugugugauugugcuuuuaugauaaaauuuucuuaugaagucagugaaaauaauucaugaauaauguugucaaaauuacuuuuaaucacaagauuaaccugcaacaacuauguauauuauuuuuauguguuggcuuauuauguucaaaaacuuuguuuauaaaaacugauuuugcuauuuaauuuuuaauuuacuuuagaaaauaauguagcacaauguuagauuuauuacauauguaacaauacuauuuaaugcugcaaaaucauagcacauguuuguaacuaucacauuuuauuaacugucuuuguacuuuuaaagaaagaaauaugaucauaaucuuuaguuuuauuuaaaucaaggaucauggauuuauuuugacauacuuucuaauaauuauaauuuuuuccuuuguaagcauaugugccuaaauucucauugagggcuuucuguacuguguaaauagcacagaaaaugucuauauaggaauguuuaaaaaauauuuucuguugcauguaacugaaaagauacaucuaauaugcaauuaaauugaauaaaauaguacuuagugaauuaaaaaguu

SEQ ID NO: 17431 - RNA, 772 nt, Homo sapiens
gcaggagacgagaaagggacaccaagaggcacggugcuucuuccccaccuaagccugcggccugcggacaccccaaugcacccugcgcccgggacaccgccgaccccgccccgcuuugcucuuugacaggucucucucccggcgagggccguggucuucaggaaaggcccgagccccuuucccagcugcgcccuaggcgcgcgccccggcugcccgcacccgccagugccgucgcgcucaccugggccgggaggcugacagccuugggcugugcccugagggccgcgagaggacgucgcgcuggcagacccgggcuugggccccgcggcgcugcgccuccaacccggaagaacagccccaacuccgcggcggcgggcggccacgugacugcagcuccgcucccaccucggcccgcgccccuuccccgccccagcuuucuucccgccaggcccccuccacccgaucgccgcgcgcucuccgaaccaaaaggcgaccucacgaaaugccccuuugagcucaaaggcuaguuacccccaggggcccuuccacucucggggacaggcgaaaccucuuugucucugccucggccugcggcccccagcccagccuccgcgcuuucccuccgccaguccuugucaaucaaaccuggugccaaacgcggcagcugaaguuuucagggacacauuugcuucuccccuugaagaaccaguuacaaagcgugauguccucucuggggucccaucagaacaaagaaacagguaauauaacucca

SEQ ID NO: 17432 - RNA, 772 nt, Homo sapiens
uggaguuauauuaccuguuucuuuguucugaugggaccccagagaggacaucacgcuuuguaacugguucuucaaggggagaagcaaaugugucccugaaaacuucagcugccgcguuuggcaccagguuugauugacaaggacuggcggagggaaagcgcggaggcugggcugggggccgcaggccgaggcagagacaaagagguuucgccuguccccgagaguggaagggccccuggggguaacuagccuuugagcucaaaggggcauuucgugaggucgccuuuugguucggagagcgcgcggcgaucggguggagggggccuggcgggaagaaagcuggggcggggaaggggcgcgggccgaggugggagcggagcugcagucacguggccgcccgccgccgcggaguuggggcuguucuuccggguuggaggcgcagcgccgcggggcccaagcccgggucugccagcgcgacguccucucgcggcccucagggcacagcccaaggcugucagccucccggcccaggugagcgcgacggcacuggcgggugcgggcagccggggcgcgcgccuagggcgcagcugggaaaggggcucgggccuuuccugaagaccacggcccucgccgggagagagaccugucaaagagcaaagcggggcggggucggcggugucccgggcgcagggugcauugggguguccgcaggccgcaggcuuagguggggaagaagcaccgugccucuuggugucccuuucucgucuccugc

SEQ ID NO: 17433 - RNA, 34054 nt, Homo sapiens
cacgucucuccugagaacuaccgaguaggucgggccugccugugguaagcgucccccucaccccucaucccucaucccccccagccuggccccggaaccgagaugccccugcccgagccuggcugcgggccggcagguggccaagacgccacucggcgggcggccugcugggcccggcggccggccagccgcgaacuggaggauccucgcgggcgcgucccgggccuccgggccgcagggggccgcugugacccgccugcgccccugccgcgccgaaggcggggagccggguuuugggggagaacuggaaagccgaggguagccgagcggggcgggcgcucuggagcggcgggugcucgggcugccguccgcuccgccagaagcaccgagcagccgagccggggcccgccgcccuccuccuccaugaggcccgagugaggcgcggcggcuauagccgacccgcggcgccuuccccccgcguccuaucgcgagcgcagcggcagcggccccuggaggaggaggcggaggaggaggagcaugucggacgguuucgaucgggccccaggugcuggucggggccggagccggggccugggccgcggagggggcgggccugagggcggcgguuucccgaacggagcggggccugcugagcgggcgcggcaccagccgccgcaacccaaagccccgggcuuccugcagccaccgccgcugcgccagcccaggacgaccccgccgccaggggcccagugcgagguccccgccagcccccagcggccuucccggcccggggcgcucccagguacggagcagcucuaagggccccaguccuccuuggcgaacgcuuccccacggcccuccacgcgugccgaggcccgacgcgcugucugcgguccccacccccgguuccccgaaagcauuccccgagagggccgcgugaccggguagggacgggcccggaaccggguuuggaaggugucugcuggaauccuuugugcgccuggcuggggggaggggccgggugcgcggucucggaguucggggucccgggaggaaguaaaaaucgccuccccucagcagcccucuaaagcgagacccuagcgaguaaccaccucuuuuccaccgaccccuuuaaaacgacagagaggaaaaaagcucgcaagcacucauuugagaggcagguaugcccauaacggagucacagcaagucuauuguuccuuuuuguaggcugucuguacacauuccggcgauaaccauaaauuucaugaugguuccuguuuaacucuuaaaaacagacgcuuuucagaugguuuuucaguauauagcaaguugcuguacaaaggaaagaaugcaucugacgccccguuuuuuuuucuuuugcagagcaaacgaggccccugagagcuccaccuaguucacaggauaaaaucccacagcagaacucggagucagcaauggcuaagccccaggugguuguagcuccuguauuaaugucuaagcugucugugaaugccccugaauuuuacccuucagguuauucuuccaguuacacaguaaguacacccuuuuuccuacaacucuggguuaauuuacuggaauaaugugguuguuacuuuguuaaucagaguauguuugugcuuucuguacuacacguaaaaaaauuuuuuuauugugaauguuuugaauuauugaacucagaaggaaacaaagcugauucagaaauacauuuuguaguuauauucaagguauuagaauguaagcuugagauacacaucuguguucuuguuucuagugauuauuccauuauguuaaaauagacauaguuuugauccuaauuauuguaugcagaaauguccuacgggguugugauaaaguauuuacauagguauaaagaauguuuaaacuuucaguuuuucuuugucacuuauauaacaacuuuaaaaaauagucacuuuucuuaaauagccguacaaagcacaguuggaauauguagaaaggaauuuguuguacuggauaaacccagaugaguaaaugcauagggauuaauuauagagaagugggagggaaucauuggagaaaugauugaugauacuuuagcuuaaauccugucuuuccuaucuucuuaguuuuauugaaguauagcagagaauaguguacuuaaguguuagcucagucucauaaagugaacacucaacuaaccagcaucccagucaggaaauagaacauuaucaacaucccgaaaacccacucugucuccuuccaguuguucuugauguccaaguauagcacuguuuugacuucauaggauaguuuugccuguguucaaaguuuauauaaauaaagucauauagaauauauucuuucucacuuucaauaucaagauuacuccauauuguagcauauaauuggaggugacuuauuuuuauaacauuccauugcaugaauauaucccauuugucuguugaugaacguugguagcuuucacucuuggguuauuaugaauagggcacauuuugugucuugcuggcuguaugccuuuauuucuuuuugguauauuaccaagguauggaguugcugggacuuaggguagccagcuuuagcagagacugccaaguaguuuuccagagauuguuccacuguacauucugaguaguguaugauuuccaguuacucugcuuccuggucggcacuugguauuuucuguuuaaccauucuggugggcauauaguaucuaguugugguuuuaauuuauauuucccuuauaacugauaaugacacaccuuuuuuauuaccucuuuuuggcucuccuuccauauuugacaguaaaaguauggaaaaagcuguguuccauguuuuagauacuccaugauucuuaugcuguauaggaaaaagcuuugggauuggaaagaaaaagauacaggcauagcaggaaaagcaauugauauggggugaaaaaggccaucuaucguguaagguagaaaugagagcaucuugaguucuugccagaaaauuguauuuagcucacagaggaaaagaaccauuagagccacuguaagagguugaauaaacucuuaaggaugcuuguucuagcagcuacaagcagguucccauuuauuuucuucccuauugacuugggcuguuuuaugauggagggauacagggguguguuuguguauguaauaaucguguaucaacuauuuuuacgugguucaagugacuuuggggcugucgagcaguauauaaagucauguuaguccaccuacuuugagccacugcaucuuuuaggcauuccuugccauccucuaauagaucagcaccuccugugcucaauuuaccaaaacagauugcagccuggcaccuggaaaccuguguggccugcaggugucuucucuagcccugaauggguuuguuuuuucuuuaaguuguuuuauuuaauuaaccaauaccuaaauuagauauuagaaacuugaauguucugguuugucauaaaaucuggccuuaguggacuggcauuuugauacagcaaaaauugguuggagcugaguagaggcauucucuuuagauggagucugugagcucuaauuugcuuucuggcuuauuucauucauuuguaaucuaccugaauucuacaggcauucaggcuuacuaccccuguucugguauauucucuagccuuacugguuuacccuaaucuuuacccauaguuaaggcuaagagaguuuuucucaauccaauuagucauagaacagcaggauccuuuuuucccccgacucuuaggauaagcucuuguugcaaaggaaacauuuccuuuuaguagccauaauccaaaguuagcuacauucacucauucaacaaauagucaaguacuuaucaugagucaagcaccggugauacagcaacaaacaaaauggacagaaauuccugucuucauggagucucuauucuaguagucuccuggcucaguuugcagacauuuauugaaucugcuuuuguucuacacaugaaaaucuauuuccugguauccuuuuucuaacagccuuuaugguagucuucugcugugcuuucuuaacucuuucaaggcaccaagcccuuuuaucuucaguucuuccucuaauccugcugcuagaauuuccuacuuuccaugucuucuuaccagugaguugcuauauccauuuaucccuggccauuauuucuucucagacaaaccauuaugccuugaauauuugucacaguucacuuaccagagccaaaaauuuaacauaggaauucauaaagcauugaugaagagacagaaguccccuuccuccccugcaaaaaaacgagcuuuuuuucuaagagaaucccucuucaaguuacuucccaguuuuuguucugccuugcaguaguaucauucuccaauagguaaaauuauucacugucucucacuguucagaccucugcagucugaucucccuaauuguauugauacuauuuuugugacugauguucuuccgauuuuuaaauuuaucuuccuaaaucucauuuuaaaacuuugagcacuguaggaucuauucaguuuauaaauccccaugugccagguccugugcuaggugcaaagguaccuuuuuagucuaucagaagcucccucccauuguuuuaagaacuaaguauuugagguacuaguuuuguucuuuuuucucucugaguauaaucuccuucacucccgagacucugcaaugauaauucucuuccagauuucaaccuaugaauuuauucuguagcauuuguuguuaugagcaucucuucuccccuaccucuuuggcuucuguggcaguacuuuauccucccaacuugcagaucauuccuuuuccccucagaugacaguuggugacguucuuucuuccauuuuauuaccuccuuugcuaaucccgccuauuccauagaaucuaucacuuauuuaugugcuaauaacccugacaucuaauuauuccuuugaacucuagugaacucuaggcauacauuuucauuuauuugaccacuucuugaggaccucacauucaaaugcaaguauaaaaucuauacacaguguaagaauuauuuaucucaugcgaaucucuucuaacuagcugcuuacacuaagaacuugguggcauauugacucaccucuccugcacacccuugccuuaauucaauccagcuagcuaaaguagucgugacuauauucacucucuguagugucugaucaguuuucuuuuauucccacgguucuguaauagguucucaucucuugacaauguauauagaguaccuaccaugaaaaaguacauuuucuauuucucccaaucucccauagaauucuaagaaaaauaaaacuugaaaauaucucuguuuggaagccauuugacuccacauugaagacugaagaaauuuguggcuuuaaaaaaucuggugcuagagaaguaaugcaggcuuugauucaaacacguuggagugccugucuguuccaaauacucuaugccuccuuuuuuugcuuaaaauggcaggcucuggauccucuguucugcuauauucagagcaguucuacuuucuucuuuuacugaucagauuuuacauuuucuuaaaagagaguucuguugacuuuaaaaaaaaaaaaaaaaagauugcaaaucagcgcucuaagcagcauuuuugccacgaagaaugacauuugauggaaacaggaaauuaguacuuucagcugggacccguaccuuugccuuucugcuguuccuugucauuaauagugguaggauacuacaagucuguaaaacuaguaacuguauaucaaaaacuuaagacuaguuuuuaguuauaaaauucacgcauguauguaguuaacauuaaguauaugaauguguacaauuaugccuaacugcuuucacaacuuuauaaugucaauauuuauaaugggaacauuuucucacucuagagguaaguacuguugucucuuguuuucuuaaauggcuauaauauuccauuauacagauauaugauaauguauuuaaccaauuccuuguuaauggauuguuacguggauuuuuuggcaaugaacaucuuuguacauaaaauuggguuuuaagcuuuuguccuuuauuuugaguuucacagagagguuaaaaauauaggcuuuguucugcgcucaguucuucuaaucaguuuugugaccaugcacagucacuuaaguuggugcaugguccuuccuuguucaaacccucuuucccccauccuguuuuuccuacuuccuuaagagccaguuuccuuaauuuggcccccaaagcccucuaagaucuccuuaucugccucauugaccucauuaguuaccacccauccucaguuucuguauucuaguuauugucuuuuucaaaguuauuaggccuccuuggggccugugugcuucuugugcccauagaaagagaauaucuuuccuuagauauuuguauggcuggaucuuuuuuucuuucuuaguuuauauauuaacucuaagaaucucuacuuggcuuuuugcuuuuuuuuuuuuuuuuuuuuuuguaguauauuucaacuucugaaugugucuuccaucaugggguaugagcuccaugagaggagagccuugucugcuuuauucauggcagauauucaugucauggcaguaucccauccccuaagacagucuuuggcacuuaguagguacucagcagccacaccauuuugaaugaauaaccaaagugacuuaacuacucugugccuguuucuucuaugcagggaggauagugaugcuuaccucaaaauguucuagguuaaacaagaugcaggcaaagcccuuauggugucuaucacauaucauauaugcagcugguggcuauuagcuuauuaacuggaguaccauccuaggugccaagaaauacagcuuuuuaucauucauuuuggaugcuuuuuauacuuuagucccuuuauguaugaauacauggcuguugcauuuggaauaugacucaguauucuccuagaaauuuaaaauguaauucauuuguugaacauucugugcuuuacuaugugcucuucaccaaucuaggugaauuugauuaauucacuuaauccucagagucacagugauaauauuuaugauuaguaaauaaaugcaucaacauuaauaccuccuauuauaguagaauguuuaacuugaauucaaaugcgugacaaaaaucuaauguauuagaguuuauccuucuauucaaugaacacuauaugugaaugaaaaaggcacaugaaucugcuauuucugcagcugguuuuacuuccugacugccucucauaguacaugcaacuuuugcuaaguaucacuucagucucugaagauacauaggccgggcaugguggcucucgccuguaaucccagcgcuuugggaggccgaguuggguggaucauuugaggucaggaguuugagaccauccugaucaacauggugaaaccccaucuccucuaaaaauacaaaaaaaauuagcugggccuggugguacaugccuguagucccagcuacucugggaggcugaggcaggagaauugcuugaaccugggaggcagagguugcagugagccaagaucuugccacuguacuccagccugggugacagagcgagacuccaucucaaaaauaaaaauaaaaaauaaagauaaaauaaaaaguguaaaacaugaccuccaaaugaugguuauuugaagugguagcacuauagugguccauuuucaugcugcugacaaagacauacccgagacugggaagaaaaagagauuuaauuggacuuacaguuccacaaggcugggaaagccucagaaucauggcgggaggugaaaggcacaucuuacguggccgcagcaagagaaaaaugaggaagaagcaaaagcggaaaccccugauaaacccaucagaucucgugagacguauucacuaugacaagaauagcaccggaaagacuggccccauugauucaguuaccucccuccugggucccucccacaacacaugggaauucugggagauacaauucaaguugagauuuagguggggacacagccaaaccauaucaagcaccaacaguaaagggacaaguggacaauuggcaauguuggucuuucuccuaagacuguguccugggccaggcgcaguggccuguaaucccagcacuuugggaggccaaggugggggaaucaccugaagucagaguuugagaccagccuggccaacauggugaaacccugucucuacuaaaaauacaaaaauuagccaggcaugguggugcaugccuguaaucccagcuacuugagaggcugagguacaggaauagcuugaacccgggaggcggagguugcagugagccaagauugcaccacugcacuccagccugggcgacagaacaagacugucucaaagaaaaaaaaagacugucuuucuccaacauggagcauuucuaaggguguuuugaccauguaugacuuuuuuuuucuucuaugcacucacugacuuuagaacuuaaccccuucacaaaaugcuucuguuuuguagucauaacuuuuuuauguggcuuuucauuuacucuguuuggagaagguuaaauuucauacaagcaguguaguuauuauuagauuuuaacuguuugguaaacuuuaaagcgcuucgggugguauuccaggcauugagaugugaaaguuguugcucaagucuauuaucuuuuguaaaacucgcccacucagccuucugccauuaaugaaaagguuggaaacugccaaaggugacagugguggaaacaacauuagcuggaaacuacugcugcuaucaagguuguguuagcaaccuggauguagcagccaaaaggucuccuuccauuuauaccgugaugaaauuuuaguuacucgagcagcuuuaugcauuucuuugcccuuggggauuaacagaugauaaaccuuauuagguuuuuguuuuuguuuuuuuuuuccccaauaaaaaaguugucaacauuugcagaaauacagagaaugguauaaugaauccucauggccucaacaguaagcuacauguggccguucuuguuuuuauaucccuaguccauacuuccccucccacuuugaagcaaauccuagaucuuauuucauucguaaguggaucagauucuuaauuuuuauauuggcauuguagugaaauauugguuuaaacuuuauuccucagccaucuuagaaguugacccagaaugagaagacaauucccuguuuagcugaacagaaccuuucugcuguuaauuauaacacuucagcuuuuaggcaaggaagaaaaauagcucaauugacaauuuuauugaugaacauaaauuuuuaucaugugagggaucuuuaaaaaagcauuugugcuagagacauaccaccuuguguguuuuagccaguugcauagauuaaaauuguuuuuucauuuuugauccguaggaauccuaugaggaugguugugaggauuauccuacucuaucagaauauguucaggauuuuuugaaucaucuuacagagcagccuggcaguuuugaaacugaaauugaacaguuugcagagacccugaaugguuguguuacaacagaugaugcuuugcaagaacuuguggaacucaucuaucaacagguauguuggcuuauagcaugcagugaccuucagauagcuuccuugaagcccaaggauaguggcuacuccuugagggagaccagauucaugaucaccugccuccacacuuacucuuuauaguuuccgggaguucuaagucugucuuguauaaaacuccuauaguuagggauccaaggguagagccagacaggauugcaaguucacauguguagucaagauucaauauagguaauauucaccuguuuagccaaagcucuauacaagcaguauaguauagaaggugauaugggcacugaaaacgaaggcuacauaagugucacccccaccaaaacccugccccuuguuuugcaggcucugaaauuagcaguaccagaaaagacugcaauucuuuuccccuauguguugaauugaauaguaguauuagaguaggggaggaaaaaaauugagagaauuugcuugccucauaaguaggucuuuaaaaaaaagaaagccaaaccauaaaaugucuugucuuagcauuucuacuugccuuugcuuucuuuuaaaauuuaaggauuucaucuuaauuccuugaaagucuaauuuagucaguugaaauuguuucauuauacaacauuuaguuuuuaucccagcauauuggucauuaacauauuaacgcuuuuuuuuuuuuuuuuuuuuuuuuuuugauauggagucuugcccugucucccaggcuggagugcaguggcgcagucucagcucccugcgaccuccgucucccggguucaagcgauucuccugcgucagucucccagguagcugagauuacaggugugcaccaccaugcccagcuaauuuuuguauuuuugauagagacaggguuccaccguguugaccgggcuggucucgaacuccugaccgcaagugaucugcuugccuuggucucccaaaaugcugggauuuuacagacaugagccgcugcaccuggccucauuaaugcuauuuuaaaagugaaaaauacaguagacaacacuggcuuaacacaaaauuucuuagucagugugagacuggucaaaaaaaaugggccaugaucagaaauguaaacuuuagguucuuuaagucacuguuacaagagcaacucaaauuuggaauauauggaagggagauuauaaugcaaauuaaugauuauuuucuauccuaauguuucauuuggcugcuuuuccaaguuauucuggaugguuacuggaccccaagauuaccuagccaacugucaguuuugaggaaguaccugagauguuaggaagacagaacugcacuguuuguccucauuucugcuuucugcugauaaauggauugaaaaggaauaugagauaagaaaaugaaacaaauguauuuauuucuuguugccuuucuggcuuccuccacuauuuaguuucaguuauucaguaggcugcguaauuauacuuauucagggcuggacaaagggucaguaaccugauaagcgucaacuauuucucugauugucaaauauguagucaguauguuuaauguuuuaauauucuaugaucaaugaugcauagguuuaucaauagcugcuaaguuucauugagguaauuuauggaaauuuacucauagcaacuaacaaacgaggaaguauuacaaaagaugacagauuaggccaggcgcaguggcucaugucuguaaucccagcacuuugggaggccgaggcggguggaucaccugaggucaggaguucaagaccagccugaccaacauggagaaacccugucucuacuaaaaaaaaauacaaaauuagcugggcuugguggugcaugccugugaucccagcuacucgggaggcugaggcaggagaaucgcuugaacccgggaggcggagguugcagugagccgagauugcgccacugcacuccagcuugggcaacgagcgaaacucugaaucaaaaaaaaaaaaaaugacagauuaaauacacauucaacucugauaucucccaaacaccacuaaaaugaugcuauggggauuuuuaaaaggcggaagcucauagggacagagaagaggaaaagaaaagcacuaguuuugaagacuagaaagcaggugggugagugguaccugauuuggcagaucuaacguugaauuccaagccaguggugguaaagcugagaaucaccaugacuuacagugcaaaaccuaaaagguucuaaaauaaggauggaaugaggcuaaaaggauugcuugagaaucuaaaaaguuagaccauccagaucuuuuuacacugaacagccgguuugaaauuuuguuguaacccuucuuaugaaauuaacaaaggacguacucugucaaaaagaggaguuaugccacggaugaagacaugggaaccaggaaaaggaacucuacaggagagacuaagugaacuguccagaugaugguucaaaggagaucucaaaacaauagcagcaugcauaguaggucugaagcagccaggcuucacuggacuaggucagaaggcuccaggaaagacuuccguaauaagaugagcacacaugcuguaagacauaagaagaaauuuacagaguagugaguuuagggauaaaucaaugagaagaauauaaaaguguaguaaaaacugaaucuagggaagacaaaguugugcaaaaguaaaagcaguguaauacaugguucagcuauaaaugaaaacacagcaaaugaauaaaaucauaaccauacugugauaggaggaaauaguagaguggggugaaauuaagcagggugaaagcuaaaagcucaucuuccaugaugggaaacuguaaguugaguaucccguaucugaaaugcuugagauuucaagcauuucagauggauuuuuucagauuuagcauauccaguauauaaugagacaccucagggaggguaccuaaguauauuacagcugaaggggguugacagggucuuuuuuccuuuggggaugcugaauaaauuauguguuguacaccuguguuuugacugaccugucacaugaggucagguguggaauuuuccacuuuuggcauuauguggacacucauauuuucuguuuuuggaggauuuuagauuuuuggacagggaugcucaaguugcaguaagaaauaacaucuaaacugaaaaauuacguagugcggagauauggggauuaaaacauuuuuggcugaagaagucaaaagugguugucuuugggaguaaaaccgggauguaaguaggaaacuguugaaugacaagccuuauagaacuugucuuuaaaucguguuauaacacuaaaaagaagcuaaaggaaaacaugcagugccaauaaugggaaaaauguaagggugaaccaagucuuggguaccagcuaaacauacaugaugucaggagaaaucacucuuucucccuuaaugugacauauacuggccccaugugagcaaggaaauaauuagaaauaaaaguuaguaaguagacccaacauauagagucagagggguagcaggacauuuguuagaucuagauucuauguucaauuacauuuguggccaagucccuuagcuuuuuuuuuuuuuuuuuuuuuuuuuuuaaaaagaugggggcuuuguuuugucacccagacuagagugcaguggcgugaccacagcucacugcagccuugaacuccuacacucaagugauccuuccaccucagccuccagaguagcugggacuacggugcaugcuaccgugcccagcuaauuuuaaaauuuuuuuauagagaugguggucacacuguguugacuaggcuggucuugaacucauggccucaagcgauccucuggccuuggccuuccagaguacuaggaauacaggcaugagccacugugcccgacuucuuaaccuuuuaauguguguuuucuuaccuaauauuagaugguaaacuauguucucuacuauucuuuagaaauugcaauuaaaguuaaacuugcugaacacugcuucaguuauaucaacaaucuuugauguguaguguuuucuuacuuuuuuuuuuuucuguuuuuaaguagcuuagcuguuuucauuuccccuuuacccaaucauucuuggaguguuuaaguguuaguugcuugugccaguuaccauuaaucaccucuuuaaagucuaacugaagcucagggagguuuacugauguccaaagucaugaagcaaaaugccagggaaucuuguccuggacugccaaacacuaaaaagucugugcuuuccugccccaagaagccccacuggucaacaguuuggcaguauucucauucauaauugucacugugcaguugaggacauguacagguuuucugcaaaaaauggguuagcaucaggagacauuaucucuucgcuuucugguagccucagguaacugauggguuuuuucuuuuuuuuuuuuuuuuuguacuuauugugguucuugcuguaagguugggagggaaagugaauuuaauuuccuuaagccuaacaaugacaaaagacuuguauauauggucaguuuggggagucaauuuuuucuucuuuagaauguugcuguuaaguauuuacauuaauaaugauguaccuaugucauauaacacuuuucuucuuuuuaaaaggccacaucuaucccaaauuucucuuauaugggagcucgccuguguaauuaccugucccaucaucugacaauuagcccacagaguggcaacuuccgccaauugcuacuucaaaggucaguguaaaugugaaauuaaaggaaaacuacuucuaaauauacuagaauuugaccauuccucagaccauauauuauaaaaagcugcaggaaagaauagggcagccuauucuuaugugcauuauauuugaaguuuauaguucaguauaccagucuuuuuucuguaauggucugugaauuugguuuuguguuuagaaagaucuuuccuuuuccaagaucuuaaaaauaaacacuuauguaauucuuauuacuuugguagcuuugguuugaauaaggaucuaauuuuauuuagauuagaauaaaagugaauaauccauuuuuccuuauugauuugaauugccacuuuuaucacacuugcauuauuuggguuuugauucuggauuuucauuccauuuaucacuuauucuguuccuuuuuauuaccauacaauucauacaauagcuauuaaaaagcuuuuuuuuuuuuuuuuugagauggagucucacuuugucucccaggcuggagugcagcggcacgcucuuggcucacugcaaccucugccucccacagguucaagugauuuuccugccucagccuacccaguagcugggacuacaggcacccgccaccaugcccggcuaauuuuuguauuuuuaguagagacggguuucaccauguuggcuaggcuggucucaaacuccugaucucaugugauccacccaccucagccucccaaagugcugggauuacaggcaugagccacccugcacugccaaaagcuaucauuuuuaaaaauaucuuaggguaauuaguuuuuuguucuuuugugggauuuuuuuuuuuuuuuccgagaccgagucuugcucugucacccaggcuggagugcaguggcucagucuuggcucacugcaaccucuaccucugaggcucaagcgauucucgugccucagccuccccaguagcugggaugaugggugcguaccaccaugcccagcuaauuuuuguauuuuuaguagagaugggguucaccauguuggccaggcuggucucgaacuccugaccucaagugauccgcccaccucagccucccaaagugcugggauuacaggcgugagccaccacgcccagccugucaaauauucuuugcuaugcuuguuucgucuaaugaacuuuagaaucaguguuugaaauuacacaagucuugcuaguauguuagauauuuuggagauaauacucaauuuauaagcuaauuuagagaaaacuaguuuucuuauaauuugaugucuucaguaacaagguuaucuucaaguuuauuauaguucguccauuaguuuuuuaagugacuuuuaaugauugcaaagcauuccauugugugguuaaacugcaguggaacagaauaaagauucuagaaguagaccccagagacccuugaaaauucaagcuuuugauaaaaaggauaaauugugcugguagcauaacuggauagucauuugggaaaaaaagaugaguucccaucucacucucugugcugaaaucccaaauaugucagagacuuauuaaaagugaaaugauagguggggcacaguggcucaugccuguaaucccaguacuuugggaggcugaggugggcggcucacgaguucaggagauugaggccauccuggcuaacauggugaaaccucaucuuuacuaaaauaacaaaaaaaaacccuaaaaauacaaaaaaaaaaaaaaaagcugggcgugguggcggguaccuuuagucccagcuacuugggaggcugaggcaggagaauggcgugaacccgggaggcggagcuugcagugagcagagaucgcgccacugcacuccagccugggugacagccagacuccguaucaaaaauaauaauaauaaugaaaauacuuggaauagcgccaaauagauauagauacaguuuggaaaaauacaaaugucaaaguuauaaaaagauaucuaaccauacuuauaauuaaagaaacacaaauuauagcuucuguaaagauucagaguggguacuuguaggcgguaggacgccaggaaugcucacucauauuuuucagugcuucucacccccggcugugccuuagaguuaccuagauacuuaaagccgagauccugucugaacccuuugaaauucugguguaauuagacgagguggagcuaggacaugguuuuuuaaagcuucccaagugauucuacuguauagcuaugauugagacccacucuucucauugacuguuacccaccauaugugcuucuguaguacuguaauccugucaauaauaauguagagaaauacuagugagcuaacaaguaaaaagcaaagcauaauucugcuaccucuuuaaaaaauauauacauacuuugaaaaagauggaacggaaguuaccuucacagcaguuaucucuuguuuuuaguaguagugcaggugacuuuguucuuuauacuuuuucuguuuuaaccuuuccaaaauaaacauacauugcuuuuauaauugaaaaucuuuagcuuaaaaauuugacuuuucaccuagucaauuauguagguauuuguuugcauguacauaaucauauccuaacguacagucugucauagcauuuuaugaaaaaaaaaguuauuucaucaacucuuaccgacaaaguuguaacagaaaagcagccaacagguguuuuuaaauaacugauuuggcauuaauuaacugaucucuuccauuauuaaccagaauguacuaucuauaaauaucccaacuuuuuucugaugaggaauuuaauauguacaagaugauaacaaauaucuuaccacauuugacuuaaacagaagauguugcucaguuaauauaccucguaaacauuggaauuggccacguaagcacaguaagcugugcugggguuucgugguuggcaaacugacccagagucaauuacugaacaagagguaauuuauuuuuucuuuguuaaaaauuguuuacaaagucaaccuaaacuggcugcguggaaaccauucaguacccauagcuuuucccuuugucuugaaaaggaaaacugucaaaaccaguuuugugaagcaaguuacuuucccagaguuuucucaccuuaucaauaaagauuacaaauacuuaauaacaaaaugauaaacuuuuacaguccauuuaaaaaaucuauguuaguaacaauaucugacacuguaguucacuuaugaaggcagugacaggauuauugugccuaguuuaguuaccuuguaggaacuaugacugacaauaagcuccaagaagaggauuucuucuuuuucuccucugugugaagcaaaugggucaagucaggggcaaagagagcaaggaaaaaucaguuauuugaagcugucagucucauuggaaauagaaaacaaguccggugcuuucuauauugugguuuuaaugggggaauuuuuuccucacauuaguacuucucugauacguauaauggaaauuacaagaauaauggacuuaaaaacaauucauuuuauuuucaguuggagguuguguguguguguguguguguguguguguguguguauuuaaagauccuuuucaaaguuguaguauuaaaaaaaaaauuacagagacaauuuggguaaaaucagugcuuucuuaguaaaaaaccuauaagacaaggugaggcucucucuccccucuuugggcugccaguaugcugugaaucagauuacaccuauguugcuuaaacauauuaaauuugauaaaaaucguugaaaauaaaacuaucaguuuuuucaaacugggagacuuaguaugaaaagaugguguauauucuagccucuucaauagucaggaacaguuucuuuauuguagaaagagcauugggacauuguccuugccucuugcuguggacaaccaaacugacaaaugguuauuuuguuugacuauuuaaaaagcaaagcaaugugagauuauaaaagauaugucuuuaauuagaugucggacugaauaugaaguuaaagaucaagcugcaaaaggggaugaaguuacucgaaaacgauuucaugcauuuguacucuuucugggagaacuuuaucuuaaccuggaggugagaaguuuuucuuuuguuaaguacuaacaaggccugagaacauaaguugaucucaaugaggaauuuguguucacauuguacuuuuacaacauuaagagugaaaugaaagagagaggaaagaaaacauguuucggcaccugcuagugucugugguuuacuggaccgucuguccauaacauuuacucauggacagaauguuaggaaauaauuacugagguaaaaaucugcguacuuuuaggaagcugugguuuacaugcaaauuuaaguucuugagauaucaacagugauaccuuuuugaguucuuacaucuuauauauuaauacauuuaguauguugacuuucagaugguggcucaaagcaguuuacucugcagaacucugagugaaaagagagacuagagucucucuaggcuuuucacucuaauucacccaaauaguuuuuuaaaaauauuuuuuuaauugacaaaaauuauaucuuuaugguacacaacacuuugauauaugcauacaucguagaauggcuaaaucaagcuauuuaacauaugcauuacuugacauacuuuuuuguguuaagaacacuuaaaauuuuuagcaguuuucauguauacaauauauuguuaacuauagucaucaugguguacaagagaucucuugaacuuauucccccuaaaugaaauucuguguccuuugaccaacaucuccccaauaccccaaccccuaagaauaguucuuuuuuguccuauuuuauauauuaaucuuccacauaaaaaugcauuuguacaaagucuacagcuaaacguauuuauaaauuugggugguauacuuaaguauaugcuuguuaguaggcaauagaagugcuggauucagcacggcauuauuacuguguaauagauuugcuugauuuuuuuuuuuuuuuuuuuuuuuuggguggggacagucucgcucugucacccaggcuggagugcagugacgugaucucggcucacuacaaccuccgccucccggguucaagcgauucuccugcuucagccuucugagcagcugggauuacaggcacguaccacuaugccuggcuaauguuuauauuuuuagcagagaugggguuucaccauguuggccacgcuggucucaaacuccugaccucaggugcuacccgccucagccucccagagugcugggauuacaggcaugagccaccaugcccagccucugcuugauuuuuuaaauuagugaauaucagauauaagcuuauaccuucuuacacccugauuugagaacuuaagaucguaaacgccauaauaucagaaacaucauaagacaaugugaaucuaucaaaugugcaucucagucauuguaucuaaaaggucuauguccaguccagagccuaacuuacuaugccuuuuuaccacagguagacuuaguuuuuugaaaaaucuuaugccauguucuuuuucagucuaauuuuuguuuaagccaaaauauggacagcaaucuaaaauaaauacuguugagcauuuucuauauggagauaaugaugcuaggucaaugggggauguaaagauaaggcuuaguuccugcaccuaaaauucuucuacacagugauauaagauacauauaccacucugaugcaaaauaccauauuuuaaaauauuuuaaaagcagaauaaaaugcuguguguucaaaaaaaagugguaguugaacaaacuaaagaaagcuuuaugaaguaguaacaucaaagugggcuuaaauuaugcugacucugguauuaaauuuuacccauagcuuaccaguuuuauuagaggucuuaguuacauauaaaguaauucuaacaaauucugugaagauaucagaguguguuccugugacuuuugugauuuagcuaaaaugcuuauuuugccaacaccuuguuaguucauuuauguaucuguauuauauuuuggcaucauuccuuuuguucuuuuuuuuggucccgaaagaucaagggaacaaauggacagguuacaagagcagauauucuucagguuggucuucgagaauugcugaaugcccuguuuucuaauccuauggaugacaauuuaauuugugcaguaaaauuguuaaagguagguuuuuuuuuuuaauuuaacuaauuuacguauuuacuuaugauuuagaggaagguuagucuauauaguauacagaugaauucaagauuuaucacuuuaagguaaauauugacauuuuacuuuuuucucgaauauuuuggaaaagcgagauauacuuauuguuuaauauaugaagcaaguucagaagugaaaaauggaaguccuuuacgccauuuccauuugcaaauucugucuucuucccuucuuaucucuguauaugugcucuuauuaaauaagaucuuacucuguucuggcuuuuuguuuuuguuuuugccaccuaaugaaacaucuuagauuuuuccauggcacagagauuuaccucuuuuauugaauaacuuccuaguauucugucauaugcauaugcauuguuuauccauuccguaacaucuaucaauguuuacuaaugaauauuuggauuaucuucaguuuagccauggcagcauugcuuguaaucuuuccucuugucauauauaugugcagauacuuuuguagguuaaauucuuaaacacggauuugguggguggacgagcauauguauuuuacgacaaguaauggcuaauuugccuuccaaaugcugaaccagaguauagccccaucagcagaaugaguacaucucuuccuacauccuuauagugauggauauaaucaaucuugguuuuuguuuugucagaugauuuuaagcauuucuucauguuuauuagccauuuguuuauuauuuccuauaaauuaccuguuuaaauccuuaacugauuuauuuccugaugaaaugcauguuuguguuuuuuuuuuuuauucaaagcuucuauacuuguugcuugcuguauauuucaaaaaaagugacauguucauuaaaaucuaauagccuaucuuagucauacagggaauauaacagucguugacauaaaacccaugauuaaaguucugcuauuguuuuuuuuguuuuaguuucucucagucaagagaaauauagagggcguagagaucacugaauauuagaugguagacagaauaauuaggaauauuaaacuugcuaaauucaucuuguuuagagaaugcuugaacuguuacugguaucuuuuuagaauuucuauaauacacuauugaauuucuuauuuuacugacaccugcuuuuuuaguugacaggaucaguuuuggaagaugcuuggaaggaaaaaggaaagauggauauggaagaaauuauucagagaauugaaaacguuguccuagaugcaaacugcaguagguaggaaaagaaguaauguaaauagccagugcaucucaauuucuugcuuuuucuuuggagauuguuuuuuaauuugcuauacuucagcaggguaaguugauggcuaacggauauacaaaaaugcuuuucuuuaaaggaauaauauuuuaccuauaguuucugcucacuagacauuuuugugauagacgugucagauauuuuugcucaauuacauuuagaaauugaaaaagcuaauuuucuuaagauaugaauuaaaugaaaaacaaaauccaaauauuaacuguccaacaaauaaaaguacuacuguaaguauaguaggacacauaaaaauguuugaaggauagccacugccuuuaagguccauauagucauaguuacguggaacauaauucaaggcuauuuuuuuuuuaaaugaauuuaugucauauaggaaacgucuagaaagucaaggcaucagauguaccuguuaaauuaaggaaauaaaguuuugggaaucugagauauuuuagggucugacagcccuuaugguggauacacuaacucauuuucaacuuugucuacagagauguaaaacagaugcucuugaagcuuguagaacuccggucaaguaacuggggcagaguccaugcaacuucaacauauagagaagcaacaccagaaaaugauccuaacuacuuuaugguaugccaguguuuauauuuuaaguuuuacuuauugcuugaauuccguuuuggaaauuagaagagcuacauaaagcuguucucagaauucagugccuaauaacugucuucacuggcuuugagugacauggcagccaucagacuggguaaaaaagaaaagagaccuggaauucuccagugaaaggguggacuagagaaagauauauccaauggcaagagagauugacaaggcuuggacuuaagugagcacagggaugccaggaagcagcuuuuccagagaauuuauaaccaaggaccugcaucucagacuuuuacuuugcauguuguaguaacgaaaaauaaaauaaaauugguuggcugggcguaguggcucacaccuguaaucccagcgcuuugggaggccaaggugggcagaucaccugaggucaggaguucaagaccagccugaccaacguggagaaaccccgucucuacuaaaacuacaaagucagcugggcguggcaguacuugccuguaaucccagcuacucgggaggcugaggcaggagaauugcuugaagccuggaggcagagguuguggugagcugaaaucacgccauugcacuccagcccaggcaacaagagcacaacucugucucagggaaaaaaaaaaaauggcuacuaggccagugaugcccugaagcuccugacaugaacaaacauaaagcagcuguggagaaauguuccuccagcccugguccuggaaauucuuaaaagaaauggugggguuggaaaccacagcuaaaaaugcacugacacuaaaugacaaugcacaacagaacaguucacugaaagacaauagacagcaccguuagaaccacaagaacuugagauaauggcauggaaaucugaaaaccauagacuuucucagugaagugaaaauggcuaccaggaaguuagguuccuuugcuuguucuugcauuauuaggugcagacgggugacaucagccaugcuucauuauuguacuuacaaaaaucaauucugaaaugauuacauauuuuuaucacuuugauucauccuagaaugaaccaacauuuuauacaucugaugguguuccuuucacugcagcugauccagguauguugucucacagucauucccuccucccaguuguuugguaaaguaguaaauuuacagaaaaccacauccucaccagcacaagauuguaacuuuuugaugucuucacaucauucuaaaauaccaguguaaugguuugucuaauauagaaugcucuucauagugaccacuugaaacauuucaaaugaaaguaugauuccacauauaaugucuugucacuuaacaacagaggaugggaagaauucucaauuaaaugcaacuauuuuaauuuuauauuuccucuaacuuuuuuauaaucuuaaauuuucaggugauuagaauggaggggaaagacgauucuaguucacugcauagucagcaacauauauuaauauggguuaauacuuuacacgaagaauuacacauuucauucauacuuggugugugacaguuaauuaaaauccaaaucucugcacauuuccucuuccagaagaggaccauuuauagaaagauugccuuaauuguauuagauggaacuguagagugaggaagagaaauuuuucccuuugguacaaacugcaaccagcuuaugguuggaauuuuuccauuuguuuccucuggauuccaagcauugacuguccugugucucuagcacagagaaguuuuuuuagggcaaggaaguagaauuaaguuacacgcuaugggcaucuuaaacuucacuaaauguuacuaaauuguuuucuagcaugauuaugccacuuaaucuucccaucagcagcacaugaggguuccugcuccucaucuuuggcaauacuuuuuauuaaacuuaauuuuuguccaucagauuguaugaaauucuaucuugcugauauuuuauuucccugacaagugauauugaaguuuucuuguucuuguugaccuuuuugauuucuuucuuugagaauugccugcuaauacucuuuguucauauuucuguuggaucauuugucugucuuacugaucuguaauuccuuuuguagucuagaacaaagugauucuuagcugaggguuuugguuaccuucuuucucucaguauuugccugucuuugcauuuuguuuauaaugucauguagaaccuuugaguuuuaaugugaacaaaauuuaucagucuuguuuguaauuucugugguuuaagaaaguuuccuuaccauuucuguuuucuucuaaaaaucauuguucuuuuuuauuuuuaggucuuuaaucuaccagugcaauuuuuauauaggaugauaucauaggaauuaucuuuuccauugccuguugucucaacaauugguauuaagccauccuuccuuuccuaguuauaauaagcccccuuuguuguauacuauguaacucuucuaucaaauugugucuuauuccuguguuugugugaaucuuuuuuucuguuaaucucuuucuaugccaauacuacacuuaaauuauuuuuaccuuacugugaaucuugcuaugucugguaagacaaaucuuuccucuuauucuuaaaaauuaccuugauuuauuuugauuauuuguuuuuuauuuuuucuaaccuguuuaauuguuucuaguacuguucgauuuacagaaauucaguuugguuguucaguuucuuuucaaggaaaagaaguaauguagacagccaguagaucucaguuucuuuuucuuaaacguuuuuuaaucugcuauacuucaugaaaguaaaagaaaucuuacaguuuuacagaaaaaucaagcuaaauuuuguuucugcauuuuguucaaauaaucuugaccuuuucucagaguuucaaguuauuuuuucucaucauucuaaacaugcuuacuucugucuuauauuuuuguuuuaucucuuaauuauaacccuucuguuauuucugaucaucacacauaaaauuuuugccuuaaccgucuuaaacuuuuauuuggaaaugauuucaaacuuacagaaaaguuacaaaaguaaaauuguacaaggaauaccuuuuacccagguguacuuuuuguuaacaguuacuugcuuuaucauuugugcucuuuccacacacuuuucuuuuuuucucuuuuuuuuuuuuuuuuuuuuugagacagagucucacucuguuacccaggcuggggugcggugaugcaaccucggcuuacugcaaccuccaccuccugaguucaagcaauucuccugccucagccucccaaguagcugggauuacaggccugugccaccacgccuggcuaauuuuguauuuuuuuuuuuuuuuuauugagacaggguuucaccauguuggucaggcuggucuugacuuccugaccuuguccacacacuuuuuuuuuuuuucuuaaaccauuugaaguuucauauuaauaugacccugauuaaaugcuucagugcuuugucuuuuuucuuuuuucuuuuuucauuuuuuuuuuaaugaaaaacacuguggcuuggauuauaggaaccucuguccaaaaugguuuauauuuccuucugccaggagccacagaguagguaucacugacuuggacaaauuuuuuguuuucuugucauagggguucuuuauguggguaguaggaauuugaggugcaggcccauuguuaaaaauucucuggggcaccaauuucuacaaagugcucugucccuauuccaaacccaggcagacaugaccaagcuuccugcuaucucgcagggaagauaaaauaccacugagauauuucuuggucuuuuuuccugauucaccuuuuguuuaagauaccagaccuuugagggucccagguuugugcaggugagguugggcauggagcauggauuucauuuuccuguuucacauggggcccaagaccuugcuuucuggcuuucuguggguuuuaaaauccaagccccuuaguuaccgagaccaacaucaucugucagccucccagcugcagcagcugcaguuuauauauggcuuucaguuccuucuucauuugugaccugaugacuuggauuuucuuuuuugugaacuuauccauacauuuaaaagaaugccugucuuuuuguagcaggaagguuuuacuguuaaaacggucucuaaauugucaaaauuggguaucaaaauguccccagcccuugaagcuggaguuacgguuuuauacagacugacacagucuuggaagaacauggcuuuuacccagucuaauauaauugcaaaauuuccguuggcuucuguucauaagaaacuauaagguaacuagucuuaauauauacugauucauuuuuuuauucagagguuaggacuucauaaagaaauacuuaacuuaaaagguacccaauaacucuuccuaagacaauuggcagauagguguaauaucaccuguauuaccuuggaggacccaaugaaaggaaaguuggcagagcugaaacguuuaccagguagcugccuuccccaucucucugggaagaaagggaaggaaaaucccccauuguuaaaacuuuugguagguuaacuucaucugaggaacagagaccaauuguuguuaccugcuuucuuuacuuccuuguggaggaguacagagggagcuggaaaccaguaguauuugauuaauaucuuuccaauggaaggacuguucuuccccaacaguuauauaaccauuauuuugucugauggaaagcagcaguagaggauauaaacacauuggcuaugaauguacaucaccuacaguggcuuugauuuccaacuuauaucuauaguacuauauguaauuacuuuaagauuucugagcaugcaggggggcaaaagucauaauauuaaaaaacauuuaggggugauuggucauuucaugugauauuuuuucaguauuuaguuuuucuccuauguugucuuacagauuaccaagagaaauaccaagaauuacuugaaagagaggacuuuuuuccagauuaugaagaaaauggaacagauuuauccggggcuggugauccguaaguuuucuucaguuacuaacuucgugaaauuucugugucuaauuuauagguggagauuagacaaaguagcucaugaaggaaugguguuuggggccaggcgcaguggcucgugccuguaaucccaacacuuugggaggcugaggagggcagaucacuugaggccaagaguucaagaccagccuggccaacauggcgaaacccugucucuacuaaaaguacaaaaauuagccaggaucacagaaucacagcuacucgggaggcugaggcacaagaauugcuugaacuuggaaggcagagguugcagugagccgagaucgugccacugcacuccagcuugggagacauaacuagauucugucucaaaaaaaaaaaaggcauuuugauuugauggugcuaugugguaguguuuauguacuaaaaauuuucagaaaauuguauuaacucacagacuaguucugaaaaauguauaguugaggaaaauaaccauuaaaauauaguauacuuaagcauaauuauuuuuuuaaaauagauucuauuguauuuagacuuuaagaagcucuaaaacuuacuguaagaucuugggcaacuucuguucugcuucuccaucuauaaaauaagaauaguaguaccuguugagucuuuuuuuuuuuuuucuugagaacuacaugagaauacauaaauacuuagccuuccggcacacaguagaaggcucaaaucuuagcuauuaaaggguaaguuaagaguaaagaaaacagauuacuauguaaaaauguuugaacugauaagaagauguuaauuauaggacuguuuauauaucuguuucuucaccugccacucuuuguaauuaaagaucccuuuaaacauauuacucacuuaccaucagagugcacuacauuuucuuauagaaggaccaggaaauugugagguuuaguaccaauucuguuaacaacuuguguauauuuggacaggcuacuuaguuucuuuucuuccuaaguaggagaugggagggaauaaauuauaucuugaacuuauuuuuuuuuuaauaucuccuguguuguagauuuuuuuaaaaaagugaaccacuuuuauucuagugauauuuuaauuaugugucgguuugagaucuagaaauacaauuguugcuguacuucuauauucuaguuuaauagaaaacaaaaaaaauacagggauuuaaggacccaggcagaacuaggaaaguuccaucuacuuggguauaccgcuggaagauaaaguuguucuuggcauugaacuucagguuauccucuuaaguuuauuugguaagcaucauauucucuugcccuaaugagcucaugguuauuucaacacauggcccuguauuggaaauggggaagaaacagaaaaggacucaucagcaguugguaggguuggcaagauuguuuuuucaugcuuguagguggaagggauuggauuauuggagggguggggaagauguugauagaaucauguuauggaggaaaagggguaagaccuggagucaaauucuggccccgccacacacuuaaaauuuuacauuguucauuuaaccuuccagaaucucuuuauuuuccaucuccaaaaugaagaugaucguaaugcauaucuuuuuaagauggcuauggacauucaguaagaauguguagauuaaauccuuaauugacacuuuaaaucuuucccgccauacuuaacuaugggaagccuugcuuuccaccauuuuaaacuaccuaauaguuggaaaaaaaucuggaauagaugaucucaaaaguagcuuccugugaaaaucugauuccaaauaaaugggaaugugacuaaauugucaucaugggaauaacccagcagaaaucauagcaggaauagcacuuucuguuauuaaguagacacaaaauauuagugcaucacuagaggugaauggcauauuugaaauuauguucuauuaauaguuauauucuaauuguuuguugguaagguaaauuuauuaauaucgaucuugagccccaaguuuauaugucaagccuuugauuaacuuucagguuauagaauuuaacuuaugucuaaaaguauauauauucuuuacuauaauuucacacacaagggacucagaaucuguaaaauuuuacuuaccaaauuaagcauuugguuguccgaagacugccauuaauguaauucuaaaguuaggcuuguguucuauuauaagucagucuaggaaaguuguauuacauuauuuuuuucaugauuuagcaucuuacuuucugaguugaaaaaccuuacacuuaugaaucaucuuugcuuuuacagauacuuggaugauauugaugaugagauggacccagagauagaagaagcuuaugaaaaguuuuguuuggaaucagagcguaagcgaaaacaguaaaguuaaauuucagcauaucaguuuuauaaagcaguuuagguauggugauuuagcagaacacaagagagcaagaaaaugucacaucuauaccaaauuaaggauguugaguuauguuacuaauguaugcaacuuuaauuuuguuuaacacuaucugccaaaauaaacuuuauucccuauaacuuaaaauguguauauauauauaauaguuuauuauguacaguuaauucuacuguuuuggcugcaauaaaaucgauuuugaaauaaaugaaauguugaaaauuuugcuaguugguuagaugcuuauccuuuaaauucuacuuuucuugaggggaaaaagucuucuucuggaaauacauauuacugcaaaaauguagcauccuuuuuuagguaggaguauuauagcuuucauuuuaguuugacauuuagugucccaaugaauugaauuucaaauaugaaucauaaucuugaaaaucuuuagcacuaaagucuuggaauauaucaacaacugauuuacauaugcagaugcuauuugauaccaagggcuuuuuaaaugucaugggggggaaaaacccaacuuggugaacucccagcuaaacaaccaagacuucacugaagauuuauuccaauucuagaauuguucuuuuuuauuuuuauuuuuucaacugacuaacuucauuaccuuaaaggcuagaacauuauucugcuuuauuuauauggcuuucucacuuuuauuuuguagcauggguugcaucgacuuuuuuacuagagaauuuuacuagauauuugucauucaaguuuucaucugcuuuauaauugauacaccuugagggucacuuuucuaauacuuuuacuauaaugugguaccaccucagcccuaauaaauaauauuuuuaccuaaugucaaaucuuuuuccagcuaacuaaaaacuguguacaaaaggauugcuuguaaauaugcauguaaauaguucuguuaauaacccacuguuuuacauuugguacaucugugucugcuaauacaguuagcuuucucacuuuucugcuuguuuguucagucugaauuaaaauuagacuuugaaaauaaagcuuaaauaguuguuuccucuaaauuuuugaaguagcaucugguauuuuaaauaauuugcuguugaacuuaaaugacauaauuaauuuacuuaaugguuugaaaucaaagaaaucauauuagaagauauuuuauucauucucugaauaagaauucaguaacaagucuaccuugaaaaacuagcaaauauaaaacauuaaaacuuuaaaauuccuucuauaaaggaaauaauguacguaauugugguuuuuggaaguuguaguaagaaauguuuuucaaaauggcuccuguaacauggcagcuauuaacauaaucugcaguucucuaaagauagcacugacuauaaauauuggagggagaggagguguagagaagagaugguacauuagaccagggacaaggaaugcuaacugcauauacuugaaacuucuagcagcugcucugugaauaacuguccaguauuugucuacuagcucauugucaccaacuacugcucuacucacaguagcuaccgacaagaucaauaucuguucccgguauuaugcuuaauaaaaaaagcacagaaaucuagcaucuuaaaacaaucauuuuauuaugcucauggacucuauaguucaggaacuuggagagggcacaauggggauggcuuuauucuaugaugucugaggccuaggcaaggaaaacuaagggcugaggguaauuugaauaucugagagcuauaaucaucugaauucaugguacugagaugacuuuuaaagccaagacuagauuggaaucguucaccagaaccaucuacacuuguccauguagcuugaacuucucacagcauguugccuggauucugaagggccauuucaaaagacccagaaagcagcugcauuuggaaguuacacagcauuaguuccauuauauucucuugguccuaagggaguuacuaaagccauaucacauaggccaucaaggagcauguggccauauuuuaaaacugauggcuugagccugguggucuuugguugaccagacuuugcauaauugacuacaccaguacauaaugaaaggaagaguugcccccguccacaauuguuggccuuuaggauugucaugccuuaaacagaaacgugucagcaagucuugaggaaagaucauuuuccaaugagcaaggacacagagcugcuaguaaauauagucuugcguucuggcaaaaaaaaaaaaaaaaccacaaauauuggucuuaaccuagaaguugucaucaacucugacccucugucuuuauguuguuaaugcucuccagccauagacuaccaggaacacacuguaccugaacauguugagcuuacuggguuuuguuuuuuuuuuuguuuguuuguuuguuuuuugaggcagaguauuguucuuguugcccaggcuggagugcaguggcgugaucucagcucaccucaaccucugccucccggguucaagcaauucugccucagccucccaaguagcugggauuacaggcacgcaccaccaugcccggcuaauuuuguauuuuuaguagagacgggguuucgccauguuggccagguuggccucaagcucccaaucucagaugaucugcccaccucggccucccaaagugcugggauuacaggcgugagccaccucgcccggccugagcuuauuguugcaguaaaggagaacauacaccuugugggaguuguggggugcaucaguaagaguguguuagaaucugugguaggauuugggcuuuggugauuuaggggauggucuaaaacuuaacguucacucuaggcugggucuugccagaaagcaagcuuaauucuauaauuagguauuucauuaaaucuuuagagaggacagaugcauauggauuaaguuguacuuuagggggaaaaaucauucacauuuaaugagaggaggauguuugguaugaaaguaaacucuaggacucaaaguggcucaaacugaaaaaaaaagcuccaccacugucagggggacaggcaaggcagcugcaaaguuaacaugaaacuguuagguccugcagcagcuauaaaauaccaucaugacucccucaugugaccacugcuuuguuggcugugacacccuuagaccuauuuugcuauaacccaucuacuacuggggauauccaguugcuaaacuugcccucaccucauugcagcaccaaucucuaguuaauucucacaucuaaucuugcuacagaaauagcauccaacccagaacuggucuccuuucccuuauagcuugcucagaacccuacacugggaacccaaaccuuaccaaagauggcacccccugcccucuuguggaaugcaccaucuuugcugcuucugguucccuugcuugcaaaucaauaaaugguuuugucagaagacaggcuugagccuggugaucuuuggcggacuagacuucagcagauguaaauaauuuaagcucauguaugcugcugcucuauugugucagccuggcaaaauaccagcccuggaugaacccaacacugcuucugcauccuugcagcuggaggucguuucugguagauuuuuaucacuguaaauucaugcucagcacauugaguuaggcugucaguacugccaacaauguuaauguguuucucuucaauccuucuguaacuauuucaaaccccuuucccucuaaagccccuuucacccccuaacugauuacuucacaggggaaaaaaaaaccaugauacccauguacacaaaugcaucugcauucacuucaucccuccucuuccuguacaggaagaaucccuccucuuauuaaaggccaguuauucaacaugugcugcaauccuaucuccucucguucucucauggagucuguuguuacuuggucuguauuuuuccucucuuucuccauuggcucuuugcauggacaguugaacacaccauucucaucagaagaaaucugcuucucauau

SEQ ID NO: 17434 - RNA, 7265 nt, Homo sapiens
ugugaucuuuaaagaugccuuuauuuacacuucauggaagauugauaucaauuugcauaucagccuuuuuuaaauggagguaaauuagggguuuauguugccccccccauccuguggugcugccacauuugcuuaaacaccuuguuguuuucuguuuuuguuuuuguuuuugagauggagucuugcucuguuguucaggcuggagugcaguggcacgaucuuggcucauugcaaccucccccucccagguucaagcaauucuccugccucagccuccugagucgcugggauuacaggugccuggcaccaugcucagcuaauuuuuguauuuuuaguagagaugggguuucaccauguuggccaggcuggucuggaacuacugaccucaggugguccaccugccuuggccucccaaagugcugggauuacagaugugagccaccgugcccagccuacuuaaacaccuuguaauaaacaauuauaccucaauaaagcuguuuaaaacacacacacacacacacacacacacacacacacacacaacuuggccaaaaauagagaccucuuuuuuuccuaauuuggugucagagaauauaaaucuugaguccauaaaucccuaauguucuguacucugccugccuaccucuguaucccacuccaggauucccuccccuucaggccucuuuccucccuaaccaugcuuaaaccacauuugcuuucuuucaguccuuuuuaaagggaaagcuccuucccuugggccucacagccuuaacacagggacuuuaaccucugcuugaaauacuuuucccccuacuuuaccuggcuaacacguacuuaaauuucaaacuucaguggaaauauuuucucaucuuagguuaaaucugcucauuacagguauuccauggagauauugcuaguuccguuccagacuacaauaaagcaaauauugcaauaaaguaaguugggaauucuuugguuucccaguacauauaaaaguuauguuuauacuauacugaggccuauuaagugugcgaaagcauauucuuuaaauauacauaccuuaauuuaaaaauucuuuauugcuagaaaauacaaaugaucauaugagucuucagugaaucguaaucuuuuugcugguggagggucuugccccaguguugauagcuguugacugauucggguggugguugccgaaggcugggacagcuguggcaauuucuuaaaauaagccaacaaugagguuugccucuuccuuucaagaaagauuuauccaguuugcaaugcugugugauagcauuuuaaccacaauagaacuucuuuaaaaauuugagucaaucaucuuaaacccugcugcuguuuuaucaacaaaguuuauguaauauucaaaauccuuuauugucauuucaacaauacucagcaucuucacuaggaguaguuuccauuucaagaaaucacuuucuuugcuaauccauaagaagcaacgcaggccaggcgccguggcucacgccuguaaucccagcacuuugggaggccgaggcaggcgggucacaaggucaggaguucaagaccagccuggacagcauggugaaacccugucucuaccaaaaauacaaaaaauuagccgggcaugguggcgcaugccuguagucccagcuacucgggaggcugaggcagaagaauugcuugaacccagcaagcggagguugcacugagccaagauugugccacugcacuccagccugggugacagagcaagacuccaucucaaaaaaaaaagaagcaacucauccauucaagguuuaucaggagauugcagcaauucagucacaucuucaggcuccccuucucauucaguucucuugcuguuuccaucacaucugcagucacuucuuucacuaaagacaugaagcccucaaacucaaccaugaggauuggaauaaacuucuuccaaacuucucuuaauuggauauuuugaccuccucccaugaagcacaaauguucucaauggcaucuagaauggugaaucuuuucccaaagguuuucaauugauuuugcccagauccauuagagacaucacucuguaugucagcuauagccucaagaaauguauuguuuaaauaauaagaccugaaaaucaaaauuacuucuugacucuuaggcuguagaauggaugcugcguuagcagacaugaaaacaacauuaaucuccuuguacgucaucagagcucuuaggugaccaggugcauugucaauaaguagcaauauuuuaaaagaaaucuauuuuucugaaugucauuuucaacagugggcuuaaaauauucaguaaaucauacucuaaacagaugugcugucauccaggcucuguuguuucuggagugcaggcagaguagauuuaacauaauucuuaagggcccuaggauuuugaaaugagaaaugagcauugguuucaacuucaagucaccagcugcauuagaccuucacaagacaaucagccuguccuuugaagcuuugaaaccaggcauuaauuucucucuggcuaugaaaguccuggaugacaucuuccacuagaaggcuguugcaucuacauuaaaaauccgcuguuuaauuuggccaccuucaucaauggucuucguuagaucuucuggauaacuugcugcagcuucuacaucagcacuuguggcuucaccuugcccuuuuauguuacagagauggcuucuuuccuuaaauuucaugaaccaacuacugauagcuuuaaacuuuucuucaacucccucaccuuucucagccuucauagaaucgaagagaguuagggcuuuguucuggauuaggcuuugguuuaagggaauguuguagcugguuugaucuucuauccagaccauucaaacuuccucccugucaguaauaaggcuguuuugguuuuucuuauuauucauguguucacuggaguaguacuuuuaauuuccuuuaagaauuuuuucuuuguauucacaacuuggcuguuugacacaagaggcuuagcuuucagccuaucuuagcuuucaacaugccuuccuuacaggcuuaaucaugcauuucuagguuaugauuuaaagugagagacauacaacccucuuuuacuuggacacuuagaagccacuguagggguauuacuuugccuaauuuugauauuguugugucucaaggaauaggaaggcucuaggagagggugagagaugagaguggccagugaauacagcagccagacacacacaauauauaucaaucgacuuguuacuaguggaagagaucugaguuaccccaaguuaccagcagccuauccuugcagguccauagcaacuucaguccuggccuccucagagaagaaagaauuugacugacagacauaaagcagaaaagagacugaagcaaguuccagaguaggaauggagguuuauuuaaacaggcauuagaacaggaaagaaaggaagguacgcauggaagagacccaagugggcaugugaagguuaaagagagaaggccagccgggugcaguggcucacgccuauaaucccagaacuuugggaggcugaagcagguggaucaugaggucaggaguucaagaccagccuggccaagauggugaaacccugucucuacuaaaaauacaaaaaaauuagccggguaugguggugggcgccuguaaucccagcuacucggggagggggcugaggcagagaauugcuugaacccgggaggcggagauugcagugagcugaaaucgcgccacugcacugcagccugggcgacagagugagacuccgucucaaaaaaaaaagaaaaagaaaaggagagagagagagagaaggucaagugccgcauuuaaccaugaucuuaggaugggcucccugcaugcucagagcccucuuuacccuugggaagugagcacacacagugauuuuauggauuuauacacaugcccaucugaggcuuucuuccuuuuuccgguggaguguaucagaaaaaucauacuucaucacuuuugucucuuaaccggcaugcccaggaaguugcuucucucuggggccugcauucaauuaacauuuugauguuaacaggugugggccaucaggaaauggccuuucccuggcgcugccaaauuuucauuuuuagagaggccaugugauaauugcugaaccaucacccaacauuucuaguggguggguggcaggggagagcccucuccugccuugcucaugccuaacuaccuguaacagauucaguucgccauuuuauaauguaugagcaugaucuguggucccccaaaacaauuacaguagugacaucaaagaucagugaucacacagaucacucuaacagauacaaaaauaaugaaaaaguuugaaauauugugggaauuaccaaaauaugucagagacacaaagugagcacaugauguuggaaaaacauggcacccauacacuugcuccaucaagguugccucaaaccuuccauuuguaguaaacucaguaucugcaaagcacaauaaaaugcacaauaaaacaagguaugccucucuaugcucucacaaaccucuguauuuuaucuuagaaacacucacaacuguaauaaaugauuguuuauucuuucuuuccaguuaaucucuagcucugauccucacccgcaaagaacugggccaccuucccugcuuuauccccacuaugccuaaacacacagugaguguuccauaaacacuuguuuaguggcaauaaauauagcagacacauuuauuugccacuuuauaaggaaaaaaggugcagauacauagacgaccuauuuucugauaccaaauuaggaagaguucuccaucuuuggccaaguuuuuuuuuuucuaaacagcuuuacugaaguauaaucguuuuuuaccuuauuuaaaaauaaguaccacuccacuaaaacgcgcucugugguuaguucucggcuggaccguucaaaaggcugauccuuacagccuuuauuauuaauacaaccaggucgggacugcuuuugcgugggucaccagaaguaaaaaaucaaagaggagccaaccccauuccgaacaaggaaacacccguccccuuccuacaccaauuccugcuccgcccuucguagggaacgcagcgagggcagccuccggaguggaggggcgggacuuccggcccuuccuguuguggaggggcgggacuuccugucuucccuguugcggagcucugaagcggcucccugagggcgcugguuuugaacuggucuugugcgguuugcgcuuucucuuagugguuacaguuggcgcugucuccgcuuuccuguuucguggcgggcaucuuggccaaaacacucucccugccaccuuauuccucuaggguugugauuuuuuucuuucaccaagaaauaucacucgcugguaauuugucaaacugaagaaaccccugaagaagcagucgugggcaggcgccgacgcugcggcuuccagagcauuuuggcaaaucaaagccagggaccguugcugggccucauuuccgcaacuuuucggcuccgaacugcugugaguggaagacuuuuggugguuguuuugaucaggcuccuucuguaacuagagacuauagcauuuugaaagaaaugagauucucauucaugucaagaacagacuuguggauuuuugaguguuaaacauacccugacguaaugugcugggugaugagaacgcaagcgggaaugagacuguagagaugagaauggcaguguggguuggagccggguuaugguuuccuaugguaugccaagaaccuuagucauuacacuguuuguuguguaugcuugauuauuuaaaauuagaaaaccgccucaguaaagcuauuaaaaaaaagaccugaccaaagauagacuauuuuucccaaauuggaaucagaaaaugucuuccaucuauguaucagcacccguuuuuuccccuaaaauaccaaguagacauacccgauauauacguguguguuuauauauauaucuguaaucuauauugccauuugauaaguacguaaacaggugauguaaagcacuugguauggugugacuuguggaaaguuaccuaugucaucaauacuagagauggauuggagagagaagaaauuccagacaguugcaggaguuggagagucuauggccugaaaaagagaaagagguagagagagucagguuccaaagacagaaaaucaacaggacuuguuacaggggcauggaguggaaagucaaguuuuagaauauuggcugcuaacaaugagacaccauuaauucaaauugcaaauucaagaggagcaguuuacuuauuuuucaucauucaaauauuuauugugccauuuacuauuugccuaauacuguuuuagaugccagagauacuguuacauauaagacagauaaggccccugcuucgguugacuuuauauccuagugggagaaaauaaaaagcaaguaaauaaucaauuuugaugauagauucuaugaagaaaaaacuugaagagggaugacaaaugauugggagauguuugggaguaacuuuaacuuaguuggucguugggcccuuguaggaguuacauuugugcugaaaccuugaugaugauaaagaaccagccuugugauuagccaaggaaaagacaaggcaggcagaaagaacugcaaagaugggaaagagcuuguuuaaagaacauuuaaaaugccaauguaucuaaagugcccuguagaaguaggagagaguugagaaaugacauugggagagguagauaggaccagacuguguggccuuuguaggccauaguuuaggaguuuggauuuuaaguagaaauggaagguacugguggguuuuaagccacgaagugauagaugugauuuucauuuuaaaagaucccucugggcacuacuguaugcagacuggauuugagggaagagaugagagugaaagugcaauuaggggguauuacagaagccugcuuuugguaggagugauuaaguuccauuuuaguuauguugaguuugauuuaucuaugggacagggacauagagagcggucuagcaggcagccaccugaaagcucugugagaggucagguacauuuaguucucuagagaaagaaaauaauuaaaagugugugaaucuccucaggagagaccaugugguuaaauauuuacuuauauccugacauauccucagaagauuacagaugauaucaccuacagcugauuacauacauuaaaggggguaagguua

SEQ ID NO: 17435 - RNA, 29107 nt, Homo sapiens
cucuaugcucucacaaaccucuguauuuuaucuuagaaacacucacaacuguaauaaaugauuguuuauucuuucuuuccaguuaaucucuagcucugauccucacccgcaaagaacugggccaccuucccugcuuuauccccacuaugccuaaacacacagugaguguuccauaaacacuuguuuaguggcaauaaauauagcagacacauuuauuugccacuuuauaaggaaaaaaggugcagauacauagacgaccuauuuucugauaccaaauuaggaagaguucuccaucuuuggccaaguuuuuuuuuuucuaaacagcuuuacugaaguauaaucguuuuuuaccuuauuuaaaaauaaguaccacuccacuaaaacgcgcucugugguuaguucucggcuggaccguucaaaaggcugauccuuacagccuuuauuauuaauacaaccaggucgggacugcuuuugcgugggucaccagaaguaaaaaaucaaagaggagccaaccccauuccgaacaaggaaacacccguccccuuccuacaccaauuccugcuccgcccuucguagggaacgcagcgagggcagccuccggaguggaggggcgggacuuccggcccuuccuguuguggaggggcgggacuuccugucuucccuguugcggagcucugaagcggcucccugagggcgcugguuuugaacuggucuugugcgguuugcgcuuucucuuagugguuacaguuggcgcugucuccgcuuuccuguuucguggcgggcaucuuggccaaaacacucucccugccaccuuauuccucuaggguugugauuuuuuucuuucaccaagaaauaucacucgcugguaauuugucaaacugaagaaaccccugaagaagcagucgugggcaggcgccgacgcugcggcuuccagagcauuuuggcaaaucaaagccagggaccguugcugggccucauuuccgcaacuuuucggcuccgaacugcugugaguggaagacuuuuggugguuguuuugaucaggcuccuucuguaacuagagacuauagcauuuugaaagaaaugagauucucauucaugucaagaacagacuuguggauuuuugaguguuaaacauacccugacguaaugugcugggugaugagaacgcaagcgggaaugagacuguagagaugagaauggcaguguggguuggagccggguuaugguuuccuaugguaugccaagaaccuuagucauuacacuguuuguuguguaugcuugauuauuuaaaauuagaaaaccgccucaguaaagcuauuaaaaaaaagaccugaccaaagauagacuauuuuucccaaauuggaaucagaaaaugucuuccaucuauguaucagcacccguuuuuuccccuaaaauaccaaguagacauacccgauauauacguguguguuuauauauauaucuguaaucuauauugccauuugauaaguacguaaacaggugauguaaagcacuugguauggugugacuuguggaaaguuaccuaugucaucaauacuagagauggauuggagagagaagaaauuccagacaguugcaggaguuggagagucuauggccugaaaaagagaaagagguagagagagucagguuccaaagacagaaaaucaacaggacuuguuacaggggcauggaguggaaagucaaguuuuagaauauuggcugcuaacaaugagacaccauuaauucaaauugcaaauucaagaggagcaguuuacuuauuuuucaucauucaaauauuuauugugccauuuacuauuugccuaauacuguuuuagaugccagagauacuguuacauauaagacagauaaggccccugcuucgguugacuuuauauccuagugggagaaaauaaaaagcaaguaaauaaucaauuuugaugauagauucuaugaagaaaaaacuugaagagggaugacaaaugauugggagauguuugggaguaacuuuaacuuaguuggucguugggcccuuguaggaguuacauuugugcugaaaccuugaugaugauaaagaaccagccuugugauuagccaaggaaaagacaaggcaggcagaaagaacugcaaagaugggaaagagcuuguuuaaagaacauuuaaaaugccaauguaucuaaagugcccuguagaaguaggagagaguugagaaaugacauugggagagguagauaggaccagacuguguggccuuuguaggccauaguuuaggaguuuggauuuuaaguagaaauggaagguacugguggguuuuaagccacgaagugauagaugugauuuucauuuuaaaagaucccucugggcacuacuguaugcagacuggauuugagggaagagaugagagugaaagugcaauuaggggguauuacagaagccugcuuuugguaggagugauuaaguuccauuuuaguuauguugaguuugauuuaucuaugggacagggacauagagagcggucuagcaggcagccaccugaaagcucugugagaggucagguacauuuaguucucuagagaaagaaaauaauuaaaagugugugaaucuccucaggagagaccaugugguuaaauauuuacuuauauccugacauauccucagaagauuacagaugauaucaccuacagcugauuacauacauuaaaggggguaagguuaaaaaaagacaaggugggccaggugcgguggcucacgccuguaaucccagcacuuugggaggccaaaacggguggaucacgagguguggaguuccagaccauucuggccaacauggugaaaaccugucucuacuaaaaauacaaaaaaugagccaggcgugguggcacgcaccuguagucccagcuacucaggaggcugaggcaggagaaucacuugaacccgggaggcagagguugcagugagcccagauugcgccacucuacuccagccuggcaacagagcaagacucugucucaaaaaaaaaaaaaaaaaaaaaaaaaaaaaaaaaaaaaaaaagacaagguggggcauaaaagugacaucaguguuauguuaagaagggaugaaauguggacuaaggucaggucuugaagaauccuugauuuaagggaauggugaagaagaaugauuaaacuaaaaacagguagaagugaagaagaaaacuguggcagcccaauguuaggggagaaaaguaggggaaaagagaguuuggugcaagggaauguagacaaugcuguuacacguugaugagguuuaguaggaugaagacuaaagucauuggguauaagaagacauuggcgaccauugcgaaacaaugucaguaaagagauagaggugaaagcuggauugcagugaauugaagacugauaggagagaagguugguagugagugaauacuacacuugagcuguuuauagguaggaaauagggauaaagugaaaguguuuucuauagaacguuauuuuuuucuggcagguaaaacuugaucaucuugguaguagaaggggauaauguggaaggggaugggguuaguguuggaaaggaauaaaaacauuucauaagauugcuugagugccugcaaggcagcauccacagugcuggucacugucauauuuguuuucucuuuuaauacacacaacaauccuguuacuacucccauuuuacaaaugaggaacaaccugagacuuauagcuagcuaguaaaugguaaggugugaaugaaacccaacucuuuuuuuuuuuuuuuuuuuuaguugaucauucuuggguguuucucacagagggggauuuggcagggucauaggacaauaguggagggaaggucagcagauaaacaggugaacaaaggucucugguuuuccuaggcagaggacccugcagccuuccgcaguguuugugucccuggguacuugagauuagggaguggugaugacucuuaacgagcaugcugccuucaagcaucuguuuaacaaagcacaucuugcacugcccuuaauccauuuaacccugaguggacacagcacauguuucagagagcacaggguuggggguaaggucauagaucaacagcaucccaaggcagaaguauuuuucuuaguacagaacaaaauggagucuccuaugucuacuucuuucuacacggacacagcaacaaucugauuucucuaucuuuuccccacauuuccccuuuuucuauuugacaaaaccgccaucgucaucauggcccguucuuaaugagcuguuggguacaccucccagacgggguggcggccgggcagaggggcuccucacuucccagaaggggcggccaggcagaggcgccccccaccucccgguuggggcggcggccgggcggaggcgccccccaccucccucccggacggagcggcuggccgggucggggcugccccccaccucccucccggacggggcggcugccggacggggcggcugccgggcagagacgguccucacuaaccagacagggcagcugccgggcggaggggcuccucacuucucagacggggcggcugccaggcggagaggcuccucacuucucagacgggucggcugccgggcagaggggcuccucacuucucagacagggcggcugccaggcagaggggcuccucacuucucagauggggcggccgggcagagacgcuccucaucucccagauggggucgcggcccggcagaggcgcuccucacaucccagacggggcggcggggcagaggcgcuccccacaucucagacgaugggcggccgggcagagacgcuccucacuuccuagaugggauggcggccgggaagaggugcucuucacuucccagacugggcagucgggcagaggggcuccucacaucccagaugaugggcggccaggcagagacacuccucacuucccagaugggguggcguccgggcagaggcugcaaucuuggcacuuugggaggccaaggcaggcggcugggagguggagguuguagcuagccgagaucacgccacugcacuccagccugggcaccauugagcacugagugaaugagacucugucugcaaucccggcaccucgggaggccgaggcuggcagaucacucgcgguuaggagcuggagaccagcccggccaacacagcgaaaccccgucuccaccaaaaaaauaugaaaaccagucaggcguggcagcgcgcgccugcaaucacaggcacugggcaggcugaggcaggagaaucagacagggagguugcagugagccgagauggcagcaguacaguccagcuuccgcuaggcaucagagggagaccguagaaagagagggagagggagaccguggggagagggagagggaggaaacccaacucuuuaauuccccuucugucacugcuguauggagagcauaggugaagacauaguacuuuagagguagagaagaagaaacugaaugcagagaaauaaggacaaauccaagauaauaggagauuaaguugcucaguaguaauaaagagcuguuucuuuaaugcuaggguagagacaggauuccagguauuuggauuucuucuucaggguccuuuucccauaggccuaauaguuacuuucugccugucuuuggaauuuauauuacaaacaauuugcugcauucuuaccauaaagguggaauuugcuuauuauuugaaauuuaaaaugagauaaugagcauauaauuuauagaaauuaaauuucuuuaggccgggcgcaguggcucaugucuguaaugccagcacuuugggaggcugaggcaggcagaucucaaggucaggaguuccagaccagccugaccaauaugguaaaaccccgucucuacuaaauuacaaaaauuagccaggcaugguggcacacaccuguaaucccagcuacucaggaggcuaaggcagaagaaucacuugaaccugagaggcagagguuacagugagccgagaucacaccacugcacucuagccuggaugacagagcgagacuccaucucaaaaaaaaacaaaaaaaacaaaaagaaauuagauuucuucuugguuauguuccugcauuggaguaaacuucuagaaguuauaagcuucuaaauaauaagcauauaauuuacaaaaauuaaauuucaguagaagugaagcuauuaaaauuauaaagacaguuaucacuugugguugucucuucuugguuauguuccuccauuggaguaaacuucuagggguuaauuaaggcauuuuguuaaggauguucauuucagauuuauccaguguaguuaguauucuuaacaaaaguaaaugcaauggcaaugucaucuucuuagaaaaugcacgcacuuauuuugauaaaaguuuuguacauuaagagaacuauuuaugcuguuguuuuuccuauuucauucagucuuugacuuagaagauaucuuauccugccguuguaauggcagcugaacugcgaaugauacuuuaugaagaugauucaguacaaguacaauauguugaugguuccacauugcaacuuucucccuguggcacugaauuuuuauuugaaaagucaccaccuguuucagcacauccuuuagaacaaccagaaagaauucgucaaaggacacauuuugucauuagcacuuacagaguaaguaaagauaucacguaaacaacuuuuuuguuuuuuagagacagguucuugcucugucacccaggcuggaguacaguggcacuaccauagcucacugcagccucgaacaccuaggcucaagugauucuccugccucagccuccuuuuacaagggaguuacucuaggacuacaggugugcacuaccacaucuggcuaauuuuuaaauuuuuuguagagcauugucuagcuauguugcacaaacugguucucacacuccuggccucaaguaauccucccaucuuggccucccauuaugccaggauuacaggagugaaccaccgugccuggccaaaacuacucuuugaauaccaaaauacuguugacguggcuagaauaugaaaaguaauuaguauuauggauuauacuguacugucauuuuuaauugauuuucaaaucauuuuacauuaagguuacauuuuauauuucuuuucauaggagcaacuacagcgagcccuagauuuucgaaacucuucagcuacuugcccuuuuuuaucugaaaccaucauaccuucugaaagaaaaaaggugauuuuuuuaacuucauuuuuguuaguauuauuugaggacaaguaacuagaaacagguaauuuaauauuuagccuuuuuuuccuuuucaggacaccuggggauacauugcuauaaaacaucaaaguuacauaguguaucccccuugccauuuucuuuguauccaagcauuauaaucagaauuuuuagauuggugacuuuuucauucucagaggucucaaaauuaaguaauuaugugaccauuuucaguaacagcguauuuguuaauguauaguagaaauauguaacuauggguaugaccuuuauuauuuugcuuauauaguauuguguuuggacuuuuaggaauaauaacugucauuuacugaggguuuacuauguccaacaacuaugaacaauauuagaaauauuuaauaacaccauacugaucaaaauggauguccauccaaucaaaacagguauauuggcuagauggcagccucuuuuuuuuuuuuuuuuuucugagacggagucucacacugucgccagggcuggagugcaguggcacgaucucggcucacugcaaccuccaccucccagguugacgccauucuccugccucagccucccgaguagcuggggcuacaggcacccgccaccacacccggcuaauuucuugcauuuuuaguagagacgggguuucaucauguuagccagcauggucucgaucuccugaccucgugauccgcccgccucagccucccaaagugcugggauuacaggcgugagccaccgcgcccggccggcagccucuuuuuauaggcaaggaaauuaugucuuagagaguuuaccuaauuugucuauggcaguuuucucaguggcaaagucaggauuugaaccuagucuaucugacucuguaaacucuguuucucaacuacuuucugcuaccuuucuaugcugucaagaugcuugccugccggcugaguaauuuuauauugucucguggcaaaggagccauaaaaaauuauaaguuguaacuuagccuagaaugguaauuuuccauugugucuuuugagucacuuuauucacugaaacugccuagcuuguugcugaugcugcagcaggauuauuagauagucuaauucuaaaagaggaguuugaugaccauccuuacaaaccagcuuugcugucaguaaauacagcccucaauuuuaguguccuaacaucguacauauagauagcaugguaaauuuaggaagcuuucuugacaauaguuuguguaaacguaagauuuuacauaaauggaauugaaaugcuaaaugcuuggcaaaauuaauucaguaaaaaccucucacgcaauaucuacuguuuauaucuuauaugaaaagucacaaucaacacuguuacuuguuaugagucuuuuauuagucagaaucaauuuuucuuugaguaauuaaacuuuuuuaaaguuuccucuaagccuccugaaauuuauuuuaguguauggugugccagguacuaccuaggauggguacuuuuuacauguuaccuuauuugguucaugugauaacccugcaagacagaauuucccaaaugcuguucaguaauucuaguacuaguuuaaauaauuuucucuuuucccucuugcucugaaaaacuuauguuaucucauguaaauuuuaagauaugauugaguuuguuuuugaauuuucugaguuguucugucaauaauuuuuaugguaguccuguaccauuuaagcuaugguugcuuuuuuuuuuauuuaaaacuuaaagaaaaauuuuuagcuaugauugcuuuuaauauaauguaucauaguguuggucuucccuuauuucuaguuuuuuuucagaguaaacuuuugcagggugaggggagggauacaaaucuguuuaauucauuguacauuuaaaaccaaaauacauuuaacacuaaauaugaccauuucucucauuuugugucuguuuuacaucucuuuuuuuuaagggugauaaucuuaacaauaucaaacauucucuggaaaaucauauauaggcugagaucuggcccuccauuuuuucauucucuguagauaguaaaacacaaauauuuaagagcuuucuuacacaauacuuaaauaucaaauauauggaaaaauuggacuguuaacagaaaauacucaccgucucuuuuccccucuccuugcagcauaucuucauugacauaacagaagugagauggcccagucuugauacagaugguaccaugauauauauggagaguggcauugugaagauaacaucuuuagauggucaugcauaccucugccugcccagaucucagcaugaauuuacaguacauuuuuuguguaaaguuagccagaagucagacucaucugcaguguugucagaaacaaauaauaaagccccaaaagauaaacuaguugaaaaaacuggcaaaaucuguauacguggaaauuuaccaggacagagacugaagaauaaagaaaaugaguuucauugccagaucaugaaauccaaagaaacuuuaaagaagaugaguuguguaaauggaacugaagggagggaagagcugccuucgccugguacaaagcacacauguguauacacaugggucaagcagugcuggucuguggcugccuguccagaggaauggaaauauccuuugucuuuagcacuucauuuucauaauaaaaucagcaauaugucuaaaauugaugcacauauaacucagaguagauuuuuaacuucugauauuucagaggaaagaggaaaagugguuucuguucuucccagggcccugucacucagcuguccagucccacaccuacacagguaaugcaguaauggcuauuggucaugaagcuuuuuaucagaaccagucuuaaccuggauaauuuucuuuuuaucugauaccauucacaaggaaaguuuaucucauccaaaauuuugcuuuuaacugauaguaaauaauuucccuagcaaauguguugcuuauguuuuuuacucuguguccaugcauugaauguagaaggcugacucuacacuagauacugugcuaaguccaguaacugcagagaugacuaagacacagucccugcuuuauagcaacuuagaaucuagugaaggucacuguaccuaaaaagauuauuaaaguaugcuaaaugaugggacaggagucugcacagggcucugugggcccaggggagcaccugcugccgcucacuggagcccgugaccuugcuugcuggaguguggaucugacacaguucuuuuguccauaccuagcuucagaggcuacccgugucuuugguucacugacuauaaauacgucuguuuucaaaagggguacacacggaguggcuucuguaaggcuaaguauaaaacuuuuaacuccacuaaggauuguagauuuguaacaucaacuuugcauaaacagugcaaaucauaaugauaaaaacuaacacuuacaaaacacuuaugugccagguacuguuggacuucacccguuugauucucaaagcauucccaugaaguuaaaaaacguaucaucccuauauguagaggaacuugcgacauagaaauguuaaauaacuugaggaaagguacacagcuaguacuuguaaaauugagauuugaucccaggcaaucucugaguauacauuuguuauuuaaaacaaaaauaugggaaugacuguuaggcuugucaugauuaucugguuaaaaugagaaaaguauuacgaguacacaucaaaagggaauuaugcuucaaaaguaaugauuuuucaauaacuuaccaugauguuuagguugaaauccaugauccuucacauagcuuaccaggucuuuugugaccuggucccuuccuauaucuguaauccucaacucucucacuacucuugcccuugcuuucucuauucuugcuaagcuggacuuuagcaaucccuaaaaugcuugcucaagcacucugugaccacugcaccuacucuuuacucugcaggaguguucucuuucucucucagcuggcuaaauuaugcucauuuccagguuucagcuuaaaccuaacuucuuuagagugguuuuccugaagacccuaaacaaguuaaguccuauacaauuccauagcaugcaguacuugccucuucuuuacacucaauguuuauuauuuaaugucccugcugagggcagagaccaugucuacauuuuuuugguuguuauauccacaguguguauagcacagugcuuggcccacuauagauauuuuaguaauuuuuuuuuuuuuuuuugagauggauucucgcucugucacccaggcuggcgcgaucucagcucacugcaaccuccgccucccggguucaagcgauucuucugccucagccuccugaguagcugggauuacaggcacgugccacuacgccuaauuuuuguauuuuuaguagagacggguuuucaccauguuggucaggcugaucucaaacuccugaccucgugauccgcccgccuuggccucccaaagugcugggauuacaggcaugagccaccaugccuagcgaauccaggcuaaauuuuaaauguuauuaaaacuguuaauuuauguaauugugcugagauucaauaaugagauuauugaaaauagugaaaaaaacauggaaaaagacuugcuuuuuacauuucauuaauauaccuucauauuaauuuuuauucuuugaucuagugaguuaaacaagaaauuaauccuguuacaguagcaacauuuuguugacuucuaaagacaauuauauugagcaaccagaaguaauagcuuguauuuuauccuucacagguggaauuuuugugauucacuuuuacagagacaaucugaugaauauuccuauccugaacuagugaaaaugguuugguacaaagguguuacauauagguaaggcaccuauguuggcuucuauguuggaguuagagcuguuuauugaugucacagagaagaugggacgagccuuauagacagacucucagaagaggacacaguucuguugggccaacugugcuccuguguuugauccugaguuuuacaggucucaaaacuaauguuauuagugcacacaaggguccugugacucacucacauuaaccauuuuuauaagacuuaugugguaccuccaaagccaaugagggauugguuugcuagugaauguaacauucauaucaguuauuuaggauacuccuuccaagcauuggaggaucaaguuguuugaaauagucaaaacagaauugcuugagcauggaauuagagaaguuagaucaccuaagggagauuuuagccuucauucacaaagcaaauacucauugaguggccacucugugccagcacuguuccauugaauuauccauaccccacaacaaaggacacccuucuagugacuagaauacuaguguuagccagauugagaguuucacuuccaugaacaaugcuagaagagcacugcuaaauuuuuggagagcgagggggcucuccuuuuccuaugugaagaccuauuccuucuaacaacauauucuaacauguauguuaauaaaauuaacuuggcuuaaguuucuauuugguauauacccaguaccuugauuguaccuggcugcuccagguacagccaucuuuucuuagggauagccccuugugcagacggcuaaucuuauccauaaaguauugauuccgcuaguuucauuaaucuauuuucagguucuggaaauguuguauuuaacacguaugcaauagacauugcuuuggugacccuuauaugccagccuugugauuagcaguggggauaucaagaagaugauaagacaagaugccugaauuccagaaguucuuaguuuaguuguugaaauaaaugcauaagccaauucuauuuaucuuuucgugaaagaguuaauuuagcugguuggguucagaauaugaaauuaucugcuucacuggacaggcaaaaagacuguguuguuuugcuuagauuuuguuguuacuguuuuuugaugacuaucuucaugcauguuuuaaucucaaguggaaaaaaauuuuuaaugguuauuucuauuucuuagacuuacccaucaaaauaugaacucaauagagauuuauucuggggauggaucuguuuucaaaucagaaggggcuuauuuugggaacuauuuuacuuauuauucuauucaagaaggaucaggaaagguaagccaacaaugaacucaacucaagaagaguuuugcuguauagcucuuucuaaauaauuccaaauauauaugggaaauuuggucauuauauaacauugcuuccuacuccccagucuggaguauuaauauaaucuuacugccagcauugguacaguaauuauuaaccaccuuauuuuuacuguauuuucaccugcuaucuccauuugccuaagcaguucauguuuaaaucagaaacuuucuuuugucauagacuuuauugauggaaaaugcugaaaccaggacuuugaguuaauacacuacuuugaauuaauauuuguacauuaaaaagcaaaagcacauucuuuuuuccccaccauguaauuguguauuuuaagcaccucuuaacuucuaaaucuuuauauacaacuagacaguugaauaagauuguucucuguugcugaaaacagugaaacauaacaugguauaauuaccagcccauagucuuaauaaugucaauauuuuguuaaugaguuuuaauuugcuuauugccccucugauauuugacaucuaccauuucacagcaaucacuauaguaucacacuacuuugcaugcuagaacaaaauaaguauguuuucucucuucauuacagaguggaguauuuaaauacuaaucagauuaucagaaucccuagggaauagaguuaaaaauugagauuuuuuuaacuauggaaauuucaaacauauacaaaaguagacaaauauaagggaccccuauguacccaucacccaucuuguucauuuauacuuccugcuucucccuccacucccuguuuauuuuuaaguaaaucccaaccaaauauuguuuucuucauaaauacuucaguauauauuggaacagauucccaacuggggccuauuucuaggaaaauauuuaguaaauacauauuaauugaacaguaacucuuuggcaggcauucugguaagcacugacaaggaugaagaugaagaagaguuccugcccucaagaguucacagucuuguguucaguuagacaggcaaacaagcaaaugagauacaagcaugcccaguaacauguauacguauauauguguguauguguguuuauauaguacaucagacaaucaagugagcaagcaaauagaguagguaugcauagucauauugcugacugcuguauaucagagggugugcaaaauugcaagauaaaaggagugugucuuccuggagcuucaauuuuacucaaagcuguugcgggagggggugauaauuuuuauacuaaagcaaauauaucauggaguagaagcaugagcuuuuggguuaaaacgcauuugugguggacugccuugggcuucacucuccaaccuuugugugcaacaccuucaccuuucucugucuguuuuagugcaaagguuuagaaacaauugacccucuuuuggggauaaaguuguuugcuccuuacuuuaacccagacuccaaaauaaauuucagaugaauuaaagagcuaaauguaagaaaccaaacuuuauaaguguuagaagaaaauauagaagaacaauguuuaaaaucucuggguaaaggaggccuuguuaaguagaauacagaaaaccagaaggcauaaaagaaaaguuugacaagcuugaaaucuucaaacuuacguuaaauuauaaauauuuaggcugggcacaguggcuuaugccuguaaucacagcacuuugggaggccaaggcugguggaucacaugaggccaggaguucgagacaagcccagccaacauggcaaaaccucgucucuacugaaaauacaaaaauuagccaggcaugguggugcuuguguguaaucccagcuacuugggagacugaggcaugagaaucgcuugaaccugggagguggagguugcagugagccaagaucacaccacugcacaccagucuaggagacagagcaagacucugucucaaaaaaauuuuuuuaauuaaaagaaaauuuuagaauuucuguuaaaaagauaagcaaaagcccagaagauauuccacacuauaaaucaguaauagaccaaaaaaccaaaauacccuaauagaaaaaugggcaaaggguaaaaauggauuuagccauagaaaagauaauguaaauuaaaaagucauaauauuugaaaacauauucaacuuuacuacuugcaucagggaaaugcaaauuaaaauaucaaugacauaacauuuuucccuuaccaaauugccaauaacuaaaaagacugaugacaucugcugggaagggugugggaaaaguggugcuuucauaguguugguugaaguguuaauugguuuggcuuucuuaaaggacaauuugauaacaucaaaugaaauugaugagaaauucugcuucucaguaucuagccuagagaaauauuugcacguguucaaagaagcacggccaaggguguguuuuguggcauuauuuguagcagcaaaaaaucagaagcaaccuaaauaaauguucauuaauagggaaauggugaaauaaguuguaauuaucaaauuaugggaaugguguacaguaguugaaaagaaugagguagaugucgaugcauacaguaauagauucuggaagaucucaaagaucggguuguugagcgaauaaagaaacuugcguuagaacacguacaaugauaucuuuuguguaaagaacaaaaaauaaacccauaccuauauaguacuuucuguaauacacaugcacaagcacaaguaaggauccugggcaaauacacacugaaguagcuauguuugggaaagagugugggauuuugugagggaggagaagucugagaggacucaauuuucauacuuuuugaacuuuuuuuaacaaaaacuuaauguauuauuuauuguauaauuaaaaauugaaauaggaaagauugacaaguacucacaguguaaguacuuccauagagauaagaacuuggugcuuugggaccacauaagaaagggcaccagacccaguguuugaggcuccagaaacaacuccugaaggaaaacuuggcuaagcuaggaucuauaauuccaaaggaggaguuguacaaaagacagauggagguaggaggagcauauagcuaagggaacaauuuacuuucucaauuguuugcauggcuggcuucuugucacucagauuucuaucuaaaugucaucuccucacagacgcuuuuccugacuauucaaauuaaagaagcuacccaagacacucccuaucaugacauccucauguuuuuucuucaaagcacugaauauugggugacauuuucuuaaugauguauguucuuuaucagcuacacuagauuuaagcccuaucuuauucaacacauuauuauugcugcuucuuagcacaguuuauaaauggcaccuaacuggacacaagagccuggggcgaguguggaguguugaaggaagugaaaauguuguaguuugguaggccaaaacauagaugggaugcugggggaaauguccagagaagaagccagaucacuaagauggccagcucacaacuggagcaugaguaaccucacugcauuuggggaaccauugaaugauuucaaguagggaagugacaucagauuuuuguuagauuauuucagaggaagaugaacuggguggggaagagguaaaacuugaagcuguagaaccagucagaagacauguauaguaguucaagugaaggccaggcagugguaggaaaaaugagaaggaauauuaaggagacagaauugauugcugacuggacgcugaggaugaggaaggaguugaaagggaugccaaauuauuaaucaaugaaugguggugcccgguacugugugaaaccaaaauuuuuaucaaaucuaaauuuuuuugaugauggcuuuuuuuucuuuugcgccuaccaugagaugucaauuaaggauuugagauuauuaaaauucaacuauaucucaaccccaccugccuaauagauuauaagacacucuuaauuguaagauggauccagauuucagagagguuaaauugugaaaaaugagcauuuuagaguugaugaaauagggucuuggaaauaagaacccagagggaacucaauauccaguagagaaagacauaaauaauuaaaauaugguauuuugagugcuucccaugugcuaagcacugugcuaauaaaugauaaugauacagacaugagcaaaacagacacagccccuuccuucauggagcugcauucuaacagggaaaacagacauuaaguaaaaaacuauuaaauugaaguuguaauuaagaccaagaggcaggauuagagggaacugugcuuguggacauaacuaggggauuucuccuagucuaugagaccucugcaauggcuucccugagacggaaggaaaaacagguguuagcuaggcaaagggaggugcuggaggagggaacugaguucuagguagagggaacaacgugauaaaugacauaccaaagguaaauacagcguagagaaagugaaagugcaaauuuugaaaugacgcuaauuccaguuuuaacauggugauguugaggugucuguuuucauagccaaaagagaagcccaauagagauuuagauagucaggucuguagaccaagauaaaaggacaaagacuuuuguuugguaccuauuauaugcuaaauucugucccaggaacuucauauguauauuauaucauuaauccucagauaagucuggaugguaggcaguauccccauuucacaggcugcaggcacugaggcuuacaaaagguuguauagccugcccaucauuauaguugguaagaggcagacuugugauuugaauccacaucugucugacuuugaagccccucuucuuccccuaaugguaaagaguaugagcugcacucucuuggugguuuaaaucagaucucuacuguuucuuagcccucagucucaguuuucucaucugaagaacaagcauuaauaguuaucucagaauuauuuugaggaauaaaugagauaauccauguaaagugaguaggauagugccuagcgcauaguaucugcuccacaaauguuagcuguugcuauuaugauauuuaaugugaacacagcuuuggacccuuuuaguauuaucuaaaaagaaaucaagaagucagaagagaaggcuggagacagagugcugggaaacacuagcaagucugaggaggaggaaacucagaaagaauuuuaaaauaacaauuuuuuucaaauuucaguaaccuccgccuguaaauaauuuuuucuuccacaaacuguagcaguauuucuuccauuaauguagcaaaaugguauauucauucaauuaaaauaguuuuuuuaaaucuauauauccaugucuuuuugucuuaagggaaagggguggcucaugauaaauuuccugcuaauguguaggaaaauuaguuugguuaccauguuaauguaaauguagcuaauauuuaaauugcacaauaaguuauuagaauguaacuuuugggccaggcacaguggcucaugccuguaaucucagcacuuugggaucccuugagcccaggaguuugagacuagucuggguaauauaguaagaccucgccucuacaaaaaaacuuaaaaaauuagcccgguaugguggcaugugccugugguccuggcuacuugggaggcugaggugggaagacuccuugagccacagaggcugcagugagcuguaauugcgccacuguacuccagcccugggcaacagaguaaaacccugucuccaaaaaaaaaaaaaaaaaaaaaaauuaaaaaaaacuuuugaaugaauaggaguaauucuauauuuuuaaaaaaugggaaaauggcuuuuuuuucccacaauggguuugccaccagaacacagguguugugaaaacuaccccuaaaagccaaaaugggaaaggaaaagacucauaucaacauugucgucauuggacacguaaauucgggcaaguccaccacuacuggccaucugaccuacaaaugugguggcaucgacaaaagaaccauugaaaaauuugagaaggaggcugcugagaugggaaaggacuccuucaaguaugccugggucuugcauaaacugaaagcugagcgugaacgugguaucaccauugauaucuccuuguggaaauuugagaccagcaaguacuaugugacuaucauugaugccccaggacucagagacuucaucaaaaacaugauuacagggacaucucaggcugugcuguccugaugguugcugcugguguuggcgaauuugaaacugguaucuccaagaaugggcagaccugagagcaugcccuucuggcuuacacacugggugugaaacaacuaauuguugguguuaacaaaauggauuccacugagccacccuacagccagaagagagaagaggaaauuguuaaggaagucagcacuuacauuaagaaaauugguuacaacccugacacaguagcauuugugccaauuucugguuggaauggugacaacaugcuggagccgagugcuaacaugccuuggcucaagggauggaaagccacccguaaggauggcagugccagcggcaccaugcugcuugaggcucuggacugcauccuaccaccaacucauccaacugacaagcccuugcgccugccucuccaggaugucuacaaaauuggugguauugguacuguuccuguuggccgaguggagacugguguucucaaaccuggugugguggucaccuuugcuccagucaacauuacaacagaaguaaaaucugucgaaaugcaccaugaagcuuugagugaagcucuuccuggggacaaugugggcuucaaugucaagaaugugucugucaaggauguucgucguggcaacguugcuggugacagcaaaaaugacccaccaauggaaacagcugacuucauugcucagguaauuauccugaaccauccaggccaaauaagcgcuggcuaugccccuauauuggauugccacgcggcucacauugcaugcaaguuugcugagcugaaggaaaagauugaucgcgguucugguaaaaagcuggaagauggcccuaaauucuugaagucuggugaugcugccauuguugauaugguuccuggcaagcccauuguugagagcuucucagacuauccaccuuugggucauuuugcuguucgugauaugagacagacaguugcggugggugucaucaaagcaguggacaagaaggcugcuggagguggcaaggucacgaagucugcccagacagcucagaaggcuaaaugaauauuaucccuaauaccugccacccaacucuuaaucagugguggaagaauggucucagaacuguuuguuucaauuggccauuuaaguuuaguagugaaagacugguuaaugauaacaaugcaucguaaaaccuucagaaggaaaggagaauguuuuguggaccacuuugguuuucuuuuuugcaugugguaguuuuaaguuauuaguuuuuaaaaucaguacuuuuuaauggaaacaacuugaccaaaaauuugucacagaauuuugagaccuguuaaaaaaguuuaaugagaaaaaaaaaaugggaaaaugaaaaagcaucauaaaauaccaugauuuugugggcuuuauuuuguuaaaauaacuacucgucuugucacuauuguaaaaacauauuucaaggaaaagcagcuaaguaauaaaggccaaaauuuauuauuaaugaaauuuuucauuuuaacuaauuuucagagagaagagaaaacuuacucaguaaauaaccuuccuccagauagaccgggaaguccauucacugucgguucucuaauuaaacaggcaacaagguaaguucuucccauucaauugaaucaaauguuaugugucuaaacaucuuggcacauuuucuugugauuaaggauaagauuaagaauuggcagguacaauggaaauauaugccuucgguaaaauuugucaacuuuuuuggugucauaauuuauaaaauaagguaauuuuugugucauuuauuaagauuacuucuggcuuuguaauuuaaauauggagaaauauccauauauggugagcaagugcugagaggaaguaagugcccuuucuuugcauaaguguggcaucauuauuguuccuugaaaucaaguuggagauuugauguuacauuuaaaauuuuuauacuucuuuauuaucuucagaguaauagauuucugaaaauauacuaaugauaaagcauagauugguucuuugguucauauguuuuuaaaauucucucaaucuaugauacccagaagaaugcaaguggacuguuguuucuuuuuauaaauuuauguacaagcaauuuccaaaauagauuugaagaagcauauucuguaauuugauuuccuagggauaguugauucacaucccuaccauuuuuagccuaugugaaacuuuccaggcagugugaaucuaucaccucuuaaaaaaggaguuccugaaaauucuguccauggaaucauuucauugcuaaaaauuaaaggaauagccuuaaguagguaagauuagcacaaagggaagcaacaguauuucccuucuaggggcuuaaggauuucuggagaaaaaaagaguucccaacacauuucagugaaaaugauuuacugaucaucuaaaauguuguauggcagugaaaauggguugcuagaauuggaaaaugucauuugcaaauguuuaaguaguauuuuuuguguucacagaauucuucaacauugugugaagaugagacuuucuuuaagccauaacuaucguauaugcugcuggaaaaugguauguuaaaauuauuuuaaaagcaagauauuuuuaaauuguuuuauuguuuauauccauacuucugaguucaaacaguuuuccucuaagucaugugagaaauucuuguaacauuaauguugguuuauucagaaaaauaccuaccuaguagacaaacacugaaaguucaggcuuuuauguuauaguuuuauuguauaugguucuuauuuuucaugaagaggaaaggauaggggaacugauuggauuugaaguauguaaaaucauuagucauuauaaaccaugauauuauaguguucuauauuuucauaaccguaaaaauaaauuccuuaaugcugauuuggaggaagugauucucagacuuugauuucuguaucuauauucauuuaauuacaaaccuguaagcuccuaauuuuugucuauaauggauguaaaguucagagcagaacagugacuuuacaaauauauuauaacugaaucugcuugaaaaaaagacuguuuuggguauccacuucuggaaaaauuaaaauauaaggauuuuauaauauuugacuucugaauaaguauccaaaauugcccuagagucauuaauauucauuuaaaucuuguucuuagauaacucuauuuccugcuauuuuuauuuacuugguuuuagguaccugggauaaacgauagcaauauacugccuuugguuuugaaagagucacucauacccagugugggaagauuucuugccuacucugaugacaaaguacaugcuaucuuuuuagauggcauuacucuaacccuaaauuggaauuucagcucuccuauugagaagagacagguggguauacuucagacuuagaucuauuuuuuauugguaaucuguggaaaacagaacaaagaaaacaaaguaccacacuauuucaguucauuuuuugaaguauaaaaucugucaagaagcuuuacugaucucuuuggauuuccuagcaaaaaucagaaugauuugacaaauagucacuuuucuaaagauaacugauuauagagaaagggauuaguauuuucauuugcuuugauaauuaccuauaugaguggugguuaaauaacacccauaucucauguaaacaacauuuaaacuguugcaucuuuaaugauuccucuacuuauuucuuuaaguuaaugaaguuagaauagguuguuuauguucuuuuuuucaguucuaaaaugauaaaacuuaucuuucuacuucuucagguaaaucaaggucuuaacuuagguugguguaaguuaacuuuuccugauggacaagagcaguuaauucagauugaacacccugaaccauaugaaagguacugaaaagcaauuuuaaaaauuauuuuuauguuuuacuuuuaacuaacagagaauaagcaauaagcauuauuuaaguguuauauauauuuuuaguuuuuccauguggauaauaaugaaggcauuucagucguuucagaguugauagcuguacuuguguuuagcauaacuaaauagaucaagucagcuuuuuuuuuuuuuuuuuuuuugagacagaguuuugcuccuguggccugggccggaguacaauggcacgaucucggcucaccacaaccuccgccuccuggguucaagcgauucuccugccucagccuccugaguagcugggauuacaggcaugugccaccaugcccggcuaauuuuuguauuuuuaguagagaugggguuucuccauguuggucaggcuugucuugaacucccgaccucaggugaucugcccaccuuggccucccaaagugcugagauuacaggcaugagccaccaugcccggccuucaggucagcuuuaaucauuucauuuguauucaaguaacuuuucaaaaugaaauguguuauagacauacugauuugcuguggagguuggauauggucagcuguguuaacaauuaacuaauccucuagccaauuugaaauaagauuugcaaccacaaauaacugaaauucuguauauuucuauaaaguggauaaaauuacgcaaugauuaucuuaaaauggggaagagucuucagcuuuuuaugaauuuuuuuucuuuugguuuaucuaauuuauuacaguaaaucuugugauagucuucacauuuuagugauuucacuugagaauauucacaaaauaauagcuuuuuguuaccucuugaauguauuuuucuguuggguuuuauuguguuucagucuaagugcucauucauugcuauuaaugauuugccucaaaaaagauaguuucuuuagcaaacauuucuauugauucagccaaucauuucagaucauucauuuuauuaaacuugauacuuguuuuagauauguaguaaguuacauauaauuacacauaugcauacaagcauauguguauaugcauuagcagguguuuuuugguuuaaauuuuaguaagcaaaugcucagucagucuuauuuugugugaauauuuuuugauaaaacuuaaacgcauuuuacuuugaaaaacuaaaagaauuagaacauuuaaaauugaacuuuaaaugaaauccaaauaucgccuuuauuuugauucuuaaaugucacuuguauuaaucacaaauauaaguaaaucauuuuauucuugaugaauaauggaaaaaauuuggcuuuucuaugaccagugaaaaauauuuugagaauugcccaguaaaugcuucacuuuaacauuuuuucuuuauccuuuuuucccaaauugucuuauuuuuacauuuguuuauaauuuuauaauguauucaaguucauuuuucaaguauuucuuuuaauguauucacuuuagauaugugacaacaguaacaucauggugcaggagacugacccagacuagucccagagagaugcccacucauucgucaucuucuguucuccaagaaaauugguauuuuucuuuuaaacuuaaaucuguuuagaagagcuaauacuuuaaaaaaaauuaaaaugucaaaugguaaacugagacuuuuuuccccaaaaaaacuuucuuaguuuugaauauguuuaacuccuaaaguauuuuugauagcuuaagcuugaaaauaauuucuaaucagacaucuaauuuauuacauuucaucauauucuauuuuaccuaaagguaagaaaaccuugcauugaaaacuuaacaugaaaaugaguggcucuuuuuaugugacaaauucauccugaaaacuuuauggaaaaauuuaaaggggauucuuaaauuuuuaguaauguugaaggaaauaaaagguuuaauaacauaagcuuucagaaaacauugauuuuuaaauaauuucugucauauuaguuacuucucccaaauuaacuggcagaucaaauaaagcaaguauuuuagucccuccugugugcuuuucagugugcaggguacuagaacugggcuucaagggaacuuucugugaaaauauaagacauuuuagggaggaaauaagggcagaaguaaaaaggauauuuuagccuguggagauagaagauaguuuuuauggaacauaugcuaucuauuaguauauaguaugaguuuugagggcuaggaauggaucuuauaauaaauaggaguucagaccugauggaauuagaaaguccuaaauggaaaaaugauaggaagaaaggucauuagaagauuagugucacugagagucuaaccugaauauaugggaagacagggauaccaggaacaauuugggaagcuuuuuaaguaaguuuugugaggugaccuaacauaguguagugaaacaaaauguaaacauuaagccaauuuuuguuaccuuuuccuaagcccuuucuuagaacaaaucaaaucauaucaguaagcguuauuugaauaucucagguagcuuaaggauccagcuuugcagaucccucauccuuuagcuguagccuguuuggaagcagaaaaguugcuaaaguaacuagcaaaaaacaauugugauggaaggaaaauuguacuugucuauaaaaccaucacuucaccauugcuuagcuggcaguuuguaaaauaucaucagccuuuuuauuugaaagcugagaagaggcugucaauacacacuaaaaacugcaaguagagauuggugauaguagcuaaaggugaaagcaacuaggaacagcagaggcaagauaaagaaauugaggaguagcuccauucccccuauaaagccuuagguaucuccacuucgguuuuucuuaucaaagaggguagguugaaggaagaaacaagauuguacaauaaaaagcuaccuaaguuguauucuaguauuuuuuuuccgccacacccuccauuauuagcuuauuaauucaacuuuuuagucaacaaauaguacguuucauaaaaaguucguucauuaugagagcaauaacaauaaagguuguauuguuucuuacauccagaaaaaugcguuggguuuaaaaaaaaaaagauauuuugcaauaaugaacaaucagcugguuguugggguaaguuguauccaaguucuuugccacagguguuuaaaauuaugaaauauuucuuuucauucuccauccauaggcuggaguacaagggaaagaguacaagcugacagggaggugcaugugaucuguuguaguaaagccaauaaagcagacaagucacacaaccuacuacgaacugugaagauuuuucuggugacuugaauauuuuagacuaaugucuucauuaauuuugcagagagcuagucaaguuacaguuuguaguuguaugccauugcucauauuucauucuaacuugauaagaaaaaggauaaagaacacacacuuagggguucugcuggagacguauauauuagcccucuacuccauaccaguugucccacuaucuuucuauagaacaugguauaagagcuaauguucaucauguuaacccucugugcuuaaaaaaacaaugaaauaaguagguagucuauuccagaaagaauuuaauaaaaaauaguuguuuugacacguaauucaacuauuuaaaaacuuggaucucccauaccauccauucccaaagaguuccauauaaaugaggucuuaauauaugcacaaguacagaaaaguaaaaaauccuuucuucugagagaaacaaucuagguaggaagagcaggaaguuaaauaguucaagagaagauauuacaaauaaguaugugauuaauuaauaugcuauaggaauucaaggaaggagagagcaguucuuucacagaaggaaugggauuuuaauagguuuguaaaguuugcguaaacuuuagggaggaaaguagaguguaagcuagguuaguacuaagaaguaacaggaaggcccauuauccucaaacaucaauauuugauuacaaauuccuugaaguggauuuacaagggguagacuuuuauucacuuaccuuuaaaggcacucaguaaguaucaguugagucaaguugauuuguugcuaaauaaagguaacauaaagagaauucuucugcguucuuccguuuaaaauucuaaugaaaaaaaaagucagguaugcuuauuugaaauaucaugaauacaaaagaaucagacaacugaaugaauuuuuucuuuuuccuuggacaggucuguugcuucugaacuugaaaagauacagaaguuuaacuguauccuuuaaacagaaugcacuguccuacauaauuacucucuuucauucuaggcuuaauucaugacuucaguacuuugugaauauuaaucuauacuuaauauauugcuaaccuuuauugagucagcaaauaccuaagauuguaauuuaagauggaucuuguccauagaagguauagcauguuaacauuuauacuuuucuuugaguuuaaauugggcaaagaacaguuaauuaggguuaaggucuccuuuggagacuuuuucacuuacauaauuauauaauaaaauuauaacuguuuaagaccucuuuuuuuaaaugaaauauuucauucuguacauucucacccaauucaucuaaauuuguuuucucuugugguuuuucucuaaucuuauucaaauaaguuaguucuauagcgaacagguuuuucacucuaaaucuuuuuaaauuaaaaauagacacuacacagauuccuuauaauccugucauccuacucuuuaauucccgugucauuucuucacuuaaagaaauguuacugaaauuuucauuuccuccuuaccaccaaaccuccacccaaacacacacauacacacucuauucucuuucccccucccuuauacuguaauuaguuucuucaucuacaaggagcagacuugauaagccuugcaguuccaacuguauuaugaauccaagaggucuuccagcugagaaauauuuuaauaugaagccuaugcuuucuguauauaaagauauuuauauagugaaaaauguggggaaaaccuccuuaacuaagcaacuuagugcuacuagaaaauagugguauccuaaaccagauuucuaacaagaaaaaugaacaacagucuuuugaucauuauaaaccaggaucuucagaaaccuugcuaggagaaguuaaugaaaauagaguaucaauagcauugaaaaaaaccucugaaauccuucacgauauugacugucuucuaucaaacucuaaaaagugaaaaauggaauuauuacaacauauuauuaaaguuuaaggauguuguuucaagugacugguauaaaauuacuaguaagccaagauauuguacguauuaccccggcacaaugauugugaaagaacugacauuuaacuuugaagguauuuuuaacuuguacauuuuuaaaauauguauuuauaucuuaauaauaaauauuucgaaguuuugaac

SEQ ID NO: 17436 - RNA, 10912 nt, Homo sapiens
agcuuuaccacuccugaaggcccuaaaccccguuccagaugcucugacugggcaagugcaguugaagaagaugaaaugaggaccagaguuaacaaagaaauggcaagguacacauuuuggaccaccuugaaguguuaaucuguggcguuuucaguaacacauuaaauuugauauuugucuuagaacagugguuuucaaaggucugggcuccagaccaaaggcaucaacauuuccugggaacuuguuagaaauacagauucucagacccuucccugggccugcgaaugggguggggccuggccauccugugaaaagcccuccaggcggguccacucuuucaagcuugaagaccacuguccucuuggugguaauccuuccaagaguggaaguaggugcacaaugguguuacugcuggauugcaggcuggaggacuaucagaacuaacuuucuuuuuuuuuuuuuuuuuuugagacagucucgcucuguugcccgggcuggaguacagugacaagaucucggcucacugcaaccucugccucccggguucaagcgauucucuugccucagccuccugaguagcugagauuacaggcacaggccaccacgccuggcuaauuuuuguauuuuuuguagagaugggguuucacuauguuugucaggcuggucuugaacuccugauccgcccaccucggccucccaaagugcugggauuacaggcaugagucacugugcccggccuaacuaucaggaacuuacuauagucauuuguuaccaccgaccuucugugugcggugcucacacaacccagcacaguagauggagugcucucuccagaugaaggaauacauugacacuuggcuuaggcaacaaacagcucagaaaugccaacauacaaggaaaggucucaaacuuggauucugugaaccucuugcaguugcacacaagauuguuguguguauccaaguucuugcaaacuaagcuacuucgucuucguugacucauuaccuaaugcauccuuaaccauguuuaaucucccuugauuaucaguguguugauccuuucucuuuugaugaguugucuaacucaaacccaguugcaaggacuggguuuauucaaacccaguuaaaauguggcucauaauugguugaaguauuuuacaagauaauuuuagccaacaaguggcugauaaacagggucucaagaaaaaugugucuugcgugucagccgcggaacgauaccuagacuaccuguuuucauuuuggcagccagugaugguauuuauaucagccuccuuugaaaagggacgggaauaugugggaauugguuauugaacauuugggggaguuauuugucauuucuucugguaucaaaauguguggguggauguaugccuugguagaagaaaugaacuaggaguucacagaugagaguaccaguguuuuuagugaauuauugcauuuauauaggucuugacuuccucaauuauaaaauuagaauguuugacuugacuuguauaguuuguguugcaugcacaagucuuagaacaguucuugcauaccgauagccuaguugcucccucaagucaccccuugccagggguuaucugcagcucuuauucaugcguauuccaccuguccagauuguccugugaguggacccuauuuguucuucagauaucucaugggucugugccugaaaauuguccuguuuuggaaaacagcacuguuugggcugcucuguugauuauacccuuugugauggaaagcuacggcuuuuauuuacuuacuuauuuuuuugagauggagucuugcucuguuucccaggcuggaguguaaugaugcaaucucagcucacugcaacuuccgcuuccuagguucaagcgauucuccugccucagccucucgaguagcugggauuauagcugugugccaccacguccggcuaauuuuuguauuuuuaguagaggcuagguuucaccauauuggccaggcuggucuugaacuccugaccucaggugauuugcccgccucggccucccaaaguguugggauuauaggcgugauccaccuugccuggccaaagcugcagcuuuuagugcaaccuguguaauuuaaacugcuggcccuuuagugagccauuacugacaggccggcuuacuuccugacaguaagagcgguaugaaaugucagcuuacuaugcuuuaaggagacuaacagacuacaaacuagcaauauaagaguaugaaaauggauuuucugcauggcaugguggcucacaccuguaaucgcaguacuuugggaggccaaggcgggcggaucaccugagaucaggaguucgagaccagccugacgaacauggagaaaccccgucucuacuaaaaauacuaaaaauuagccaggcgugguggcagcaaccuguaaucucagcuacucaggaggcugaggcaggagaaucgcuuggacccgggaggcggagguugcacugagccgagaucucgccauugcacuccagucugggcaacaagagggaacuccgucucaaaaaaaaaaaaaaaaagaaaaaaaagaaaauggauuuucaucauaccugaaaaccagucuuucucaucugugguacuggagagaaugaggcccugcagcaaaugauuugcaggacuaaucucugaaucguacaaagaugguguuauauagccagugcuacucuagaugcacgggagauaaauuacuucauuaccuucuggcguccaaacugcacugaacaccucagcaaacuuggguggauuuuagauuuugagaggaggcacaguaauacaugacauaauuuagauaccugcaugacaggccaggggugguggcucacuccugaucucaguacuuuugagaggcugaggcgggaggauugcuugagcucaggaguucaagagcagccugggcaacacagaccuccaugucuccaaaaaaagaaaaaaauuuuuuuggagaugguuguggcggcacuugccuggaguccuagcugcuugggaggcugaggugagaugauugcuucagcccaggaauaugaggcugugguaagccaugaucgugcuacuguacucuagccugggugacagagugagaccccaucucaaaaaaaaaaagauacucacaugaacuuggagcucaagguagcucgugguuucaacgucagauugcgcuagacuccuuuuggagaugucauacuuuuuuuuuugcaaaacugcguucugguaaugacugcaauagaaagcagaugccucaggaaguucaugaggaacaagagaaaagggggcacguuuggucuccaggauuggagaagguaugcagugcccaguaggcauaugagucccauuaguaaguuugguguuuuuaaaauaauuuauuucaauuuauguuuuguuuuucuuuuuuuaaggcugccaaguuuuagggaauguaaauuuuuguuguguggaucucacuacuuaaacugaaccugacaaagauuucuuuuggcccacggagcuucuggauugcauaggauggugugccugcgggcaucaggguggagcuuccucagaccuggcugcuuuauuuuuauaucuuuuuuaaaaacagcaauauuuauuuugcccucagauauaaaaggaaacuccucaucaaugacuuuggaagagagagaaaaucaucaucaggaagguaaaggcuguguaaauguuucuuuucuaauuugauagaccuguaauuuguuaaaaaaaaaaaauugugacugucagaaaugcugacugucgcaguagcauuuauuaauaccuuuuucacuaauuugaaauacuguaucuguuguguacuaaauucccauacaugcagucuccggacuauuuaggauucauaugguugggaaucuggagugaaucuuccauuauuguguuuugacauuuucuuggcuuaccuuacauacauggugaucuuaauugcagggcuuauucuguuaaucuguuguuuuuucaguucugauucaaaggagucuaugucuacugugccggcugacuuugagacagaugaaaguguccuaaugaggagacagaagcagaucaacuaugggaagaacacaauugccuacgaucguuauauuaaagaagucccaagguagucuuguuucaguggcaugucuugaacaagcuguguggcauugcguuucuaaagaguugcuuagauuggguaguacaaaugaugcuggggauaguucacaccugcuaagagcuauuuaauagggacuuacuggggcuuaugacguaaauaaagaauggauuggcaacuggaaaacuaaagacaugaagauuuuaaaaaucauuuucauauaauuuugaauguuagauaacauuuuauuucuuaggagucagcaaucauagauguaagcuuauuaaaauacaugauggggaaaaaugaaguucaaguuaaauauuguaaaauucuaauuggagaaaaaaaaauuggcauugcccuauugucuuuaagcagcauguucuugccuauccuggucccucaaacacacagacacagaaggauauaaagaaagcuuuaguguuuuccugaacuuuuuggcaggauugggguugaaauuuacauuucugggccaggugcaauggcucaugcuuguaauuccagcacuuugggaggccgagaggacugcuugaggccaggagacuagccugggcaauauaaggagaccucaucucuacaaaaaauuuaaaaauuagccagguguggugguuugcaccuguagucccagcuacuugggagacaggugggagaacugcuucagcccaggaauucaacguuacagugaaccauuaaucacaccacugcacuccagccugggcugcagaguaugagacuuugucucuuaaaaaaaaaaauuuuacuuuuggcugagugcaguggcucaugccuguaaucccagcacuuugggaggccgaggagugcggaucaugaggucaggagaucgagaccacccuggcuaacacgguggaaccccgucucuacuaaaaauacaagaaauuugcugggcgugguggcacacauuuguagucccagcuacucgggaggcugaggcaggagaaucacuugaaccugggaggaggagguugcagugagccgagauugcaccacugcacuccagccugggucacagagcaagacuccaucucaaaaaaaacaauuuuuuuuuuuuuuuuuuacuuuuuuggaacauagcuggcaaaggaauaguaagauucaaugugauggugcuuuuuuuuuucccuccugaccgagucuugcuguuaccuaggcugaagugcaguguuauaucaugucucacuguguauucauuuuuuugagacggaaucuugcucuguugcccaggcuggagugcaguggcgcaauuucaacuccaccucucggguucaagcgauucuccugccucagccuccacaggcgccugccaccacacuugguuaauuuucguauuuucaguagagaugggguuuuaccauauuggccaggcuggucucgcacugcugaucucgugauccgucugucucugccucccacagugcugggauuacaggggugagccaccacgcccaaccaucauggcucacuguagucuuaacuccuggccucaagcaauccuccuaccucaaccuccugaguagcugggaccagcggugcaugccgccacaccuggcuaaacuuuuaaauuuuuauagagaugggagucucccuaugucgcccaggcuggucuugaacuccuggccucaaguaguccucccaaaguacugugauuacaagcgugagccacugugcccagcggauagugauuuuuuugagaccgaguuucacucuaguccaggcuggaguacaauggugcaaucuuggcucaccgcaaccuccgccucccagguucaagcgauucuccugccucagccucccaaguagcuggaauuacaggcaugcgccaccaugccugggcuaauuuuuuuguauuuuuaguacagaugguguuucuccauguuggucaggcuggucucgaacuccugacuuugggugaucugccugccucggccucccaaagugcugggauuacaggugugagccaccgcacccggcccggauagugcuuuuuaauuuuuuaauuuuuuuaaacauauuuguucauuuuguaggaucucaguugauuuuuuauuuauuuauuuauuuuugagacggagucucccucugucaccaggcuggagugcaguggcacgauuuuggcucacugcaaccuccgccucauggguucaagugauucuccugccucagccucccgaguagcugggauuacaggugucuaccaccacgccuggcuaguuuuuuguauuuuuaguggagacaggguuucacccuguuggccaggcuggucuugaacuucugaucucaggugaucugccugccucagccucccaaagugcugggauuacagcgugaaccacugugcccggcuuuuuuuuuuuuuuuuuuuuuuuuuuuuuaagguggagucuugcucuguugaccagacuggaguugcaguggcaugaucuaggcucauugcaaccaucgccucccagguucaagcaauucuucugccucagccgcuggaguagcugggacucaaggcauaagccaccaugacuggcuaauuuuugguauuuuuaguagagaugagguuucaucauguuggccagccugaucucaggcucuugaguucaagugauuugccacacccagcagcguuuguuuuuuuuuuuuuuggaggugaagucucgcuguguugcccaugcuggagugcaguggcacgaucucggcucacugcaagcucugccucccggguucaggcgauccuccucccucagcccccuaauagcuaggauuacaggcacaggccaccacgcccggcuaauuuuugcauuuuuaguagagacgggguuucaccauguuggccaagcuggucucgaacugcugaccucaggugauccacccaccuuggccucccaaaaugcuaggauuauaggugugagccaccgcucccagccccuagcuguuuuuuuguucuguuuuguuguuuuuuuuaaauagagacgaggucucacuguguugcccaggccauuuuuaaauuccugagcuuaagugaucuuggcaugaccucccaaaaugcuaggauuacaggcaugagccaccaugccuggugaucuguaauauuuaaaauaauacuaaucucauaguuugguuaaucuucaggcuaauguggaaaugugaguggcaugugggcaugugcuagaauaaucuuucuccuguagacaccuucgacaaccuggcauucaucccaagaccccuaauaaauuuaagaaguauagucgacguucaugggaccagcaaaucaaacucuggaagguggcucugcauuuuugggauccuccagcggaagaaggaugugauuugcaagaaauguaugucuuuauugcauucuuguccugugauucucugauugguccagugacuggagcagcugcgcaccacugggacaggaggucuggugccaagucccccagcagcuguuggggagcagagcagcugcugcagcucggugcugaguucuucuguacugggagggaggcagcuggaaggaagaguuugcuuccuggauugaauuuauuuuuucaagcaaagucaaucugggaauacaguuuuuguuuguuguuuugcuguuuuuguuguuguaguuguuuuuccccuaaaaauuacaauaaucucuggaauuuguuuuuuaaauauaaauauccuaaaaaguauuugagucauuucggcucaaccaugaaaauaaaaguucuuaauuaaggaaggaaggcuuucuuucucuguuggcuuuuuuuuuuugggagaugcucugucaccgaggcuggagugcaguggcgugaucccggcucacugcaaccuucaccuucuggguucaggugguucuccugccucagccuccugaguagcugggauuacaggcacgcgccaccacgcccagcuauuuuuuguauuuuuaguggagacgggguuucaccauguaauuccugaccuugugaucuacccgccucagccucccaaagugcugggauuacaggggugagccacugcucccagccccguuggccuuuaaacuugugccuaguugaaaugucucaggccugaacuuuugcugcaucauggcaauaccugcugaccaggaagguagagagaaugaucguguaccucccucccucuaugugggguuucuucucagcuccccucugguccugagccucucgcuuccucagacacauucuuuaaacaaacaauuagaguuucuccucugugcugggaaauuuuuuagagacuggcauguuugaaacgauuguaaguggcuuuaccaguuuguccugacagaugucauuuggguuuuuucccccagugugacaccauugucccauucucugaguagaaacuuggaaaaauuagugauaaugcauaguauguucaucacagugcucauuucucccccucaaaaauugggcuuaugaguguuucuguuuccaaggaugcuuguguggugagcccagcagaucuuuuuguugcuucucauugccauccgcuuucucuuugcuggauugauugggcugggauuaagucugucaaauagucacugaaagcugaccccucagggagccucgggcacacugucaguguuguggcuguaccauauggaugggguuugucuguagcgccccgucuccuggcuuuguuaaguuagugccugacgcacauguuggaucuuguuuaacagacacccuguagaccuugaaucugcagaaagcagcuccgagccccagaccagcucucaggaugacuuuguaaguacuuuggauaagucuuucagcuuggggguugcaggugaauuguuaauaacacaugcugccuuauaaacugaaguuuggacugggcacgguggcucacgccuguaaucccagcaccuugggaggccaaggcaggcggaucaccugaagucaggaauucaagacuagccuggccaacauggugaaacccuguuucuacaaaaauacaaauaauagccagguaugauggugggugccuguaguccgugcuacucaggaggcugaggugggagaauagcuugaacccaggagguggagguugcagugagcugagauggcgccauugcacuccagccugggcaacagagcaagacucugucucaaaaaaaaaaaaagaaagaaaaccaugugcugcgcgugguggcucacgccugugaucccagcacuuugggaggcugaggcaggcagaucaccugaagucaggaguucaagaccagccugcccaacauagugaaacccagucucuacuaaaaauacaaaaacuagcuggguguggucaugcaggcauguaaucccagcuacucaggaggcugaggcaggagaaucacuugaacccgggaggcagagguggcaaugagccgaaauuguaccacugcccuccacccugugugacagagugagacucugucucaagagaaaagaaaaccguuuuuaaauguaucaguuuaaauacugucuccuguccugagacagccacuauuugugguuuugucuaggcuuuuacaauucuuucugugcuuauaaacuauguacauggccaggcacagugacuagugacuccuuccuguaaucccagcacaaugggaugugugcacaucuaaacgucagugucuuguaaaugguacaugugguuucucuuugcaguguuauuauuaaaaucugucucaguugcacgugaaguguacaccuugcugugcauuacaucacaugauuuaccacauaaggagugggguguaggaaggggccccuguuuucagggugagaugaaugucaaccgagccaugcuucuguuuuccaggauguguacucuggcacacccaccaaggugagacacauggacagucaaguggaggaugaguuugauuuggaagcuuguuuaacugaacccuugagagacuucucagccaugagcuaacugcccccuggcggccaggaagagaaacagcuccuccccgacuagguggaaggcuggccaggcaccaagcaugugugugcacuuguaccuggugguuucucuguuagcaguccauuagcucaugcugaauuauuuuugccuuacuuucuuaagaaacauuaauuuuauguauagugaguauauuuugcauguuuuaaauuguaaauggagcuaaguccaagaaaguacuugaagcucucuuccagcgagcuuaauugcguaaucccuguuguccuccaggguaagcugacacgucuacauaacugguuuuccacaggcaucuucaguuauugcuugucagguggacuguuuuggauuuaaccauguaauccaugggaccaauugagagucagcuacuuuuauaggcaucaaaguauucucagacaccuuuaauaucuuuauggaaacuuaauuuuuggccuuuuaucaauaugucauaacagcauucugaagucagacauuguuaaauugagcuauuaaacuaaugaguuuuauguaaguuauauggucuuaauuugguacuuguaaauagcacuaguuagacucuuuagaauacuccaagaguuagggcagcagaguggagcgauuuagaaagaacauuuuaaaacaaucaguuaauuuaccauguaaaauugcuguaaaugauaauguguacagauuuucuguucaaauauucaauuguaaacuucuuguuaagacuguuacguuucuauugcuuuuguaugggauauugcaaaaauaaaaaggaaagaacccucuuucacuga

SEQ ID NO: 17437 - RNA, 163888 nt, Homo sapiens
ggcucagcgcgcaggcgcggggccaggcgccucgcgcggccaggggcgggcggccgcagagcagcaccggccguggcuccgguagcagcaaguucgaaccccgcucccgcuccgcuucgguucucgcuccuucggcccuugggccuccaaacaccaguccccggcagcucguugcgcauugcgcucuccccgccaccaggaugccgguaaccgagaaggaucuagcugaggacgcgccuuggaagaagauccagcagaacacguucacacgcuggugcaacgagcaccucaagugcgugaacaaacgcaucggcaaccugcagaccgaccugagcgacgggcugcggcucaucgcgcugcucgaggugcucagccagaagcgcauguaccgcaaguaccaucagcggcccaccuuucgccagaugcagcucgagaauguguccguggcgcucgaguuccuggaccgugagagcaucaagcucguguccaucggugaguucucuggccgggcccaggcgcccacuguggugccgacccgcccccgcgcgugcaccccugcggagggcgaggauuucccgcagcgcgcccccaccucggagauaagggggagucguccccagggguggguuauagggggccuagacccccuccccggugucuuccccugggaugggaccuguugugaucgcuccccgccauccgccccagcagugcaccuuuggcuggcuaaggguugaggguuugggcuggggucacaggaggagagguggaguuguugcauuucucuacaccuggggcgccccuaugggagcuaggggacuagaaacccucguucgcuguccccgggggcgggcccuagggucagaugcuccgcggagugcucucccugcugcgcccagguuggugcucucagaggcagcugaaugggcguuggcucggaggccgggccgugagaccugaggaggaaccguucucugcgccuggggccucccugcccagguggagacagagaccugguaccuuccccugccgucgcuggaaugggugugggccccgagguugcaaggguaggcgcggguguguguccucgcucucucugcucccagcucagcucuggccgcgcgccgcagguugaacccacuccuugcugccgaaguuauaauuuagagaugguggugguaacaguaauugcugucuuguagggagcccaacuagcguccacuguguaccgucagccuucuaaguuaucuccgucccuacgcauccugccaucuggggugaggcuagacccauuuuacagauaaggggguccggaggguuaauugaccuguccaaggucagcaaguagggcccagcugagaacugaaggaagugggcaacaguuagaaggaggcuuuguuuuccucuccucucccaaaccuacaccagggucuuccugaaaggagggagggaauuggugucucuugcuggacugggccuucuggucuggggaggaagaauaaggaugaagucucccuuguggucugagauaguuggaggcuucccagagggccacaaggcuacugauagugugggcugugaugguaggggcugugaugugugugugcaugugggcguuugugcagagaacguguguacacacauagcauguguguauagcaugugcauaugcaaagaguuugcauguacacggaauguaugcagagaauguguauccaccuacacguguguauggguguguguauguguguguguguauguggguggguggguguggguuggggcagaggaggguucugggucuggaucucuuccuaaggagaaccagggacuggcccuggccugugauuugggucucuuccugaggaaaccaggucacuauagugacccuagugacaggaagaaagggagauggguguggcugccaggacuuucuccaguggaaaagggauucccucuaggcugagccuccccugggccuuagggccucacccuucccuucccccacaccuguccuggcagguaaggcugcuuccugcuuccugggcccagauggcagccgcaccacccagcugaucuccagcagcccucccccuccccaaggguggcuucccugcagaagaaucugcauggcacgcuguugucuucuuucugggguccaucuccuguacuggggagggagaaccucagaaucuccuggaauucuuuaccauucagaaaccagccuccccucugaagaaucccaaggcccagcugggcucaauuuggaucuguucuuuguuuuaaaaauguguauuuauuuaauuaacugaauaaagaaacuuaaaguaaaccagaaguauccaaauacgacaugaaaucucuaaaacaacaacaaaaccaaaccaaaccgcagcacuagcaaaucacagacugccugaucuacccacuguuuacagaggcagcagcuacuuccagcacugucucucaucagugcccggggcugugggucucauucuagauuuugucuacauuuuuuuacaugguucuccugauucccugcucccccuccccaccaccgccccgccuggagauggagccuugcucugucuccaggcuggaguacaauggugccaucucugcucacugcaaccuccaccucccggguucaagcgauucuucugccucagccuccugaguagcuagaauuacaggcacaugccaccacgcccggcuaauuuuuguauucuuaguagagaugggguuucaccauguuggccaggcuggucucgaacucuugaccucaugauaugcccgccucggccucccaagugcggggguuacagcccugagccaccgcgcccagcccgguccuccuuuuauuuucgaauccacucaggcccuagcuacucccauugucccgacguuccaggguuaguuagcuucccuuccucugugcugggccugugggcuguuggcagcuucuuccuguuccuaccacaacuugcauucuauuuuuuuccuuuuuaaugauuucuuggaucauauuccccagagugacauuccuggguuaaagggugugaccacauuuaugacuuguaucauuggcugccuaauugcucucccgagagaucuugcaacaaacagguuuuccagccucuggagaccacagagagcccuggcaagugccaggacugcuguggggauaaagcaggaggcuucuucccuaagcucuugaggcuguuguggguaaugguccuucauccuucaaggcaaaguuaccuccagcuuggacuaagguucauauauucacugcuuagguuguguuacauugugcugacaaugacacuagcuucaauuugggggcaccuacuggguguuaaguguguucuguugaucaccccauugaauuuucaugcuaaucauugauugacagcaacuacugcccuaucucuaaugaucugcuucugcaagucacuuagagaguucagggcuuaacacuguccugggcauguguugcuuagaaaauggcgccuguuaauuaaauaaggugcugucuaauaauuaucucaaaaguaaugccagggcuggaugccguggcucacgccuguaaucccagcacuuuaggaggccaagguggguggaucaccugaggucaggaguucgagaccagccuggacaacauggugaaacccuagcucuacuaaaaauacaaaaauuagcugggcaugguggugcacaccuguagucccagcuacucgggaggcugaggcaggagaauugcuugaacccgggagguggagguugcagugagccgaggucuuuguguaacugcacuccagccugggagagcgagacucugacucaaaaaaaaaaaaaaaaaaaaaagucaugcccgaaugguuugcacaccgaagggacguucaaaauuaggggagaacagccugguuguuuguuucuguuugguugaucauacucuugccaugguuaguauuauuaucuuuauuuaaagaugggaaacaggagugaagccacuuguggaggugacccagcuagcuaguaaauggugucugaaacccaggucugcccagcuguugaauuggagccuuaacugacuugccuuccaguuucagagaugaguaaaauacagcuuuucucuccacaucagagggucccugcaacacuagguuugcaagucuuagguguuagggugguggcuggauacccacacucugaaccucugaccuuggacaaaauagggaugucagggccuuccaugauuggcaggaugaauccucugggcugugaugaaggucucacaaguugagagucagccgggaauuaagugggaucaguuugccucuuguguuuuccucauuguguuuugguugguugguugagauuuccuacuacccaauggaugauguuuuauuccaucgucagggaagguaucauugaaugaauacaggguuuuguaugcuuuggauaagaccagacaguuguggagucauuagaauuguguacaugccuccagcucugagauaggugguguuucaacagcugccagaggacucuggcuuuucugccuagaauucacugaaagacaacccuggcuauugauucacauuugugguucauuguaagguaggccccuaggcgccauccaaaaguugaaaauuuccuuacguuucuuguuaugugaugggcaguucauagugaggacucagugucuuuaauuccagcuguuugccaggaguuggcaguuuuauuuacuuguuuuuccaaaaaccuuucugacauggggcaguccagccagcugggaggaaaaggggucucucagcccaagaaugaugaucaaggccuagaaguuugggugguguguuuuguuuugggccuuuagagaaaggaauuguuuccuuuucagaggauguggucuaacccuaaaguuuacuugacugacuuaaaccaggccagcgccagagcaggcagggugcguguucccaagacuucgggucacuaggcagcuuccaggguggugggucacugguccagucagcuccuuuuccuuccucucccuuuugugcuacuacuaccaaaauaauuuccaaauaaccuuaaguucugcucuuucuugcaugucuagcagaugccagcaugucuuuuggguaguacagagagugcuuaaaaaguagcaaaguuggccggacgugguggcucaugccuguaaucccagcacccugggaggccaagguggguggaucaccugaggucuggaguuugagaccagccugaccaacauggagaaaccccaucucuacuaaaaauacaaaauuagauggccgugguggugcaugccuguaaucccagcuacgugggaggcugaggcaggacaauagcuugaauccaagggcagaggcuguguugagcugagaucaugccauugcacuccagcuugggcaacaggagcaaaacuccaucucaaaaaaaaguagcaaaguagcaugcuuugucagaauuauuaauaacaaguugugggccauguacaagguggcacauuagcauucaaugucacuuguguaguaguuaagagcaaggauucuugguucaaaucccacuugccacuaaguagcuauuagaaacuucugugccuugguuuccuuaucacuaaaauggggauaauaacuaccuucuuaaaaggcuguuauaaagauuaaacaaguuaauaauuuuuaaagugcuuggcacaguuuaugguacauaguaagugcucugugaaugccuguuaauuaaauaaggcacuguuuaauaaucucaaaagucaugccggaaagguuugcacacugaaagggcauuugaaaucagcgcgcucuggggagaacagcuugguuggcuaagguugauccuacuugcuaaaauacggcuauggacugccuagagggugucaccuccuugaaaggggcugcccccugcuauguuauggcugccuccagggcccauucacaccagcuuuguuuccaagcuggacagggagcuccaggcgucuggucauuccagccucccaccccuuucaggaaucucugggccaaaucacuuccagauggugguugggccucuguggaguucucccagcaacggcggagccagcaugccagucggcagccgccuucguucuuggagagucugagcuaaaggagggcuuugauuuggagccaaauugugucucuuggguccugguuuugugcugugaggcagguaccauggagugggcugcuggcuuaguugaggauggcugcccugcuccuuaggggagcagauacccagggccuggagccuuuaggcccugccuccaguagcuccauggucagggugccagucaccuugcguuuucuuuuucuuuuuuuuugagauggagucuugcucugucgcccagguuggagugcaguggcgugaucucggcucacugcaaccucugucucccggggucaagcaauucuccugccucagccuccugaguagcugggauuacaggcgugcgccacuaugucuggcuaauuuuuguauuuuuaguagagaugggguuucaccuuguuggucaggcuggucucgaacucccaaccucgugauccaccugccucggccucccaaagugcugggauuacaggcgugagccaccggacccagccaacuuugcuacaucaguuuccagguagcauauccuaggcaaaacuggauguagccuagugauucagggccucggucugaagcuagacugucuggauucuaauccgcacucugccugauaccagcugugcaacucuaguccacugcuuuaaccuuucugugccugcuucccugucuauaaaaugcaagagcaaaauaguugcuaucuuagaguugcugggagcauuauauuugaugagguuaaguuauagcacaguguugucauuaucacuaugaauauugugcuuuuggacccaaguccaggacuuugucuugucuucugucuauucucuggccaguccagauauuuuuggaauccuauugcugucaucugguguguuagcuguucccuuucuccaaguucagaacgucugaugaagaugucucccaagauccuuucuuccuuuccucauucaacaaauauaugaaagcccaucucugaaccaggcccugugcugggugcuaggacaacaggaaugagaggaucauguccuuugcuugccucagauacugcucagaggagaagagacaagcaagcagggagagccaugcagaggagagcugcucaaaccuucaggcccaugcucaucaccuggggacuuuguuaaaaaugcaggucugauugaguaggugcugggguguaggcugggauucugcguuuccagucagcuucagauccugcugucugugcaccgugcuguaaguagcaaggaucuaggugccaagcccucugaaaaggaggagcaccugccccuaggcuggguauggguaaucuagaagguucccuggaggaagggaccuuucagcuaagaccuaaagcgugacuagaauuaggcaggcaaacagacauuuacacaggagcagacgagugugucaguuuagaggucuugaugcucaggucagaggggcaguggaggggugggcagggcugguuuaccaagggcuuucugaaacuggaggcugccuaugggguaugcuccuugaguuuguuuguuuguuuuuuuuuuugaguuggaguuucaaucuuguuuccuaggcuggagugcaguacaguggcaugaucucggcucacugcagccuccaucucccggguucaagagauucuccugccugagccucccaaguagcuggaauuauaggcaugugcacaccuggcuaauuuuguauuuuuaguagauaugguguuucaccauguuggucaggcuggccucgaacuccugaccucaggugauccacccaccuagccucccaaagugcugggauuacaggcgugagccacggcauccagccccuuguuuaguguaggguaguaaacccagccaaaaggggucguuuaucucaggggucucaccuguugcuccagucauuccuauuagcagaaaguuuuguaugugccccuuccucauauauauauauauuuauauauguauuuauauauauuuauaaguuauaaacauacucuacugucaauuuguauauuaaauauuaguaaaucuuaguuucuuuuuagaugacaaauccaaauauaaaaucuguuuuuuuccuggcucuaacggauuaucuuauguccccuugggguggacauaccucuuuuggaggcucccgugaagguuuguguuucuacauuuaguuuuuuucuuuuuuccauauucuuguuauucugcuuuuaauuuucaucuuugaguauucuaaauuaaggagcuggaucuguaauuguaacaccuucccccaacaauaaguuuaacuaaugaaaauauucaauggaaugagccauuuuaaucuaaauggggcuauuuccugcuuuuauaaugauuacaguugcuuuucaugacauucuacuagaagccaucuuacauuacuguuguaaaucuaguuauucauuaaacgggcacaguaaucccuaaauuggcucagguuauuguauaauaaacaacaauacuuucuucuucaggagcuugagaagugaucuuguauuuuuaaggugccuaacuaacuuuucaugggaaacugaguccauguacugggaagaaagcuuuuuggggaaaaugauuagaaaaccaaaugggucucuuuaugacugaagugaugaaccagcaggugagaguagguauagaugguacagaggacggaauuacuggguauuuuaaucaggcccacuuaguaucacaauuuauuauucuauucuauuuuuauuauuauuuuuugagauggaguuucgcucuugucauccaggcuggagugcaguggcgcuaucucagcucacugcaaccuccgccucccggguucaagagauucuccugccucagccucccaaguagcugggauuacaggcaugcgccaucacaccuggauaauuuuuuugcauuuuuaguagagaugagguuucuccauguuggucaggcuggucucgaacucccgaucucaggugauccgcccgcuuuggccucucaaagugcugggauugcaggugugagccaucgcgccuggccagugucaggauuuauucugugggaggggaggaggacaaagaaaaauacugagcuauguuugaagcuccugcccucuaagagccuuagagcagcugacuuaaauguguuccuuugauaaacuguagaugguuguuguaacucuucugcaaacuguuuauuuuuaaaaacaauuugaugagauuuuacuuaugcccauuguuugaguacagcauuuaccaaagaacaauuuuggccagaucccaugcaguagaaugcccuuggccaaaauuuucuuguacuauaagcaaagaagcaguuugguuuuucacuuaggcaagacugccuaucagacugaguuauugugacagagccgcugacucucucccuuuccccauuaucaaaaucuggcuuuucuaagcagcgcauguaaaaagcuuggcaaggaggacccuuguccuccuacauauuauucuuuggcucuucuugguaccaagaauacauacaaauaaugcuggcuguguacugaauguugaggugugcacuguugaggauauucauccucuaauauaacaucuaguauuucucacaccuuccgucugcugagcauuggucuaucuuacuuauacuacuucuaauccucgugaacucugcaaaacuaguggcuuuacaucuaugagaaaagaaaagaacuuuuaucggaagaaggugaguccuuuuaaaguaucaggccuggaaagacauuaaaugagacagcgaacacauccugcuacccucuuugagcuauguauucauugacuuuuuuuuuuuuuuuuuuuuuuuuuugaggcagaguuuugcuuugucaccaggcuggaguguaguggugcaaucuuggcucacugcaaccucugccuccgggguucaagugauucucaugccacagccuccugaguagcugggauuacaggcgccugccaccuugccuggcuaguuuugguauuuuuauuuuuauuuauuuauuuuaagacagggucucacucugucacccaggcuggaguacaguggcgcgaucuuggcucacugcaaccucugccucccggguuccagcgauucuccugccucaaccucuccaguagcugggauuacaggcgccuuggcaccacagccaguuaauuuuuuguauuuuuaguagaaacgggguuucagcauguuggccaggcuggucucgaacucccaaccucagguaauccgccugcuuuggccucccaaagugcugggauuacgagugugagccauugugccccgccuauguauucauuucuuaaaauugguugcuggcuagguguggugguacaugccuguccuauaaucacagcacuuuggaaggccggugcuggaggaucuauugaggccaggaguuuaagaccagccugggugagaucacaucucuacaaaaaaaaaaaaaaaaaaaaaaauuaucuggaugcaguggcacaagccuacauaguuguagcugcuugggaggcugaguugggaggauagcuugagcccaggaguuugagucugcagugagcuaugauugcgucacugcacucuagccugggcgacagagugagacccguuucuaaaacaaagaaauugcuauugucacaauuaguuauaaauuaaucuaauaaugcugcacgcaguaccauaauccacacccuauagcuuaacgauggauggccaaccacuaaucaaugcuauuucuguacgccaaugagaauuccugacaaaaaacuuuguaucagccccacucccugucuguccccucuuuugcuuuuaaaaaccugcuuguaacaaaggccaaacagagcucauauccaagguuacuugggccugagucuuucaggcagcugucuucacuuuggcucaaguaaacucuuuaauaguuuaaauuuuaagccucugccucuuucuuuuagguugacaucuguuuccauuuuacagaugagaaaacugaggcucagcucugccucacuuuacaggucaggcuuaaucccuaaucccugccugcaucaugcuguaaaggacuuuugugucaaaacugaguuucacacucuguaaaguaaaauagauauauuguagugagaggguguagaagagacuguuuucugcuucuguggauuuuuuuucuuccuguuuugcuuugcuccaaacuuuacucauuugcgcuugauucaugugaaacugaaauuuccuucuacagaacaaaacuuuuugggggcuacuuaccauaucuuuucccacaccguggagcucugacugggaccuuuuccaguuuuuggagacauugcuccaguucuuucccugccuuugguuuccagggggcaguaaugucaccgcagguguggacaguagggaccagcuaaagguugcuuuggaggaggugggcagggcuuuuguuugugaggucuagaaaccagaggugaggaaggaggugucccuggaacucccccuggcugcagggcucacagcacacaccaugacaccacagggguguguguguguguguguguguguguguguguguguguguguguguguugaggggaguguuguugagagccaacuaugccaggagauccuuggugacagcggacauaggcacagcuaugcucugucaggaaugaguucacccacacccuuuucuucugcuaccuuguuuaacuggugggagggugugcuggguuguguuugcuggugagcccagcaacugcacccuucuuuccaggccuagcacccagccuuuaucagucucauggcccuggcacaagugggcagccugcuuccaauccaagcaggcagcuuuccgcucaucugcagguagccucgugcuguggcagcacaaaguugugugagccagagcugaacuugugauccccacgggcaucuccugaggcgcaccucuccugagagagaaagcugguccguccagcccauucagggcucagccuccccagccgucgcagggcuggcuugcugaaaggucuggguguuaacacagcacuccuguucucucucucugaaggcccuuuaugcuggcaugaauuccuuuucucauagagaucugaaagcucuuuugacuaaaugggucaccuuucugaguauuuucauaaggcugucagccuuuaccaugccagacaaguuuucuggaauuuccuuuccagaaaaaaaaaaaaaaaaggcuacuaaagagguuggaguuauuuggaacacaggguggaauucuggcauucgaacuauagggaaacggguggggauuuguggcaggcacuauguaaauuugccgcaagcccauaaauucagacuuuaagaugaaagauggcaagcagcagucagcuuuccuucaacaggcaggaacggugcuaccuuccgccugugcugagugugacugagggagaggcaggccuccuagggaggccggggcaggaaagguuucuugguggcuaaaauaggauuucucaguuucccccgugucccaagaaaauaaguucuuaucaugcuuguaccacacuucuugugcguaucacccugguuucccugcaccuccuugaagugguuuaucagauuccagggacacaagaaugguuuggcaucuacagccuauugugggagcaggggcccggccuggugcuucuugcccaggaacaaacugauuguucccuuggugugggguaaagcaggccagaguaugggaccaggcccugccucccaggggaccugaggugcaaggucuuugagcugagacccuaaaaggccuuugugagucuguagugcuaucaguugagcagaguucaggguucuguuuacaagauucccucucagcagaggcagggagggguaccugcuggaagaccaggaaugugcugcugcugggaugggggcccucgguggagcuucuagccaucuggaggcagaacccagaauguguucugagugaggcgccuuggcagaguuggcuugaaagcaccuaggcaguggcuugucacauuccuuaucuccaccaaaggaggcaagcuagcaccugggggauggcucucccaucagggaguccuuuacaggaugugauccaggugucacauuacacuuccugcaggugugcaccucuuaccuaauugucucuccuaucccuuuuucucagcacuauugucugacauccauggggagucacacccaaaguugggcaugagguccucuccugggcacccaacaccuuguuuuuuuguuuuuguuuuuuuuggagauagagucuugcucugucacccaggcuagagugcaguggugccaucacagcucgcugcagccucgaccuccuuggcucaagcgauccucccaccucagccucccacguagucagaauuacaggcacacacaccaacacugcuggcuaauuuuguauuuuuuguagauucgguuugcuauguugcccaggcuggucuugaacuccugggcucaagcgaucugccugccucagccucccaaaguguggggauuacaggcaugagccaccucacuuggccacacugcccucuuacugagccguauugguguucuaaauggccuucuuacucucccacgggucaucagugcuccaggggcaggcgcugugucucuuguuuaccucuguggcucugaccuuggcacuuaauaggaauuuaauaaauaacuuguuaaauaaacagucucuaguauaauagcuugaguauuaagacugguacauugacuuauuugcaauucagaaaaugcaaaacagugguucuuugcugccuuuagugaagugggaauuauauguaguagacaacugggucuggggucccaguggaacacuucguuuuuggacugugaugcugaacuuaaagaacucagcaguucauguucauucucuggacaucugugauuugcuucaacaacuguuagagaacaaggccuuuuccaggugaagcucagaaaaugaauuuaauaggaaauuacugaaagucacaaucauaguaacaguuucauuaguuacagugaauauagagagagcccauacaaaguaccaggcauugugauaaacgcuucuuacuaauagcuauacaaaacaucauugcaauucugagaaguaguuauuguuguaauucccguuaugcagaugagaaaacugaggcacacccagauuggccagugagugugugguuauuacucagauucuugucugagauuuuaaucuucauauuuuacugcuuucccaaggaaagccaucagcucagcaagucuuugaaauuugcuucuuuuuuuuuuuuugagacagagucuugcugugucucccaggcuggaguacaguggcgcaaucuuggcucacugcaaccuccgccuccuggguucaagcgauucucuugccucagccucccgaguagcugggaauauaguugcaugccaccacaccuggcuauuuuguauuuuuaguagagacgggguuucaccauguuggccagccugguccugaacuccugaucucgagauccaccugccucggccuccuaaagugcugggaucaggcuugagccaccgaacucggccuuuuuuuuuuuuuuuuuugaaaugaugucuccuuuuguugcccaaacugcagucuuggcucacugcaacuucugccuccuggguucaagugauucuccugccucagccucccgaguagcugggacuacaggcacgugccaccaugcccagcuaauuuuuguauuuuuauagagacaggcuaagcuugucuugaacuccugaccucaagugauccaccuaccuggcccucccaaagugcugggauuacaggagugagccccugugcccagccugaaauucaauucuaauaaauuuuuauuggagcauuaaaaaguuacaucuguaguuguuacucuuugcaaaaaauugcaagaacacagaaaaauauaaagaaaaaaaucaccugugaagaauuuuaaugaaucuuuuucuacuuuuaggggauuuugcuuacagcugccuuuuaaucagaauagggaagaaagagauuccuuucucaggaaaaaagugacuguggacuggaaaugcuuugugaaauaauuuuggucauacugaugguuauaacaagauucgucuucaauugaguuauugcugagcuuuguccaacauuaaaaugaaaggucucauuugagucucauugugguuugcaagucucccuuggucuagaaauauguuuggucaaccacggcauggagguguuccagccacuuucugucucuuaaaaguuuuuaggaccuacuuuuauugggacugccagggucucuuaauaauaguuauuauacuugguaacuauugugaccuugucucauaggcagcccagcauagaaacucauuuagcuuuuaguugcucagcuccauuagcuguuuaaacauguuucagaugugagccugacaauguacuugggcagcuugguucacccuugacugccugggaacuuugagaagucugaaaauuauauguagcccuaaggucuucaugguauuguuuuuuuggaggcaccauuucccaauagcccugaggacaccaggcccaugaagccauccugucucagccaggaggcagaggagauggaauggaaaccacuucuggauacagauccagccacuuccggagugcuucagagcaugggucagauagaccuugcugcuuucuagcuggcagacuuggggaagguuguuugaccucucugaguuugugucccagacuauagcaguacccccuuacuggcguuaucgaagauaaaaugauauaauccugauaaaucacuugacccaguccuuggaggugguggugggggcugggguaagugccccaugaaugguggucaucaugcuccccaccaaccuccuuucucucuucuccuuucccgucuuucacaccccuaauuccuggaccuggggguggucucuccagacuagaugaagaagcaaucuaauuaucuaggaaggugaaaggugguugggaauacucccagaaauaggccaaagauaccgccuccuaccuaacagacucuuuuuagaagaagaggcaaccuggguuuuuggauaacuguugaguaggaaccaucaugaguggcauuucugcauuucuggucuucuggccaagccuccuuuuuuuuuuuuuuuuuuuuuuuuuuuaaccuugagacagucuugcuuuguugccaggcuggauugcaauggugcagucuuggcucacugcaaccuccaucucccagguucaagcgauucuccugccucagccuccugaguagcugguacuacaggugccgccacuaugcccagcuaauuuuuguauuuuuaguagggacgggguuucaucauauuggccaggauggucucaaucucuugaccucauacucugcccgccucggccucccaaagugccagaauuacaagcgugagccacugagcccagccuuccuuuuuuuuuuuuuuuuuuaaguagcuccauugcccucccucacccuuucuuuugucuccuguaauguccuucccuuccauuucuuuuuuuucuuuuuucuuuucuucuuucuuucuuucuuuuuuuuuuuuuugagauaggaucucauucuguggcaaaggcuggaguguaguggcacauucacggcucauugcagccucgaccuccaggacucaggugauccucacaucucagccucccgaguagcugggaccacaggcacacaccaccacacccggcuaauuuuugcauuuuuuguagagguaguguuuugccauguuucccaggcuggucuugagcuccugggcucaagugauacucccuccucagccucccaaauugcugagauuacaggcauaagccucugcaccuggccuucccucucauuuuuuuuucuuuccugguuuugccugucccagaccacccucuuggaaagaugcucucccagcagcggcaguaagguccuggucuuguguuugcuccugggccugagucuuggcuuugcugcuuuguagcuagcuggcugacaccagggagcugcuucccuccaggagccugucguccauaugcugaaugugauccuuaaaugcucugucuuacaggggccagacauuguggcucaugcacuucagggggcugaggcgugcagaucacuugaggccaggaguuugagaccagccuggccaacauggcgaaacccugucucuacuaaaaauacaaaaauuagccggaggugguagugugugccuuuaauuccagcuacuuggaaggcugaggcaggaaaaucgcuagaaccugggaggcggagguugcagugagccgagaucaugccacugcacuccagccugaucaacagagcgagauugucucaaacaaacaaacaaaaaauguucugccuuacagaguucuuagguauaaaagagaaggugccucuaaagcucuuggcaccgugccuggcuuauaguaagugcuugguaaacgucagcugcugcuguugugguguuaguaucagcauuguugcugugagacccugcacuucccacuuagccuuggaaaaauaagucuucacguuaaugccaugggcuaccgcuucucuuuucagggcuucuuggaggaggguggagauggagagacaggugggggacugccaggguuacauccuccaugaggcugaggcugugcugacugccuugugugcuuucaaccuggaguaaaggguggcugugccagcugcucccaucccccaggagucugacucgucccugccuuggcccugggcagcacuuucccuccuagcucuuuggcaucuggggucaugguggggcugccugccaucugucaaaauuuuugcugcccuggguguggugguaaacccccgcacuauccaacuuggugucauggagcuggcgacaauauuuuuacagugguuagugcuuggaaacuggacuucuggguuaugcccuguacaaacagcaucaaagucgcugggcuagggugacagaggaggcugccaacagggaauucuguggcuccugggacaggaauggauaugggagguugggggccaguauuuucgguucucuugaggaguuggcgaguauuagucuuugcccugauggauagaaggaaucugucugugucuugcaugaaccguguacuucccccaguuacuccuuggacaccagcugccugcuguucauaauugggccagauuucuaauacugcagcgcuaccaaaugucaguuuuaggccaucucugguguagccagggaacgcccaacaccuuucccaaagguagaauuuguguggguuuuacuucacugagugacuaaugcagaucuuuauguuuuaaugaugggaagaaauucgucagccuggguacuuuuuccaugugauggggcaaaaauuuaaaacacuugcacaacggcuuuuguuucuccagcuacuaaaggugacugucauuuaggcauuaucaguaugaucagcugauguuaacccacuccccuucuggagacccguuucuguuucugggaaagguguaggacaugcuggauuuggcaagauugcaggucccaggcagauguccggacuuagacucuggcucuuuuuuuuuuuuccagacagggucucccucugucacccagucuggagugcaguggcgcgaucucggcucaccacaaccuccgccucccagguucaagggauucuccugccucagcccccugaguagcugggauuacaggcgugcaccacuaugcccagcuaauucuuuuuuuuuuuuugagauagaggcucacugucacccagguuggagugcgguggcccgguccgccugccucagccucccaaaguguuaggauuacaggugugagccaccgugccuggccucagcuaacuuuuguauuuuuaguaucaacgagguuucaccauguuggccaggcuggcuuugaauuccuggccucaauugaucugcccaccucggccucccaaagugcugggauuacaggcaugagccaccgcgccuggcccagacccuggcucuuacuccuaggucuaccucuaccaucacuggggcccucgccugaaccuuuugccccaucuauaaaaugggagaacuagacuaggucugugucccccaagcuucaaucauuuguaaaggaaccaccuuuacuauuuugccauaucccacggcugucucuauuucauuuuucacuuaauauuauuuuccccugcaguugacucacuuguaaaacaaauguauuugaaaaggagacuuugugucacuauaauaacggaaaaacagcgucacuagguaaauggaagguaaccauaaauaaaccccaaacaguuauuaaauuccagccagcacuguugccuguucacaacaugaggcauacucucuuuugguuaaaaagggaaauuagcaagagauggagagguguugaagguaaccuagcacuacauugagccuuuuccuugaccugcucaggaggauugagaaagaacuaggagaacugggaagagaauaacgucuuuuugugaugcaaagugccugagugugaccaagagcucagaguaguaauguauagaugcuuuguuuggauacuuaugcagccauuaccaugugccagggguguagaggggcuaggaguauagaggggauugggacuuguucacugacuucugguugcuuguggucuaguaguggggagguggucauagaauauugaauacaaacgaagaucgaacaggcugcagggguuuaauaggaaaaucacaggacuaaauucugucauguguacauggggucuacaaauaagaguuguuuagaauuuuuuuuaauuuaaauuucccaugaaauauaaaucuauuucauuccagaaugauucuagagaagcucuaaauacauuaaaguuguguuggcugggugcaguggcucaugccuguaaucccagcacuuugggaggcugaggcuggagaaucacuuguggccaggaguuugagaccagccugggcaacaugggagaccuuaucucuaccaaaaaaaauuuuuuuuucuuuucuuuuuuuuuuuuuugagacaaaguuucgcucuuguugcccaggcuagagugcaauggcaugaucucagcucacugcaaccuccgccucccugguucaagcaauucuccugccucagccucccaaguagcugggauuacaggcauguaccaccacacccagcuaauuuuguauuuuuuuuaguggaggugggauuucaccaugucgaucaggcuggucuugaacuccugaccucaggugauccacccaucucagucucacaaaguguugggauuacaggcgauagccacugcaccuggccaaaaacauuuuaauaaauuagcuggguauggugguaugugccuguaauccuagcuacuugggaggcuggggcaggaggaucccuugagcccaggaauuccaagcugcagugaacuauaaucaggucacugcacugaagccggagugacagagugagaccuugucucuuaaaauaaauuugugucauuguuuguuguuuuuaugguguuaugacaaugauccaucuuaacccuuuauguagugguaacuaacuuucucuuuuccuaaaagcugauuugaguuuuagguucucuuggagucugugacaauuguaaauagauaagauauaacaaaauggccugaaauacucuugcaacacucauauuuccccccucagauuagcauguucuauacucucugcaaagcaagauauacaccagaauuaggccucuaaaaagccucauacugcuaaucucugggaaugaaugguguucuuugggauaaugggauaugaagcucagucugauuuuucuguucugcugguagcuuagggcccccuuucuucuguuggguuuuuugggagaagggaaguugugauuaagaaugagaauucuuuuuuuuuuuuuuugucucaagagucuugcucugucgcccaggcuggagugcaauggcucgaucucggcucacugcagucuucaccuccuggugucaagcgauucuccugccuuagccuccaaguagcugggaauacaggcaccugccaccaugccuggcuaauuuuuuguauuuuuaguaaagaugggguuucaccauguuggccaggcuggucucgaacuacugaccccaugaucccaacccccccgaccuccccggccucccaaagugcugggauuauaggggggagccacugcguccagccaagaaugagaauuugggagucaggcaccucugggauugaaucuggaauugacugaguguacaugcuuucucugaggccuccguccucacugcucucaucuauaaacugggaauaaucauaguuucuaucugaaacagugggugugaagauuuaacgagcuaaauuguaaagugccugagacaugggaagaagucaggaugugcuaauggguaaucuuacacuuccccaauggaaagggccagguuuauauuacucuaggcugguaguaagcgaggcaaaggagauaucagguuucagcuuuguuagaacaugcuaauggcaccaggacacucagaagagauacagaguuugagacaaauggcaccaugagcccugagacauuguguauggggugaaucggauagcaagaauagacuucaaggagggaaguagggcaguuagaauccuuucagcugcaaggaacugaaaacuggcucacauagaaggaaaaugauuggcucaugucagcaagccuagaugcagagcaaguuauggguuucagggauccagcaucuaaaugaugucaucaagaacccaaguuuuuugggucucugcucuguugguuucuuucauccuaaagcugguucuccugugguuuaccauaguagaguuccugugagaacuccacucugaccaaucaggccuucccagagccagggauggauggagucgcuucuuuugaggcccauggguccuaucuggaggggauggauccagacuccuaucaggaaucuaggaggggccgggcacgguggcucaugccuguaaucccagcacuucauaaugccaagguggacagaucacuugaggccaggaguuccagaucagccuggccaguauggugaaaccccaucucuacuaaaaauacaaaaauuagcuaggcgugguagcaggcgccuguugucccagcuacucggguggcugaggugggaggaucacuugagccugggcacagagguugcggugagguuguggugagcugugguugcgcugcugcccuccagccugggcaacagagugagacccugucucaaaaacaacaacaacaaaaucuuauguaccccauaaauauauacaccuacuguguauccacaaaaguuaaaaauuagaaaaggcaaauugcagagauuuccauaugcuaugauaccguuuauaugaaguuuuacauaugucauaaaaauacagauaaccuuuaggggaaugaucauuaccaaacuuuuggauaacgguuucuggggaugggcagagagggcuauacagucaugaagagguguauaggggcuuucaacucuuuguaguguuuuauuucuucagucccauggugguuauaugauucuucacuccccuuuuuuuguguggaauauuuuucuuauaaaaagugugucuuuuauuuauuuauuuaucuuuuucacauggagucucacucugucgcccaggcuggagugcaguguugcgaucucggcucacugcaagcuccgccucccggguucgcgccauucuccugccucagccucccgaguagcugggacuacaggcgcccgccaccacgccuggcuaauuuuuuguauuuuuagcagagacgggguuucacuguguuagccaggauggucucaaucugcugaccuugugaucugccugccucggccucccaaagugcuaggggauuacagacgugagccaccgugcccugccuuuuuuuuuuuuuuuuuuuuuuuuuaaaggcagagucuugcccuguuggccaggcugcagugcaguggccugauaauggcucacugcagcuuccaccucccaggcucaagcaauccucccaccucagccuccugaguagcugggacuacagguaugugccaccaagccuggcuaauuuuuccauuuuuaaagguuuugccauguugcccaggcuggucucgaaccccuggguucaagccauccucccaccuuggccucccaaauugcugggacuauagacgugaaccacugcacccccauccaaaagugucauuuuaaugcugacauacugcauuacuaagcuugaccaggggaagagaaaaaaaaauaccuuguguuuauuauuuuguuuguuuguuuguuugagacagggucuugcucuuucucccaggcuagagugcaguggcaugaacauggcucacugcagccuccacuucccagggucaagccauccucccacuucagccucccaaguagcugggauuacaggugugugccaccacaccugacuaauuuuucuuuuuuucuuuuuuuguauuuuugguagagacaggguugcccaggcuggucuugaacuccugagcucaagcaauccucucuucagccucccaaagugcugggauuacaaguaugagccacugugcccggccuguuuguuuguuuuaaagacaaguuugggcccaguuuauaagaaaagaaaacagaccauccuuagggugucaggaugauauuuugacaaaggcauucaugcuuagcaggauuucucucccccuacccccaccccaaguguugaaacggcugagcuaauuaccuuagaauguaaggcuuccucuguugcuugugaacguggcagacuugggauucucagagacagagggcuucagaagcuugccucugggagcguccagucaauagcuuuuugucugagcagaaggagauauugcucaagguaccaucucaagggacugcugaaucaguugcauugucucuaaaaguagguaaaagucuagaguagggcugguucaacaguggaaugaguguuaagagagaguugcauucuaagaacaccuuuacacuguggccaaauucaagcagguccauuuugugguuuggugguccccaucuagugggauguggucugguaucccaggcaccugcauauaugagcucagauggguuuaauuuuugaaaaacugcuuuauuggcugggugugguagcucaugccuguaaucccaacauuuugggaggccaaggcaggaggaucucuugagccugggaauucaggaccagccugggcaacauugagagauccccaucucuacucccuuccccgccaaaaaaaagcuagguguagugacaugcaccuguggucccagcuacucaggaggcugaggugggaggauugcuugagcccgggaagucaagacugcagugagcugagauugcaugacugcacuccagccugggcaaaagagugagacauugucucaaucuccccaccccugccaagaaaacccaaaaaauauugagguauaauuguuauacaaugaagaacacauuuugauuagcuuauacacacacuccuguguacacauguacacucacacaucaggaaaccaucaccauaaucaagacagcgaaccucccuauccagccccagaaguuuccuugugccucuuuguaauucuugccuuuuaucucuccaugucuuccacacccaugcucaagcauucacugaucugcuuucugucauuaucagucaguuuucaucuuuuagccuuuuauauaaauggaaucauauaguaugcuguuuuguuuuuuuuugagacaagagucucacucuguuacccaggcuggagugcaguggugcgaccucggcucacuacaaccuccaucuccccagauuuaagugauucuccugcccuagcuucccgaguagcagggauuacaggcacaugcuaucaugccuagcuaauuuuuguauuuuuaguaaagauggggauucaccauguuggccaggcuggucccgaacuccugaccucaggugaucacccgccuuggccucccaaagugcuaggaucacaggcaugagccacuacgcccugccaguauguacucuuuuugucuggcuucuucuagcauaguuauucugaaauucauccuuguugcaugugucaauaguccuauuccuuuuuauugcugaguaguaguccauuguauggauauacuacauuuuguuuauacauccuucuguugauaacauuugggugguuucuuauuuauuuauuuauuuuugagacggagucucacucuguugaacaggcuggagugcaguggugugaucuuggcucacugcaaccuccaccucccggguucaagcaauucuccugccucagccuucugaguagcugggauuacaggcauuugccaccacaccuggcuaauuuuuguauuuuuaguagagacgggguuucaccauguuggucaugcuggucucgaacuccugaccuuaggcgauccgcucaccucugccucccaaagugcagggauuauaggugugagccaccacgccuggccgggugguuucuaaauaaagcuaucaugaacaucuuuuacuacucuuuguauggauguauauuucuauuuuucugaguggaauguuaggaucauacaucauagguguacguuuaacuguucaagaaacugccaaacuguuucccaaagugguuguauuguuuuacauuuccacgagcaguguuugagagcuccaguucuugcacauccuagccacaaaaagguucuguuuuuuaaagacaauuuuuuuuuuuuuuugagaguuucgcccuagucgcccaggcuggagugcagugguaagcgaaucccugcuacaggccagagacuguucucaguugguuuuuacaccaaguaucgcacuucauucuaacacuccaccauuuuacaaaugaggaaaccgaggcacugagagguuuaguaacuuguggcacagccaggaagcaguagagaaagacuuugaauauaaauguauccauuaggauguauaugguuccaagucaugggaaaccuaccuaauccugguuuauccaaaaagggagcucauuggcucucguaacugaaaagucaagggguaggcaggcaguuggaccuggaagucuccagggcaucagagagccuuggcucugcuucucugauucuguugucucuccacagacggguggguguagcagucccaggcccgcagccacaccccacaccucccagaggaagaaggcgggcccugaucccagcagucccaggaaagcccugagguucacugugauuggaccagccuaugucaccugcucacaucucagcccaccacuggcaaggguguuugacucuugggaaugacucuugggacuggcuuguccuagaucacauguucuaccugaaauuggggacauugcagaggauugguggaguggaccucaaggagguguuucacguggcuuccugugucacuagguugccauuuauucuuuagaaagccccuuuguuugaugaaacccuggugucacaggcugugugacuuaggguaauccccuuguccacaucugugaagugagauuaccucuucaccucacaggcagaucaaacaggaaaacaaaaacaaaaccaaacccaaaauacacguaaauugcagagugcuugagguuucuuuuaagcugucuauguaauuaaaagcuguuacuuagacuuggauaugaaauaaaaucugacuucaaauuuaagugguguaauuuccaugccucuuaaaauaucagguaacuucauuugugagccucagucuguagacuugagggauuuccaucugaagagggggcagaauggugguuuagggaacgcaacauguaccccacccccaacuuuuuuaagaggaagaguugaaagaaauaaugaaugugugagaaauaagggguuugauugccuuccaggguccauguugaaggagaggaaaauguagcucaaccacagugacucuccccaauuaaaaacuaaaaaaagauccgugguuauagggcuuggacuucggacaagccagcagccucagucauugugagugugauuccagauuggaagguucugcuaggaggaaaguggaaguuuugagaauuccuaguuggacagaaugccucuugaucacggccuuagcuaaaggagaccacucuuugcuggauggaucagucagcuacgugugaaguuuggcucaguacaacauucucggccuggggcggcagcaugggaaagauuuuuauuggaauuaacuuucuacagagauguacuuucaaaugagaccauccuucucucacuggugagcucacccgggcucuuauuccacaaagcuuaauuguuuuggacccauacauuuaaacuccuuaauuaauugacucaagacuuaggacagauuugcuuuucuuuauaaugacuccauggcuguaaaugcugcugauucagaugaaagaggacccuagagcacagaaugagaaggacguggacucaggauaccuguuucuuuauucugacugugcucuucgucagcucuggggcuuuggaccccaguuuuguaaccaccuaacgaguucaccuugccugcugccuagacggagcugauuuaucaagacagaggaauugcaauggagaaagaguaagucacccagagccagcugugugggaggcuagaauuuuauuguuacugaaaucagucucccgagcauuugggaucagaguuuuuaaagauaauucggcagguaggggcucaggaaguggggagugcugauuggucaaguuggagauggagucacagggggucgaagugacguuuucuugcugucuucuguuccugggugggauggcagaacugguugagccagauuaccgcucugggaggugucagcugauccauggagugcagggucugcaaacuaucucaagcacugauguuaaguuuuacaguagugauguuaucuccagaagcaauuuguggagguucagacucuugcaguuucugaccccuaaaccuuaauuucuaaucuuguagcuaauuuguuaguccuacaaaggcagacugcucccaaggcaagaagagggucuuuuugggaaagggcuauuagcaguuuuuuuucagagugaaaccauaaacuaaauucauucccaagguuaguuuggccuaugcccaggaaugaacaaggacagccuaaagguuagaagcaagauggagucgguuaggucugaccucuuucacugucuauaauuuuugcaaaggcaguuucaguuucucaccuguaaacguugaagacugagccagaaucagggucaucaaauagcaccccggcuauacuuucuucucuucaugacaaacauugcuggucaguugauaugauguucuuucccacugggcccagacuugacauuagagucuuuuuuuuuuuuuuuuuuuuuuuuuugagacagucucgcucuaucacccuggcuggagugcaguggcaccaucucagcucacugcaaccuccgucuccagaguucaagcaauucuccugccucagccucucagguagcugggauuacaggagugcaccaccacacccagcagauuuuuguauuuuuaguagagacgggguuucgccauguuggccaggcuugucuggaacuccugaccucaggccauccgcucgcuuuggccucccaaagugcuaggauuauaggcguaagccaccacgccuggccgacaucagagucauuuuagccugcaaugcaaguuguccucagugggcugcuagcauuggcuucaaccuucauaucagccagcuaaagccccuuguaaugaauggggagguuccuucacccuugccucccgcugccuccucuugaccacucauuuuuuuucuuguaguucaggaaccaauucagaugauuucccucgugaaguccucucgaaagcccccagguagaauuauucauuuuuucccuugcauucccacagcacugugcacacaaauuagaauccuuguaaaauggccaugauucuguuuaugacccuggcccuccaccagaccagccucucugcccucuggcuuuuuuagaucacuggcaugguuucugccuacuccaggugccaguauuauuuugugaauguuuuuuuucuucauaucuacucaucuuuauacuacuuuacucguaaaaggaaacuagagaacaugaucuuaaaugaaaaccacgaucacuugccagaaagaacagguaacuaggcuuugaaaaaauaaguuagaggagauagcauaagaaaaaauuaaaaaauaaauaaaaucaaugaaaacaacguguuacuaaauucuugaaaaguuuuuugaagacuuugagccugaggccuguucuuauuguuuguuuguuuguuuguuuguuuguuuuuaugacagaguuucgcucuuguugcccaggcuagagugcaauggcaugaucucggcucauugcagcauuugccuccuguguucaagcgauucuccugccucagccucccgaguagcugggauuacaggugcccgccaccaugcccagcuaauuuuuguauuuuaguagagauggguuuuugccauguuggccaggcuggucucgaacuccugaccucaggugauccaccugccuuggccucccaaaguguggggauuacaggcgugagccaccaugcucggccuguucuuauuguuaaaaagagagauuugugugaaagcugcugacgucuuuuuggcaccaagucaagacugaguuaguucuugucagaaucugauuguuugugaauugauggcuuuuuuuuuuuuccugaguugggggucucgcucuguugcccaggcuggaguacgaccacuauaaccucaaauugcugggcucaagcaauccuuccgccucagcugcccaaguagcugggacuacuaggcaugcuccaccaugcccaguuaauuaauuuuuuuuuuuuuuugagagacagggucucacuauguuccccaggcuggucucaaauuccuggccucaagugaucuccugccucagccucccaaagcucugggauuacaggagcgagccacugugccuggccggauuuuaaaguucugcccaugcaccuccuuagcucuggcaguuacuacuugcaggcaucuccuuugucugcccugccccuuguuaggaaaggcugugcugacugucagcuggcacccagugcauagaagagauaguucucuguagaugauguugaacaaugugguacuauaaucccaaccuguuguaucuuuguuuacucucaaaagcaacaauugggcugggcaugguggcucaugccuguaaucgcagcacuuugggaggcuaaggugggaggguugcuugaaguuaguuccuuuuuuuuuuuuuuuuuaaaaaaaagacaagaucucgcucugucaccccggcuggaaugcaguggcaugaucauagcucacugcagccuugaccacgugggcucaaggaaugaaccauugugccaggaguucaacaccagccuggauaacauagcgagacccugucucuacaggaaaaaaaaaaaaaaagaagaauugcauaaguaucaucagaacuguugaauggaaaaucagacuuuguggguuugguuuguuaauuacuucucguuggauuagaauuugauagguaaaaaaaaaaaaaaagguguagaaaagugauuccagucuugagcaaauuuuuaauggaaaacggugucuugguucucuguucacuacaacuuguaucuaagggaaagccuagugaugcagacauuucauuucgugaugggaaaacugaugcccagagguucacagcugaccaggggcuagucugacuggggggaucuaggucaccaccccccuugccuuguuuucccagcuagugcauuuccuacuagacuugacucuacuguaauucaaguugcugaguagcaaacaagaacuacaaugacuagaaggaacagaacuagcuuuuuugugcucugaaaguggaaacuuauugaggguucuuuuccucccagagaaugcagaagugcccugauuugcuuuuggaaggacaccauucacuuuauugccucuuuucauuguugcccagaauaucaccaugauuuauucaugggugguggggaggguagcacuaguguaugcucccagcaaagaggaacaucucacguugugaagagaugcgcaaaacuaagccagggcagggugugguggcucaugccuguaaucccagcacuuugggaagcugaggugggcagaucaccugaggucaagaguugaagaccacccuggccaacauggugaaacucugucuguacuaaaaauacaaaaauuagcugggucugauugcaggugccucuaauugcagcuacuugggaggcugaggcaggagaauuucuugaaccugggaggcagagguugcagugagcugagacugugccguuguacucuagccugggcaacaagagccaucucaaaaaaagaagcaagccagaucuuuggggugcugugacggcaaaucccccagcgcuggccucucagguucucuugcgggauuaguguuuguugaauaauaagcaauacacccugacccagcgagccaaagcaaacaggacaguaacugaaacugcaggggagugugaguaaacaguuaccuucuacccucauggagcuggccucuggccagcaacaugauagcuguuugcaucuuacucuuauggagccauuggcccucucauuaaggugggggcagcuucugguccaugccugcaaguccucaugggaguggguaccugacaggguguaaaggguaggucugaggacaugguuucuuuuuuuuauuguuguugagauggaauccugcucuugucacacagucuggagugcaguggccugaucucggcucacugcaaccuccgucucacugguucaagcgauucuccugccuaagccuccugaguagcugggacuauaggcgcauccugccaugccuggcuaaguuuuguauuuuuaguagagacgggguuucaccacguuggccaggcuggucucgaacuccugaccucaggugauccacccaccucagccucccaaagugcugggauuacaggcgugagccaccguccccagccaacaugguuucuuuaaaauauacuccccgcuccaucccauucaugugugggaguugagcugcaucuggguuuuucuuuucucuuuuucuguaaaucuuuauuguauuuuuuuuggaucauagaauggauacauguuucuuaaaguuugaucauuauagaaacuuaauuagacuauuauuugagugcuaaccauagugagugagugcuuacugugugcuagguggcuuuuuaugccucaugucacuuacaugaggucugaggaacgguguuaaucccguuuugcagcugaggaaacugaggcuacauuuacggucaccuagcuggcaagcaaguggcugagccuggagcagcagcagaucuggggaacuccacaaaccagauuucugugugguaucccuguggacacaaggauuuaacuugauucuuuuugcuuucaguaucacuuuaugauauuacaaugagcuugcaguauuuauuuucagaagaaaagccagauuauucccauuuaugagagaagcagccaggugggcagggauuuccagcgcugaaccagccagugugugcauugucucuucccgcugagcggcccuggugugcuggguuagucugugagccacaggaaauguugucagggccucugggcuuuuggaugucagcaggccuucaguggugaggagguuguggcuggacucagaggacuccuugcuuuugcugaacgacccuccccaccaaccaccaccaccaccaccagugggacuagcccaugagcuguaagccaaccuuuuccuuccuaacuuaauuuuccaaagaauaguaacuuacccaccaccacugcagucacugggccgggaagacaagcacucuugccuugaauccaugccuugagccaguagccuugacccaggguaaagcaguuaugugcuugggucaccugggucauguuuuugaaauugccucaagccuaccuuacaaauccuuccuggaacccugcuuggcuuuucuuugugggcuucccuuaggagggaagcuucccgagcagcuugucuugacuguagccagcuggguggucccagccacagaauuuaacugucaaacagcaccagaaggguuccucauccagcugucuugccccaagugcccucuuugcuuucuuuuuagagaguucugagacucauuagagaguuuagagauuuuagcauucuugaaguucuuucuguggucaguuuggugaaccacuucauuucuaaaguuucucaguugaccccauucuuccccagcuuugcauucuccaugaagccaccuguguuugguguguauggguuuucugcaaccuagguugaacaaguccucuagaauccugaacaauuggugauucaugcuggccugguuuuucuaauuggccuggaaauguggcuguaguggacacaaguggacuuggccuccucuuugaugcggguaaacuuuagauuugcauuagcucuguuugauuagaggaucuuacugguuuuuguuguuauuuauuuaccuuuuaggagcuuuagucucuguagguuuuuuuuuuuuuuuuuuuaaaguccgggucuuacucugucacccaggcuagggugcaguggcaugaucacagcucacugcagcccccaccuuccugggcucaggugauccugccaccuuaguuuccugaguagcugggacuacaggcaugugccaccaugcccagcaaauuuauuucuacuuuuugaaaacagggucucacuuugucacccaggccagaaugcaguagcacgaucauggcucacugcagucucaaccucccaggcuuaagggauucucccaccucagccucccaaguagcugggaggcuacuuggcaugcaucacaaggcccagcuaauuuguguuuuuucuuguagaggcgggguuuugccauguugcccaggcuggucucgaacuccuggggucaaguuauacucucuccuuugccuccagccaugagccguucguugcgccugggcuagucauuauagauuuaucccuucuuucaucucaugcuacaaaagcaguucuuguauuuuuacccgacuugugauuuucuacugggaauguuuguuugugaugguuagcagggugcugagagggaauuaaucccaggaggcccaauauugggccaugucgugcuguugagcacagucauuugacaccuauaacuucucaucaauucuucugauagacugaggaggaauugggaaauuuccuagaguuuugucugcauuauuggguuguuuugagaacauaaaccuuaaacucuagcuauguaaacuggauaagucauuuugguaauuuggcauuccuuuuuuuuuuuuuuuuuuuuuuugagacagaguuucacucuguugcccgggggaaugaucucugcucacugcaaccucugccucccagguucaagcaauucuucugccucagccucccaaguaguugggacuacaggcacacuccaccguguccggcuaauuuuuguauuuuuaauagagacaggauuucaucauguugaccaggcugguaauuuggcauucuuuugaguacaagugagagaaacucacuugagcuggcuuaagugaaaaaauucuuugucaggagaguuuugugaauuucuguuuaguggcaaguuguagaaaccacuugaaacugcuuaaaggcaaaagagggagccacuugucccaguaacugagacaucccagagccgacugcccccaagcauuacuuggucccaaguuucaaacgggucuucaggguuugaucucucuccucaucuccagucugcuucauucauuuuggcucuaugugguggcagaagggcuucuggcaucucuggaccuuuaugccucccagguccaaacccagccagaaaggagagugagagugcugagugcaaaacucuccuauagcuccuauacaaguccaggauuugcuauuagacuccuugaauuaugugcccagcucugagccaauggcugugcuuaggaggcuccugucucaugcacccaccccaguacugggcaucagaaacaaccagugaucccuauaaugaaccacggguucacagacuuaaguguaauccugcagcagggccucaggaagacuugaaacccaaaaucagaaagccaugguuucuugucuuccuggugucuguuuugucccuucccucuguagaggaguccugcuaucacugcaggcaacggggcugcccugcagcuccugcuguuuacauuucacucgguguagccauaggcagagaccucagggagaaccugauucggcuuggauugagucagguuccaccccaguccagucaguuguggacugagaggugaugaggcugggcccuuuaagacaaaucuggguggguggagucugugcuuaaugaaguugugauguuagcugauggcccagaagggacugguaggugccucucauugucugguugggaagcauucucuuaaguccaagaugaugauaaauaguauuaggccaggugccgugucaugccucuauacccagcacuuugagaggccaaggugggaggaucgcuugagcccagaaguucaaagccagagugggcaacauaaagagacccugucucuacaaaaaacaaacaaacaaacaaaccaaaaaaaccccacaacaauuagccaggcaugauggcgcacaccaguagucccagcuacucaggaggcugaggugggaggauugcuugagccuggcgggucgagguugcagcaagcugugaucacaccucugcgcuccagccugggugacagagugagacccugucucaaaaaguaaaaaauucaaauaaauaaacaaauaauaucaagggccucucucccaagcuaggaagauaucagcugaagcucuagcccagcuacguggauggcugcuuccugccuggaagcgaugcccagaucagcaccuugggaccccccugaacuugccucugcuccagugugggcccuuccuuccugcagaggagacagcacugucugagaggcaugaaugagaauuuccuccuucuaggcccaagucagcaugacucgaggauggcuuugacuggaaaaacugaaucaaagagugugcuacagccaaggauuuccccaaacacuaaucagugcugauuacuuccaggguauugccuuuggcucuguggaguuuuguccacuguggcugcaaugucuggcuucugcugcccagaagaugagaaaugaguuuguagggaugagccugggugaagggaugugcccccucaccauccugaccucuauuagguguaaaagacccugauugccaaauucauaggucauggguuggcucugccuccagcauuaacacuuggggguggaguuggggaaucauaguauuacuugcauaaauggaauccuaaaaguuuguugggacaguuucauaaaaauccucaccaugaucaguuugaaaaugacguucccuucacauguuugucuucugaacugaguugcaaugcugaguaugaguuugagagucccaagaccaucuaaagcaagccuguccaacccacagacugcaggcuguaggcagcccaggacagcucugaaugcgccccaacacaaauucguaaacuuucuuaaaacauuaugagauccuuucgcauuuguuuuuuaaagcucaucagcuaucauuaguguuaguguaucuuauguggccaagacaauucuucuucuuccaguguggcccagggaagccaagagauuggacacccccgauuuaaaggaaguaacucaauuuugugaaccugaaacuugaucuuggaugaaccaaaugaaauuuuaugauucucuuaagcucacgaaaguucaauaacugugcuguguaaaauagagguaaaagacuugaguuggaccaggaaugguugcucaugccuguaaucccagcacucugggaggcugaggcgggugcaucacuugaagucaggaguucaagaccagcccggccaacauggugaaacccuguuucuacuaaaaauauaaaaauuagccgggcgugguaguguacgccuguagucuuagcuucuugggaggcugaggcaggauaaucccuugaacccaggagguggagguugcagugagcaagaucauaccacugcacuacagccugggcuacagagcgagacuccgucuccaaaaaaaaaaaaaaaaaaaaaaaaagacuugaguugguucuaauagaauaccuuggagaaccucaagaugccuucugguccagccagguuuacagauuggaagauauucuguuaaucagaaucucagagagggacaggcccugaucaagguaacacagugaguugugguagcugggcugggcuagaaccugggccuccuugguuccaggucacagggaccaagggauuuggcuugucuuaguccuacuuguaacuacaauacugccuucugcuaggaagaauaagagcuugcaggcuagaggaauuuauaggaauuuucuuucuuuaaaaaaauccccccaaaaccagcuuuacugagauauaacucacacaccauaaaauucacccuuuuaaaguaugcaauuuuuaguauauucacagaauuaugcaacuaucaucacuauaauuuuagaauuguuuuuuuuuuuuuggagacggagucuuacucuugcccaggcuggagugcaguggugcagucuuggcucacugcaaccuccaucucccagguucaagcgauucuccuuccucagccuuccgaguagcugggauuauaggugcaugccaccacacccaacuaauuuuuguauuuuuaguagacaugggguuucaccauuuuggucaggcuggucucaaacuccgccugccuuggccucccaaaguguugggauuacaggugugagccacugugccuggccaauuuuagaauauuuuuauugccucagaagaaccccuguauccauuagcagucacucucccuuucccuuccccaaccaggcccaauaaaccacuaaucuacucugucucuauggaucuguccauucagaacauuucauaugguaaaaucauacacguguucugguguuacugacuucuuucacuuagcagaauguuuucaagguucagccauguuaugucuguacuuuauucuuuuuuacggccaaguguuggaauguguaggauuugaauuuucaaauaaagcuuuaaaguuuucagauuuauuuuuacuuugccugguguguuuuuuccuggaaagccaacuucuacauuuggagauuaaaagacaaacuuucucaaacucccuguaccuaagugguugcugcuuuucuuaaauguuuugacaccaaagagaaaaauugguuucuggaagaaaguguguuuucuuuuauugccaagaaaauuagugcauguuaauuaauauagaugcucaggacccagaguuguaaugaacuuuuuucuuauauuuauuuucuagauguuugacuuauuuuaacaguuuucauuuuagcaauaauguuuccuucccacucccaaauuuauuggaaacccucaaucaacccuauuuauuuauuuauuuuagagaugggaucucacuauguuguccaggcuggucuggaaacccucacucuuauagauaguaugaaagaagauuauagccaacucuuauauaaccuuccccagagccuccaauuguuaauguuuugccauauuugcuugcucuaucacuugcucuaaagaugcauaucacacacuuuuuuuuuuuuuaauuuauuuuugagacagagucuggcucugucgcccaggcuguagugcaguggcaugaucuuggcuuacugcauccucugccuccuggguucaagcgauucuccugccuuagucuccugaguagcugggauuacaggcacgggccaccaugcccagcuaauuuuuguauuuuuaguagagaugggguuggccaagcuggucgugaacuauugaccucaagugauccuccugccucagccucccaaagugcuaggauuacaggagugagccaccaugccuggccacaugcguguuuuuuauugaaucauuugaaaguacucagcucguaucaugacccuucacccccacauacuccaacaagcaucucuaagaaaaaggacauucuccuaaccacagugucucugcauucccaggacauucuucuaaccacagcgucacugcauacccaagagguuagcaccgauacaguaauaacaucuuguguaaaacuucccaaaaugcucccaaguguccuuuaugacaguuuaaaaaaaaauggcauuuuuugggauccaggaaccaauuaacgauuacucaauugaauuugguuucaaagucacauaccucaacuuuuccuuuaaucaagaacagccccccugccuuuuacacauuuuuuugucuuucgugaccgugucauuuuugaagaaaucaggcccguugucuuguagaacugguguuucucaagugugcuugggagggucuugguaaaaugcacauucugauucuggagaacaggguggagccugggaaucugcauuuccagccagcaucccggugaugccagugcagcuggucuucggcuguagaauguuccacauucuaggucugucuguuuccuugugauuaaauucaaguugaauauuuuuggcuagggcacuuccugaggucauagguacuucccacugccucacagcacaggcucacaaucucaguuuguccuguuacuucguggugcuaaguguggucaccugcuucaagugguguccgccugcucucuguugaaacaauaccuuucuccuaguauaaugauuagguaaccugugauuguaauugguaaguaaucuuugagacuacaugaauauccuguuccccagcaguuuucacucauuggugaacuguuuugggaaaaauaauagcaucuuacaguuauaauacccugcugguaacacauggcucuuacauaaucagcaguuaauuguuuguauguguguuaauuuuuauuuuuaaaauguaacuagugacugguaacucucauuuguauuuuaaacauuggcuuuuacagcuucucaguacauuucacucuguguauguuuuugguagagcauuuguuguccuguauaaugguuuaggaaauccuauaggccaaaugaagggcuggagacucaccuguguucccaccacuguguuucacuguguauugccagagaaaauacaguuaaauuugaauuucagauagacaaugaauaacuuuuuaguauaaguauguuccaaguguggcagacagcucucacaaguuacaagucguugcguaggacauaccuaugcuaaacgauuugauguuuaucuaaauuaauauguaacugauaucuuguauuuuuauuuguacgaucuuccaagcccacgucccaccgccuucucggggauggccaccauuuguguuugcugccuggugguguuugcagcugcgagaagggccuuggaggaggagcaaaguguagugguaucuccgugcuguggccuugggcacugggguggggguuagaugaguaauuagcugaauaugaccucacccaugaagaaugugcccuugcuagguauuagcagagguuuaggcuccagggagccauugucagaagcuugucagugaugucaucagcuggaagggccagcuuucaggccucaggaaaaagcuugaaagucagggcuccaguuuugguaauaaaugggaauggaguuucacagguaggguguggaggaauuuauugugacaggaagccugauggagccucuugccugugugcagcccccagccagguuucugaguucugaugaacuaccagaaacuuccaccacggccugugauuacacuguuggcccaaugcccuggaaaaauuggcuugcucucggggaacacuccaggagcugcaaagggggugucaggacuguugugcagcuccccuuaaauuggggaggagggguggcugauguggaaacuguucauuagacugcucaggguagugugagaaaacguguaaucugugggcaucuaccccuagcugccccucugaucucacccacuacugugggaggaccccguggaugggggcagaggagggucuucuggauuuagacacucacaaaacuuccuuuuaccuuguucauuggaagaaauagaaaaugccuuuuuuuuuuuuuuuuucuuuuuuuuugagacagagucucgcucuguugacaggcuggagugcaguggcaugaucuuggcucaccgcaaccucugccucccggguucuaacaauucuccugccucagccucuggaguagcugggacuacagccacgugccaccacacccagcuaauuuuuguauuuuuaguacagacgggguuucaccauguuggccaggacggucuugagcucuugaccucguuauccacccgccucggccucccaaagugcugggauuacaggcgugagccaccaugccuggucucuuuuucauuuuuaaaggguaauuugcugugcaggagugggcucucagaccagaaguggggaccugaaugaaaucaaggacugaguaugguaacuacagccauuuaauuuuauuugaagucucccguaaaauguucuggaaaaaacagggguuccagggcugggugggcaguuucaaucauggacuggauuuugugguucagauuucucugggccuguuggagguuccccuuaagcaauuacccaaggcaguucugcccagcugaaguacugauuaccugcacacuauaccagugaggacucaugggugagcagaugggaggcacugagcuugauucugaaacccuggccuccaucccaccugacauucaaugucagauuagaauuuggaagacccuaagucuccagauuggugcacuggguagcuccugaaaugggguggcugagacagguccucugugcccccuuccacagcuuccucuggggcccuucugcucacuggcaugugcuucugggcaaauaggccucucccagcauuuguuuuggcucugugaaaugggguaauauuuguuccuauugcgggugaagcgcugcuguugggaugcucagguaacucacuccguggguagcugauauugccugggcaaguggcauuuuagaggaaaucugugccaucaaaagaguuggaccugaucacacuuuugcuuuugaauaugcuuugucccagccuggccauucgucacuugggacccccugagucucucugaccccacuguaaaauggauaugccauggaguugucccaggaaucaagggcagguccucuccagugagugaugggcuugccucucacuucucuaacacccuucugcuuccuuguguaagauuucacuauuaguggcuauucucuuuuacagaagaaaaagggagacgcaugccucuuccaguucacuguucaccauugcagcauauuuauuccaagggacuggccgaaucaucccuuucuuuguuagaaugugguuuuguugccuugagacaaguggcccgcaugucugcacugaaggaggcuuugcgcaauagccuugggcaccuccgguucugcaagcauguacaguacuugcucuccuuucccuuucuuuguauacuuuuucuggucugcuacguguccaucugcauguggauaaagggucgucgucuugaguagugauuuugcugugaugugauuccugugaggucuaguugcacacagugauuccgaagguagacccagcuggaaagcuuuuaaauugcugauacuccagccccacuccccaagagaugcugauuuuguuuuguuuuggggagggcaguuuuuuuggguuuuuuuuuuaagcuuuuugauguguagccaggguugagacugaagugauuuuugugaguaacggagaaguguuaaggcuugagaaguuggaagagccaugcuugagauaggaccaaggucauauccccggcauuagcacagagcaacccugaccuguuggagaguugggcuggauggaugcggucaggggagagacucgcuuuauuuuauuuauuuagagauacaguuucacucuugucacccaggcuggaguguaauggcacgaucucggcucacugcaaccucugccuccuggguucaagugauucucgugccucagccuccugaguggcugggacuccaggcacgcgccgccacacccugcuaguuuuuguguuuuuacuagagacaggguuucaccauuguuggccaggcuggucuugaacuccugaccucaggugauccgcccaccucggccuaccaaagugcugggauuaugggugugagccacugugcccagccucgacucgcuuuauuauauccacacuuggaauacaauucggauugauuguaguggggcauuuuauaauuaggaaaaauuaaucaggaaaaaucacuccauguagauuaguaccaccauaugaggggacaagaauuucuucagauuaggaacuucuuccaacaggacugacaggguccaaaacuacucuuggauccagcuuuaagauggacccagcccacuguugaguccccucugaggucuucucucuguggauggauuugauuguuaacaauggcugagucauguggcacccagcccggugaguaagacagcugaguaagaggggaaacagggccuuuggucagaaaaaccagacugacuucagucuuaucuguuuagagaagccccagaagcugcaaaaauugcagcuuccagacuuuagugugccguggucaugacaucgguguggauggcagguugucaucugagcagucaggguggcagcacacagcuugcgggcuggcugauggccgaggugugugaacugaccugccccaagugacuucagugcugggcacagcauaggagcaguacuaaugauauggacaguaugcucagaggacguuagggagcacagcuuuguguaaagggcaugcccugcccuguccggauuuaaagcagcuauagcacugaaaccccauggucacccucgcauuucuacacuucugccugugccaagucuaguuugugugccuccuccauuuuguguguacauggggguauuuuuuucugcuaggcaacugcuauuuaugccucucaguacuguacuuaguguguaccauuccugcaagguauagacauugucagcccauuuuacagaugaggaaaauggaguuuuugagagggugagaucauucaguggcagaauggaauguuaacccagguagucuaaccucucugcuguagaucugauguccauuugaacuuuagacuucccaucugugucuacagucuagcccuuaaaaaaugugauaaacagguuuuuagguaagucuguuaauuucagaaagacauuauuauuauuuuuuagaaaguuagagcuuauguuagggcucagucuauccuccugccucagcugccugaauagcugggacugcaggcacaugccaccaugccugguuaauuucugugguauacaucauugauuacugagaagucacaguccguuguuaaauaacugagcuauucauagccaaaucauuuuuaaaaacacaaauauaagcaaaaacaaaacauuuauuuauuuauuuauugagacggagucucgcugucacccgggcuggagugcaguggcgcuaucucagcucacugcaaccucugccuccuggguucaagugauucuucugcuucagccuccccaguagcugggacuacagacacccacuaccaugcccggcuaauuuuuuuuuuauuuuuaguagagacaggguuucacuguguuagucaggauggucuuuaucuccugaccuugugaucugcccgccucggccucccaaagugcugggauuacagacgugagccacuguaccuggcccaaacaugugguuuuuuuaaaugaaaguguguucauuuuacaaacagugcauucuuacuaauuuuacaggcccugugcuagggacauggccucgucuuccgcuaucuuagagugaagaaguaaagacagagaaaguguucacaaguugcugcacaagucucauugcagugccucccagaggcgcgaagagcaacaccuuucaccugggcuguccuagaaggcccguggcagggugggguuggugaacacuggggcuuaagggggugaauucagaagacaaaggaccuucugggcaaagaagggcccaguagugggaagugcaggagugugagagugccuggaauugcccacucacuggcucuggagcuuggugcugagugcuugggaaguguugggaggaucaguuauauugcuggcuggguucuaaagaaccuccaaaguuuacauaaaaguuaccuuugauuugacuguucuacccuccagucacguggcuaaauuaauuaaaucaaauuuaaaauuaagcucagccauaccaaguauauccaguguucaauagguacauguggcuuguggcugaugcacuggacaguguacauauaaaacauuuccaucguugcagaaacuucuauugaacagcaguuguauuaguccguucucaacacugcugugaagaaauaccugagacuggguaauuuauaaaggaaagagguuuaauugauucccaguuccacagggcuggggaagucucgggaaacuuacaaucauggcagaaggggaagcaaacauguccuucuucacauggaggccgcagcaaggagaagugcagagagaagagggggaaaagccccuuauaaaaccaucagaucuugugagaacagcagcauggggguaaccauuccccugauucaauuaccucccaccaggucccuccaaugaccuguggggauuaugggaacuacaauuuaagaugagauuuggguggggacauagccaagccacaucaguguuguuacacaccacaguggugcugugguguguaggugggaaaacuauggcaugggggccauaucugguccucugccuauuuuuauaaaguuuuauuggaacauaggccacacucauuuauuuauguacugucuauggaugcuuucacacugcaacaauagauccaaauaguugcaaagagacuguguggcccacaaaaccuaaauauuuacuauccaggccaggcaugguggcucaugccuguaauuccagcacuuugggagguugaggugggcagaucccuugaggucaggaguucaagaccauccuagccaacauggugaaauccugucucuaccaaaaauacaaaaauuagcuaggcuugguggugcuugccuguaaucccagcuacuugggugucgagacacgagaauugcuugaacccagaaggcagagguugcagugagcugggaucaugccacuguacuccagccugggugacagagugagauucugucucucaaaaaaaaaaaacuuacucuuuggcccuuuauggaaaguuugcugaccucuucuguagaugguaggguacgguagaagguguucaagccaggaguaacaugaaugauuguauuuauggccuaagaggauaacucgugguggugggcgggccauauuuguggagagacccauuuucagugacuuccaagagucugcgugagagaugacugaggucuugcccuggcaggaaugguuccauuaaucugugucucauuugacaaaugaggaacuacaaaugggaacaguuuaagaugagauuuggguggggacacagccaaaccacaucaguggugcuaauagacaguggugcugugguguguaguagggaaaacuauggccugugggccaaauuuugaaguccuuuuacuuuuugguucuaaaaauuauuaauuguagccagaguuguuaacuuaauaugucuuggaccccuugggcucucugaagacuguacucuuucuuuccacuuaauaauauacauggaauugcaaaggaaaccaaugauauugaaauagauaucagaaauaaaauuuuuagauauagcaauaaaugcacaucuguauuaaaauguguaauaacaagaucuaacagugagucuaagaacuacuauaauuaucauguagcaauggcauaaaggauaguuugugcuaucuaaaacagucaaugacaggagaaaaucugauuucuuuggugauaaaacgacaggugcugcuaauacaccuguguuuuauggucuucguuuguaaugaaaagaaaugccauuaauaaauuuuauuuauuuauuuauuuauuuauuuauuuauuuuuuuuuuuuuugagguggagucucacucugucgcccaggcugaagugcaguggcaugaucucggcucacuacuaccuccuccuccuggguucaagggauucuucugccucaggcuccugaguagcugggauuacaggcgcccaccaccaugccaagcuaauuuuuguauuuuuaauagagguggggguuucaccauguugaccaggcuagucucgaacuccugaccuugugaucugccuaccucgggcucccaaaguccugggauuacaggugugagccaccgcacccggccagaugcugggauguuuuuuaagaccuuagacccuaagccuaucauaucaaauacaaugaaacacacccacuuuucacacuuuaaaaaaaguguguugguguuuauugcuguaaaauaguuugaaacuuuuuaaaaaaaguuuuggucuugcucauacuuguguuuuaaaaaaguauuuggcuaugacuaacucaguuauguauuuauuuauuuauuuuugagacggagucucgcuuuguugcccaggcuggagugcaguggcaugaccucggcucacugcagucgccgccuccuggguucaagccucagccucucgaguagcuagaauuacaggcgugcuccaccauacccagcuaauuuuuguauuuuuaguagagaugggguuuuaccauauuggucaggauagucuugaucuccugaccuccugaucugccugccucggccucccaaagugcugggauuacaggcgugagccaccacgcccugugacuaacucaguuauuuaacaauugacuguaauuucucagcaaucaguguauacuuggaaauucuugggaugugagaaaacuaaccuauaacucauuuucuuuuuucuuugaggugaggucucucuuuguuacccaggcuggcgugcaguggcaugaacagggcucacugcagccuugaccuccugggcucaauccucccaccucagucuccugaguagcugggacuacuggcacgugccaccaugccugguuaauuuuuguauuuucuguagaaauggggucucacuguguugcccaggcugauccugaacuccugagcucaagcaauccacccacuuuggccucccaacauaccgggauuacaggcaugaaugagccaccaugccuggccugcaacuucuauaaauagcaaaguuaguaauuagugaagaugaugguuugcaagcacugaauuauacuucuauuaauuucauuuccuuucaauuuucuaauguuuugugcccaaucuguccugucugccucuaccuagcuuuagaaguguuuuguugguuccugagauggagcugugccugaaggguaugagguuacccucuggguucagcggggagauuugggaagaguuuugauuuguaggccaguaaaggggccugacauuagaugauggcugcugggcuagggaacaacuuagaggcagcuaacaggauucagggagaguggauuuggugggagagaguagucuaggaugaauccaauuggguuuuuaugaguaguuugguaguugguugacuggguggguggucccuugguaauuauuuguugauuagugguuguuggguuagguugguuacacuuacauuauagucgauggaaucucagauuuggaucuaauaccacauguaagucgaguggauuuuuuuuugagacagaguuuugcucuuguugcucaggcuggagugcaguggaacagucucagcucaccacaaccuccgccucccagguucaagcgauucuccuaccucagccucccgaguagcugggauuacaggcaugcgccaccacgccgggcuaauuuuguauuuuuaagaguuggggguuucaccauauuggucaggcuggucucgaacucccgaccucaggugauccgccugccuuggccuccuaaagugcuggcauuacaggggugagccacugugccuggccaguugaguggauuuuuuuagcacucaagcuucguggcucauugcuauuauugugcaugugagcguuuuaucuuucaguagcauuagggaugcuacuuggauguguuuuaguuauuacagaaauaguuuuuacuaacuuuuacuaaguuaucuuuccucuccuguguaggaaguuuagagugaagcggcaguuggcuggagguucugaagguuucccccuuucacauaauuugauguuccaguugcccacaucaggacgacucccucucuuucuacugauguaagcagugggccaaauuauggggcuccaucccugcaucuuccuacuugucuaaaucuucgucacagacaacauauugcucuaaaggaaaccuagaaaggaggagaagcugguuuucgcccaaauuccucaaaaucaucgccuguuguuuaagaauuacaguuugcacuggaacaauaagauguuccuuaaugugguuuuuaagugaguugguugucgccugaauuucauaaacacuggcuaaggauugugcaaaagggugugcuucccuuuagcauccuuaauuagggacagcguuuugaaaacugcuuuuuauuguccuuuaucugcaaaacuucuugaauccaaauagcgagauucucauuucuuaaucacugccacagaaaguuguagauuagagaaagcuccaauuccuuauuuccugucuuccuuucuuucuguguguuuauugccugugucucauccucacuccugccaguuuuauagaauguaaccucccagccucugggaauguuugggagacuuguucauagaggaucugaagagcaguuuaaaguggacuuacccaaacuaucuucuggagaacauuagucucuuuggagauaaaauuuuuaaacauccgcuaguccaauaguguuggcaaauucccugugacacuguagcccucucuuugagauugucaauguacguuggcauguuaaaggcucugagaaguccugcagcaguuaaaaaauuguuuagucuagugugcccccaguuguuuggccacugaaacccccuuuucuggaaaaaccagcuaacaucugguagucuuuucuaagaggugguacugaagaugauacucauguuacacauuuaaaaauucuaacauguguuuuucauguguuuauaaaaugcaacuaauguaucaaaccugugauuuccaggacauaauuacuuaagcuaaggaaaaaagaaaacaugagugaaggaaaaacuuuaguaaauaggccaggugguaagaggagagagccuugucugugaguguggucuagggggaugcuggaccuagcuuuucagagcuagguucaggcagagcugcucugagauguagacacugcagcugggguucuuguugagccgggaagcagcuucugacuaaggugcagacuguuuagaugagcuggucauaaagagcccugacuguggacugcgucuccagccacggcagcagcugguggauggggugaugccuuggauauuuaucguguguuucuugccuggccugcccuuggacagugcgccucaggaauguuagaauguguucccccuuuagcagcaaagccgaucugcuguguacuuguucuguuuaucuuacugccacgaccguuuaucacgggccagaguucaggggcacacugauaaaucucuuuuaggaggaugauguaacccucagcauuuucccccuacuugguucugaguuuuuaaagcuuuuguaacaccaucauguccuuguuugggcaucuuccuguguacucccguuugggucuccagggugaaauagccaacaguggauucuggagucauggccuggguucaaauuccugcucugcugcuuaucaacucugacuuuggguuuaauugaccuauucauuauuuuucuuaaucuggaaaauggagccaacagcaguuccucauaaagcagcuguaaggauucagggggguaacugcacagggccaagcccucagguuucaccucucacugggaggucggaccucugcauaauggacaagcucuccuagggugcaagugaacgggggcgcaagggaguuaggaagguggguguuuuuuguuuuuguuuuuugguggcuugaaaaacaugcccaaggcugggugugguggcucaugccuguaauuccagcacuuuggaaggcagaggcgggagcauuguuugagcccgggaguuugagaucagccugggcaacauggugagacccugucucucuuuuuuuuuuuuuuuuuuugagauggagucucgcucuguugcccagacuggagugcaguggcgcaaucucagcucacugcaaccuucacccccagguucaagugauucuccugccucagccucccaaguagcugggauuacaggcgugugccauugugcccagcuaauuuuugugcuuuuaguagagaugggguuuugucauguuggccaggcuggucucgaacuccugaucacaggugacccauccaccuuggccucccaaagugcuaggauuauaggcgugagcuacugugccuggcugacccaaaaaauuagcugggcgugguggcacacaccccuguagucccagcuacuugugaggcuggggcaggaggauugcuugaggccagccugggcaacagagcaagaccuugucucaaaaaaaaaaaaaaaaaaaaaaaaaaaaaagaaagaaagaaaagaaaagaaaagaaaagaaaaacaugcccaaaggcaaccaaaugacuccaucuuuugcaauguaaucuucaacaucgacuccucuggcaagcuguuuggaaauggcaaaguccaucuccugaggcugggagauugcuuguccaggacgggugugucuggugaggaauggaaggcauuuggauggccacugagaaagcugagccaaggagcaucagaaagacaaucaggcaaacccacagagucuccagguauuccuuugcugauagguaacauugcacuagcgauuuaaacaaacaggugaaaggccauugcccuaccaccccaccucaccucuauuccuugcugcucuuuccagaagcaacugcauggucugggaacaguuuuuugucuugucaagagacagucuguacauagaugaauucaauuauauuacuucuguaguacccuguacucaaauuugaaccugucauacacauugcuuuuaucauuucauaauaccuguugauuuucccacguuaguaccuauagauccugacaagcaauuuuguuaagaugaagaguucuucauauguauuguacuauguuucuuuuuuugaugauguaugucaagauuuauuauaaaaguaacagauggguagggcaugguggcucauuccugugaucccagcacuuugggagaccgagaugggaggauugcuugagcccgggaguuuaagacaagccugggaaaccuggcgaaauccugucucuacaaaaauuacgaaaauuagccaggcaugguggugacugucccagcuacuugggacccaaaugucccagauacucaggaagcugagucgggagccugauccucagaggucgagguugcagugagccgugauugcaccacugcacuccagccuaggugacagagugagacccugucucccccuggccuccaaaaaaaaaaaaaaaaguaacauauguaguuuaaauuuuaaaaauuaaauuuuugggggggcugggugugguggcucaugccuguaaucccagcacuuugggaggccaaggugggcagaucaccugagaucaggaguucaagaccagccuggccaacauggugaaacccugucucuagaaaaacacaaaaauuagcugggcaugauggggggcgccuguaaucccagcuacuugggaggcugaggugggagaaucgcuugaaccugggaggcggagguugcaguaagccgaaaucaugccacugcacuccagccugggugacagagcgagacuccauuaaaaaauaaaaauaaaaaaucaagcaaugcagaauaaauaacaacaauaaaaugaaagcccaucuuccaccaucagcuucuuaguuuucuuccuagaaggagccagugaggacaguuugguguuuaugcuuccagaucuuucuguucagaugcagucaugacuucugaaaaacaggauuguacaauucauacuuuucuacaaauuauccccuucccuuaauacaucauagaagccuauucauauuggaacaaacaaacauuucuuauucuuuucacagcacccuguuuuccucuugcuugaauguaaaguuuauuuaaccacuuacugucagggaggcauuuguuuucaguucucccucccuccccccaccaguugucuuguaaugaacugcuuuaauggcuaaagaucacuuuaauaucaaaaccucccccaccucccauuagaaaaagaaaucauguuagggaacuucaaauugaauuuacggaccuuguguuuaauuuucuaucagcaguggccccagccuggccccugcagacugccccggaaucugugggaggaguugggguggccugcagacuagagcacacugccaguucauucagcagcucaccgagcaagaaacaucuugauucuaucagccuuaaugcugugucccauuagggacccagcucuuguggucauuagcagauggaaugcucaucugugcuagaaggcggaauucuagggcauucggcucugagcagucuugaaccagaauugaauggcuugaauccuuuucacaaugccaacggggaggcacccuuagcucccaaacuuguguguguuauaauacuaugguaguaauaacagugguuguaguagcccccgugaauuugaugggacagucgucaggcagugcugcuugcuugcuuuacuccaucguaucaccgcagccugaugaggcgagggaguuacgacucucauuuugcaggugaggacacugagcacagggaaucgacccacucauggucacacagcuugccaagucgcugugcuugggaggugaaccaggcuucucugacgccccagcaggacgucugaacuucuagcugccccaucacuaacugacuuaaugccccugacuccugggugacuuggccaccaguuacuucagccagcgaccugcccuuucuuugaguggguuccacccaucccugcaccaugccuuuuacuuuggauguugguggcauggaauuccacccguaagaaggaggucggucccugggcugagagaguuugcagagagcucuguugggauugggugggacguguguuuggaggccuccucacauaauugugggcugaaagguccagauuuggggauauaaaguugagccgucagcugagcuaaagacagggcacagggaggagccauccagaaagugucaguguagguaaagcaggcagaguucccccuaucuguccucugagggccuccuuucuugugguuuccucccuuuucuguggugauggucagagccagcgguuauaaauuauuuggaauuuuccucagcuugguuccuacucaagacuuuaaauuaggaguuuuguucccuuuuaugacuucacaaucuuugggcaggcugccaucucuacagcaggcuaauaugaguuguaacuugaggugaguuacaggggaaaaauggaagcugauuucuccccuuuuaaaccaaggaagccaccuugaucugacuuuguaacaaagcucaacuuuuguaaguuugcaauuaaaggauaaauaccuauccuauuuauuauuauuauuaacuuuuuauuauaaaaggggaaaaaacucccaggaaacauagccuaauaugagggacaaaaagccaaaagguuuuuuuuuucuuccuuuaaaagguccucaaugucuugcccuguggagacaccaguuuucauuauaauaacgccauuaucucuuuguagagucauuucaagccaauuuaacuuucucauuuaaaaguauaauugguauucagcacagagcugggagcucaguaggcaguuagaaaauauguguauauuuuuugagacgaaguuucacucuugucaccuaggcuggagugcaguggugcgaucuuggcuuacugcaaccuccaccucccggguucaagcaauucuccugccucagccucccaaauagcuggaacuacaggcacucaccaccacgcccaacuaauuuucguauuuuuaguagagaugggguuucaccauggcuggucucaaacuccugaguuucgccaggcugguuucaaacuccugauuucaggugaucuaccugccuuggccuccuaaagugcuggcauuauaggcaugagccacagcaccuggcuggcaguuaggaaauauuuauugaauaugagaaaagaaaaauagagcaaauugaaucuucaaguaguaugugaguaacucuaauuccuguuuucuggaaaacacacaggcugauagguuuggguaaauaagagcagagcugcaucuucucucaaguucccugauucccucaaggaguuaccugagaauagcucugugccaagcagugcggcaugcauaggggaccucuugaauggagggacaguccauuaucauuagaauccccaguuccagccaggugcaguggcucaugccuguaaucccagcacuuugagaggccaaugugggcagauugcuugaguucaggaguucaagacuagccugggcaacauggcaaaaccuugucuccccccgccacacacacaccacacagacacacagacacacacacacuggcuaggcgugguggcaggugucuguagucccagcuacuuagaaagcugagguaggaggauugcuugagacuuggaggucgauacugcagugagcugugaucgugccacugcacuccagcuugggugacagagcaagaccccggacccugucucaaaaaaaaaauuccccaguucucagggugugguagaggccgagucagucauggcugagacaaggggacugugcucugugugcuucugugcccuguguuuauaugguucauacgcugccuguccaccauguuuuucccgagagccucggcagcgcaggcaucaugggaaugacugagucagguggaaauucagaggcccugcccuggugggcagagaagccuggcuuaccucccaagcacagcauguguguggaucacuucugugcacugucuccucaucuccaaaaugggagucauaacugaacucaccucaucaaguuguuaugagaugauguagauucagcgaaguagcaagaguaggaguuugggcuuugauaacagagagaagugaguuuccaucuagauucucccccugugucacuuuuggcaguuggcuucaccucugugggccucuguuaugucaucuguaaaaugggauuaacccuaaaagccacccucacagggucauugugaggauugcacaaggugaugcaaguggcacagggucuggcccaggagagggggcuggaagagagcgagcugccauuguauuuugguugcuguggaucuaaggagaagagauguuuaggagucuuucccuggcaugguuccuccugccuucacccaucacucuuuuccucgagggauucccuguggggugcacagccccagggugggccagacugagcucacaggagcaugggcuguguuucaggugagguggccucaccacaugacaaacugagcuggagucaaagggucacgaggaccuccauucacagccagcauuuauuauuucagcuggaaauguuugccgagcaguuguagcuggaagcugugagcgagacacagacugccaucaggcugaggccuccagagcucaugcugggcuuuaaccugagccucuugggggcugggcucugagcuccuccacuucugcucaugcccaggcguccuugggggccuugaacugucaguuguccaggagaacuguguggcagcaacagaaugaguuuguauagcaaccuguugcuuugagguuuaaaacuuaguuuagaacgcaauugcuuugaccauuuuggagugucuauacuuuuuuucuucuucuuuaaguuuucuuuuuucuuuuuuucuuuuuuuuuuuuuugagacagaguuuugcucuuguugcccaguggcaacaagagugcaauggcgaaaucucggcucaccacaaccucuaccuccuggguucaagcuauucuccugccucggccuucugaguagcugggauuacaggcgcccgccaccaugccugaccaauuuuuguauuuuuaguagagacggguuucaccguguucaccaggcuggucucgaacuccugaccucaggugauucaucugccuuggccucccaaaaugcugggauuacaggcauaagccaucaagcccugcuuuuuuguuucccuucuucgaccuuucuaacaagagguuggaauccucguuuugacuuuuaaaggauuucccagugcuagaaagugguaagauaguuacuguauccuaggcccuuuagcagaccugucucauugaucauuuauuuaguccaguguggcuuuguuguuggauauuaaguaauucucaaaauuuuaccuuuucaaaaguggcauugaaaauaaaggcauugggugaugaaaauggaacuuuuaaauacagugauuccuguuaaccagaaauaggguguuugggauaauuuaugaagcaguacaccaucauagauacuaugagcugaaaguucaccaaacucucuaucccaaaauaacaauaagguauuuaugaagugauucguuccaacuauuugaggcaaaaauuguccagcaagugagagagaacagaaggaauaguuggcaaaauagggaauuugaagucugagguuaugcauaaggaauguguuaugggccuauaguagaaaucucaaaucagggauuagggaauguuuacucaguucuguugcagagaaauccuggccacgacucccccaugccaugcccagggcaggcauugcuaaucuucacugccuccauucuccaugcccuguucacggaagacauuucuaaugcauuuuagcagucuuuuuuuuuuuugcugaauccagauguggccucagaauccuucucaacacaguguacuagcaccacuuggugcuccugaucuacuguaucaucucuugaaaaacuacuaacaugaaaagaccugccaagucaacuuuauauuaacugaacccuugacacagugauggauaaaaauuaauucaaacagcuucuuugugaucuuugaguaguucaugagcaagaaagagaauuggaaauccagccaacuucggcccccuugucuacuuguauuuuacugugguuuauguuuucucuuaccaauugagauaggcccaugagacuucuggucuuccaaagcccagaacauccccacauuauaguuuaaccacuguaacaaagagguuuuuuuuguuuguuuuuuuguuuuuuuuuuguuuuuuuuuugggacagaaucucgcucugucgcccaggcuggagugcaguggcaugaucuuggcucacugcaagcuccgccucccagguucacgccauucuccugccucagccuccugaguagcugggguuacaggcgcccaccaucacgcccggcuaauuuuuugcauuuuuuaauagagacggggugucuggaucucugaccucgugauccgcccaccuccgccucccaaagugcugggauuacaggcgugagccaccacgccuggccagagguuuucuuaaaaacaauaacaacaaaaacaguuguggaaagcauguagaguguggguuuuuucggucuucagguuggcagggcaucugauacugggacccagguuccuucccucaccuugcugugccucuccuagugcaggccaaagccaggugacugcgcugucugggcuccuggcuggcaaucggggaaagagugcauggagcaggcaugcccacuguucagguccugaagccguggcucauuucauaucauuuguugcuuauuugaaagacaggcacagcacugacuuccaggggaggcugacugaccaucuagguggaaguugcaugccugggagggagaaggggacaaaggccacagauaggcaucaguuaucagggccuuaagucugccuuguuggcaugcagccuuuuauuggaucaaggcccuggagaaaagcccugagcaggaggagauaagccagcuugguccccuucauccuacccaggggccucugggguaccugagccaaagugcacaguucauuggcuguguggauggaagggauaugggacuugaaaaugggacacugguccugggcagcugaccgacaugguccuccuuaaccugcugucuggggagauggguugcaucuggcuagguuuugacugaggaacugaggagagcugucagcuguccccgcuuugguucagaaugcccuuuuguuuggacagcugaagccuacaauucagccaugguuuguuugggcucagaaaacaggcaaggauggagagaaacugcaaagcugaccugggcugucagugggcaccagguccugcuggccuggggucuggaugcaggagaucugagcucuucaaugugggguggucuugcagcagcucuucacaggcugcugcugcugcugcuguaggcucacccaagcagccaagacggacaggaucuauucuaguuuugugcagaguuggauauagaagaggcauuagagggagaggggauggggaaggaguuccaggccaggugagcauggggcacaguaaacugggauguuaaggaggggccaguuugugaccagccugggcaacauggcggaacccugucucuauaaaaaauuaaauuagccagguggguggcaugugccuguaguccuagcuacccaggaggcugagguggaaggaucgcuugagcccaggaggcggauguugcagugagcagagauuguaccauuguauucuagccuggaugaccgagacccugucuuuaaaaaaaaaaaaaaaggaggggccagaccccugacccauaugugcugcucuuuucuuucagggaggucugauaaaauaucaguaguucaauucuuuuuuuuuuuuuuuuuuuuuuucugagauggagucuugcucuguugcccaggcuggagugcaauggagugauuucggcucacugagaccuccgucucccagguucaagugauucuugugccucagccucccaaguagcugggauuacaaggugcccaccgccaugccuggcugauuuuuguauuuuuaguagcgacaggguuucaccauauuguccaggcuggucucgaacucgugaccucaggagguccuccugccucagccucccaaagugcugggauuauaggcgugagccaccaugcccggcccauaguucaguucuuuaggugguucuuggugcugcauaugagaucucugcaagaaggacacgucugagccgggugguuuagaagaccagcauggcccaagacccucagagcaacaccaagaaccaccuaaaauucuuucucagacguguccuucuugcagagaucucacgugccccagguucgcugcagcguuaggggucagccucccuuuggagcaggagagcaggggccuuggagguggcagucauggcccuccuaauuaauugcuuggcucagagaagugacaaauugaacauuucaaccaccuguuaauucacaagguacuucuuuucauuucuugcugcuugcacaaaacacuuggaguauggcuuguggaugucuggcccuagggaagaguguuuggcacauagcagguacuuaaguauuaggaaaaugaggauggaggggagggagggaacauuauuaagcggccaacugugagacaggcauugugcuugacucuuucuuucuuuuuuuuuuuuuuuuugagacagagucucuuucugucacccaggcuggagugcaguggugugaucucggaucacugcaaccgcgccuccuggguucaagugauuuucgugccucagccucccaaguagcugggauuacaggcgccugccauuaugcccugcuaauuuuauuuuuaguggagacaggguuucaccauguuggccaggcuggucucgaacuccugaccucagugaucugccugccucggccucccaaagugccaggauuacaggcgugagccacugugcccggccgacacuuggcauucucuaaccuaccuacuccuuauaacagcccugggaaguaguugaccauggccauuucuauuugguagaugaggaaaaauaagguucagagauggauuguucaaaccgauguaucuagucaagcuacugguucccgagccuguguuugcaaccccucuaccauguagccucuccgggugguagagaugagggggcagagugcacagugcauggcauccuguuccccagauggccaagucuuagugcgaguguguguggccuugguaacuugugucaagcacacaccccaucucucucucucucucuuuuuuuuuuuuuuuuugaaacggagucucacucggucacccaggcuggagugcaguggugcuaucuuggcucacugcaaccucugccuccuggguucaggcgauucucuugccucagccucccgaguagcugggacuacaggcacaugccaccacgcccagcaaauuuuuagaagagacuggguuucaccauguuggccaggauggucuugaacuccugaccucgugaucugcccuccuuggccucccaaagugcuaggauuacaggcucucuugcucucucucucucuuguuuuuuuuuuuuugagacagagucuuacuuuguugcccagcuuggagugcaguggcgugaucaugguucacugcagccucgaucuccuggcucaagcaauccuccugccucagccucucaaguacuaguugguacuaaugggcaugcaccacuacaccugacuaauuuuuuuuauuauuuguagggacagggugucccuauguugcccaggcucuggucuugaacuccugggcucgagcuauccuccugucucagcuucccauagugcugggauuacagagaugaaccgccuggccuacacaccccuaucucuccucgauucuuuuuuuuuuuuuuuuuuuuuugagacagagucucccucugucucccaggcuggagugcaguggggugaucuuggcucacuguagccuauggcucccagguucaagcgauucuugugcuucagccacccaaguagcugggauuacaggcacacaccaccaugcccagcuaauuuuuguauuuugaguagagacaggguuucaccguguuagccaggcuggccucgaacuccugaccccaagugauccuccugccucggccucccaaaguguugagauuauaggugugagccaccaugccuggccucuccuugauucuuacagucacuuuguuggcuguuucugacucagcagcuaccugcauuguggccaaaggaugaccuauuccuucucaggagggcaaaaauguggaauagugucuguccaugccucuccucaugggcuaccaccucugccaccgugguuaaucaguaacaaccaggagagaagcugcuggaacugaccucugggaacucccuggaugguuuggugcaggaauguaguaggcauacacgugguugcguggaucugggcccuccugaugugaguagagagguaaaaggccaccaucuccuugaccucuggggaacucauccacaaagaagauguuuccaagaugcuucugaagauugccuaaaaauagccgguuuccacccccgugaaugcauccauucuagaaugcuccuucaccaggaccagagaacugauuuacagaagugacaugaaaacauuccaucccagaauuugcaguagcucaaauuaaguuucuagcuauuaaaaagaaaagaaaacaaaacuaaacaaaacacacccacccugcucacuuagaagcaacacugaguaauuuuaaguaguucgagaaaauguaugugguuugagggucaggguuguccagagccaagaccaguuaugugggaauuguuauuggcuggauuuggggaggagaaacccauggcccaauuccaacccacugaaaucuaagcagauucuaggugguuaggcggaccugguaggcguugguuuauuuuauucccgaaaaaggcccuggagcaagucuucacauggaauccugcugaaaggcuuccggcucaucuggccuuuuccuccucuuaagguucugcuccauguuuuacccucggcguaaacauugcagagcacguucagaucugaaaagugucucaucuacgugauggucagacguuguugacccugugaugcuguguaacauuucauuuucgaggcuuggggagucuccuauuucauguggaugggaaccuggaggucuuugggcaagucgccaucuuuuuauuguuccaagaguuuggugaagcguuugaaccuucaccugucaaaaucaguuuuggaaugagaacugcucucucucuaguccuuauaauagcagaaggaagguaucauuuaucccaaugagaccauaaagggggcuuucccguguggacacccaccuugaauucaauuggaaacagaaauucugggcauuguauuuuuuguaaauuuggcucagacuucaacuggaucauauuucccccaaaaucuuuucgaaaaagacuugugucucauuccuuuagacuagcauguguaagcuggguaaaaauagagcaagccgauuucauguuaaugauuucauguuagguuugugaaucaaaucugcaagucugcuuuugaaaagcauuuaacauauaacuugggaaaguuugaguuuugcagacuaaugccuguggccggaugagacuucauagcuccauccaaucccuccuggugcaagagaucaaugccuugagggugccuggccaccaccauuacccugacaguauacccacuauuuauuuauuuauuuauuuauuuauuuacuuauuuauuguuuacccuuuugaagauugcucuucucccuuuaacuuaaaggaauuggcauggaaacuuguuugaucuggaauuucugauaaucaguagguaguaacuccguaaucaauagcacuucaaaacaacaaccaaauaacaggauaacuaauccaaaaaauucagucauggucaaggacuuccagcucaggaaaugucuggucccgugggguggauuccuuggauaaccaaguuccgugcagggccuggaguuuuaugcagaccauugcuccuugauugaccacaggaccucaaaaggagggcuggcuucaugaccacaugacccgugugcucagaagggcccuguacuugguuuauugcucugcuguugcugucuugaaguucuuaauuuuuuuuuuuuuuuuggcacuggggaguugcaguuucaaacaacacuuauucauugucucacaguuucugugggccaggaguccagccauggcuuaagaccagguccucugcuccgggucucacgagacuacaaggaaggugccaucuaggguguguuuucaucugaaugccuaacuaaggaaaaauccacuucauucagguucauucagguuuuuaaaagaauccauuucugugugauugucccacugacaggucccagcuuuuuacuagcuguugcuuggaggcuaaccucagguuuuacaggcuacgcucauaucucugccaugaggccuucugcauaggcaauucauaacacaggugccuguuuccucacagccagcaagagaaucugucuccugucugcuaaaguggaguuucaugcaucguaauauggucaugggaguaauagcccgucaccucugccauuuuucuguugguuagaauaaaggcacagguuuuccccacacucaggaagaacccaugauauaaaggcuuucaguaaaggagacgacaaacagaauauggaaugaucagaauuacucuuaugacccagaccaagaacaucagcauuaccuacgaauuuauuggaaauucaaauucuccuguuucaccccaggccuguuaaaucagaaacuuuaaaagcgagcccagcauucugugguuuaacagauccuucaggugauucugacaccugcugaauuuugagaaccacuggucuagaggcaggcaggucuugcuccccuaggaguuaaguuugauguaucuucugguaauacugagaaaugagcugggaaaugguuccaaaaucagauuauccuccccaggauuaacaagacucauacuugcaaaagagagugaagaagagaaacuaaaaaaagcaagaggcugugugugaagcuagauucaaacaguuaaagacagcaacacauggcaaaggaugggaauuugaggaaguggguagugaaagcaauucuugagcuaaauuacaagaaaacacggugaauuuguaucuguuuccuauauuuagggggcuggcuuaaacguuagugauacauuuggggaguagaaaauggauguuggugugaaguucuuaaguuuuggacaaggaacccuguauuuucauuuuucucugagccccaugaauuauguagacaguccugcuucgaaguuauuauuuauacaauucauuauagagaaaguccuugggaaccuuaacuuugagugaggauugcuugaguuaguuuuucuuaccagccacuccaugauacucuuuguuuuuuccagguuagaugaucgaguuuuauuaugacugaaucugcaccugcaaaauuaauucugauuaauuaauuuaauaauuaaauucugaugauuucucucugaugguuugggugugggcucuuaaagagggucuuuuuuugcaagaggauauaacaauaaucagguuaauuaaaaaaauaaggcucucacccuuucauuuuugaguggcaugccaugcaccccuuaucagcaugugaguaugcuuuucauguggucgugguuggguuucauuaaguguaauuuggcauguguucaaccagcauucagguggcucuugguggguggcuggggagacaccaagaugcagauagcucagucacuccucaacaagcggcuuaguucuggaaugaggugggaggccaaggaacucacacauaaaugcuggugggagugaagugccaccagcuguagaaucuggugucagaaugaugagccaggaguuaucccacaggaggaugggugaaggucuucccaucaaagggauagagaacaugugaagagguccaggggcucagggcaagauguaguccaggaacaaggagucuuugagccugcaguaugguggguggaaguggcaagaguggaaagcggauuggaugggguuuauguagguucugaggugcuguguauguuuaaggagcugauugugugcagcgggaacccuggugaauuuggaagcacagaggcaccugacgagaaagaugguucugggguuaugugaacagugauucggcuucaaggcuaucaaagacaaaaauguuuauugggaggguauagaaaaggguuugccaaaagaguuagguagggauagaauugacacauuguggaaacuauacccagaguuuaagagguggaguccaggauagugcccauguuuguagcuugggguccugguagaaugggagcuggcuauggaguaucuuuguuggagaguggguauagggaaacggagagagagagaaaguugcagggggugcgggagauggauagcugcagagaaggcaagggcagggaaaguggaaacaaauggcagugagacuccuggaaggugcuggccaggggcauggcauggcauguucuguuaagcaaggaaaggacuagaaaggggccaugauuuuggcugggcacuuauccuccucacaacaggacgcauuugugucauggcuuacucuuaagaaugacugacgugucagaauagcaaauaugaaaaugauugauaacaccuagcauuggugagauuugcagggauaacuagcuggccucuuaaaucuauagauaggaauguaaacagaaacaaacuuuuuauagggaaaagauaucuaggacauaaugauuaaugaaaagaaaaaaauuccuaccuaucgaaaaacgugaauucaggcagcaaacacacaugcauguauacacauacacacgugcacacacgcauacacacacaaucugguaggcuguauacuaccaguuuagcagguuguuaccucugggaugcagucacuccuuuuuguuguguauauuugugaaaugauuucuuucaauuuuugagacagggucucacucuguugcccaggcuggagugcaguggcgugacgucagcucucugcaacuuucacuucccgggcucaagcgauccuccaaccucagucuccugaguagcugggacuacaggagugagccaccaugcucggcuaauuuuuuuuuuuuuuuuggguagagagggaguuuugccauguugcccaggcuggucuugaacuccuaagcucaaagcaauccuccugccucggccucccaaaagugcugggguuacaggagugugccacugcaccuggccauuauuauggaaaauuuuaggcguauacaaaaguagagacaguggugucuuacaugcucaugaacccaugauccagugacauccguuaauggcauuuuggaaucauauuucaucuguuuuuguccucaaauguuuugaagcaaauuucagcauuacaucauuucacucuuaaauaucucaguaugguucucuaauaguugaagacuccauuuacauuuauauaaggagcauaauuuacacuuguguaacccaaaggaaugaccaagccugugcuucucuccccagauagcaaagccauuguggaugggaaccugaagcucaucuugggucugguguggacgcugauccuccacuacuccaucuccaugcccgugugggaggaugaaggggaugaugaugccaagaagcagacgccaaagcagaggcugcugggguggauucagaacaagauccccuacuugcccaucaccaacuuuaaccagaacuggcaagacggcaaagcccugggagcccugguagacagcugugcuccagguaaguggccagggcugccuaaaccaucuguccaggaugggggugugugggucccaaacauucugguuuucaacgggaaugcuaucuuugcuuugauuagcguauuucuccaggucuuagcccauuauaagcccauuauaaggaaacuaaaacuggcucuguguacccuuccaagggcagauuuucuagguauauccauagacauguuugagcaucaaguugagucuuuuauccaaauuccaaugaaggaguuggugcuuagaagcaagacuuggguuuagguuccagacuccaaaauccugugucuucccacauuggugcucaguuucucauuggauuuggagaaacauuugguccuauuagguggcuuggcaugaaaaucugaaaacuuccauggaguggaaaguacccauuuuuauuaaccacugguuugacuauauauggcauucuccacccuuuucuuucuguguugcugugaaauagcauuuggucaggauccaguuggagccuuuuccacccuugaugggcugcucauuucuuagugguugaguguauaugaagguuguaauuauucccacuggaggguuuagauugauggguagaguuugcugguacacacucaguagaaagaccagagucagaguuuacacacacccccuaaaguugauuuuaauaaaaaaaaaagguauuaaucauauuuuccauuuacuguguauucuguauuuacugggcacauuaguauuuaguuaguuagugguucuugacauacucaaagcagaacuagugucaguuggguaggggagggcugaaggccucauucuuacuugagagccuauaaguuggugucauccaggaaaaauucaaagugcagcauuaauugauuuccuaauauccucuucuuuacuuccauuuaaggacacauuuuaggauaccucuuuccaauuuaaaccugggaguuuuuacucuaguccuuuaccucaugugcuuacaaaggcuuuuaagauaauucuagguuugugccuuugagcaaguggauuuuugaaucacacaggaugcuauucuagacuuuuuagauauauccaggaauagaguaaaaaauaaaaucccuccugcauaaaggcaccaggcuuuuuccaagcuuuguuuauuuuuuaacaccacuucuucaaggaauggauaauccccaucuucaugcaagaacauagcacccggaggagaagucucaguaauggaggauaguuuacacccuggcacacucauaccugugauacuuuuugccuauuaaauauaugauuugcucagauuuuaggaaaaaaucauucucugaacuaaaagaaaaaaugggguuaguuuaggcacaugguuuccuuuaaucucuuuggucagcuaaugcuaaaagaaucuuuuguguucuguuaacaggucugugcccagacugggaauccugggacccgcagaagccuguggauaaugcacgagaagccaugcagcaggcagaugacuggcugggugucccacagguaugcacaagugugccagguccugugaggcugcccccacccacuagcuuguucuguggaugccuucccgggucaggcagcccgaccuucuuggcauugagacuucagagagcauugccugugaugcucucucaucuuccucaguuuacccauaauaauaguagguucucauugacucaggugcuuauagaucuuaguguguugguuuaauguagaucauccagaaauuuucaugucacucuucuuugucacacacuggcaaauuuucuaguauuucuucucuaaauauuuugaagacuaccuuuaaaccccagacuacaaauauggacccuaacuauuagguugagccauaagaaauugauaguauuugaccauuuuucaaucuacauuuuaaaagguaauuuuaauccaauagcuuaagaaaagucacaggacuuaaaauuuuuuuuuuuuuuugagauggagucucgcuuugucgcccaggcuggagugcaguggugugaucuccacucacugcaaccucugccucccggguucaagcaauucuccugccucagccuccugaguagcugggauuauaggugcgcaccaccacaccuggcuaauuuuuguauuuuuaguagagacaggguuuuaccauguuggucaggcuagucucgaacuccugaccucgugaucugcccgccucagccucccaaagugcugggauuacaggcgugagccacugugccuggccgacuuaaaacuuuuaaaaacauguaagccaggauaauccaccauuaauggaaacuguggaagaaucucuaucacccauaauccuaucacaggaauauaacaagagaacucagaaaucaaauaagucuuggauaccaucuacaguagucacauugcuuaguugaagucugaucuuccuagcugggaggaaaaccaguguuuucuuuccagaaacucccucuaacaguuaggcaccaugagucccguguccaaaggcuagccagggaagauugcagguagccagugccaugggacugauggcgucacuauaggcugcauugaggucugaguucaguguauuuuguaacagggucccuuggaagguagaacaacaugccuguuucuuugguuugguuuuggagucaugucucuccuacauggcucauugguuucuuggcucguccacccucaggaaguggugugguguguuuuucaucuccgcuuaaaccuaaaccgucuccuuuuuacguucacgugauguuggcaugggugaaguuguugaaggagcugcugggaagaaaugccaaaucgacacacauccuacuuuuuauggaauguauugaaggcgacuguucaaacccaaguagcucuuuuguuccugcaggcuaauggucagaauguuuucuggugcuuuuuaucacauggggagggaaguuggacacaucuguuguucauugcacaugguuaaccugguccaugagacagagccucuguucaucugaggaagugugauuuaccuccuuagcaccauuacuggaggcagggaggacucugcaagcuguuuagggcugggucagaugaugguacugaaacugaggugguggcaccuucagggaagucaccuguccaggaugggucuagucuugcuccuaagcugaauaucaagagaaguucacccauucccuauuuuuuuuuuuuuuuuuugagauggagucuugcucugucacauaggcuggagugcaguggcacgaucucagcucacugcaaccuccgccuccuagguacaagcgauucuccugucucagccucccgaguagcugggacugcagguguaugccaccaugccuggcuaauuuuguauuuuuaguagaaaugggguuucaccauguuggccaggcuugucuugaacuccugaccucgugauccacccaccucggccucccaaagugcugggauuacaggugugagcuacugcgucuggccuuuuuuuuuuuuuuaaagagacagcgucuuacuccucuguuacccaggcuggagugcaguggcaugaucucgguucacugaaaccuccaccugcuggguucaagccauccuccugccucagccucccuaguagcugggauuacaggugucugccaccacacugggcuaauuuuuguauuuuuaguagagacuggguuuuaccauguuggccaggcuugucucgaacuccugaccucaagugauuucucuugucuuggccuccuaaagugaugggauuacagucaugagcuaccacgccuggcuucccuauuuuuuuaauggcuccuaauauauugagaucacauaucuaauauuuacauguuauuucuuuuuuauuuaccuuuuuuaauuaguagaguuaauacagauacagaccaugaguauacaagcaaaggaaaaagcugguuaaccugugcacuuuuuuguaacaugcucuaaucccaugugugcuuguuucuucauuuuccugccuugcuauagcuuauccuuuuaucauuuuugaaauuuugaccagaggaguaaauggacuuuuggggaauggggaggacaaugaacuuuuggaaguuacaugcagaauuuuuuggagaggggccccuagcuuucaaaggggucugcaauuucucaaaaaugguuaaaaacacugauauugguguguugguuuaaaguaauuucacuuaauugagaagcugacucaguuucuuaauauuuguagugcuugguuuaagaggcauuugcaaacacuucaauaguugcaaagugauguguucuggguguucauccaccaugucauuauccuaggucaucacuccugaagaaaucauucacccggauguggacgagcacucaguuaugacuuaccugucccaguuccccaaagccaagcucaagccgggggcuccucucaaacccaaacucaacccgaagaaagccagggccuauggcagaggugagugcugguccucugguguuguauuggagacauguccucugguguuggagaugauuucauggcuucaagagugauguucuuagaaucaaaaauagauagguguaauccucaaagagaccccaagccuccuuuguaacacauuuuaugacuguuuuauucugccuuguuuuucuaaggcuuuaagaaauguuucugcuuagauggaaagggcaaguuugcugcuuggugauuuuagugcaguagcccauugcucccauuuuucagaagaggaaucgcgggguagggagucgggggaguuuggucuugccccagaucaccacagucagugaugggggugggccaucuggcugcugauucauuucuccuucuguuacacuaagccugccucagauuuccagccggagugggagcuauuguuaaccccuggcagauacuuccuugcuaagacauccuguuuaugacugcgaggcagcugcggaacaccguuuugcucagaacauuauaguggguagaagccauuucaaggcauuugguguugugauuggcaccugacuucaagcacacuagcuuugugaagagaacaguuacauggcugcaaagugugguuucuggugaagaucaacauggccagauacaacuuaaugccuuuucuaugggggaggggaaggagugcauuuuauuucucauuuuucauaauuaagaaaauaucggccgggugugaugguucaugccuauaaucucagcacuuugagaggccgaggcgggcagaucaccugaggucaggaguuggagaccagccuggccaacauggugaaacccugucucuacaaaaaauacaaaaauuagccaggcaugguggcgggugccuguaaucccagcuauucaggaggcugaggcaggagaaucgcuugaacccaggaggcagagguugcaucgagccgagaucuugccacugcacuccagccugggugacagagugcgugagccuccgucucaaaaaaaaaaaacgagaaagaaaauguuaucccagugggauaauaguuauacacacaguauucuguauaucuucucccagaauugacaguuguuaccauucuagcuuaauaguuuucucuugcccuuuguguguguuugcauauguguucauguguaugauugcugaauuauuugaaaauaaguugcaagcauggugacaguucuguccucaguacaucacuaagcuucuccuaagaauaggauauccucuagcauaaccacaguauucauugccacauguaagaaaauuaacaauaguuucauauaaucuaauauucaguuuguuguagaauuucucuauuguccuaagauuaucuuuuauaguuguugcuguuuuacaaacuaagaucugauuaagguucacuuacuacauuuguuuguuauuucucuuuagacucuuuucaugcuaaauaauuuccccaaacuuuuuuuuuuuuuuuuuuaaaugacacugacuuucugaauaguuaagggcaugugucuuguaggauguuccuucccuacaaauguucccuuugaauaaaguauuuuccugcuugguaucagcuuagucuuuuuuuuuuuuuuuuuuuuugagagucuugcucugucgcccaggcuggagugcaguggcacgaucucagcucacugcaaccucugccuccuggguucaagcgauccuccugccucagccucccgaguagcugggauuacaggcauccaccaccaugccuggcuaauuuuuguauuuuuaguagagaugggguuucaccauguuggccaggcuggucuccaacuccuggccucaggugaucugcccggcucggccucccaauccgcuuauucuuaagacgacacauggcuagggcagugaugcugaccacgugcuguucucaccucaguggucgagucuucucaucugacuuuuugggcaugauuuagaccggcagauaguucuggaacaaaccccuuaccauuugagguuccguuugcaguggguugugaggugugugagacaucacuuguguuauguagggacuagggacuucaaagcccuccucccauucacagucacuugaaggcuggcauguccucacuuucuuuaaaagugcuuucuuuggccgggcuugguggcucacaccuguaauccuagcacuuuggaggcugaggcaggcagaucacaaggucagaagauugagaccauccuggcuaacaaggugaaaccccaucucuacuaaaaauacaaaaauuagcuuggcguggugguacaagccuguagucccagcuacucgggaggcugaggcaggagaauugcuugaaccugggaggcggagguugcagugagccgagaucgcgccacugcacuccagccugggugacagaacgagacucugucucaaaaaaaaaaaaaaaaaagugcuuucuuuaaggcauaccacaggugguggcuggaaugaggaaucucugacuuuaaagguuaugcuuccuuaaugacaaaacaguugcaaacaaccaauuaaauccuuugucaaccagauuggucaaauggacugaaucuaaucaaggcauaguguauguuuguaauaaccuuaucacuggccauccggcuucccuguuguuaaugugagacgguuuccuuucacggugcuauuuucuagaaaaugaucacuuguuaugguucaggaauguggcuggucauugccauuuccuucaucugccucuuagcaaguguggugcacuuguagaggaaacacacccuuuuaaaaaaaaauuuuuuuuuauaugugugcuuuuugcauuuuuuuaauugugggaaaauauccauaacauaaaauucacuauuuuaaccauuuuuaaguguggcauuaaguguauucacguuguugugcaaccgccacugcuauccaucuccagaacuuuuucaacuucccaaacugaaacuccauacucauuaaacaauagcgccccauucuccccucuccucugcuccugguaaccuuuauucuacucccugucucuaugaauuugcuuauucuagggaccuccuagaagugaaaucauaugcugucuguuagguaccuccuagaaguggaaucauacgcugucuguuagguaccuccuagaaguagaaucauaugcugucuuuuuuucucuggcuuacuucauuugucauauguuuucaggguucaccauguuguagcauguguuagaauuucauuccuuuuuaaggcugaauaauauuccuuuguacguguauaucacauuuugcuuauacauucgucugcugauagacauuuggguuguuacauucuuuuggcuauugugaauaaugcugcuaugaaaacauggguguacaagugcuguuugagacccugcuuucaauucuuuuagggauauacccagaaguggaauugguggaucauaugguaauucuauaugcagcuuauuuuucaggaggaaguggccucacucugcuuuuuaaaguaggagacaaaauggucauauuaggugacagggucacaaggccacauggguggggcugugagauaugucccugucaugugguuagaugaaagccggggucaguuuuggucuucucugugugaccacauugcuucauuucugccaccugagcccaggaagagagaccguuucaucuucuaguuucuaaaagauuugaaaguguuguuuuauuuuuuauuuccugauuguuuaauagaugccaguugccagccaguuagcauuuguugauccauucacugagucccaccuugcuuaguucuaguggguugaaaggagagagggcuggggugagguggaccuccagccacaaacagaucuuuguggugggcuuccuugcaggguuagcuaugugaaaagcauucguccaugagcuaaucagaaaucuuuguaaaaaucuaguucucuaugaagcauuuacuguagagcaauccuuaagcacccuucuaucugaguaaucagagggguaccaguugucuccuuucaugguaagcaaagcuccgcagaaguuuacagaguuggggugugguucaacuuucuaaccagccaugguuagccacgggugaccaacccaagcccagaccuuugacaagcugcagaguacguuguuucuuaggcugcuggagucacacgaaguggaacuuuuaguauuuuaggugcauguuuauuuacuuacuuauuuuuguuguugucguuuucagauagagucucacucucucucucuguguguggagugucgugaugccaucacggcuaacugcagccuugaccuucugggcucaagugauucucccuccucagcuucccuaguaguucggaccacaggugugcaccaccauguccagcuuuuuuuuuuuuuaauauuuuaguuugagaccagccuggccauguugcccaggcuggucucaaaauccugagcucaagcaaucccccugccuuggcccccucaaagugcugggauuacaggcaugagccaccaugcuuggcuauuagguguauguuuaaauccauuugcuuauaucaguuacauaaccugaguguuauguaaaucuuaagcaaaagaaaaauauaugaaauaaaaauugaaacucacuucccaacugccaaucucauuccugccuucaaaguuucagguauuuauuucuagccuuuuuucuaugcugaguuaaacuguguaucuucuuugcuuugcauuucuuacugagcagugugggaaggcuaccuuuuaaaauuuauuuguaguucuuuauaauuuuuaccuuucuuuuuaggcagaaagauuaucuuauuauauaacagucuacggccauuuuuucuuaaacuaaauuauugggaaaugaauagaaauccagaguauaguaacaaaugaccuagugucuuuaacagauugguagcuaggaaaaggaagugguggagagacagccggagauuaaaugagacuuaagagacuuagcaaccauuuguaauaugugaccuuauuuggauccuauucaaacuaaugguuaaaaaaauucaugauagcugggcaugguggcucacgccuguaaucccaguacuuugggaggcugagguggguggaucacgaggucaggagaucgagaccauccuggccaacguggugaaacccccuuuaccaaaaauacaaaaauuagcugggcauggcggcaugugccuguagucccagcuacuugggaggcugaggcaggaaaaucgcuugaaccugggagguggagguugcagugaaccgagauggcgccacugcacuccaggcuggcgacagagcuagacucugucucaaacaaacaaacaaacaaauaaaaauucaugauaaagcagcagcucaaggugcuguaagaaauucaugauauuuauaagauaauugaaaauuugaacacugaauauuugacauuaaggaauuauuuuuuuuuauaugguaucgauauuguggguacuuugcaaguaucuuuuaaggauacauagugauuguggauaaaaaaucugaggucuaggauuugugucaaaauaauacaggaaggggagguggcgggagugaaggugaaacaagaccagcugugaguugauaguuguugaagcuggguacaggagguccacugugcagugcucucuacaucuguguuuguaauucuuuuuuuuuuuugagacggagucucacucugucgcccaggcuggagugcaguggcaugaucucggcccacugcaaccucugcugcccggguucaagcguucuccugccucagccugccaaguagcugggauuacaggcgcccaccaccacacccggcuaauuuuguaguuuuaguagagaugggguuucaccaucuuggccaggcuggucuugaacuccugaccucgugauccaccugccucggccucccgaaguguugggauuacaggugugagccacugcgcccagccuuuuuuuugagacagaguuucgcucuuguugcccaggcuggagugcaauggcacgaucucggcucacugcaaccucugccuccuggauucaaguaauucuccugccucagccucccaaguagcugggauuacaggcaugcaccaccacaccccgccaauuuuguauuuuuaguagagacaagguuacaccauguuggucaggcuggucuugaacugcugaccuugggugaucugcccaccuuggccucgaaagugcugagauuacaggugugaaccacggcgcccagccuuuuuuuuuuuuuuuuuuuuuugcugaaguuucacuucuguuucacagguuggagugcaaugguaugaucuuggcucgcugcaacccccgccucugccuccuggguucaagggauucuccugccucagccucccgaguagcugagauuauaggcaucuaccaucacaccuggcuaauuuuuguauuuuuaguagagacggaguuucaccauguuggccaggcuggucucgaacuccugaccucagguaauccaccugccuuggccucccaaauugcuggaauuacaggugugagccacuguguccagccuaguuuggaauucuucauaauaaaaagcuuuuuaaaaagguaauauuuggacuucugcuccugggaagauggaauaggacuuuuccuaauucuuucuucuaacuacaacuaaaaccccugggcuauacauaaggaaaacacagggagccucugaaaaaggaugaggcagaccaaccagggaucuugggacucgaggaaugacacaguacugaguuccuuggguuuacuuugcuuuauauaucccagacuuggagccaaagaaagaagcugacaaccugaaaaugccagugggcacaaacacagaaagugccaacaaaagcuccccuguccagccagaagaccaggaaagggcagcccagugaggcagaaaacuuaaagagucacugcucuacuccagguccacaccauagaaaaaacuaugcagccccacacuuacacccgcagaggugaauggggagccuaggcuuugacaacagucuagcaauaaggaagccacucuccggggccauggaggagcaguaaugaggcacuccuacuuccuccagccagaacucccaccuucacgcaccaguaaugagccccccaaucuugagcaucagucgagguugaauggagagccuagacuucuucccccacuguuaguaacaagguguguacccuucccuccccugccacagugguaucauaaaaugccagcuacaacagaacauuuacagaagacccagagucucauuacaugauaccccaaauauccaguuucaaaaaaaaaaagaaaucacuugucauaccaagaaccaggaagaucucaaacugaaugaaaaagacaguugaugccaacacugaggugauagagauguuagaauccuaugacaaaaauuuuaaagcagccauuaaaaaaggcuucaguagccaggcgugguggcucacuuugggaggcuuguaaucccaggacuuugggaggccgaggcgggcagaucaccugaggucaggaauucgauaccagccugaccaaccuuaugaaacccagucucuacuaaaaauacaaaaaauuagccaggugagguggugggcaccuguaaucccagcuacucgggaggcugaggcaggagaaucgcuugaaacugggagguggagguugcagugagcugaggucaugccguugcccuccagccugggcaagaagagugagacuccaucucaaaaaaaaaaaaaaaggcuucgguaggcaguuaagaacaaucaugaaaaaaaugaaaaaauuaaaaaucucaacaaagaaauacaaugucccagcaaaauaauaauaaaaauuuaggagauaaaaagaaccaaauggacauuuuagaauuggaaauugcaguaacugaaauaaaaacuuauuggauaagcgcaauagcaggguggaaggacagagaaaagaauccuucaacuggacaacaauugguuguuuuguucugagguggaguuuugcucuugucacccaggcuagaguacaguggagugaucuuggcuuacugcaaccucugccuccuggguucaagcuauucuccugccucagccucccuaguagcugggcuuacaggugcccaccaccacuucuggcuaauuuuuuuauuuuuaguagagacguaguuucacccuguuggccuggcuggucuugaacuccugaccuuaggugauccaccucgguaauccaccuuaggugauccaaagugcugggauuacaggugugagccacuggacccggccucuguaagcuuuuuucuguguuuaaaacuuuucauuuuuguacuuuuaaaacuuuuuuuuuuuuuuaaacacacacauuagucuagacuuacacagggucaggaucaucauuaucacuaucuuccaccuccaaauccugucccacugucccacugguaggucgucaagagcaguaauguguggaaccgccgucuccuauaauaacaaugccuucuucuagaauauuuccugaaggacuugcuugaggcugcuuuacaguuaacuuaauuuuuaaauagaagaugcccacucuaaaauauaaugauaaaaaguauagcauauuaaauacauaaaccaguagcauugucauuuaucaucaaguauuauguauugaacauaauugucugugcuauauauguuucuauggccgguagcccaguggguuuguuuauaccagcaucaucacaaauacaugaguaaugcgaugcguuacugugacgucaguaggcaacaggaauuuuuuggcucuauuuauaaucuuacgggaccaucauuguauguguggacuauuuuugacugaaacuucauuauuuagcaaaugacuauauuagcaaauaaaauugagcuguauauaaugaagaaguaugcauuauaaccaagugggguuuauugcagggaugcaaggccucguucacuauuagaaaaucagucaacagccuggcucgguggcucacgccuguaaucccagcacuuugggaggccgaggugggcgaugggcggaucaugaggucaggagaucaagaccauccuggcuaacacggugaaacccugucucuacuaaaaauacaaaaaauuagcugggcgugguggugggugccuguagucccagcuacucgggaggcugaggcaggagaauggcaugaacccgggaggcagagcuugcagugagccaagauugugccaccgcacuguagccugggcgacagagcgagacuccgucucaaaaaaaaaaaaaaaaagucaaauaguaaagauaccaccucuccucaaauugucauucagguuugaugcaauugcugucaaaaucccagcaagaguuuuugcagauagcaagauuauuauuuuaaaaccuauaugaaaaggcaaaggaauuaaaguagcaaaaacaauuuugagaaagaaguacaacauggaggaaucagccuuccugauuucaagacuugcuguauagcuacagaaguccagauuuuguaguauuggucaaaggauagacauuauagaucagugaaacagaauugcagccccacacaaauaugcacaacugauuauugacaaaggugcaaagauaagucauugggggaaaaaaccuuuucggcacaugguggcagagaaauugaacaucccuaggcaaaacaaaacaaaagcaaaccccaaaccaaaaaacaaaaaacccauauaacuauaaaacuuugagaaaaaaacauagaagagaaucuuugagaucuagagcuaggcaaauaguucucagauuugacaccaaaaacaugauccauuaaaaaaaaauaaguuggauuucaucaaaauuaaaaacuuuuuaauguuuuaagaaggauggucugucucaaagacucaacaugguacauggugguuggccuuuaugugcuguugaggguuuuccugcauugaagggugcacuccugggucaccuacuguccugcaagacaagcugucuuagcccucacacuauaaaagccacccggacaccgucucaaacagaacucaaaauguugcugagacugggaucugggggcuggauuuuacuuuuacaaacaauuuaaaacuuuuuacaguuaagaggaugaauauacaggcuaaagacugggagaaaaaauuugcaaaccauauguccaacagaacacuaguaucuagaacauguagaaagaacucucaagucuuagucguuaaaaaacagacaaacauuuaaccaaacaacccaauaagaaaaugggcaaaagacauaaacaguuucugcugaagagaacguccauaugacaaaaaaacacaucgaaauuuguucaguaucauuaaccaugagaaaaaugcgaauuaauccuaguacacacuaucagaacggcuaaaauaaaaaauauuaauacugauaacacuaaaugcagaacggauggagagaaacugaaucuggaucacucacucauacauugcuggugggaauguaaaaugguguagcuacuuuggaacacuguuugguaguuucuuaauaaagaaauaggcugggcacagugacucccuucuguaaucccagcacuuugggaggcugaggcuggaggaucacuugagcccaggaguuugagaccagccugggcaacauagggagauugcaucucuacaaauaauuuuuaaaaauuauacagguguggugguaugcaccuguggucccagcuacucaggagauugaggcaggaggauugccugagccugggaggucgagguugcagugagccguaauugugccacugugcuccagccugggcuacagagugagacuuggucucaaaacaaaaacaaaaacaaaaccucaaaaaacaguacaugcaacuaccauauggcccaacaauugcacuccuuggcauuuaucccagaggaaugaaaacuuacuguauaugagagccacuguuuuuccuucuauagucucacagcuaaagaaaaaaaacuuuucucaucuucucuacuacuccucucaguauuucgcuuccggucaccaaaaucuauggauuucugucccccauacugacaaguucuccaauuuuauguggacaacaaguagguguccuauaaucaauucccuucaauucugacacuaucuaccugaaguuagugcagacgccauuaagggcucggucccucaaaacugccccugacuucagaggccagucagaagugguggguccucagguaacccacagcuucuguccagguuugcuacaaaucagaaggucccauuaccccuuccucauguuauguuauuugcuagaguggcucacagaacucagggaaacacuuaccuuuagcaguuguguagugaaggauaugauagaggauacagaugaugccccagaugaagaggugcacggggcaaaguuuagaggcguuuugaacacaggagcgucuguccccaugaaguuggggugggccauccucuuggcacauggauguguucaccaacccagaagcucucuaaacuccauacuucagggauguggaggcuaagucacguaggcgugauugacauuaacugagacuacaguuccucucccuucccuguaggauggggaguggggccgaaaguucuaagcuucugaucaugacuuggucuuucuguugauuagccacaucuugaaagcuauccgggagcccacuaagaguugccugauuagaacagaagaugcucuugucaccaaggacauuccaagggguuuaggaacucuggaaccaggggcagagaccuauauauauaauuucuuacuauuuuauacuuauguucacacacacacacacacacacacacaccccuaugcacagauguuuacagcagcuuuauugguaagagacaacuagaaacaacccagauguucuucagugggcgaaugguuaaacugugguacaucuauaccauggaauauuagcuacucagcaauaaaaaggaaaaaaaccauugacagaagcaacaaccugggugaaccuguagacaauuauauguagugaaaaaggccacuccuaaaagguuacauaguuaugauuccauugaugugacguuaccgaaauaauaaaauuacaguguggagaacggguuagugguuaucagggcuaaggagagugugggugugguuaugcaagggcagcaggagggcucccugugcuaaagggaauguucucuauuuugauuguaucaacgucaauacccugguugugagauugagucauagcuuuuuaccguguuaccacuggggaaacuauuuugagauggagucaugcucugccgccuaggaugcgaucugggcucacugcaaccuccaccucccugguucaagcaauucuccugccucagccucccaaguagcugggauuacaggcaugugccaccacguuguauuuuuaguagagacaggguuucaccauguuggccaggcuggucuugaacgccugacuucaggugauccaccugccucagccucccaaagugcugggauuacaggcaugagccaccgcucccagcaagggcauuguuucuuacaccuacagguaaaaucugucucgaugaauuugcucgaucaucuuaaaauaaaaagguuaauuaaaaaaaugauugaauauaauuuuuaaaaaugucaggcaauacaauaaaugcuguuuaaugagaaauaagcuucgcuccucccugcuguguugcuuccaucaaggcaagcucugcuacuacuuauuaaccacauuauuuccacaauuuuauauagacuccugacugagguucucugaauaucaaaauuggauauuacuucaauaacaugggcaaaauuaaggcuuucgaccugccugauuuuccuugucaaggcaguuuguccccauuucccacaugggaucugcagggcugggucccaucucucaguucccugaaagagaugcagugggcgauggcucaugacacacccucgccuggcuucuaacaugucuguguaaaccuguggcaggaaucgagcccacuggaaacauggugaagcagccagccaaguucacuguggacaccaucagcgccgggcaaggagacgugaugguguuuguugaggacccagaagggaacaaagaggagguauguuggaggaugcugccucuccuuuccagcaccucauggagcuuuuggggcuuguaaugcggccagggacugugccuccauuuucauuucagcucacaaccaaaaguguuuuuuaccaaaaggauacugaggcuuauagcuguuaaaguaaccugcccaagaggugagccuugaaaucaaauuuaaauugauugccagggacacaguguuuaaugaaauaaaggauacuuuggauuuagcaaaggugccuugucaguugagguuuauguauguauuuauuuauuuauuuauuuauuuauugagacagaguuucacuccuguugcccggguuggagugcaguggcacaaucuuggcucacggcaacauucaccuacuggguucaggcgauucuccugccucagcccggcuaauuuuuguaacccaaguaacugggauuacagggaccugccaccacgccuggcuaauuuuuguauuuuuaguagagacaggguuucaccacauuggccaggcuggucuugaacuccugaccucaggugauccaccugccucugccucccaaacugcugggauuacaggugugagccaccgugcccagccucaguugagguuuuauauacugauggccagaauaauaagagucuugcccugcucucuucccacauuggccauucuuugguuccucccucagagccuuugcacaugcuguucuuucugucacuuauuuucguaggaccauauuuuauucuuggcauuuagcauaauuugcaauucuaaguuuacagauggaugguccauuucccccaccggggcagggauuguaucugacuugcucauguuuuauuuuuaguaccuaacacugggcccugcauuucauaagcuuucaaugaacuauugaguggauaaagguuuaaguuucuugcuucauauucucucuuaccuagagagugccagccugacacuggacacuggagaguccugacucuguuaugccucugugcugcaugguuuuguuucugugacuucaagcaguuucucucuaggggcguugugcaagagggacaggagcucgccagcaccuucaguguuuccgaccuggcagcuccugcagaaccccugcugacacagcaugcuccuuacucacacccggcaccuuuucuaacuguugcccaccuucccuccuaggcacaagugaccccugacagugacaagaacaagacauacucuguggaguaucugcccaaggucaccgggcuacacaaaguaagaugaagcagcauggcuguggcuugggcugcucuggggcuaggagaagaaagauagcccaggaagaagaguguuuuucuuaagugaauuucugauuuuccuuucugauuauagaaggaucuaugcucaugauagaaaauuggaaucacuaggauucccucuacuagcuaggaugaguuguuugcaaugucguaagauuuuuccaacuccaucuagguaacuaaugguugcagcugugugucuggaguguagaugcuguggugacuacacuauagauggguucuuuguccuugauucuuuuuuuggagacagggucuugcucugucacccaagcuggagugcagugguguggucucagcucacugcaacccccgccuccugggcucaagcgauccucucaccucagccucccaaguaggugggauuauaggcacccacaaccacucccagcuaauuuuugcauuuuuaguagagaccagguuucaccaggucaccuagacuguucuugaacuccugaccucaaacuauccuccugccucagccucccaaagugcugggauuauagacaugagccaccacacccugcuggcucuuuguccuuaaugcuuucuuaagaacucuccuuggaggugcucuggaggagcugucagcauugaaggcugaggauggaguaguucagcugaauauaguagagggaaauggcccucucagcaccuggagaaaugauagggauugaggccucaggcucuuugucuuggcagccuuucgaguucuguuugagaugacauccaggugaccuauagggcaagggcugagagagccugucuugcaggagaguggggugacccaggaguacacuuuucauuggaagaaagcccucaacagcacauaaaggccaaucccaucauguaccugcccagacuuuggaauacagacuguacucaccaccuugggcuuuagugaauucaccuggaaugauggccuuagcguucucuuagacucuuagacuaugaugcauuuggaguaaaugcucuugaagggagcauuuauaauguaauuaauuaauuccagucaaguauagguucacaugaaacccaacccaauuaccccccaaaaauuucagagaugagaacagugacucaaguuuuagauggaaaucauucuacuuugucccaaauccauguaucuaagaaugauuuucgucccuugaaaaaacaguuuggcuguggauuugaaauccuggaacugcauauuuuauucugagggauaguggcccauucagcccccgaaaggacucaauguccagagauugaaauguguuuguuuccuauuaaagagacuaaguguauauaaggucagcauuuuuauuuugcuaaaggugugaugucccagacccagcuguauggcugaaggggccaggugggagucccauucaggcuguuaaacuugguuccagggcuccuuauucuagacaccuugugugugccaucaugggaggguaggagaggugaucaucaauguauguggcuugaugucagucuugcugggcacagagaagugauuauguauuucucaccuaucugucaccuauaggucacaguccucuuugcaggacagcacaucuccaagagcccauuugaagugaguguugacaaggcccagggagaugccaguaaagucacugcaaaagguccaggguuggaagcuguagggaacaucgccaauaagcccaccuacuuugacaucuauacggcagguaacgugccucuccuccauggaucugaccuuugcgcuuucuuccagaggcugaaauauaauccucggggacuugaaggccugaccuuuugucuuuuaaaucaaauaaauaaucacaaagacaauuuuuucaaauguguuauauuagauuuuucaaaaccagcuuuucuucucuaaaauacucaggcuucacuugaauaagacauacuucuugaauuguuggcuucuuuuccauguaguaaauagaaaaugcagaagaaggaaacauucaaccauaaacccuucaaccccuagaaaauaguuguuaacaucuugguguggaccucucugagggccugucuccuguuuacuuguuuuguuguuguuguugggggaacagagaaucacucuauugcccagacuggagugcaguggcgugaucuuggcucaacgcaaccuccgccuccuggguucaagcgauucucauacaucagccucucaaguagcugggauuacaggcgugcgccaccaugcuuggcuaauuuuuguauuuuuuuuaguagagacggauuucaccauguuggccaggcuggucucgaaauccugaccucaagugaucuacccaccucggccucucgaagugcugggauuacaagcaugagccaccacacugguccuguuugcauuuugcacucagcagcagugagcuuucagagagggugacuugggcucauggaaugcuugcuuucuuguaggagcuggugugggugacauugguguggagguggaagauccccaggggaagaacaccguggaguugcucguggaagacaaaggaaaccagguguaucgauguguguacaaacccaugcagccuggcccucacguggucaagaucuucuuugcuggggacacuauuccuaagagucccuucguugugcagguuggggaaggugagugcugggcugcuggccacaugugcuucucauagggaagcugacugcacagcugggcagggaggccaggaaaacagucagggcccaacauugaccuuaugccuaucccuuuucugccagggcuacuucagcaguaaguggcuuacuuuguccucaauauauuaauauuaauaucuucuaugagccacgcagagaccuaaaugcuuugcuuauauuaacucauuuacuucucuccaaaacacauguacaggagaguaauuauccucauggagggaggugggacugaggcagugggaggacucgguagcauaacugaaguuagcagcagcaacaugggcccugcagccuccauugcuuggccuuuacuggcccaggcacuuaccaugacugcaucuaaucauugcaccagccuguguguugcaggugcuauuauuaucccuagcuugcagguggagaugcugaggcuuagauagcguuagguaucaguacuacaaggcaucagcagggcuagaaccacagacucuguuggccuuacccuuaacuacucugcuaaacucccucuggcgcuggggguacgcauuuuucucaaauguuagacucucucccucugacuuuguugccccuuuuuuucuguuuuguuuuguuuuguuuuguuuuccaacuguacuaccuuuucuaacccacacuugccuuucccuguucuguccucugaaucugcgucugcagacguggcuuccucuuccgaauccuaccucugggccagccuggacccugaagcuguuggcuuccuaguugagaccacugggccagaggccucuugcuugguaagggcugguugggugggacuuccuugccaguucuuugugcugcuugugaauguuagcugggcccguguucugugugauuuuaggaaacucugugcagguguuauuauuacagccuguccagccggaacccaaacccacugucuaauugccuuuaaacacaucuagggcuuuuuuagauggugaaggagcugguggugcccuucagacucuagccccauuuaauguuuauaugaacucagcaauuacucuuuugauguugagacuguugcacauguucauaauuuccaugaguguguguguguuucuuaagacacauuaaagcccuccgaggaaguccugucauuguauugugacugacuucugguaugaccaacuuuucuccccuugacaaagaaaaaacaggcaaaaaaaauucuaacauauuccuaagcaaagcucuuuuuuacauaagagagcauuuugaauagcuuuccuaauucuacuauuguuuuccaaccuuuccucacucguggacuuccuuuuucuuuucuggccuguacauccuauacuauuuagcauuuaaugaauaaccuuuuucuuuuaauuuacuaacauccucucucccaccuaaaugauuuuacauauguaaaaaaaaaauauauauauauuugcaggggcgcggugggaaggauacagggucucacucugucuuuugggcuggagugcagugguaccaucauggcucacuuguagccucgaccucccaggcucaaaugauccucccacuucagccucuugaguagcuaagacuguagaugugcgccaccaugccugguuacauuuuuuacccuuuuuuuuucuuuuucuuuuucuuuuuuuuuuuguuuuguuuuguuuugagacagagucucacucucucacccaugcuggagugugguggugugaucuuggcucacugcagcuucugcuucccugguucaagugauucuugccucagccaccugaguagcugggacuacaggugcacaccaccacgccuggcuaaguuuuuuuguacuuuuagcagacacaggguuucacuauguuggccaggcuggucucgaacuccugaugucaagugauccaccugccucggccucccaaaaugcuggguuuacaggcauaagccaccaugccugaccuaauuuuucuuuuuuuuguagagguggggucucacucuguuguccagacuggucuuaaaccccuggacucaagcaaucuccccgccucagccucccaaagugcuggguuuacagauguaaauuauuuuauguuaaaagaaacuuuauaucacuuucacaauggaaaaccaaagucacuugccauaaagugccaccguaagcuuauguucauccauaaaccaucuaaaaucaucucuaacuccaaggguauguguaugacucuuugggaagcaguuguuugccaaauagccagcuaaggccauugcaggaaggaggaaccagaggaggaauuaccuuccgucuguggaguagagucccgucuucuggagucugugaccuuccuguauagagauuugucaaauuuucaguguuagauuuggaaaggaaaagccacuuaauaacaugacauuuuccccacuagucucccguuucuauuuacugaaaagguuguccgugcugggcagaagauuuauucuagggcauaaagguaucuuuuaucaaccucuagauaccauggaacaguaguucuguggacauuucaaguaaggcauauuggaagcuaucuucgcccuuaacuuuuagacuuacaacucuagguuuucaagcuagacccggaaaugaaaucagcaaugguguuuacugcuaauuauugccuuuauagccacccacauucugaaggccuuguaacagacagcacgaaaagauuggucugccucagccaagguggggcugaacuggucucuuuccaagcuguguugguuguuuuugccugguuguucaggcggaagacaacaacauuuagacacuuaaaaauggcugacccagguuuuggaacccagacaggcauuuucaaguacugcauuuuccaagaagacuugaaaaaguccagucuauccaauuacugagcccuugaguauggcagugagguuugaauaauguccagcacucggccuuaacucccuuucacaaaugaaagguuaaaugcuggaagcaggagcacagcauggauuugcugugcucuccuguuuucuuugccaaagucacuuuucuccaguccuucuguggugucacuggacaaaguuauauugugucuguauuugcuagccuggugugcucccugagugggaccccuggucuugggcaacuacugcauacuauuugugcaaagcaaauauuuucuuggcggguggcuccagguuaccuuggcuuucacgacucugacuaaagaaugaaagauugaauugaugucaaaacugugcuugcagccugcaauccaaaugccugccgggccaguggccgaggccuacaacccaaaggcguccguauccgggagaccacagauuucaagguugacaccaaagcugcaggaaguggggagcucgguguaaccaugaaggguccuaguaaguguuccuuuguuucucuaucucaggugugguuuuggcuaacuuugcagccauggcauauggauuucaucccacggccaguuguccucaauaaucccagaaggcuaugucaaggauuugaggcuaucugggcuccuuggggaagacggcagugauugauuaguaaugucugcccuggaugcggccaguggguggcuugacagcuuuacauuacaucaagacuucugggaguagaaaaagcagugauguaaaggaguuggggaaaugcugcuguuggaacaaguggcucauuuuuuauuuuagacaucugggcucagagaggaaggcucuugccuaaggucauacagcguuuguaaucaucugagcuggaauucaagcacagucuccaaagccagugauuuucccacuacagguuacauuuuauagaguaugaaauuaugucaaguacuuaauuacuaugaucagugcuuauagaaggagaauaaaauucccuaagauuaaguuuucuuuguagauaaaugccauuuguggagguacagguuaaacccugcaacccauucucucucccucuuuuggggaaggagacagcagauguggggaugggugucuucacuuuuuucguuggaacagagaagcauuucagcacuucuagucucggguguagcagccuuuggugguuuuacucccaugccuguggaaucuugagcuuccuguaccaggauugcucuuaccuucuguguucccaacaggcuggggcaggagcauucugagcuccagaaaguuaauauuugacuucacagcaccaggcuuugggucaggcugugcccugaggguagccgagguucuagacugcccagaccuggagucaagcugcuuggggacugucuucccucccagauuauuccaacaggagccaaggagggugugugugugugugugugugugugugugcacgcgcgugcaugccucugcguaugugugcguacguguguguuuucuccugaccuugaauacuugcuugacucaacggcuuuccuggccaaaccucagggcucaacacaaaacaaguuccugccugauggcuggguuuggaguuugcagcgucacaucuaaaaccuguccucuugcagauagcgucugaggacuuucuugcuuuuguuguccagcuuuagauggaaaaguauacgcuggaacacugaaccuaaaacucauaccaaauacuucuaaagguuuacuucuuccccaguuuuugugggggacuaggaaggguagcuaugauuauugggaaauacugaaaugugacuggauuuaucuuuaugcaggcccagggaguucaggaccucagggccccucguagccaagcaagauuucuaaagccaauuagcugggaaauccuccauuuccucauaccuugaagcagagauggcuguguuuuuagcuuugaaauaaucucccaggcuuugaggggagaggucccauacucuggggcagcccacuugguuuuuauguaugguuuauguuuuguucaguguggcugccucucuguucuuguccuuuugauucucauuuugggccuaggauuguguuggaaagauuaucuccuuccuucccacagagggucuggaggagcuggugaagcagaaagacuuucuggauggggucuacgcauucgaguauuaccccagcaccccggggagauacagcauugccaucacaugggggggacaccacauuccaaagaggugaggcuccugcugcagaggggucuucucuggagggugcucggcccagggcggacucauggguaguugcuucccgggcugcaggagggaaagagaucugcuuuguugaaaacuuuuuuuuuuuuuuuuucggagcagcacagacauuuggccuguucucaaaagcagcagaaaguugcugugguuuuagcugacuugcuuuaaaucaaaugcuggugguuaggggcuggugggaggcaggggaggcagaaggagcaguuagagcaaaugggcugugugucuagaugcccgcauauaaacugagauucucuuuuucaaugaacuccuuuguucaugaaugccacggggcagaaucugcugugguuuacauuaagaccgucuacgugagugcugucaggggccaagggacgcagucuacagcuuugccuugugggcauugcacuugccccucugcguucuguguuuuccagcuccccuggaggugcaacuuuaaacuccgaauaaauucaguuagccuugagaaauauuugggcauuauuggguuccgaauaccuaccacgcuuuuuuuuuuaagccucccaugccaagguuacagcacauucauucauguaugagauaaagcccauucaaccaaguuuucugguuauagcauaagcaggauauaguguguggacucucucacuuuccagggucauagucuggggaggccugcacacaaagguaaagggccaggaggcuggugcaaagcagcguggcuugagugccaacccaguggccaccugagcucccagaagcagucacauuacauuauauuguugacauaacaguagcuaugggugagaggccugcaggaggaagggcuuggcugcaguuugggaugccagaugaaaggaucaggcaaguggaaagaaugugcaaaggaacugcagcuuauggcuauagugacaccuuacuuuacucuucuuugaugcuucuucuauuccuuucccuguagccccuuugaaguucaaguuggcccugaagcggguaugcagaaaguccgugcuuggggcccugggcuccauggugggauugucgggcggucagcggacuucgugguagaauccauuggcucugaaguggggucucuggguaaguggacacagcugaccagcaucuucuggaggacugaggauuacagggcuuccgggcugugucaggcuggauguuggggccuugccuagccucaauaccuuuagcuuccuggccuccuggccacccuaagccaucucugcgugcugcuguacauuugcaguugccucugauaccagcauugauucauucaggagaccuugagggcagaaaccuuauguggguauugugccuaaaacaaugcuuggaacguaguaaacacuuagcaaauaguguugacugaccuuuauaguuuagaugaaugaaugaaugaauuuugcugaaauuuggauuuggaagauaaauauuuccuuuggagcacagcugaaguauauuuuaaauacaugucuaauguauauaugaucauuuuauaucaggagucagccagcuuuuucuauaaaaggccagauggcaaauauuuuccaccugugggccuuauggucucugucacaguuauuugacucugccguuguagccugaaagcagcuauaggaauacguaaacaaacguguguggccauguuccaguaaaacuuuauuugcaaaaguaagcaaugggccagauguggccuucagacugucguuuagcaacccguuuuagguaauagcaauaagcaaaagagaaaaauaagaaaucacauuuaauuuucccuucuagagagaugauaugaaucgucuuguauauucuuagucuagagauaauauuaagucuuuuaguguauccuucuagacuuuuuucucuauauaugcaugcaaauauugauuugguacagaaaauaucuuagacaagucuuuauaucuuuaugcguaaauauaggguaugccuucauuuuccauagcuuccauggaauuccauuguauggcucuauccauugucaggcucuucaguuauuuccaggguuuugcuauaaaaacagugcugacuguguauccuugguaauugccuucagauaaaaacccagaaguggauuugguggugcuaagaguggguguugguucaaggcuuuugccacauguugccacaucuccaacagaaggguuugcugguuggacuuccccuguuggaugaugauaaaauacauauaauguauuuaauacuauauauauauauauauauauauauccuccuggccucaagugauccaccugccucggcccucccaaagugcugggaugacaggugugagccaccacacccagcccaggccuacauuugaaaaaaaaaaaauauauauauauuuuccaccccuuccaucucuacugaagacuuaaugagcuugguuuuggaagaaagggauacaaacagauuucaaucuucuggccaacacuuggcuuuuagggaggcagcgggaaugagcugucguaacauagaauaggugcuuuccaccauauaaccagggagacccuuccaccuccacccccuaggguuugccauugaaggccccucucaggcaaagauugaguacaacgaccagaaugauggaucgugugaugucaaauacuggcccaaggagccuggcgaauaugcuguucacaucaugugugacgacgaagacaucaaggacagcccguacauggccuucauccacccagccacgggaggcuacaacccugaucuggugaaucagcugcugugcuucugucuucuugucccuggccccugguuccucacccccaugcccgaaguugccuuaagcagcauguugagagauggcagagaggaaucauuuggauuuuaggaaggaaacaggccugcauuuguuuguuuguuuguuuguuuguuuguuuguuuugagacagacucuugcucugucgcccaggcugggguacgguggcaugaucacagcucacuggaaccucugccuccuggguucaagugauucucgugccuuagccucccaaguagcuggaacuacaggcaugugccaccacagcuggcuaaucuuuguauuguuuaguagagaugggguuucaccauguuggccaggcuggucucgaacuccuggccucaagugauccacccgccucggcccucccaaagugcugggauuacaggugugagccuccacacccagcccaggccuacauuugaauccugguaguagcacuuagcacuuuuauaguguugggcaaguaacuuaccuaucugacucuuggugucuuccucuauaagacaggaaugauaguagucucugcuucuagagagcuucuaggaugauucaggagguggcaugcauaaagaccgccuuuggcuuaugccuggcccaugcagggagcuccauaagcuguuauuuucuugcaacuccggggaucauaugucagucuuacagccauuuucuauaguuauuauuucaaggugcuccauagauaaaggauuuuuuuuuccuaguuccgugucucuuaaguuggagcaauguuuccaagaguguccucucaaacccuuagcaggcugauaagcaucaagucugagccagccuggcugacagggaguuggccccagaggccacgugugcuacuguuggcccacacgggcagcuguccauaggcugaugucagucugggcugguagcuaccccguuuuggccaaaugauauuccuuugcccucuagggcaaauguuguccgugguaaagauucugaguccccucaaagugggaacguugaaacugggcaugacuagaggucucugccccaguuguuagaaguucuuuaggucaacucagaauaaggcagggagcauggguuaguuugggcaugguuuuagaacagggguuuccaauauuuugccuucccugggccacacuggaaggagaagaauugucuugggccacacauaaaauacuaaugauagccgaugaacaaaaacaaaaacaaaaaaaaaauugcaaaaaauuuuauaacauuuuaagaaaguuuacaaauuuguguugggcugcauucaaagccauccugggccgcaugcgggcuucaggccguggguuggauuuguuuagagaguuuucucccuuaugagggagagacauuuguuuuuaaguuacaaccuacuuuagcacuuuacuucccauaaccaaccucuuauguggauacuguaaaaccagacacaggucauuuuguucuucccccacccccugguuaccugucuuuguauaaggguuuaguuggggcauuacacagaaagagacuuacuaucugccuuugcuucagguucgagcauacgggccagguuuggagaaaucuggaugcauugucaacaaccuggccgaguucacuguggauccuaaggaugcuggaaaagcucccuuaaagauauuugcucagguaaauuucagggggccaccugugcagguaauugucagguaacaagaucugaccacguaauggcaaguugcugaguccaucugaucuucaguuuccucaucugcaccguggaaaugauaagaagauuaucuuauaggguuaugugaggguucagugagacuaccauguagaguacugggcuuuaaaaaaaucagcuuucugauuuauauucuguggaaaugaggcuuguuuguuucagguuauucuauaaugucuuuugguguggcugaagcugcugaggccauggggggagauuuguaaacaaggauuuaaaaaguauguuuauuuaaucuaauugaauuuggccaaaggacuuaaaugcaggaauugaguggccaaagcuuuguuuuugggucacuugcucuuaauaacuaaaaauaaauaaaugcaugucauauuuugucacugguugucaccguguugugaaaauauggcacauuguaguugguccaugaaguuuuguuguauaagcaaguggugacuuggcugucuugggaggccacagugacccugucugauagagacagugugagggccaccucugguccuagcucuggcuuuuuugcaggauggggaaggccaacgcauugacauccagaugaagaaccggauggacggcacauaugcaugcucauacaccccggugaaggccaucaagcacaccauugcuguggucuggggaggcgugaacaucccgcacagccccuacaggguagguugugaggcagaauccuggcuguuuuauggaaaugccuggucauacaccaggucugggauccaugccugacagccaaggcagacauauggaaggaacccaucccuggugggccuugaaugauggaggggcccgaagggcagagugcuccagccugcucagaagaacuauuucuaacaauguuuuuuaauaguauuuuacuggguccaaguggaggagaacuugaugaccuucuccaugucuucucuaggucaacaucgggcaagguagccauccucagaaggucaaaguguuugggccagguguggagagaaguggucugaaggcaaaugaaccuacacacuucacgguggacuguacugaggcuggggaaggugagaaagggcuuuguucaacccagugaucauugcuccguggggaaggcaguucuuuucauaacguuucaaugccuuuugaacuaggaaguaguccaucugaauagguaaucaucuacugagccucugagucauuccuuagugauaucuuugcuaauccaucaucccuuuccccaaauccuuacucuuucucagguuucuuacuagaaacuucccaauugcuuuuugaggguguuaaccugagcuggaagagauugcacaggacaugcuguuucuuguaagcuggugcuaauaagcuggucuguuccaggugaugucaguguuggcauuaagugugaugcccggguguuaagugaagaugaggaagacguggauuuugacauuauucacaaugccaaugauacguucacagucaaauaugugccuccugcugcugggcgauacacuaucaaaguucucuuugcaucucagguacgugguggggccugggaggagauggguggaguaggccuggauucucuuuggccacuugugugcaugucucaucuacuuuuugguguuuuguuaguauuauuauuuuugagauggagucucacucuuucacccaagcuagagugcaguggugugaucuuggcucacugcaaccucugccucccagguucaagugauccucccaccucagccucccaaguagcuggggacuacaggcucauaccaccacccagcuaauuuuuuuuuaauuuguuuuuauuuuuuuauuuuuuuuuugagauggaguuuugcucuuguugcccaagcuggagugcaauggcaugaucuuggcucacugcaaccucugccucccggguucaagugauucuccugccucagccucccaaguagcugggauuacaggccaccacgccuggcuaauuuuuuuguauuuuuauagaaaugggguuucaccauguuagccaggcuggucucaaacuucugaccucagaugauacgccugccuuggccucccaaagugcugggauucuaggugugagccaccgugccuggccacucagcuaauuguuuugcauuuuuaguagagacgguugcccagacugcucucgagcuccugaccucaggcccaccuggccucccaaaguguugggauuauaggcaugagccaccacauuuggccuccuuuuugguguuuuacugacagggaaguugucuugagaacacugcucaaucguuuucucucuggcuccuuacaaccaagaaggaaaaaaaauuuacccagagcuaaauuauuaccacuuucuaacaaaagugaggcaguguguucagugguuaaaagcaggggucuggagagagacuaguuuguaauaaauuuucaucaauauuuugguugaaaugcaguuagcuucuagauauguucuacuuugaugccuuugaagcaaugacuguggucuccacccuuaaauuuuuauagagagaggugauuugaaguuucagguaugcaauagugaagauagggugagcaggauccugaaagagagaauuuugaaauccuagggauuaaaauuaaccuuacauaaaaauggaaaucuuaguagaauguucugugccuaaagguaguggucuugacauccauuuaaccucuucugccuuuauuccaauagucugcaacauucuuuuugaagaauuauaaucauucugucucugaucacuucuugcauuuccccagaccuuagcucucagcugucccuggaggacauuuccuucccccagccccauguauuauugucguuuuugguuuuauucuuguuggcauuuuucauccugaguacucaacauucaguauuaaaggcucaaaguccucggguuuguuugugacaucagggauccaggcauuagagagugaccuguuauagaaggcccuuucccaaugcugggcccuuuuggcuuaucuuacccuucuguuuaccugugguaauagaagucugcucaccacucgcuaagucagagugaugcuaagguucacccuuuguugaaggcucccugagcucuggcuguugcuucaggggcuuuccuacuaagacugugucucugcuacaggaaauccccgccagcccuuucagagucaaaguugacccuucccacgaugccagcaaagugaaggcagaaggcccagggcucagcaaagcagguaagauggcacgucuagguuguccugggccccucugccagccgguggcacugggcguguuucauccacggccuugaggaacuucaucuccaccaacaccaacaccaagcuggcagguuuucugugcagcucugaugcagcaguggcuggccaggcccguugcuggcugucauaauagaccuggugcuguugaaccugucugacggguucucaaagugaaacuacuccagcuggucugucuccucacuucacaguauaucuuuccagguguggaaaaugggaaaccgacccacuucacugucuacaccaagggggcugggaaagccccgcucaacgugcaguucaacagcccucuuccuggcgaugcagugaaggauuuggauaucaucgauaauuaugacuacucucacacgguuaaauauacacccacccaacagguaggguccuucuccccucugcuccccuggcccccagccaggccccuuucuaugcagucggugcugggucacuguggacaccaaggggugugagaggugcucugccaaagugcucccugaugggaggcagcuccuggcacuuugaaccccucugggagcaccuauaggaagcccaauggguucuaucaggugaacugcagaauuccccaaaagcaagcaggaagcuggucccauaucuccaccuuugguuugcauuuuaucagagaaaugcucaguucuugauauucaggcccuaauaucuaucuuucuguuacacaugugcacacaugugcacacacacacacauacacacacacacgugcauucccucgcggccucaccagcugccuuuuagucuuuucauuaauuacccacagaaaaagagcugcuacaccuuuguguuuccuuccugguccuuuuagcuuaguuuacccuuuuuaugagguguuggaaugaggucuuuucucaaagagccaguucagccuuucgucccuaaggcccagcacacuauuuagggcagcaaauuauuccccuuuacaaaaugcaggauuucacaugugaucuuaccaucuaggcuggcuuacucugauuauuucaggccauaagggccuuaaaacugccucucuguacaaguuaauguuuauuuguuuaaaaacauuaaaaaaaauuuguaucgugguaaaauacacauaacacaaaauuuaccgucuuaaccauuuuuaaguguauaguucauuaguguuaagugcauucauuaugucgugcacccaucaccaccauccaucuccauaauucuuuacaucuuguaaaacugaagcccuguauccauuauauuuguuuaaaauuuuguuucgcuucauguucacaccucuggggucuggagagcagacauccuggcagaaaagucuggauuuuaauacuuaagccuaguguucgaagugguuguuccaagccucugagauuccuuuauucuuaagggaaaugauccugcuguguuugaaaugccauuuguaggagaagaagggcaacgcuuucugcagaagcacugcucagaagccuugcucccgucuggguccucucagcgaggagcagucaagagucaaguggggaagaaagaggauuauagugaggaaggggucaugguguaacuguccccugaguuugggggcugcacucccuuggagauggaauccuuacugugagaacaucccugcagugggagggauucccugggcgaagggauucugugugucguguuauaaauguggccccuuacauccaggcuugcugcuguuugugcuuucuuccccaaauuuuuauuuuuauuuauuuauuuuuuagacaaaagucuugcucuguugcccaagcuggagugcaguggcaugaucucagcucacugcaaccucugccucccagguucaagcgauucuccugccucagccucccgagcaggugggauuacaggcacaugccaccacaccuggcuaauuuuuguauuuuugguagagacgggguuucgccauguuggccaggcuggucuccaacuccugggcugaggcaauccuuucaccucagccuccaaaccugcggauauuacaggcaugagccacugcgccugaccucaguauuugucuuuuugugacugauuuauuuuucuuccuauauguccuccauguuguagcacgugucagaacuucauuccuuuucgaggcugcauuccacuguauguauauauguuuugcuucucucuucgucuguuuuuuguuuguuuuuucuugagacucgcucuguuccucaagcuggaguggcacugucucggcucacugcaaccucugucuccuggguucaagugauuguccugccucagccuaccgaguagcuggaaguacaggcacgugccaccaugcccagcuaauuuuuguauuuuuaguauagauguuucaccauguuggccaagguuucaccaugggguuucaccauguuggccaggccggucuugaauuccugaucucaggugaucugcccaccucagccuccgaaagugcugggauuauaggcaugagccaccgcgcccggccaucuucauuuguugaagaacauuuggguugcuuccgucuuuugucuguugugaauaaugcuggguguacaaauaucucuuugagucucugcauuuaauucuugugauuauaaacccgaaauggaauugcuggaucauauggaaaucucuuuuuaauuuuuugagaaacuacuauacuguauuccacaguggcugcacuacuuuacaguccugccaacagcaugcaaggguccugguuucuccacauccuugcuaacauuuguuuuuuuucuguuuuuuuuuuuuguuguuguuguuguuguugauagugaccauccuguugaguguaagauggugucuuauugugguuuugauuugcauuuuccuaaugauuagugaugcugaucaucuuuucaugugcuuauugguccuuugcauauuuucuuuggagaauuaucuacuugcccauuuuuauaucaaccuucuuaauuuuauguugaguuuuaggaauucuccauguauucuggauauuaguuccuuaucagauaaaugauuugcaaauauauucucucacuccuugguuugccuuuucacgccguuaacaguucucgugugcagguuauaaacgcggcuucuuaucuccagacuugcucuuccugugcuuuaaaauaaaaaauccaaaacaaaacauucauuauuaguaaugauaaaacuaacacuuuuauagauagagcauucuuuucucaucaggccacucaauaguaaguagguaauuauuuuccugcugaugguucugaggguuggugggagccuuacuacugggugcaccacgcugaaucuucuuuguugccaaauucuccauauucuuuaggagaaagcaccagaaagccauagcugucugcguacaaugacugggaucacaaggccaugacgucuucuaaaaacauuuugugacuucugcuuuauucuaugucuauaugccuuuuaguguuuuggcugagccguuagaaaguaaguugcagauaucaggacagggucaggguuugaccugcauccuuggaaaggacugcagaacccaguaccccagacguccccugcugcugguugaggcagaaguggagauuaggagccuagguccgguuuuguccccuuugaaguaaugcuggagugggaggcuccuuacuucagagucaccccaaggucacauucauccaguucucugauagcagcagguuugagaacugcugccaugcugaguacucacuuagggcuuuguguccggaugcucccaggaugcauucaaggagccgggugggccuugguggcggucguugccaccaaguggcaacauccaagcugcuugaagccacccacaaccccacaaccaagagaagagaagaccaaaguccucagguaaaucacaagugugaaugacuugcaggguggcacugggguccuucuuguuguuuguugcuuggagcuggguuuauuguuucauuauuugggcaacuugcaauucugccuauuuuucuauggcaaagaacacauuaaaucucuccuuagauugaauuuccuucccacccccacccccagcacagagccuggcccuauaagugcucuguguggauuaauggcugugagugagcgaauaaaugacauggcgccuggauucacaagcggagauggccuaagaacguuguaaucugguagaggagugaugccaacaccuccucauucuccuuugaacucuguuuucugaagagcagcuaaaagcucaagacugggcuaaggaagugugcccuuggaugugguuaagagaccugggucagcccagaaagccacccccugacacgggggagggagcauacuuugagggcugacacccacaggcacaccuucucaugguaguuuuaggguauaacaggcuggaaauccccagaaagguggcugcuugggcauggguguguccuggccuggugugggcgcuucccccucagaacacaggcugugccacguggggagccgagguccugccugaguaacccaggucccugauugcugguuuugcucccugacaccugcaggccugccacuccaccucgcaaagucccugagugacagcuugcaggugcuugccugccugggguggaugagugauguggauggcuguaggauccugugagucccuugaggaugcaaaaguagagcgcguuuugccuuagaggaauggacuuguuggcuuggggcuugaggacccucccagaggucaaagacucgguuuuauagaagggaagugauuucccugaggacuuuggucuucucuucucuugguuguggguggcuucaagcagcuuaaauuucucaccgcacguuccccugcgcagagcaguuugagaagcugguggcaaugucuccauuacgugcugugcugggagccacuaggauuggggaccacuccauguaguacucuggcaccuuuagaaaucccugugagcucacagacccucacagaguaacagcuucuaccuugaaauguucuuaacguggugguccuggcugcuccuggagggcccuaaaagggauggugcugaggguggcucucucagucccauccucuucugagcugucuggucagugucuuguguauguauauuuugaagaauaagauucagguuucagaagcauguagaggagagugaaacugucuugcagccugcgaagucguggcgaaaugcacuggccaucacuacccagacaucccucacuucauagcccuguuggggaauaaacacaguccauuccuuaguuggggccucaggggacacuuuaaaaugcuguaggcauuguagguguaaaucuccgagauuuuuucccucccccuucuuagguuauuuaagguacaguucauuuucuaucugaguuuuuguuuuguuuuugacugguaacaagagcauacuuucuuuuaugggaugggugggcuuaacuggaagaggguuuuucccucucuuuuuuagcacuucagagaagaggccagaaaacuuuaugcgggugagggaggagguauccccaagaccucugguuagccugaggucugcuuagugagccccugaauuguuaggggcuguggggaaacggaagcucgggaagaguuggcacguugggaaugccacguuggcugaaguagcgagucaguccugccuuaaacaguacaaaaaggagaccuuuccugccccuuggcuggcucccagcucuguugaauuugaccuguacacauuuuaccaggaaauguuguucacaugaggcagggggccaauugguuuugugugcagugcuuaaaaaugcuggaaaauuaauccucucuucauugaugcaaccaguuuuuuuuuuuuuuucuuggccuuuacccccuuccuuauuacaaaaggaaugugacaaaauauacauaggccaaaugcuacacccuuuuaacacuugaucagcaacagcuuucagcagggccugcauuccagcaaggcugcuggauucuuggggggaacucgucucucccucacacuuuccuguuacauuaugccuggccgauuguggugaaggggaucuugaucuacugagacagccaugagauuucuuggagccucgauuuggagggagggaacuuggccaaccauggagagaagaagccggcugugugccagccuggaaccggcgagaggagagaaauggcgcacacauggcuaucgcgugccacccggccacccgugagggugccugccaauccugcaagcaccaucugccuucacacuugcaauuuuauuuucuuucacauggaaauggaaguucagauauugugcgauggucuuagcacaggucuaggugaacucuugcaaaucccuguugcagccugggggccucaaacugauuccuaggacagaaaugguucuguuuggugaguggccccaggcccagcugcacuggcuggcacuggguaugaugauggggaggugguguggcagagcagcuaggacacagauuugggggccauggguaugaggcccagcucgcacccuuaccaaggugugugacuuggggcacguuccuuuaccagucugagccacaguuuccucuccugaaaaaaugagaugacaguaggaacuaccccuuaggacuguuuugaucuugaauugaggaaaugcauaaaagcacauagcauggugcuugguguguagaaaaugcucauuaaguugcuucuguuauuauuagcugcucuuauuugaucuaauuuuucuguuauucuugccuuguggucaaaagcuagaagaaauagaucuaagauacuuucuacauugauuggaaucaagucuccccuguccgugagaagaaugagggaucuugaggggauuuuaaaugccaaguuagcuuuuugguacccaaagguaaacugaguuuucucucuuguuccagggcaacaugcagguucuggugacuuacgguggcgaucccaucccuaaaagcccuuucacuguggguguugcugcaccgcuggaucugagcaagauaaaacucaaugggcuggaaaacaguaagugccugaauggagagcagauggguuguugaugaccccccaacguggcugcugguuagauuuucuucaaaaggugaaauuugcagagaagcaaauucuauguuaagagacuuugcaguugcacagacuuugguucgaauuaaggccguggugugaaguaacugugacugugucugccccuuagccacaccgagacucagcuuucucauuuguacagugggggguggucggcggggagagguugagaacacccaugggaauauuuugaaaauuauaugagcuaaugguucagaggcuggcacguagucagcccccuggcauugcaguaggaaguuuucauuaaaaagagaauuugggcuauguugcuuucugaugaguuucuaacugugccagcuauccuuggcaacugaauccgcacuaagguugcgagucaagcauaaaugccaaaucccuggcacucagaagucacuaccaccacaccucugccccaucccaauguuccuuuagcuuguuagggauuuuacuaguauaagcucauuucgcuuauuuucaauuuucugauuauuuuuuaguagggaaaauuucaaacagaaaaggaaagagaauaguauaacaugaacacugauguacuuaucacucagcuucagaugugcaacacaugcucauaaaaugauuuuuuuauacaaguaaaaauauauccauuuuucaucuaaaaaacauuacaguuaagggauaauuccacuuuaacccucaccucuccuucucccuaggguuaaccaaaguuuucaauucaguuucuguucuuccagaucuucucucugcaucuauacauauagaugugccuguggaacacauuuggcuguauuuauuuugcauuaaaguugcccugcuguauaaaccuacuucuucggccugccuuccaacagugcaucucgggaaucauucacuccuacaucuuuuccgucuguguuuacugcugaguggcuccagacuggauguaccucagggcucacauucaccugguuucaggcuuacugaggcagggcugagugcauacccccaggacggggccuccuguauucaccugugaggguuucuccagaguaccacuagcagugccauuagugagcaucuuccuucacucgugacccaagugcacaaguugcaagcaaggccagcucccaguugcagagauccaaagugagagcucacuguuggcuuuuguggcuggagcagccagcucugaguguguaaacguccacugcccaacccugucauguguccccuugucacuccuuuccccaagacacugagagcuuugacuccagaacaggaaaagcagggugccaauuaggaaagccucuuuuccggugggaaguagcgauccgggaccuccuugccugugguucggcaguguccaucuugccaggcccuauguuccuucagagucaagguucucuggguuguggcaggggcccuguguucccagugcuuuuguuuuggguaaaguccuuucccuguucuugucuaaucuaacacuugggcuuccugcagcccugcuuugcagagaccuuuuggaaaccaucacgguacagucaguucucagcacuugcuucaaucggcucgcauuuggcagcucugugacuucugcuuucuugagggggaggggugccuauaagauggaguuggcugccaagaauuaguaaauaaaacauugacuuaugaggguguuuggauaucaaguuaacaccaaaaguaaguaaauaagagacgacagugucagauuacaacuuucuggucagcaaagauuguggggucagguaaauuucacuuugagucccagcuuggcaggcugcugcauaugucacccuggacaaguuacuuaaccucucugagcaucaguuuccccaucugugaaagccauugguuaauaauaaauaccccauaggauuguggugaaaauuaagacaauaaccuauuugugcuuggcauauaaaaugcauucaguaaaugauagccguuauugcugucaucacuaauugauuauugugccgacacuuguuguuacugaggcugagaugcugaugauacuuacucagcuuugcugcuuguccucugcagcagcuguugcuuacaguggaggcugagauaaguccccguguccaaagaaccauugcuucugugcucuggauuguuccugcugcugaaaagggucagcucuucaccucagcuuguguuucuuuuccagggguggaaguugggaaggaucaggaguucaccguugauaccaggggggcaggaggccaggggaagcuggacgugacaauccucagccccucucggaaggucgugccaugccuagugacaccugugacaggccgggagaacagcacggccaaguucaucccucgggaggaggggcuguaugcuguagacgugaccuacgauggacacccugugcccgggagccccuacacaguggaggccucgcugccaccagaucccagcaaggucagccuuugcuuuugucccagaacuugucucauugcugucaaacaugacaccauaguccuucucugguucuuccuggcaaagaccuucugaaaaucguuuugugaugaaaguuagcacaauucacugugaaagguccccuggguaggugggucacaacccugcuccuccucuugcucucugacuacaagacuuuggugaggggcucccugucccagagucuucuuucuucgcuuguuagcauaaucacaguccucacuacaaagccagccuguaagggguaggugaguuagcaaacguggaggccucugcccagcacccagcucacagacggagcucacccuccagaagcuagaaucauguaauauaaaaauacauuauucuggccaggcgcgguggcucaugccuguaaucccagcacuuugggaggccgaggcgggcggaucaugaggucaggagaucaagaccauccuggcuaccacggugaaaccccgucuccacuaaaaauacaaaaaauuagcugggcaugguggcgggcaccuguagucccagcuacucgggaggcugaggcaggagaauggugugaaccugggaggcggagcuugcagugagcugagaucacaccacugcacuccagccugggcgacagagcaagacuccgucucaaaaaaaaaaaaaaaaaaaccacaaaaaaaaacauuauucuuggcugggcgcagcggcucacgccuguaaucacugcacuuugggaggccaagguggauggauaacuugaggucaggaguuugagaccaaccuggccaacauggugaaaccccaucucuacuaaaaauacaaagauuagcuggguguggugacgcaugccuguaaucccagcuacucgggaggcugaggugggauaaucgcuugaaccugggaggcagagguugcagugagcugagauugugccacugcacuccagccugggcaacagagugagauuccguccccuccaaaaaaaaaaaaaaaaguucaucgucauuucuucauaguaacccugacucaagggguuuuggaagauuuccaguggucucaauggugugaauccuaugaaggugucuuauuuguugaauuagaggugaaagccuccuuccucacucuuuuuuagaaacaguuuaguuuuauuauuaugcagaauuuguugagcaaauugcaacagcccaagccacagcuagcuccacaagagcccuuccaugagcccucaaccugggaucucguguaucuuuguuggaauggacauuagguuuccaaguccaggccugugauuuagaagggucagguuggguaggagagaggagagucuuggaggggcugcuccaugggggucacaccucucuccuguggguuuucgcuggugauugaguucugaggcauuugcugcauugacuguuguagcuuuaacucgugugcacgugugacacauaaagccccaagagaagggcugccuggcucagaugcacuuccaugcugauuauaugcauggguguugaaagcagugcuggcugagcagcgaucccagugcaguuugacuuuauucuuugcucaaauaggugaaggcccacggucccggccucgaagguggucucgugggcaagccugccgaguucaccaucgauaccaaaggagcugguacuggaggucugggcuuaacgguggaagguccgugcgaggccaaaaucgagugcuccgacaauggugaugggaccugcuccgucucuuaccuucccacaaaacccggggaguacuucgucaacauccucuuugaagaaguccacauaccugggucucccuucaaagcugacauugaaaugcccuuugaccccucuaaagucguggcaucggggccaggucucgagcacgggaaggugggugaagcuggccuccuuagcgucgacugcucggaagcgggaccgggggcccugggccuggaagcugucucggacucgggaacaaaagccgaagucaguauucagaacaacaaagauggcaccuacgcggugaccuacgugccccugacggccggcauguacacguugaccaugaaguaugguggcgaacucgugccacacuuccccgcccgggucaagguggagcccgccguggacaccagcaggaucaaagucuuuggaccaggaauagaagggaaagguggguuucauuuaaaaaaaaaaaaaaaaaaaaaaagacaagcugggacuuaagggcuaccugaaacuuggagcugcaaacucagccaccugcaggagccaggugacauauaaggcggugcucaccuguucccucugccucggggaguaguuggggggcccuggugaagguuaagcacauugcauuucuggggaccgugcuacucaaccccuguuuucuguuucuccauggggaacaggaccuagcauugucagcagaaucucuaguuuuuuggcaaaggcagaaaucuugauuuuucucuggaaacucaacauacaacauguuggcauuuaauuggaaaaaaguuuaaaauguaguguugucuaacaccugcaugccacacagcagguuagucuucaaccuuuaaccuguccucgagcccggugugagcagucguguugucacuuagccguggcuacucuagaaaggccuucuuugggauggaggggguuaauauucuugauuugagaguuagaaaaaccaguuuuccaguuacugaaauuggacuucauguguccugaagugccaagaaccuugguucugggguuugcuuuugggucugggguacugguggcaguguuagcuaugugcuugcucugcagauguguuccgggaagcuaccaccgacuuuacaguugacucucggccgcugacccagguugggggugaccacaucaaggcccacauugccaaccccucaggggccuccaccgagugcuuugucacagacaaugcggaugggaccuaccagguggaauacacacccuuugagaaaggugagccgcccuguccucggacuggacccucguucagagcugcccuuggucauugccuccugguggcugguacugaugccugccccaugugcuaggccugucucagcagggccacgugcagagugacagaguggaagucagcguccgcugcagucaccugcccacucagugccuggcuugcuggccuuguguaauaggugggcuggguuuagccucagucucaccucagcaaguuaugggguaaugucaugauguugcucauuugugccauuuuucuuugcguaugaauuucuuucuucuugaguauuaggaauuauaaaaaauuucaauaaauagaaaaccauaaagaaaaaaaagugccauguauaucuccacuaccuggagaucggaagccugcgauauucugauauagauauuuucagucuucuuguggaugccuguuucuucuguuucacggguuucgcuuuuucuuuugguuaauggcuggaugguguuuucccgaaugagaguagucuguuuaggaugacugacuugaauauuugcuugguugggguggaguggcuuaugugacugcagauagacgguuuguauuauuuaaaagucagaucauaccuacauuacugugggauuguuuuguuuuguuuugaaacaggaugucacucuguugcccaggcuggagugcaguggugugaucacggcucacugcaggcucaaccuccugggcucaaaugauccuccugccucagcccccugaguagcuggaacugcaggugugcaccaccacacucagcuaauuuuuguauuuuuuguagagauggggucucgccauguugcccaggcuggucuugaacuccuggacucaagugaucuacccaccucggccucccaaagugcugggauuauagguguaagccacugcccccagccacauuacuguguuuuuaacccccuuuuccaaauaacauaguauagcaugcagacuucgaugcuagaugaaacucugaaguagagaaucauuuuucacaaauaggggauuuguaugcaaauaugcguuucuguuuguuguuuugagcaggucuccauguaguggaggugacauaugaugacgugccuaucccaaacagucccuucaagguggcugucacugaaggcugccagccaucuagggugcaagcccaaggaccuggauugaaagaggccuuuaccaacaagcccaaugucuucaccgugguuaccagguaggcaaggcccuacauuuggugucuugagucucacuuuuguggcuagauucuaccuaugugucaugguuuccuaacuuuugauaagaugaauuuuuauuuuuauaacauguauuuccuucuguagagacuuauguuacauagaaagaccaagcauaccuaaaaaacauaccaaagcacuugauaauggucaugaaacuauuuagcaaaccaggagucaaucaagcucuauaacuugauaauguaaaaauuuguagccaaccuuguaaguauuuuuauuaaaguugguugcaaggcauaugccugcguuguacuugcaguccuagccagugcaauuagauaagaaaaauaggcuggguguggcggcucacaccuguaaucucagcacuucagguggccgagacgggacaauugcuugaggccaggaguuugagaccagccuggccaacauggcaaaaccccaucccuacaagaaauauaaaaauuagcugggcuugguaguacacgccuguaaucccagcuacuacuugggaggcugaggcaugugaauugcuugaacccaagagacauagguugcagugagccgagaccgcgccacugcacuccagccugggcaauggagugagacucugucucaggaaaaagaaaaauaaaugaagcauaagcauugaaaaugaggggucagagugucuuuacuuacauuauacuaaugugaaauucccuaugugagagguguaguaauugaguugggguggcuacguggaauaguuuauaaagggaauuugcaugaauuuuggcaauaagcagaccagcauaaauaaauggugcacauuucacuuucuuuuccacucuuuccagaggcgcaggaauuggugggcuuggcauaacuguugagggaccaucagagucgaagauaaauugcagagacaacaaggauggcagcugcagugcugaguacauuccuuucgcaccgggggauuacgauguuaauaucacauauggaggagcccacauccccggugagcuauuccucagagaggaccccagagaauaauugauuuugcaggaaaauggguuugauuuugguuaucucucugaguggggaaaacaaucugauauuuguaauagcugcaaaaggagaguuuuucuuagggcuacaucuccaagauuaucucaacucccaguagaaccgguaacauggcaaaaagcaucggcuuagaauuuugacuggaaacaguugugcguguguuggaggaccuaguucuugauucaggggaaagcugguucuuuacaaaguugaaaaucacaguggcucacaccuguaauccccaaacuuugggaggccaaggcaugcagauugcuucaggucaggaguuugagaccagcccaggcaacauggggaauccccaucuuuacaagaaauacaaaacuuagcugagugugauggugcgugccuguaauccuagcuauguggggugggggcugugaugggacgaugucugagaugggagccugggagguugagugagcugagauugcgccacugcgcuccagcuugggugacagaggaagacccugucucaaaaaaaaaaaaaaagaaaaagaaagaaaauuucuaccuuauuuugugcuuggcuccuuauucaugugucuugguuucuuuuuuuucacugacaauacuaguagcugaucaagauaugcagauucaaauucuuucuuuuguauuuagugaugucauguguaaucacugugaaacacgguuucucaacuccggcacuaugacacuuugggcuagaugauucuuugugguguggggcuguccuguucauuguagacuuuugucagcaucccugcccuguaccugcuagaugcccauagcagacuucuccuuccccauucuuauuuguggcaaccaaaaaugucuccauaucuugccagaugucuuaagggacaaaaucacuucagccugaaccacugcuguaaagauucaaacaauaaauaaauauaugacuuaaguagugaaagacccuccuccauuuguuuuggggggaggacucuccauagguucuaguuaucuacucaaaugauugucacccccacacauuuuauuuauuuauuucaauagcuuugggguacaagucguuugugguuacauggaugaauucuauaguggugaauucugagaccaccucccccgcccccauuucuaaaagggcaggcaagugugugguguggacagaagaccgagggcuggggcuguucugggccacuuaugccuugucuuagguguggugugaagagggcaaagccccaccccaggaccccaggagcagaaagagccucagcggggucuuguucuucuuucucugggucacgcugagaggggaagggcagguugaggggcccacugcuggguucuggguuaacucucaggcagcuggaguguccacugaccacacgcuuuccugauuccauuccugcuucccccuuaccacauggaaaugugcacacacacucacacucacucucucucacacugaucagaaaguauugacauucaacucagacugauucuacucagauacucauuuaagccucaagucauuuaaaacaacauguuucuccucaaacuugugcuugcggcucauucaauauagauuuaaaaaauuccuauaaucacuagucuaggggacuucagcugugggcaagacaaaguuccugcccucagggagcuuacugucuagggcuuuuacaacuaaaacuugugaugacugcuaugaagaaugagaauggggcucggugacagaauucagagcuacgggcuuguuuuggaguuuuguaacacuugcguuaggagagaguugggcacaggaaacggguagaaggcugcucccaggaggggugauguggcuccgaccuggcaggcaacaguggagaugaacaucuccuguggcaaugaaacuuuuugacuauggggaaaggcuggugagugccaccagcuuccgaaucccccuuacagaaaggggucagaguuuguccccuguggccgaccugugagcuuaaagcaaauggucgucuuugagcauaacaacagaaagacacucauuugugguuuucccaucagguguggauggugccuuuuuauguuucaggcucucuguugccucccagagagccaaaugccggcuuuuccagaaccccagaacuuucccaggcagagauauuuagugaaguguugguugguuuucuaagcaucaggcuucuuagcuaaggcaaccuauggggguacugccgggaaacagucggcuaccugccaccuucuaauuugcuuucaugguaauucugggugcuuaaauauuagccuaguuuuuccuggccugguuaaaaacccggaguggaguuauuuuuaacaacguguccugucuuacccguaauggcauguugauuuccugugguaggccagcugugguugguugguggcggcucccuagaccacuggauugacugggguucagagugcaugaggaagaagaucuggcaugagggaauggugacaugugucugggcauggaacaggggaguggcggauaaugcuuggggucugccaucuuggacaguuuaucuuacccggguuuguugguuuuuggcuacucucaugcugagcucagacaacuucuaguggaggcucugacuuaaagauuggccucagagguagucccuugccaucagcuguugacauugaaauccucaacugucacucucuaaaguaaagcccccuuuuguuccucucaccccaguguggaggccugugcuuguuugccagggccagccauuuauuucacguagcuaaagaccuggaugccguugaaacccagcuguuguuagaaagccagggacucaauucuuugugugucuuggcugucuaccaucucuaauucuacaaaguauaaauucucugggaugcaaagcagagaucccucagcuuucacggcagucauuaacuuugccagauaccauggggagcaccaggacucccaugcgaggcagaggugcacguagccccuuggugaugggcgugguagccugaggcaugcugccguucgcuggauggggaggucccccuccacaguggaguccaugaguguccuuggccuagcccuuguuucucuguuuagcacuucucuagcaaaucacuaucuccucuccucgacuccucugugcuucaucuuuaaaacugacacccucaaggagucagaggcccucagggucccccggggggucagccauguagcaggagcucagcuuacacucaggaagacggcaaggcuucaccagguggccgagugaccgagaaggcugaguguggucagaaggugccagcugcauuggagggagaggagucugggggacacacaggagccaugugugggggacagggcuggaugugggcugcagggccugcccaucucucuccguucuguuguuccaccacuuggcuuccuccuucaguugcuccagcagccugucuccucccucgccucuaggcuccugcaugugcugaggccucucuacuugaagcaccucucugucugcucccucuugugccgcaacugagauguuacuggaaagcuuucucuggucucccgcagaccagguuaauugccuccugagugcuccaccuuccacaccccaaauauguuauguaggauguuagagugacuugcuugccucauccuucuccugcaguuguggguuccugggggguguuaaccgcucaggauccagcacguggcacaacaucugcacguaguagguguucugugagaaugguugacaacaaugaguaggcacaugagcagugcacacagugaggcagggggagcugaccgaggccugcauggccgaggucccgggggagcagcagugcuauucugggugugcacaagguggucuccaauucccagcuugugcucagaaucccacaaccucucuuccaggcagccccuucaggguuccugugaaggauguuguggaccccagcaaggucaagauugccggccccgggcugggcucaggcguccgagcccguguccugcaguccuucacgguggacagcagcaaggcuggccuggcuccgcuggaagugaggguucugggcccacgagguaagugugcacccugccuuccugcagacauucaucugccccaggcaggggcagcuguaacccagagcagaugcuuugcuuuugaguuugcucaugagcuuaaaauuaaauuaaaaaaaauuauuguuucauuucuaguuaaacaguagaaauuccugcuuacaaguaagcaggcuuguuauuucuccagugaucuguccccccauuuaauaauauggcuaucaauuucuuagaggaagcagcaguauuugggcugucauauguaauaugguggcgacuguuucauuauguguuucagcauuugugaggggguggguugcucuggauguggcagauggugggguuuggaggugauaacucauugagauaucuugguguccaugugguacauaccagaaccucugggaaugccaggcacaugaugcacgugauacguggcuuugucauugucuuaguuccccagagagagagugugucuuggggaaugggcuuuguuggcaauuuggccugccuuguuggcagcuuggaacuuggguuugguaaggcuagcgggccauauagggacaaagcccugaagugcauuggaacuugccuuuuuugauaagugaccauguuuccuccuccagcacuuaaaaugugccuuucucccacauagaggacagugugccuaauuucuuacguaaucuggauuuuccucgccaaugauauguucuuggauucacagaaguggcaaaugggguuuucccucuuugaagaggaaccuucuccuucaugggguucagcaggagguuuuaucuuuugaagcucagggcagaaaugguuugggggaaauuaggucaugggucugggaucagauucugugaaguuacugagcuucaggaccugcauguguuugugugcauguaugugucccuguguaugugugaaugagagagggagaaaaagaagaaagagaagcuuuacuuggauaucugccucuauuaugaaggacucucaaguaacagccuuuugauuuuagcugacgacacggauucccagucauggcgcagccccuugaaagcccuuucagaguucuuuaaaggugacccgaagggugacuuuaauaagacagguuugcauuuucccauggcugcugaauuauguaacccaaaugcuucuugcuggccucacuucuaaaauugcuuacaccugccucaucugcuuugcuuaaugagcaugccauccuuugauuaaccuacccuggaguugacccauccuugacugucacguuggaagcugggaucuggacucugcaacccaacgcgugccuugauuauguuuuagcauaaucucuaacaucuccacaggcuucaccuugaggguccccuugccccaugagauuggcacccucaccugcccugcaccuaugccccagcaugcugguaccacaguguucuuugcucaaagguggccacaagucuugacuagccagcccauugguuaauuuuugcucuucacaauucuggacucuuuggcagugucucagcuguagaguaaaauugccacauccuaagcgugccuaaccagcuugaaagguuauauugugucuucaacacacaucauccacauacacccuccagcagcaagcacaggcagucuccuuaauuauacucuagggcagacugaguguauuuuagccaacaaaaagcuaaaggugucucucggggucauuucugcaaccaugaauuggggauccugugauuuuuuucaggccugugauuaugguugcuggccuuuuuguuacucaucaguggaaaccaauagcucuuggggauggaugugguccuauuucagacucagccaaggguggaguaaaggugaggccaggcagcuccuuaaaccucucaucucuguccucaggcuugguggagccagugaacgugguggacaauggagauggcacacacacaguaaccuacaccccaucucaggagggaccuuacauggucucaguuaaauaugcugaugaagagauuccucgcagguaagcuccauccaucugcccauccauuccuccaucagucuaucuguccacccauccauuccuccaucaguccauccacccauccguuccuccaucauuccauccauccacucauccauuccuccaucaguccauccauccacccauccauuccuccaucaguccauccauccauccauucuuucaucauuccauccauccacccauccauuccuccaucaguccgucuacccauucauagaggcagcaaguauuacauagaaccugcaacuugucaccacacacuagccuugauauuuguggcucccgcucucucacucccccaguuccuuucagacaucuuuaguuuaaaggugagcugaaauuaagaaguuggaaauccuaaccacguguggugggauucgccuguaaucccagcuacuugggagacugagaugagaggaucacuugagcccaagaguuugaggccagccugggcaacauagacccuccccugacaucucuggaaaaaaaaaaaaaaaaaaaaaaaaaaaagcaauaguaguagacaaucauugaugaaauaaauaauuuauuaguuuauuagaggcuuccuuuugguguuuuggugaaccugcaaguaguuuucugauugggacaggacaaaggucuuuacuucaggguuugcuugauaaaagcauuuccaaaagguuuuacauagaaaccuuguuccuuguugauauuaauacaaaaaaaaauguuacauaagcucuucaccucuuggaacaaucucuaaggguuuucuuuucuuuuuuuaaaaaaucaugccccuuaagaugaaaaacuuucacccauauccccuaacacauauuuuauauagagauaagcauauuagcucuauguagaaauauguaauuuauaaauuacauuuguauauugcuuuacuaauauaccauguaccauaugaagcauacuauagaauaauuauagauacagaauauagaauaagaugagauauaaauauuaaaacugaaguuccaguauucucuuuccauuuggugaccaugaucuuagcauaacaaaagugggguaaauguguuuaacccuguguuucccaaacuaauuugugaacucuuccuccccaaacuacuuguaucccuuggaacagagguccccaacccuuggagcguggacuggugugggugcacggcauguuaggaauugggccgcacgguggugggugagccaucauuacugccugagcccugccuccugucagaucagcagcugcauuagauucucauaggagugcgaacccuauugugaacugcacaugagaaggaucuagauugcacacuccuugugagaaucuaacuagugccugaugaucugagguggaacaguuuuauccugaaagcauucccccaccaggcccccuggucuucuacgaaaccagucccuagugccaaaaagguuggggaccgcugccuuggaacacacucaggacaaaaccagucugucauaugaugguuacuaccucauaguuguaaauuucugcuagacuuaggcaccuugacuaacucacugucuuaucugcuguagaaauccccuuuuccaucccacucuuauguguaagaaaagucagaugcagcuggguugacauguaucuuuauugacuagggugugugugugugugucuaucaagucccuucaaggucaagguccuucccacauaugaugccagcaaagugacugccaguggccccggccuuaguuccuauggugugccugccagucuaccuguggacuuugcaauugaugcccgagaugccggggaaggccugcuugcuguucaaauaacgguaacuuggaguuauuuucugagccaaaccuuaauccuaagacuuaauuucugggccagauuuaagaacaaggguuucaauaaccgauuucugacucaaugcaaguuguuuguuagauuuucccaccaaagagucaguaaaugugcagaagcagaagcagcucaccugagagauuugaggguguagcuccaagaaccacuuuuuggugaauuuucauguuuuuuuacuacaucuauuccuauguuuuuauuuuuauuuuuuuuaaagaugggguuucaccauguugcccaaucuggucuugaacucucuuggguucaagcagucugccugccucaaccucccaaagugcugggauugcagacaugagacacugugcccguccccuauguuuuuauuuuuaaauguuuuaaauuacucuuugguucauuuaagacuaaguuaugcugcauaucacaguaaaccuuaaaauaagaguggcugaaauaaaugagauuauucucucuuguuaaggaaccccaggcuaagccaccugggugcccugcagcucaccaaggaagucagcuccaucucucugcuccucuaccuagcauguggcuucuguccuuaaggucuccuccuggaccauaaggcugccagugcucuggccaucacauccacauggcaggccagaaggaggaagaaagaagggaaaaagggguccucccagcucagugggcucucuuaagcagcccugccaaaaguccaucauagacuuccauucccuucugauuuguuggggguuggucacaauucacauuaccuaguggcaaggaugcuaggaaguggauucccaucuucugggagcggugcaccuagcuaagaguuaugguccuguuaauaaagagaaaagggagacuggaugugguggugugugagcagaagccucugccuccuccccucccuacauuucagaggauuucgagcuaaaacacucuugguucaccugacaacaaaauuacuaaaaauuggccaugucugucaugguguuaaagggaucugugacccucuacucucccuaccaaaaaacaaaacaaaacuagauuguauuaagccaucaauucugucuguuuccacuagaggcacuaauuggaaaauaugucaggguuuuccaugaauguuuucuacaucuugacaacauccuaaauagcauuucucuaugauccacaggaccaagaaggaaaacccaaaagagccauuguccaugacaauaaagauggcacguaugcugucaccuacauccccgacaagacugggcgcuauaugauuggagucaccuacgggggugacgacaucccacuuucuccuuaucgcauccgagccacacagacgggugaugccagcaagugccuggccacgggugaguacagggcaucucaaggucaggggcacaggcuuugcaaucagaaagccgggccguagcccuucucugugacuuacaagcuacaugaucugggcacguugcucaaccucacugaacuucaguuugacauagauugaagcucuuuguuuuuauuuggagaacauuuagauccaagaagcucuucuaaggaacagagacuguuuuacaggguuacugcaaagauuagaugaggucaggcaugaaaaaugcuuagcacagugcuagguacaugauaacuauuauuauaugcuuuugaaauguugagaacccaacucugauggcggcucccaugaaaagcagcacauuucugccuuuuaugaguagauaguuacucaggauucauucaagagcauuucaggucagcauuagagaaacacauuuaaggaucuagguuuuuuucaucaugcauauguaaaccucucaggaauucuccaugaauauuugagcaucacaguuucuuugguuucuuucuuuuuuuuuccccuccuuuuuccuucaguuucuaagacacaacuauugacugucacaggccauucuuuuuuuuuuuuuuuuuuuuuuugagauggagucuugcucuguugcccaggcuggagugcagugacgcaaucucagcucacugcagccucagccuccugaguagcugggaccacaggugcccacgaccaugcccggcuaaguuuuguauuuuuaguggauucaggguuucaccauaauuggccaggcuggucucgaacuccuggccucaagugaucugcccuccucagccucccaaagugcugggauuacaggugugagcaccacgccuggccggccuuucaguuuuuaagaacagcccuugggcagcucagugcugcugcucaagcagauuuuaaaacacgaauccccaucucuaaaaugagacagauuuacuucuuuuuaaauaagaagacuaaacacaggaccacccuugauguguucuguuucucucuuagcccaucuuuuuuugaauggagaaaaucugggcuuucacggcaagguugugaauugcucagcguggcccuuuuuggcucacccauggcaaaaaauggaaaaauuuuggaaugcaggccaauccaccaccuccuaggucuaugcagcugccagcgacaaccagaucaucuuuacuaauugauggcauguuaacguuggauggggacuucccccuugccuugcaggcccuauuuccucccccagcuugggcagaagccugagcugaauacuugccuuuuggccacaccucugggucugucauucagggucuuccacagauugacuccagucuucucuuccacuccucccugaacaaacuguucuugccacccucccuauuacuccuacgcacuuggcucauaucuaccaaugugcuuuuaguucaugcuuuucugcauuuccugauauguggauccuguguaaaggggcgccagaaaucaagagagagacuggucacuggggagagguugcaagucucccuuagcuaacagcacccauccuucaggguucagccauguuuccuuucuuuaggaagcccuuugucagugcggcaacccugggauauaaauucuuagaaccuuugccuagauaugcugccagacacuucucugaggaacaguuuguuauuuuuucuguaacuuaguuccucuucagcauuuccacugcaguuggaaaugucguucuuggugccuggcccuguuaacaucuugagagcagggacugugucuugcccaccuuuauguguaccuggcacuuaagaaaaugcccaauauguuugcuauugaaagucaaccuucauugccauaccuuuaaaugcuggcaaacccaggcuaaccuuuagucaacacucagagcuuacagaugcuccuuauuuaguaaguaauugaugacguaacccuuugagcaacaccugaucaggggaucuuugggauaucccucugaauggcagcaguuggaggccuaacauuuacaggcacagacaacauggauggguaugauuuguucuugggccuccaggauguguguccauacuuccauucucuuccccugaacucuucuccagguccuggaaucgccuccacugugaaaacuggcgaagaaguaggcuuugugguugaugccaagacugccgggaaggguaaagugaccugcacgguucugaccccagauggcacugaggccgaggccgaugucauugagaaugaagauggaaccuaugacaucuucuacacagcugccaagccgggcacauaugugaucuaugugcgcuucggugguguugauauuccuaacagccccuucacugucaugguaaggaaaauuccuucucccgagcaugcuguuauugguggaaacuguaacagcugccguuuguugaacccugacuaggauauccucuucaccuuuuuuuuccuuuggaaaaaaauuuguuaagcagucaugaccuuguagagucccagaguaaucucuagaaacucagagacccuuuggcuguaaggguuuuuagggaaucuuacuggccaccaaggugucuaucauaauaagggacuugggcaauauccuggccuaagcccaggcauuuugaaagauaacuccucagaaaaacacaccuuuaugaaaauguuucuacauaaaacaugacagguuuuuaaccggccagcucuuccuucuuccaucuucauggccauucuccauggcuggaggagagagcuuccugaugcuguuuuguuuggagacuugacucugaaaucccaggacucaaaguaccuccacuuguguuuuggaaagauucacacuuuauguaugagggggaaauaccucgucuuuugcagcuaggaacaucuggaauaaaaggaggaaaccauuaugcaaacaccuggguuagugaaugaccaaggucuuucauuuucaguugugaguuacuuauagaucuuccucuguuuauuuauuuuuauuauuacauaauagaucuucuucugaauauucuucaaccaggaaaaggguuagaaaccuuggggacauuaccucauugaacccucaaaaccaagcaucguuggcuuuuuuacaaaugaagcaugcuuggucuagacagacaccaaauaccaugcugucauccucacugguguccuuugauacuguggucagcagccgcacuugaccacaagguuuauaggcccuuaaugaccuggccuugugcacagccgacaaagcaccuucuaauuauuucauuuugugcagcaauggagaggugcaugaagacuccauuccaaacuccaaagcucagggacuuucuuccgaacagucuauacucuguuguaguauuauucccuuccaucgacgucuguuuaucuguaaacagcaugccagagaucuggaggcucuuuuaugucucaaguauguaaauguaaacacuugucaacuuuugacauuguucauuuaagaguguuuuucuccuguaggaagaaagaaauacagcugggaaguugauguccuuauucacagagaaggguaccaguuguaguuuucagaaucuguuuuuagcccauaguggguuuuaucugguugguuagaauuagguggaaggagggaagagcagccaagcacugagcaguggucaugggccugcuggugcaaugauuuggggguaagagaagaccauauugggaaggucuacgugagaaagucagaguaaaaaaauugaggacccuuuuugcagaaguggaggcuuccaaacucaguaauaagugucuucuagccccugaauacacacaaagcaagaauacuuuguguuuacccacugcccccugaccacugcugaaggcagaaagggacgaucaccuacaguaccugguuugggucuuuauucucucauuccagggagagaaccuuaacuagauggacugacugacuguucauuggcuuugguuggguagauucccugcuucccucuauaaguuugacgccaaaaaaggacaccgaccagcacugcagucauagcaaaugucucaaggagacccacagggugguuucuucaaauacacuacucacacacagcacauggagucauggacaaacagcuuaacugcccauugccuuugagaaguccuggaccaaaggccauagcucagccauugaaagaucuuccuucugacugauaugucccugcauagcuccaaccugugcaggcagaggauagggcuguuccaaaugucgcucacagagcugccuuugccuuucugcagaucccaagauacacacaaagcaguuaacauggguaaauaggccuuccucuguaggagagggcuucugauucuuauucuuucuuauggcggaagaggguguugagagggguucccuugcuguugguucuguugaaucaggagcauuaaaucuuuuuuguuuuuuuuugagacagaaucucacucugucacccaggcuggaguacaguggugcaaucucagcucucugcaaccuccaccuccuggguuuaagcgauucuccugccucagccucccgaguagcugggauuauaggcaccugccaccacgccuggcuauuuuuuguauauuuaguagagaugggguuucaccauguuggccaggcugguaacuccugaccuccagugauccaccugccuuggccucccaaagugcugggauuaccggcaugagccacugcgcccagccaugagcauuaaagcuaagauuuguugaaaaugaauuuauaaaaaacuuuagaaacauuaacugcugagcaugguggcucaugccugaaaucucagcaguuugggaggccaaggugagaggguugcuggaucccaggaguuuaagaccagccugggcaauacagugagaccccaucucuaccaaaaaaaaaaaauaauaauuagccuggugugguggugcacgccucuagucccaacugcucaggaggcugaggugggaggaucaccugggcccagaagguugaggcuguaguaagcugagauugcgccacugcacuccagccuggaugacagagcaaaacucugccucaaaaaaaauuaaauaauuaaccacaguagacauuuaucaaguaaaaaaagaacuuuuuccugauucugugcugcagagaugccuuguguuaguuuuuaccuacuuacacuucacacaccucacuuucaugccuggggucacaccguacauacugcuuucgcaccuugcuuccuucccucaaugugucauagguacccuuacauauugauucauuggaccugacugccauguuccacuggacagacucaccagaauuuauuugaccaaaucccuuccagauggacauuggguugcuuuaguuuugcacgaccacagacagcaccagucaagguccuuacacacaucaauuaacuauggagucucccgccagcuuaggucugcgugcuacaagugggguugugggcucacagggcaugcgcaucugacaguugaagagaggacaccaacugccuuccaaaagggcaguaagaaaguguccuucgcuagagugaguggcucacugcaguucaagauggagcagugggggaagcagcucuguggugguagucuacugaguguauccuuccaguaugguucccaacuaaucuccauuugccacugaccaggccacagauggggaagucacagccguggaggaggcaccgguaaaugcaugucccccuggauucaggcccuggguacaauuuugguuuuuuccuuuuuguguuucuguguuuacucagccuucauuucagaaaaucugccaucugcuucugggauugcuuaagcccuguggguguccuggucauuggugugccccucacugaucagcccaucacgaugaucccugcuuuuucuguaauaagaucaccuuugcgucaccauccgugcuccacgaaucgccagccgucgugucugugaucacgcucggugcaguuugucucuguguuuaaagagaaagacagacagcugucugcagcccuccugcugccucucaaagccgccacuugcacauucaguuucuguucagggggaaagccacccacugcuacucucugccacuuaaaaugcaccuucuuuuccaggccacaagcaacuaaaccuuuccagauggagccucuugggacucauagacauugcugucucucacuuuuccacuuucccgugggugcugcugggaauuuuacaaacagacucccgagugauugcuaacaguuggucagcaugaccucuccagucccucagguucuacccugggucuggagccacuuagacaaagcccauaccacaaugggcagccgcauucccaaaucccggccucacuggcuuguagaauucccagcagcucuaaccccuguagcuucaccagcucccgcuguugucugcuuuacccagugaccacugccuucuguuuuuaggugaccgaagaggccuaugucccagugagugacaugaacggccugggauuuaagccuuuugaccuggucauuccguuugcugucaggaaaggagaaaucacugguaagcacuugccauaaaggccgucucauucucacuugcucucacgagcuucccagaauggugcuggggagguguguccacugucccccagacccaggcuccuuaacccagggucacgaguucuuggucuccgguguugggccgugggcuccugaaacuacagaauaugccacguguguguuucucugaagaaguggcucacugacaacuugcauuacuuucuugagcagucccaugauucucucuagguuaaaaacugcuguguuuagauaccucaugacugucggguucuuguuugccccuuuuuccugccuucucuuauuugacuuuuccagaugugacuuugacacugagucugucauacaggaguuccuuucuccccucagccucuuuucaauggcccacuucucuuugguuugaugcucuauguauccagcugguuucaugguguucucaaguccuuucugagcuugauuuugccaguuguagaaaacucuuuaagaguugucugcuauauuuuguggaagccaaauggaacuggaaaaaaaaaaaagaaaagagcaaauggucucucccauugugggacuugaauguuuuaggcagcaacgaauguucuugggucuggaaaccuuuauuuugaauacaucugugccuugggcucugcuucucuggggaagguugcuggugggcuucauugccccgucucucugugcuccauaggagagguccacaugccuucugggaagacagccacaccugagauuguggacaacaaggacggcacggucacuguuagauaugcccccacugaggucgggcuccaugagaugcacaucaaauacaugggcagccacaucccugguaagcugagucagcaggcccagcagggcuccaccauucaggggcauccgggcagccugcagacacuccucagccgcuuugcagggagcagcucucggcagcaggcuggagaaugcagcguugguaccccugugaaaccaaacagucugggacccuagcagguccagcugauuucuggaagggaugauguagcucagugucuugggucacagugcaggccuuugggucugugguuguuuaucuuugucacuacgcugaguguggccagaggucaagcugggagaaaaaugggaggcauggugagggacuuuccagccuggccugcagagcccugugugggcuggaggcuuggggccaggucagagguggaagaagaggaccagcagcccuggaagaagaggaccagcagcccucuacaagggaagccagcccagguuucaugggucaccaaccagcacagugucaccaguucauucuuucuuuuuguaguuguauuuguuuuuuaauuuaguauuuugaauagguaacacauucucaugguucaaaaauaaaaaugauacgaagaaaguuuuccuuccuaccccucuccuugaacuagacuaucauaaauuuuuuuauguucgauuucagaguuucaggguuuuauuuuuuauuuuuuuguggagauagggucucacuguguugcacagauuggucucaaacuccuguccucaagcagaccucccgccuuugucuccuaaaguguugggauaacaggcaugagccgccacgccuggccaauuucagaguauuuuuaagacucuccaugcaaacggaaauacagauauauaagagagugucuucccagccuucccucauguggacgaaccauuacauauuugaccauuucccuauuggagggcauuuugguucuuccugcccucgcuguccccaguguugcugcgcaaaucgacuuuuccccuagucaccucacacucacaaagauguaucugugagauuuaguuaccagaggaggcaaugcuagggccccagugcaggcaucuaugauuuugacagaucuugccaaauugcccuucagaggggcuguugcaguucacacgcccucuggccauggagaagagcaccuucuuuuccacaaaauuugccaguagaauaugguaucaaauuuuuggagcuuugccagucugaugguuggaaagaaacagaaucucagcguugcuuuauuuguauuucucuugugaaugagaccacacaacuuucccuaugucuauuuguauuucuuuuucugugaacugaacauuuggauccacggccuguuuuucuauuugguuauuggccuuugucauauaguuucuaagagcaauguaaacauuggagagauuagcccuuugugguaggaguugcaaauguuucucugagauuggcauuuacuuuaguugucuguauguaauauugguuuaaagcaaaaauguauuaucugcuucuauuuaaauauucuaaagcggcagauggagagagaggaaaaaaugucuuucucacaucugccauccacuuccacugcuggugugaguuguguaucuuuucagauguuucucucuguaucuacaaacauacauauaauuuuauucuauuuuguuuuuaaaggaauagcauaaugguauucauaguuuauagcaacuugcuuuuuuucuuuuuaaugcaucauauuauggauaauuucucaagucaguaaacaugggucuuccucacucuuuuuaauggcccaugaguagaucagcauuuauuuaaccgguccccuguugugaacacuuaggucuuuuccugaugugcacccgaacacugcagaaaugaaagugcuuacauagggcuaggagucggggugggcagagaagaccacugugggguugauuccuuacagguugaauggcaugggcaaauggccuuccaaaagcccuuuccacuuaccuucccucuggccauggguccuuucaccacccagugcaaaaguuucuuccuuauuugucagguugggcugguaccuuaccuuagcccccuuccucaucuggagcagcuuccaggauuguuuuucuuauguugugauugaaggaauaauacugcguagacccucucugauguccuaggauggcgggggaugggaggugcaugugcaucuccuucugucucuucaugccucugcuuaggaggcgccagaccuguagagagguggacgucaagaugccaguuguccagggucuucguucaccccuuaaugagcaccaauuuuguuuguguccuucguaaacccagagagcccacuccaguucuacgugaacuaccccaacaguggaaguguuucugcauacgguccaggccucguguauggaguggccaacaaaacugccaccuucaccaucgucacagaggaugcaggagaagguacugugugguuuacguguuuauacgccuccagcuguccauuuggagggugaaguggacacgguuccaggguggcuuuuaaaagugagacaaucgaaugguaguauuugucuugucuuuucucucguguaaaucuguuucuucuuuagagccgcuucgucuucuacccagacagacauuuuugaaguccuuuguguucuaacugaaaucagauucaugcuaugaaauacuuuaugugacuugucuggaauuuaaguguguuuugguuggugauguuuuuguucuuguugcacauguauccacaagaccacaugacuuacugaguggcucuuuuugauaaagcugugugcccauucccgugguauucauggauaaucccaaaucugugguucuaaugggauuuccgugauggcagccagugccugaugggcagggacaauccaccucugcccuccaccacccaccgucuccuauguguaauugauguacacggcuccuuccuuuucucaucccaugcauccugagaguagagagagcuccaggguuacuugcagugaagaacucagauguuugggguuucuucucaguggguguuuuuacugcguggacugcuucauucugacagaugucccuuugcccacagcucacguggagugcgucaauccauuguccccagcaucagggcugcccuggaugaguuguuaaaaggaaacucuuaaaacaaggcaacucucucccuaacaccccugcaucccuguucccacuuguagguggucuggacuuggcuauugagggccccucaaaagcagaaaucagcugcauugacaauaaagaugggacaugcacagugaccuaccugccgacucugccaggcgacuacagcauucuggucaaguacaaugacaagcacaucccuggcagccccuucacagccaagaucacagguaggguugucuggcuucuggggucuuccucgugggaaguauggcugccucugacugccacccuccuuaucagaccccuggcagcaggcuagacgucucuuugaguuuagguuucacagagacuuguugaggaggagcaggggauggaaugcaauuuuggauuagcuaaauccuucucuugcugauaauccaggaaaaugcgagagcuaguauuuggagcacacuuuuauugugccagugugacucuagggugcaaagagaaagcucucagauggaguguucgaaucauacuuacugcaauagugcaugaagugcaugagcuuagacaugcccuucagcgucacuacuagguaaauuuucugcuaucccuuuuacagaugggaaaacugaggcuuggcaagguagugguguagccaaguucacauauagguaaacagauccagguuaucaaauuccaaagcccaugcuccucaccuugcuguguucagguuaugcuuucaguggguuauaaggaagaugcacaaggcagauccuguuuccccaccguauuuagaccugucugugaagcagccaguaguacuguguggaauguggucauuguuuaccuagaaaugcccacagccaugccaggcagguaugaggugccuucaacuaacaaaaauuccuauauuuuauuuuauuuuugagacagagucucacucuaucacccaggcuggaguuuuaguggcaugaucucggcucacugugaccucuaccuccuggguucaagcgauucuccugccucagccuccugaauagcugggauuacagcacccaccaccacacccagcuuauuuuuguauuuuuaauagagaugaaguuucaccauguuggacaggcuggucuugaacuccugaccucaagugauucgucugccucagccucucaaaguguugggauuaggcaccuggcccaaagauuccuuuaaaaugugguccaugaggacucaagucucuagguccugccagcuucuugucuuugcugcaagcaggcaugaaucccaucauucuucauugguugggucuacucaguguucaaggcucauuuuuuuuucacuuaacuuuguguaauuaguucuugcguguucauccgugaacagcauauggcauggcagcucugugaagccaggguaaccacauguaacgggaguccuuuuugggggauguuucccagaugacagcaggcggugcucccaggugaaguugggcucagccgcugacuuccugcucgacaucagugagacugaccucagcagccugacggccagcauuaaggccccaucuggccgagacgagcccugucuccugaagaggcugcccaacaaccacauuggugagcuaggcuacccuuccuggcuggagccaggacaucuugggugggagauggggacucuugcaguccuuucuugggaauggguagcacaauggagugugaugugauaaaccugcugggucacacgcacgauaaaugcccaagcguauuugugcauugugauaucgacacucuggauuguugggugucaggaaagaggacauauuucuauuucugagagugugucucucuccugcuuccucuccgccauccccuuacaagccccaaucuguguucugguccaggcaucuccuucaucccccgggaagugggcgaacaucuggucagcaucaagaaaaauggcaaccauguggccaacagccccgugucuaucauggugguccagucggagauuggugacgcccgccgagccaaagucuauggccgcggccugucagaaggccggacuuucgagaugucugacuucaucguggacacaagggaugcaggucuguguggucccaggggagaggcccagagcuugugggaaccgacuuauuuugcugaggcagcgucaucuuuucauccuaccaacuccuuuuccuuucugagcauccuucaagcuauagguccuucugccugcauugucuuuuaugccucaugaccauuggcaaaaaugggauugucuuuguuuuuuagaugaugaaacugaggcuugcaagguuuagagcccccucugcacuaggaucugaacccagagccacaacaccucgcaaaccccuguuuucuuaucugcucucccacccuuguucucagcuucccagcgucucuccaagcaaagaauguuggguugauuggccaagaccauggucaucugagcagagcuuuuguggaaaugaagcaucucuuucuguuuucucuuugagaugguuugaguuagauugugucucuuccaagcuugccacaccccagugccuccagucaucugcuuucuugaaggauggccacgcuggugaauucuagacaaauucuaacccggggagagggcuggagaauuucugguccugguugggagauacucccuguuaaaccuucggauaugcugaccuagcugagguagccaggggcuauuuaaaaauucaaaaucucagaucuggcuguggauaaacccccaaggugguacgugcaguacuuggaggcgugagggcagaagguccuccccagcaguuuguacgggacacaucaucuaugggauauuaguaaauauccuuaaggaaaggcuucuguggucaaaaccagguucagcagguuauuucacuauggggcuucucaggacgcuuaaccuacucaucccccucugggcuuugcaaacgaggccgccauugcuuucuuucugcuauguagaaauagauugaggcguaagggucggauguccuuucuccauucaucaggcucccucuuccugaggagcugcugucagaacagccuggggcugcuguguugcagguuaugguggcauauccuuggcgguggaaggccccagcaaaguggacauccagacggaggaccuggaagauggcaccugcaaagucuccuacuucccuaccgugccugggguuuauaucgucuccaccaaauucgcugacgagcacgugccugguaugugcauuccauuccccuccaggugggaugcuuggguuuucuguaaaugcugugccuuggccucuggccugcucacaggagccuucuugggucuugcagggagcccauuuaccgugaagaucaguggggagggaagagucaaagagagcaucacccgcaccagucgggccccguccguggccacugucgggagcauuugugaccugaaccugaaaaucccaggugggcgucggggacuaguaggguggggaagccuuggcuccagccuucagggcagugggugccuuugggaaccaaguuuaggcauggcccagaacacaguauccaagucggcugugcugaccuuuucauuucacuucauuucauuauguucuucuauguuuauuuucacagagucucauccaagaaaaacaaauguuuaccuugcuaccuuuuuccucuuccaaauaaaaauagcuuuauugugucacaugggggaaacguagauaugcuuuuagauuuuuagauuaacuaucugucaaauagaaucaugucagugaaagaacuggcccugccgaugccagggucuggaaguauuuaagagguggcagcccagcggcauccuucuaguauuucucuuucauuccugaaauuagaacgagggcugugcugcagaacucgcugggccacaucuagcccuuugguggugaauuguucuucuugggccccgauuagccagucaacaggucacacagucugucugaaauguguuccaaguucuuucuauaaagaauccuuccagagggaagccacugugagugaaaauuuugaggcuccucugcccagaaguuggcauguccuguggaauugcacaaauucuacagagaagggaaaucuaaaucgucuucagauggagcuuguguugcgagcucuggagaggggguugucuuucuacacugcaucucccauccuuccuaacgagucacggagcugucgacuccgccuucuuggcuuuaguuaacagguucuucuuguguagucacaucaacgucgggucacaugggaaugugguaaagccucauuacuguagaguucagacaugaucacuuaaaaagagcuuuauugggccgggcgcgguggcuuacuccuauaaucccagcacuuuggggggccgaggcaggcagaucaccugaggucaggaguucgagaccagccuggcuaacauggcaaaacccuaucucuucuaaaaauacaaaaauaagcagggcgugguggcgggcaccuguaaucccaccuacucaggaggcugaggcacaagaauugcguaaaccugggagguggagguugcagugagcugaaauugcaccgcugcacuccagccugggcaacaaagugagacuccuucucaaaaaaaaaaaaaaaaaaaaaaaagagcuguacugaucguuuguagucauaaacaguucgugugccucaagguggggggaggaagugucaccucccagagagagcuugguucacauuuuagguacagaguuggacccuggcugccccauccucauagccacgucugcucacuuuccagucacauugguguacucauccacuguuuuugugggcaucuucccaccucaaaaaauagacauccacaucaucucuuucaugacccugauaaaaugccauuucauucaauggaacuauuggugauagaaaaagagagauuccauuucaugucuagaugcaucaaccuucguuacucaucucugugccucagcucccaucaucagggcugcugugacauuugccacccugugcucaggcugugggcuggaugcccaggagugggcugggcuggugcauuucagaugcugccaugccuuggcagaccgcccuccacauuucuccauacucccccaccagcacuggggcugucucuccuucucacuuuggccaaccugauggaaaaacauggcauucaguguucaguuucauaucuucgauuacuagugauauguguacuguguuuucuuuucauuugcuuuacauuucucauuuggcaaaauuucugugcucugcuuauuucuugaggaacuagcaaguaucugcaguguggacguuuacccuuucucuuaagucucuuccagcucuuggccauuuuguuauucuuuuaguuacuuaguaccagaugacucugggugaggcucgauuuuccacucauuacccaaaugauccucucggagauccccuccuccuuaauggaggacagcucacuaacuucagauguccuccggacccagguuuugcggggcaucuuugucaguuugggcugcuguagcaaaaucacaugaacuagguggcaaccaacagaaauguaugccucacaguuguggaggcuggaaguccaagaucaggugccagcauggccagauuguggugagggccuccuuccaggcugcaaaccgacagcguccccuuguauccucacaugcuggagaacggagggagccagcugucugggacucuuacaaggccacugaccccaucacagggucgcuccacuuucaugaccuuaucuaauccuaauugccuccucaaggcccaugauaaucccaucacauuguuggggguaggguuucaauauuugaauuuuggagggacacaaacauucaguucauuacaugggugacccucuuuucaaccucccuucccuuuucuguccucaggggucagagucaugaacugcucugcccagauccuguggggcuggagggugcaguuucauacuggcucuaggugauggcagugcuccgugccccgcaugcggccgccuggccucaccacggcagugcaggcacagucguuggcaugacgugagcagcucacggagagugauguggucuugcguccuagcacuggugacccgagacauugcuuuucugaaaguguggccccuggucuuugguuugcucaaagcuuugcucacgcaugguuuccccucugccauugggacuuacauauguucaccuuuuucucuaacuuugucuuguugccuaaaagaaaugccaaagcuucuugacgguaaaggaugauggcucuuguuuucuacccuuaccuaucuguggaaaggagcccgucugugcaugauggaugaccacgucaccuuuggcaaaaagucucagugcccccagcauggguggccugaagggcccugcccacuccaugcuggccacagaagggcaggcacccagccugaagggaaggaagccugggcaccucacguccaccgggcugcacacaccuugcucucggcugcuugcccugcauguccugcccugucucaggcccuugcccuaacccucuucucucccccaaccucccucccucuuucagaaaucaacagcagugauaugucggcccacgucaccagccccucuggccgugugacugaggcagagauugugcccauggggaagaacucacacugcguccgguuugugccccaggagaugggcgugcacacggucagcgucaaguaccgugggcagcacgucaccggcagccccuuccaguucaccguggggccacuuggugaaggaggcgcccacaaggugcgggcaggaggcccuggccuggagagaggagaagcgggagucccaggugagcauugcgggcaggauuuucacuugggaagaauagaguugagcccaggcagugugggcacccacauacuuuuuugccccauuugaaagagaagacuucugauagguggcauuaagggcauuauuuaaaacaaggcaucaugacuaagucuggcacaguuuguaacuaagcuuugcucacuuacguaaagccaaacagguuucuuacugggagccuccuuggagcccguaucuuauuagugugcaccugagucucuaauuggggagcagaguaauacgguuuccagagcaucuuucagggcugauguucuguggaacauacuagaaagcuacaaaacugacuguaagcauccuuuccugugguugccgcuggugggaagaucuguagggaaaaaauggaacauucucaucuuucucuggcuugguuaagguguauucauuuuuuaaauuuuuuauuuaauaucuuuuucucucuuguuuguuagagauggggucccacuaucuugcucagacuggucuugaacuccugggcucaagugauccuccugccuuggccuccuaaagugcugggauuauaggcaugagccacugugccuggccgguuaagauguauucagggcugggcgugguggcucacaccuguaacucuagcacuuugcaaggccgaggcaggcagacugccugagcucaggaguucaagaccagccugggcaacacggugaaaccccaucuuuacuaaaauauaaaagaaauuagcugggcauggcggcaugagccuguagucucagcuacucgggaggcugagacaggagaauugcuugaacacaggagauggagcuugcagugagcugagauugcaccacugcacuccagccugggcagcagagcaagacuccgucucaaaaaaaaaaaaaaaaagacaugucuucagaggacuccagauguccugugaauuuaguuaucacuagugaugcuuaggaaacuucagcaauggaccuuggaccuugcuuggguucugcuugggguuggagaaagaggaaagggcuagcaacagacgaaaccuagcacugcagguuugaacaaggauggaagagggacaggggcucuguggggcucagucacuaaccagguuucucuuugcucucagcugaguucagcauuuggacccgggaagcaggcgcuggaggccucuccaucgcuguugagggccccaguaaggccgagauuacauucgaugaccauaaaaaugggucgugcgguguaucuuauauugcccaagagccugguauguauucaggguucacaagaggacauuuuccuuguuugaacaugauuagguugcaaggaacagaaauccaucaaguuugcugaagucaaugaggaaucuauguguaugggcacaugggacagccuccuagaaauccaguugcaagauacauggccagaccucuuaagggugggaacgcuuguucugguugccuuuugccuuucuccauuagccucucugcuucuugcuuucauucaauugcuccauucuuuccaccaaccagccucugucugcccacccauggcuacccuggcuggcugccccagaagaguggccuuggcaucugagcucccucuagcaggagcucuuaaccuuuugugugccauugacucuugccaucuggcgaagccuauggggacuguucuugggauaauguuuuaaagcacauaaaaugaaauaugucacauuauaaaagaaaucauugauauuauaguacaguuaccaaaaucuuacaagaacaaauaugcaacauagaaacaugcauaucuucguuaauacauuaaaucauaagauuuggugacaguauauuaacugucaucaaagugacaaaguaauaagugaaaaugauacgucaaaauaacuguaaaaugacauaaaaauauaugauuuuuaauggugauguaagucauauguacuuauaaugugcugugauuucuugucaacauuucugaagaaaggaaaugguaaauuucaguuagagaauggugaaaauuaaaacguaauuuuuuccccauugaaguccauggaucugcugaauucaauacaggccauuuggggacccugugagccccgguuaagagucccuggccuuaccccacuaaggaaaucauaucggcccagccucagccaggcgacucccacucaaccaaucagcuguggccauugaggagggcugggucucucugaaggcauuuuagcccuuggugagaagcaagaguccacucuggguccagagucucugaaaugaugggacuuuccuguccucauagguaacuacgagguguccaucaaguucaaugaugagcacaucccggaaagccccuaccuggugccggucaucgcacccuccgacgacgcccgccgccucacuguuaugagccuucaggugagaugcaaggaagcauccaucuccuuggccgcaggccaccagugagaccccuggacuccugaggcugcuucaauguccccuuaggugcugaggccccuuuucacauuuugaccacagaugucacccagucacuggggagcuuuccuguggcagagucaacuccccauacacuuagggcggaugacacuuggggcgagcaaaaacagagccacagucaacaacacaccuuaauguuuggggacacguuuguuuuuaaagguuuauuuaagagaaacaaaggaagccuguucauaacugguuaagggauaacaagggcuuucaaaacaaaaccaacacaaaaauaacagugcagugauguuuuagccugcuguuguuggcugccuuucuucaagaaagucaguugcaacuuacugugauucauuaauaagugugcagggaacuauauuaagagcuuuaucaguguuaccucaguaaauccuugcaauagccugacaaguagguucucuugaccccauuuuaaugauggaaaaacagagauacaaggagguuuuguccacugggaaccagcuaguaugaggcagaacaggcacaguguggcuccagaaccuguauuuuuguuuguuuguuguuguuguugaggcagagucucgcucugucacccaggcuggagugcaguggcaugaucucggcucacugaaaccucugccucccagguucaagugauucuucugccucagccuccugaguagcugagacuccaggcacgcgccaucacacccggcuaauuuuuggauuuuucguagagaugggguugcaccauguuggccaggcuggucucaaacuccugaccugaggugauccaccccacucaaccucccaaagugcugggauuacagacgugagccacugugccuggccagaaccugugcccuuaacggcaaccucucuaacccccaccugauguuguggcacacgguugcauaguccaucccauuaggauaccaggagaugcaacauuuuuccucguccuaaacaggucacuuaauucaagguuguacuagcaccuucagccaaacuaagaaccaucggggaugccucuggguuuuugcccaggacacugaaaaauaauuaggugucugaacugggaguagcaauuaaguugugaaauaacaucgaaaucccaaaguaugauuucuggguaagaguuucuaaauagccuugagcugcccccaguucuugaaaauauuggauucauuaaaauccaaucugaugucuaagauuggugauaucauuggcuuuaguuccauacacuugguuuacauuugagauucuaaucuuacucugaggggaacugggauaccuccaguuguuccaaacauuagucuuucauuuagagacguaaacagaacccaaaccagacucaguccacacauugaagcggccucauccggagaauaccaaggguacuaacugguuacugugguguagauguuuuucuuguguuucauuuaaaggcuucuuaacagaagugucuuuuguggccaacuuaacuaaaaccuacggagggagauaaacccagcacuuauugagggcaggagcugcccucaugcaucucgaagauuucuuucaaaucugccgaggcauuuaucucccucuugaggauuuagcggcaagcggauucagguaauguaaaugauucugucuaaaaggagcugguuuggaaaaauccccuccaggaaacuucuguagagugcucucgucauagcugggucauaaauguuucaguaagugcacagcaggcuguuucuuaagcuuuuguaaccagcugcugccgcaggagaaguguguucaucagcaucgcccccuguucuucccgggucauuugaugccgagugauauguaaauuauugaucagagauuuugcggaggcccacgcaagcaacaucuggugcugguuagcaaagagaggcauguaucguuuugucuugcuuuugagacuuuuuaggaaauuggaguaggcuggcacuuggggugggggugggaugggagugaucuggugaucaaagacccucuaauucuguguucuguccucccuccucagucuauauccccuagggcagcacaguccaauaguagguucugcagugaucaaaaugcuucaagucuaugcuaugcagcaugauagccacuaaccauaugugacuauugaacaucugaaauguggccagaggaaccaaggagcuggauguuuaguuuuauuuaagugcauuaaguugaaauauauguauauauggccucguggcuggugacuaccaaauuagccagugcagcuuuaggaccuugccaugaagaugugguucuugggccaguucuuggaccucagcaucaccugagaacuucagucccagacccacuggaaaagaaucuguauuuuaauaagauccccagaugguuugcuuacacauuaagugugagccaugcugcuucagaguuauugccugaggaguggcuguccgaccaagucuaaaucaaaauuacugacuuguaaaaugcugcuguucaggauuggcuagucuuaaaauaucucaaauguuguugcucagcuuuguucuuaaccaucugaacuucuaauccccuccucccagaagaggagauaguuuccaagacaaaguauggggagugaaacugauccagggaagagcaaaagcuaugucuuucuauggcuucuuguggggauacaaccucuaaaugcauauuaauauuuaauaauaagcugacguuuucgagccucucuguguaugggcuaggcccugugauaaauguuuugcaugcacagcuucauuugaucuuuauaguagcccucgagauagaucguuauuaugcccauuuuacagaugaggaaacugagacucgaagagguuuggcacccuagauauauagcuaggaaaugguaggaaauccagauccagcugauucuuaacugcuauggaguacugccuucuuugcacacguagcccuuuauaauauguuccuccaggucugcccuugagauaacaaacagcauaacauaaaacuguguucguguucgugagugcaugacuuuguuagcugcaguauccucuuaaaagaggacacuuuuuugaccuggaacauacuggguuuucuggccugcaugggcauuauuuuggaugcugagaugauaguccuuuugaccaggaugucucaaguauccaagcccagaaaucaucucuucuaggcugaaucaagaugguuugcauaagagaccaugcagaugcacgucucugcuaucuuacauuaaaaaugcagaauggcucaccugcccuuuguugucauauguuauauagaaaaaccuauuugcaugagaacugucacccacaguuuuggguagggucagugugugccacugagcaggaacgccgagggccauaaccugucugauguauuaaauucucaggaaucgggauuaaaaguuaaccagccagcauccuuugcuauaagguugaauggcgcaaaaggcaagauugaugcaaaggugcacagccccucuggagccguggaggagugccacgugucugagcuggagccaggugagcaggaggccugcuggggggucccagcaccagcacuuuccagcagaauguuccuguaaaugugugucccaagggagggcugaucaguuucauuacugccagugagccucugaauucccuuugcuguugccagauauuguuuauaaauuaggguuuaaacaugugccagggauagggagacccuuuaugcuaggagagaaugcucauucuuucuuucuuuuuuaaacaaaugcugggcuggguacagugccuuaaccugagaggucaaggcugcagugagcuaugaugcagugagcuaugauugugccacugaacuccagccugggugacagagugagacccugucuccagaaaaaaaacaaaaaaacaaaaaaacacauacacacaacacaaaaacaaaugcuucuuuguuuucuguuaguuuuucagauuccuuuugcaugacauucaucauaauuuuucuuucauauuguaacaacaucuuacagauuuuuauucauugaccuuauggcacgaguaagcauauuuugaucucacuuuacucuaaaggaaaaguagguuaauguucuguaaauuuaaaaaagaaaaucugggucucuaggcccuaauguccuaagauuuuucuugcuuggugccuugguauauggaauucucugauuuaaucaacuuuaaagagacaguguuaccggugaacauaauaaauuuauuaagugucagaaacuugaaggaagguauaaggcucaaagaguugcucaaaguuuagugaaggccuggccaaaaagcagaugaugaccccaaaugaucacuaguaccacaggagaacugugaagcaaaugguaaagauggucagagcaggagagagaaauaguuucugccucggugaguucaggagggcuucucagaggaggugacauuugaugugggccuugauguaugaggaggagaccuaugauuacugccuuauagggcauuuguugugugccuggcuguauuuguauaguguaguuggaaaucuaggcucugaccaggcaugguggcucacaccuguaaucucagcacuuugggaggaucaguugagcccaggaguuugggaccaaccuggguaacauagugagaccccuucucuacaaaaaaaaguaaaaaaaaaauuagccaggcaugguggcacacaccuguagucuacuugugggggaugaggugggaggauugcuuauguccaggaggucgagacugcugugagcugugaucaugccauugcacuccagccuggguaacacagcaagacccugucucaaaaagaaagaaaaaggaauguaggcucugugugaacauuuagaucuauguuuccuaguaggcagaaaggcaguggggagccucaggaggaacaaguguaaaggauggggucagauccugguuuuagucugaaaggccaaguggcaagcuggugcucccagagugguccauuugaggaagcaguggcacuggaaauggagaggagggacuugaggccagagaucuaugguggcuauagagagugagagagagaauccauuccaaaauguuccacguagcuuagugauugggucggaagaugacagugcaguuaucagaacuagggccagccaggcagagggugggugaggauuggucagggccuuaaaggguuuaauauuuuacuuugagggguuuugaaggauccccaauacccaaauggagauguuuacuagaucacugugagguuugguggccucagccccaacagucccucacuggguacccucccucuucucuuaaagccaaugugcuucaggggaagcuaacuccaccccagacaggauuugaaccccuacagauguaugagaucauuagcaugacacaguuacuauugauugcaaauuacagaauacccagcucaagccaacucacacaauaaaggggcccaguaaguugcauaacuagaaaguucaagacauccaagacagguuucagcaauuugauuuggucauugagcugcgcccugcaaggcgucaaauauuucugcuguucugcuuugugggccugguucuggccuuccucuugguggcaggauggccuuccucuugguggcaggauggcugcagcagcaccagaugucccaccuucacgccacaucaauuaagagagacacccucucaggauucuuagaagucgagagccuccuuucccagaagucuccagcacgucugccuuccccucucacugaccuggacacaugcccacugcugagucauuuccuguggcuaaagaaaugccaugugcucauugacuaaggcuuagugaagaaggauuuuucccugauccacucagggaccacaccuggacauggcgguggagccagcuuccccuacaacacauuggcuuuaagggaggcggauggggacuguuggaggauguucagugccaaaggacguagggugcacagcuucauggaggugcaccucuguggagacguccagaggcagggagaagagcuuuggggaacacaaauucugagagggaugaagaguacuaggcaccagggagagaccgagagacuaccuggagagguaggaggagaacaggcucugcacccugggcaggagggcuucaaggaggaagcggcagucagguggugcacaauggguagauguucuaggugcccacuucaguuaacagauuaccuugcuacaugcugugacccaaacgcacagccacaaaccugcccugugggggcaguuccuagcuuugagcuuaauuaaggagcauuaaugccaguuggaaccguuuuuuuuccccuucaaguggccaaauagagaaacauagaagaagugagguuuucuuuuuucccuucauauauauuccuuuuuauuucuuguuaugccuucccaaaacagagacauugaacaguaguuagaauggccaucucccaauguuuaaaaacaaacugaacuccccaaugggugaacaaaguaaagaguaguaaccuggaguucagcugaguaagccgcugcggagccuuaaguggugaggucuuccaauuucagagugcugugucuucaacuuguaucaucauuuuaguggaaaaacauaauuuaauuuuggugaaaugagauucaucucgugacaggauuaguaacagcauucacagaauuucacacugaagaagugagguuuucuaaagaaaggaaguguucuucugaggcaggggucagagucuuguccuguguuuauaggauuugcaauguggaugcguuucccuuggggcugaugagggauacccagggggucugucugguucugaaauccaggaugcugagugccaggcucccuguagaacuguugauuuuaaaugggccaucucagcuuggccuccauccuuuauccucacugaacucagggguguccauuugcuugauuucacccugugccuuugcucauucuccuagauaaguaugcuguucgcuucaucccucaugagaaugguguccacaccaucgaugucaaguucaaugggagccacgugguuggaagccccuucaaagugcgcguuggggagccuggacaagcggggaacccugcccugguguccgccuauggcacgggacucgaagggggcaccacagguaacccacucuucugcuucuugaagccuuaacugaaccagcuccagggaccaagccagauggaaauccucaagccccaugaaagcuuuuuacacguacuccccguggaaacuggggucaugcacacuucggaggcgcuugcuguccaaagcuguuuugggaguugcgguuugacccacgauaaauccagagugagagcucgauggccguguuaucacaccucauuacuguuaguugugauucagauuccuuccucugccaaguuucuugacuuucagaacaggaugcugauagucagggaacacagcacagugucauuaauuuugaggguuucuuugccugcacagaauucaugaugcguccaagugggcuccuacccgucuguucuuucaugguaccaggcucccagaaaugcacugaagcagcaauaagaccugucccagccuaucuccuccucuuuuuacucucagaucuuaauggaggaggagaaaagacugaaauguucaaagaauucugaagcuuuuuagacccguuacaauuuacuuuuauucuuugccacagaugggacauguuugauuaugaaagauacaggcagugaagaaguaaauaaagugagacucacuccaucuucucuccuccucccccaccugggucuggaagcaaacggcucugggaagggaggaccuucacccugucugucaucucauugucugucuucauucuugguugcuggguugguuagcuaauugguucauuagacaagcagacacagaguuuugcuuuugucuuacagaaagaaucuuacuguauccacugugugguauagcuuguguuuuugcuuugacaucuuaaagaucuuuccaugucagaacagaucuuccccuccuuuuccuggcuguagugagaauuccugcugugaaucgcaguuauuugaacagguggcaucggguggugcgcagugagugcgucacuguuauggaggcugccaggguggagagucaguccuuagucuuugcaggggaagugcgcaguguggacucacuggggcauguuugcauuugguguuacuuuggacccucuugggaaagcaguauguccugguuucuugagucucuuguguguguacccccaccccgcauaaggagagugggauggagcagacuugccucccaggggugaggggugaguggcugcaugguugccuggcauccagcccuaggagcaagugaccuguguggccaaggggcccucuccgggugcaggagugacuggugggcuggcaggcugcccgggacucuggccaaagcaguggccucagcaaagccacccacagggguggugugagugcugccagacuccccaggcaaauccagcccggcuccacgcugaacucugggccugcggcuugccuuuugugaaaggcaugguaucauuuuaccguaagugauguccauuuuacagauguggaaagugagaugcagagguugagucacuccccaaacaacacucccccaaaaagcagucagcugggaggaggcagaaccaggaaucagucuacauccgugaccucagagccuaugcgcugaacccccgagcuuggcccccucucuaaguggcuggcucacccagaggcagugacugcauccccagcccacuuuggggauguccuaaaccaggaccccuguccucccagccacucaggaguacuuuccaggcagcagugcuggcacuugggcccugacaagguacucaccuuugagggcccaggugggguccucucggcacuuggagcgcguggcaggcuucaggccaggccucacagcagcugcuggggucucccacacuggccaggaagcaucucacccuccugcuggcucaugccgcugugccugggcccucucccauuuccuuuuggcuguucgcacaccuuuuugggagcuuggguuucaggcugugcucugcaagugcuggacgcugcugagagaaggaguugcucuugcagggaagcuccuagccaggaggggagagguacagaaccgccugcuucaaacccuguguaaauauugcucuugucacagggaaggcgccuuguuuuuccagcccuccugcucccaagccuuucccuaaauauccauucugagauuacacagcugcagugugcauggaaugaaaagguaucugugcuuggccgccagagcgcccaguauccugaccuucugaacaaagcaaaccucccucuguuuuuaaugggugaguuugcuguaucucuuggcucaagcuuuaaaugguccauucuguagauuuuggaguaggggaauguggagaauuuggggcgggacccugcuggaggcggcuugagaggcugggagauagaccagggagcuccagauucuuuggagccgcugagcaauuuuccuaaugaaaugguccaggaaccccagugugcucgggguauaccagaagggccuccuuccuuaacugccuugaagaacaagcagugcugcguuuaacaugcauuaaacucacaggaacugagcuggacauauuugagggggugggggaagaccgccacgcccagagauguuuuguggugucagauacagguuauagcuagaggcaguggugagagacuucugcuuguggauuuuuuuccuuccaucuucucucagguaagugcuuuagcuccaaguuggacagacuuuauguuuaaaucccaguucugcugguccccagcugugugacuccagaugaauuaucugacuucacugugccucugcuuccuuuccuguaaaacaggauuaauaacaggacccaccuaauaggcuuguuuggagcuguagaggagguaacagccaaguaguagcucuugucccauaaccccugcuuucucuuuucccaccucgucuucccugcccuuuugggcccucacagucaagaugaacugauuuuugguuggucaaaauauugcauuagggccaaaugggugcgguggcucaugccuguaaucaaagcacuuuggaaggccaaggcagaaagauuguuugaggccaagaguuugagaccagccugggugacauaguaaaacuccaucucuaccaaaaaaaaaaauuuuuaaagacgaacuuaggaaugaaacagcuuguuaaaaaaugguggaacuuuccccugcagccacaucauuucaacuucacuuuaaaaauaucuuuuuggccuggcacaguggcucacaccuguaaucccagcacuuugggagguggaggugggaggaucacuugagccuaggaguuugagaccagcccaggcaacacagcaaaaccccaucucuacaaaaaaauuuaaaaauuagccaggcgugguggugcaugccugaagucccagcuacuuuggaggcugaggcaggaggauggcuugagccuggaagauugacgcuguggugagcugugaucaugccaccguacuccagccugggcaacagaggaagacuuuaucuaaaaaaaaaaauauuaguaauaaggccgggugcguuggcucaugccuguaauccuagcacuuugggagaccaaggugggcagaucacuugaggucaggagcucaagaccagccuggccaacauggugagaccccaucucuacuaaagaaauacaaaaauuagcugggcaugguggcgagugccuguaaucccagcuaaucaggaagcugaagcaggagaaucgcuugaaccugggaggcggagguugcaauaagccaagaucaugguacugcacuccagccugggcaacagagcgagacucuaucucaaucaaucaaucaauaaaauaucuuuccuuaucaucaccuuacagcugcuuccuggauggacacacugucuccuuguugcucaccucccgcuucuucccuacguagccccaggccucagagcugcugcuugaggggcuucuuggcugcacagauuagauaccaugaugagguugagauaguguuggggguggaccuuggggcaggagccucaagagcuuccaggaacagcuggguuguguuugagaguugcacgauagcagcucuuuuguuuuuauugauauccagaacaauaauucuuucucuggacuaggagcuauaauuaaaccaaaauauuucccagcuggggcagugucuagggcucuggcagaagcauagcccugcauggggaugcuaugccaggcaugccccauagagggcacuguagcaggcaugcgccagaccugaugacugaaggaggcucucccugggccagcuaaguugucucagggcugcaguuaggggaucugaggcagcuccacugcccauccaggggucaagagaugagccuggcaccagagccaugcagacaugguucaaacccggcucuaccacuuucugguuguguagcgugacuggcccccucccugagccgcagagucauuugugaagcaggaaucacggaaaggauuccauaccacaugcguaaauggugcugugcacaggaccuggagccggagugggguacgcaugccccgucagcgggagcugcuguucuguuccugugcuuguugcuggaauucacggcaaagugggugggcuggcaggucacaguggcugcacccggucugcagcacagugccuggggugagggcugaggaggaagggaggagaugcuuggccucccuggcuucuccaagucuacccggagaagaaaggacagucagaggggcccacgccucccccacaccccuggagggagagcuggacucugguggcugaagcagcacuucaggcucacagugugacucaggcuucuugcccucagccacaauggcucaugcccagaggagagaacaggguguccaggcuguuggugcuugugggcgaaaugucagccaugcuccuccugccuuggccuagaaaagggagcccccaccccgcagggccugagguucucucugccagaaguucagagcuagugccaguggguucccaugccaccagggugagcccucuguaaggggaucuaugugugucccucaccacggccucagugcucccaggaaagcccuccaagucaucaacacagcauuuucuauuccuuucucccagguauccagucggaauucuuuauuaacaccacccgagcagguccagggacauuauccgucaccaucgaaggcccauccaagguuaaaauggauugccaggaaacaccugaaggguacaaagucauguacacccccauggcuccugguaacuaccugaucagcgucaaauacggugggcccaaccacaucgugggcagucccuucaaggccaaggugacagguaacgaacaaccaccuucggaguuacucucccuuccuggggagcugguugugucagaucaaucauaguggaaacuauggaugguuuuagauguguuaaagcuacuuugaacuuugaaugucaguaaauaguaugagaugucagagggcaguguuugaaacuuacaaaaguccacagaguggagccgugcagaaguugagaaagcauguuaggauguuaggugguuuucuaucucuaacaggaaagaauacauauugaaaucuuacguauuuguuuagaucagggucugaaaaauccccugauuucuaauuuucacuugaaaaauaaucaaaaaguuuuccuauacuuauaaaaaugugucuccuccaaaacacuggaaaaaauaccaaacuaugaaaaccacuucacagccaccacccaagguaaccaccauaaacacuguaguaaaucccuuccacacgucaugauucacuguuacauaaagaauguagguucaucgcaggaaaauuagaaaauucagauagaaaaaucauccuuucucauccacagaaucauuuuuugauauuucauuauaugucaucccaaacuuuuacacugcuuauacauagacuauuuuaugucaauagaaagaugugaauuccacaggcacaucuuugguggguaggggguggggggauugggaggguccuuggccuugucagccaaggccagacucauccauuugcccagaaagccagauccuaguuguaugggggugggauccuagggguuuagaagacauuaugggugugagauacaggugugguggcuuuuguguuggggugcgcgggcucuccugggguuacuguguaggguacucgccuguccucuggcugagagaccccucuugaucuggccauucaugccugucccccucccuccuguaucuuaggccagcgucuaguuagcccuggcucagccaacgagaccucauccauccugguggagucagugaccaggucgucuacagagaccugcuauagcgccauucccaaggcauccucggacgccagcaaggugaccucuaagggggcagggcucucaaaggccuuugugggccagaagaguuccuuccugguggacugcagcaaagcugguaggugucugggccuuuucaagggugggguggggcaggggcaggcugggcacccuggguacacuggccuucccugcugaggucuccugcagugcccacccccauguaggccagccguuugcaaguaaccaucgucaugacccuguucuccugcacuuaauauuuuuaaaugauuuccuucucuuuugccuuuugaacuuggguauuuauuuggguuucaagggucgguugccuggguucuggcauccaguacaccugggcuggaaaccuaguaccgccacuucauucauucauucguuuguucuaaaacuuauuuagccaugugaccuuggaaaguuauuaaaucucuuuccaaaagucaguuuccucuucucggaaguaccuuccuuaaggugcuugugagaguaaacaagaagauucucauagccaacacuuagaauagcccuuacugugugcuagguuuugacacccauaacucuuaaaccucacaacuaguucgugagguaugugcuguucucauucccuguuuacagauggggaagcugagcuagggagaggugagauuccaguccaaggucacccagguagcaaguggcagggcagggauucgaacccacaccgucaggcucuaugagccucugcuuguaauugccacgcucucccaccucuuaggggccccagcauuaucguggaagcaccuuaccuuuggcucucauauuuccucuucuuccugugccuguccugaugcauccggguggaguaaccaccuuuugccuccuaggcuccaacaugcugcugaucgggguccaugggcccaccacccccugcgaggaggucuccaugaagcauguaggcaaccagcaauacaacgucacauacgucgucaaggagaggggcgauuaugugcuggcugugaaguggggggaggaacacaucccuggcagcccuuuucaugucacagugccuuaaaacaguuuucucaaauccuggagagaguucuugugguugcuuuuguugcuuguuuguaauucauuuuauacaaagcccuccagccuguuuguggggcugaaaccccaucccuaaaauauugcuguuguaaaaugccuucagaaauaaguccuagacuggacucuugagggacauauuggagaaucuuaagaaaugcaagcuuguucagggggcugagaagauccugaguacacuaggugcaaaccagaacucuugguggaacagaccagccacugcagcagacagaccaggaacacaaugagacugacauuucaaaaaaacaaaacuggcuagccugagcugcugguucacucuucagcauuuaugaaacaaggcuaggggaagaugggcagagaaaaaggggacaccuaguuugguugucauuuggcaaaggagaugacuuaaaauccgcuuaaucucuuccaguguccguguuaauguauuuggcuauuagaucacuagcacugcuuuaccgcuccucaucgccaacacccccaugcucuguggccuucuuacacuucucagagggcagaguggcagccgggcacccuacagaaacucagagggcagaguggcagccaggcccacaugucucucaaguaccuguccccucgcucuggugauuauuucuugcagaaucaccacacgagaccaucccggcagucaugguuuugcuuuaguuuuccaaguccguuucagucccuuccuuggucugaagaaauucugcaguggcgagcaguuucccacuugccaaagaucccuuuuaaccaacacuagcccuuguuuuuaacacacgcuccagcccuucaucagccugggcagucuuaccaaaauguuuaaagugaucucagaggggcccauggauuaacgcccucaucccaagguccgucccaugacauaacacuccacacccgccccagccaacuucaugggucacuuuuucuggaaaauaaugaucuguacagacaggacagaaugaaacuccugcgggucuuuggccugaaaguugggaaugguugggggagagaagggcagcagcuuauugguggucuuuucaccauuggcagaaacagugagagcuguguggugcagaaauccagaaaugagguguagggaauuuugccugccuuccugcagaccugagcuggcuuuggaaugagguuaaagugucagggacguugccugagcccaaauguguaguguggucugggcaggcagaccuuuagguuuugcugcuuaguccugaggaaguggccacucuuguggcagguguaguaucuggggcgaguguuggggguaaaagcccacccuacagaaaguggaacagcccggagccugaugugaaaggaccacggguguuguaagcugggacacggaagccaaacuggaaucaaacgccgacuguaaauuguaucuuauaacuuauuaaauaaaacauuugcuccguaaag

SEQ ID NO: 17438 - RNA, 10439 nt, Homo sapiens
gcccgcucucuggcuuccagcccgcgcugccguuagggggcgcccgcgcucguggcgccgcggcucugcugggaaggcgccgcccgcgccgggcagcuggagccgcaacuccgggcgcgggcucagucguccccucugccgccgccgccgccgccgucgccgggcgcgggcucgcuuguccccgcgcucgcgcucuccggccgcgggcaucucccggcccggccgcagcagccgccgccgccgcgcagugaguggggcuggcgcggggcuugcggggccgggguuugggagggccggguuucaggagacgucugcgccgagcggccaggggagcggggcugaggaggaucugggcgggggcuccuggaacggggcggcggcggggccgcguugaggggaccgcgcgucccgggcuggcacgagccagcagcggaggugcccgcggcggggccugggcggggguuccggggcccgcccggcggggaugcgcgguuucugcgggcccggguucggagccccgcggcgcgccccucguccgggcccggagcaucgcccgcccuaccccuggccgggucggguugcgggggcuucgcuggcggggcagcagcgaagggcggcccggacggagauauuuggggugugcucgaaaaugauuguuuuugggagauggcgcuuauuagccaccaauugcccuaguuuaaagcuugaggcaggacucaaaacccugccuuugggauuuucugcccugaagagacucucagaucgcagcugaguucuuuaugccuagauuugugugugugugguggcguuuuuaaugcuugaugucagaggugauaaauggccaugguaauggggagcccuggcagcaccugcugggcugacagugguggaggcugugucugggggugggacggggaaaugaaacgugacagagauccuguuuggauauucugccgaaguuaccauguuucuguucaaguauaccaguucuagaacaaguugauggauccaauuuuaggacuuugugauagaagagguuuggguggcaaagugaccugggaugacccggcucggcuaagaauauuugggguagccuaaguaucucuucuauaucccccuggcauguucuuuuuuucgcugucacaaaugcccuauuacuugaaucauccugggauaggagagaagcuuggggacagcauguagcacaguccugagcccaagauugagauguuuucaaaugaacgaauauguagcuaggaaaaggaaaauguguuugucagcaggguugguagguugagaguauuuucucuuuggccgaaaccaucaguccauacugauacuugauuuugugcuaugccuuagauaugaacgauggaguggucaggauagccauggaugccauuccaaaguuuugugauuugaauuuucauaaaucauauuuuaaccaaagcauuacuacuuaaaggaaucuuagggugaacccuaugaauccuucagugcgcuuggauuuugauauuugggguccauuuaaaauggaguaccuguauguauuuggauucagcuuuaacuuggagauaaucccgagucaugcuuuaaagaaguuccuucugagaucaggagcucagguguuuggugaacucugggaaaacuagacacuccccuuuaccuguauauaguucucccuucuggagcucugggaaaaggaggaccuggggagauuugaagcaaauuaagaggcugccuccuccauauuugccgucuccaggccaaugcucuaaauuacuuguguucacacucaaguuucucauguuaaccuagaaauuuuguuuaugcugcugccacuaauguuuucacauuugucuaauacuugcuaguuuacagaugguuuuauauucaugaucucccuuauuuucuccauuuccccaaagaagaagcugggcauaaagagugauuuucucagggucucauaaucaguaacggagcagaauucaacuacaggaccucccugggaaccuguucucuuuccuuguccugauguguuacucuuauaggccaauuuuugccuuuguguugugccuaaaugguguaauuaccccguuuugggaaggugguauuaucccguuuuaucuugcggaaacugaggguuaagaggaauguuaugauuuugugacuauuugugacagcuuuuuaauauuaggucacuuuuaaaccuauagcuucucucuucuagaccacaugguugagaaaggagaaagagaaaaugauuacuuguagagaaaaauccauuucugcagugguaugguuaaggauaaucuaaccauaaucacauuauccuuguaugccuggcuacuuaugcuggccuguaugugaauguuaaccccaaagacuccuuuagaugucgcugaacuaguuacuauaaaaaguauuucgcuuucaaacucccacauuucaagaagagcaaaacucaauacaaggcaauuuugaagguaaguauagaaagagggaguuuauugagucuuuucugacuaccagacacgaagguuucaguaaaaaagcauuuuuaaagggcugccuggaaacucugggaagucaguaguuggaguuuuuuauuauucguuggagguuuuuauugcaacauauagguaguuauauaggauuaggacuuuugccccggagaauucuuaaucuauagcaggaaugauaaacccagaauauuuuuguuaaguuaguucaucauaaccauuaggccuguaauugcaauucugcagugauagggagaauggcauuuaaggguucuuagguuauuuuuuuaaguuauuaacuuacugaauuauguaugcauuucuucagauaugcuacuuuagaaaauuaauacuuccuuuuaagguuucuauaaauucuucaguauguguuuucuuaagcuuaauuaccugcuaacaugacacugucagaauuuauacauuagucacaauaaccuuugaagcuuaaacaugguugaauuuucagcacugcuuuauauucuuuggggagugggcaguguuguuuucacaagaauuuuauuugcaucaaagguuacaucuuuucaggugaacugauuuuucagggucagaggcuucuuugaauuuuauagcuguuugugcucgguugcauuugcugucuuucaaaaccaucuuuaguuuuaguaaggaaagucacuauaaaggaaaaauuuuuuauuguuaccauuccugguagauuuucugaaauauuagauauuucuuugcuuucaucaaguaaaauaggccuauuugauacccauuucaagaucuuccuucugcugccugucuuguggucauuuaacuucucauuaagcccuccacuggagacugugccagaagggagagaagaugaaaagcaaaugaaucauuuucuaauuguuaguagcucuggaaaaugauucaguagaagagauugaaacuauucuggaaauucuuugggauuguauuucauucaucugcaucguuucagagauguuccuaauggucgucaauucagaauucagaagccgaucauuauccagcuauuggauaacagggaauuuuucaugcuuuuuuuuuguuuguuuguuucuugcuguauuuaagcaucuccacagaagauauuuagaagcagguagagauaaaauuuaaacuaaucaauacuguuuuuucccuuugaacucuuuaaugcacaauuugauuucuuuagacaguuuacucauuguuauuggaagugacuaauaguaacuuugcuucaauuuauuuugauguaucuuauacacaaguauaggaaggcuuuugggugguuuuuaagaaacaugggcuguagauucccauaauugcuuuccugaauuauuaagcgugagcuuucauuacaucuuuguaccggaacuuuugcuuuugcuguggaacagauucagggacaucgucuaauuuuuuuuuuuuuuuuuuuagauaacugcucaagaaguuaccuuguuuugauuuagcaguaaaaaagaaaaaaaggguuaauaguggacagacuuuucguuaacggcugcaacauugaugucugcuuuuuuccuugucuuugaucuucuguuucucauuuaaucauuuggauauucacggauuggaguucuuuaugucacuacagacaggacagcaaccguuauucacacuaguugaauggguuccugccuuuuuuuggugggggggccucaggagaauuuuuacaaacccauuaugacuguuuaguuaggcugaguuacuguaaaauuuguaaauaaaacccuacuggauggauaggguuaauagauggcuauagagaguuuaaaguuaagcuuuuucaauuucuugucucuuggauucuguucuuucaauuucuacccuaggaggggauuuauggaaaaaucuagacuaagagucagaacaugcaaguucuuaucuaguuacuucccagcuguggcgcccucagcuagucacuuaaucugccuuguuucucuguuuugcaucuuuaagaugaggauaguaaucccugcucggccuacugguaucaggaauguuguagggggaaaaaaagucuuucaugccccugucuauuaaauuguuucuuccuucuagaaucccuucucagguuguccgaauuuucuuucaaggauucaacugaaugggcucuucccagaaguccucuauuucccauuugaaaucuugcuuuuccccucucacgggccucugcugguccaucuguuauacagcacuuugaauucuguucuguacuucagucauugcauguugccuuccauuauagauggaaagcuccaugagggcaaagauugucuuuuuccucuuucuguguguccgcauugcacauaggcacccccuccacuccauaggugacccacaauaauuguuggcugaaugaaugauuauugaggcugucagaaugaauacuuugggugaugggaaaaugccaaagaugagcaucuuaccagaacuuuuggaugaguggccuuuuaaauugcucaguuacuaaucuguuguuaucaguaacugaaucagauccuggcaagacaaauuggcaaagcccauuucuugguccuguuuacuucggauacuauuugugaagcaagucagaggaaugaaagacugucauaacagucuugaauuugacauuuguuccauuucucaccccauagcauguggaggccugucuauauccaacugcugaguguaaagaauaaaaacugacugccccauagucugguccacauuuuaguugugugcuuugaaggauuugcaagguagagaaauagaugcuucaggcucugauuucagcccaugcugugcuaugcaaauguucucuacaugccugagugaccuuuugagaaagagccuuugugaucuucuguagcuagggcuuguucugggaauucugugccagauuccucuaaaagugggaaaagugaaucuguuaaaggaccacguaaaaaagccagugcuuuuccuggaugaauaccaauaaguccauguuucuuaccaugucuugccagagcuuuagaaauuugcucugcaguuugcuuuacagguugauuugggauugaagugugugagagggaacugacuaaggcaguucaguagcugggaaacuguuuguuuaaaugcuuuugaauuguagauaaaaauaaauucacauuggcaucauuaguaucugagcauuucucagugucuuaaggcuggcucuccaugagugcuggcugauugacucucaucuauaucgguaagguucuuuuugccccaaauugugcucuuuaacacuucggcauuuaaaucacuuucuauuuguuuuaauuguacaaagagaaauacaucauuauuuaaaagcaucaucuuuuuuuuuuauauuguaagauaaauaccauucugauguauuucucuuggaaagggaugcugguauccugggagguuuaugauuuuugauguuuuuacucaggugauuggcuuguauagcugaaaugcugaugaaaaggaguuuucccuucucccuuuuucuuuucuuuucuuuuuuuuuuuuuuuuugagauggagucucgcacuguugcaggggcuggugugcaguggcacagucucggcucacugcaaccuccgccucucggguucaagugaugcuccugccucagccuccugaauagcuaggauuacaggugcccaccaccacgcccagcuaauuuuuuguauuuuuaguagagaugggguuucacuauguugggcagucuggucuugaacuccugaccuggugauccuccugccucagccucccaaagugcugggauuauaggcaugagccacugcgcccagccugucccuuuuucuuaaaugaccuuuuuggugaggaccauuauagguuuguaccaggauaagguuguagaguuaaucauaauauucucuuauauaaauucuaaaaauugauguucuaagaagagagguagaauuugaaugacuggguuacuuccuagacucuuccuccuucucuuaaguacaguauaguucuuucucugaaaaucuucagucucuuaguuccagauggguucucuaugguaagaauacaggacauguagaaggcccuaggggaaugcuuucuuccccagaucuuugcccuguaguagguuucagcugagcaaggacgaguaguuuuucugguguuuggccuccucuguuggguggaaaaagacuuucuucucuauuuuccuaguuauauaugcuaucauaugucuguuuuucuccucuugaaguuucccugaaaccugggcucuugaagacgcaucacuggagcagauggauaauggagacuggggcuauauggugagugcuucuuggagaugcauuuugaaggcuggggaauuauuuuugugugucuuuuuauccuuauguauuuuuagguauaucuuauaagaaaagaaaauugugaauuuguguaaccucucuucccccuuuuacuuaguuuagauguauuuuggaggcguuuuugucuugugugguguuuuuuaaauuuuuauuuaauuuuuuuuauguggagucucgccuucuugcccaggcuggagugcaguggcgcgaucuuggcucacugcaaccuccaccuccuagguucaagagauucuccugccucagccuccugaguagcugggauuaucagcgugcaccaccacaucuggcuaauuuuuguauuuuuaguagacacgggguuucaccauguuggccaggcugaucucgaacuccugaccucaaacgauccucugccuuuguuugguguuuuaauggaaucaaacucaaaauggauuuuccaaauacuuuuuauaaucacuggagagguaacgugauuuuuuauuuuuucaaguguguugcucugaagacucuuucuucaugaauagugacuacaaagggaucuagugaguuuggaggauauuuuguugugguuugggagauuaaugguugagaaagugccucuucuccccacuugcauuuuuugugugugcauaugucucccuauuuuucuauuccuuugguguaagguauauuuuacuugccuauaccugaagucucugucugccuuucuuuuuucuuucuuccuuuuuuuuuuuuuuuuucgagacagggucuugcucuuuucccuaggcuggagugcaauggcgugaucucggcucaugacuuuccaagcucaggugauugucccaccucagccuccugaguagcugagacgauaggugggcaccaacauguguggcuaauauuuuguauuuuuuguagagauggaguuuugucauguugcccaggcuggucagcaacuccugggcucaagugauccacccuccuuggccucccaaagugcugggauuacaggugugagccaccacaccuggccuauuuuuuucguaaauaguauuucuaaaacugaagguauguuuuuuaagagaagcuugcuucucagaauuaaaggccagauugcagcauuaauguuacaaaagugaauacacuaucagauuaugaaauuuuauggcugcuguaagcuuuuggguaugugaugcuuuucuggcuugguuguauugacuaaacuguauauuuuaacuuaguauuugaaaguaucacuuccaugaaaaaguuaccaagauuaggucugcacaguuuuuaauuuaauuuaaauaauuuuuuuuuuuuggagacaaaaucucucugugucgcccaggcugaagugaaguggcaugaucuuggcucacugcagccugugccuccuggguucaagugauucucauaccucagccucccaaguagcuaggacuacucaggccaccacacccagugaauuuuuuuuuuuuuuuuuuuguauuuuuaauagagauggggucuugccauguugcccaggcuggucuugaacuccugagcucaggcaaucugccugccccggccucccaaagugcuaggauuacagguaugagccacuguaccuggcccaaauuuuuauuuuaaaaacaaauuucauaguuuguuccuuuuguuugagggggagaaaccaaagaaauauugaaaguaaaugucuauauuaucagaucauuuuaauucuaucuaauguuaaauuaaauucagaaaaaugcaagccuuaaaaaaaaaucagaaaaaaauaaguguauuuuagcguggcuuuucccuucccacauauauucuggccugaaaacucuauagauaaugggccugaaaugauuuggcucuggaagucaaugcccuguauucuuagcauaagucuuuaaagagaaauuggauuucuccuuuuuuuuucuauugaaagcaaauguuagaucacuucaucuggguggguuuauugcugguaguaaagucauuuugcauuagaggauuacuaaauacauuauagccugaaagaaucuugggcuuugcucaguaucacuuacuuucuuaauuugucaaaguuaguauuuaaaaauuucagaugacugaucauuucuuuacaaauuucagaugacugacccagucacauuaaauguagguggacacuuguauacaacgucucucaccacauugacgcguuacccggauuccaugcuuggagcuauguuugggggggacuuccccacagcucgagacccucaaggcaauuacuuuauugaucgagauggaccucuuuuccgauauguccucaacuucuuaagaacuucagaauugaccuuaccguuggauuuuaaggaauuugaucugcuucggaaagaagcagauuuuuaccagauugagcccuugauucagugucucaaugauccuaagccuuuguaucccauggauacuuuugaagaaguuguggagcugucuaguacucggaagcuuucuaaguacuccaacccaguggcugucaucauaacgcaacuaaccaucaccacuaagguccauuccuuacuagaaggcaucucaaauuauuuuaccaaguggaauaagcacaugauggacaccagagacugccagguuuccuuuacuuuuggacccugugauuaucaccaggaaguuucucuuaggguccaccugauggaauacauuacaaaacaagguuucacgauccgcaacacccgggugcaucacaugagugagcgggccaaugaaaacacaguggagcacaacuggacuuucuguaggcuagcccggaagacagacgacugaucuccgacccugccacagguuccuggaaagacucuccaggaaauggaagauacugauuuuuuuuuuuaaaucacagugugagauauuuuuuuucuuuuaaauaguuguauuuauuugaaggcagugaggaccagaaggaaguuuugugcuuuggcagacuccuccauguuuuguucccuucccccugaguaugcaugugccuguucagagucuccagauaccuuuuuuauaaaaagaagucugaaaaucauuaugguauauaaucuacccuuaacagagcuuuucuuauuacagugcuaaaaugauuucugauaaaauggucccuaacucaacuagaaggcuaaaaauacaagaaugaaagaauaagcagaguacucaugaugccuuugagaaaaaucaaaacaucauguagggugaccuaguuuccaaaccaauaaauaaguaguauuguaauauuaaaggaaaacuguuccaaucauuuaaaaguacuuauuaaguacugcuuuuuacaguuaugacaacuguuucuuucuaugcauauaaaucaaggaaccaaauaucuguagccauggaaaugucugacuagaaauauuuauauugaauucugaauacaaaaugucccugugguagaaaacuuacucuuuaugccuggugcaguauaauucccaaguguacugucuaccagaaaaaaaaaacaaaacuaauaaaaaaugaaauaugaaaauuaag

SEQ ID NO: 17439 - RNA, 2487 nt, Homo sapiens
agagaaaaucuuaaauguuuuaaaaaauggaauguacaugucauuuguuaugcauagccucauuuguucucuaguuucuaagugcagcuuauaggggaauugaaggaagaaaaguacuaauacaggaaggaaaaaaucaaucugauggacacgaauacagccaccaaacuagccgagggauuuauucgaugacacuguuuuaauguuaaccuucacucauaucauuuauuauuuggggaacugcuguagaaagugaauagaauaaugguguuuuuauggcuccuaauguagauuguuauugaaaaucugucaauuuuacuggcaagcuuuuggcucaaaaauaagaucaucauuuauaauuugcaggcagugauaacuacaaauuaugggaaguaacuagaaaauaaaauaacuguuaugaugaaaauuacauaauuaucuuucucauuaaaaacaugagguauucuauuauccuugggaugugcaguagacucuuuaacagcugcuauuaccaaacuaaaacacaucagaacaggaaagaaaauacaacacucaucacccaaaugaugaaaaagagauacugcuaaaaacauggguggaacagaacggaacacagcaggauguauugccggcaucuguaaaccacacgggaaccacuuacagaugcuucggggaucgagcucagccuuuccccugagauuucuuucagggagguuuuguuuagugaagcuggcacuugcugggcugauagauccuucgcuuugauuacgggcucuggaguuuucugacaggacccacaccuucuuccaguuggagaaaggcauguuguaggcaacaaacucauuucaaaguuauuucuaucuauuugcuccaucgaggaauccuggcuuucuguugcuccugcuucuguguaggcgcuccuuagauauuccuuacuuguccgcuuugcagccuuccccagcaggcucucuaauguuaacugaguuaacucugaaggaccaguuguugggccucgagaacccuggauacugugguuacccuauguuggggaacaaaguaaaaauaauuuugagcagaaauuuguggugaauaaguuacugaguacaaguucuuaauaaauucauauuuucuaugaauaaagcaaaagcaucuauauauagauuuuacuuuaaucugcaaagaaaaacaugaguaacuaaaaguagcaaugcaaacaguuauaagccauuugcuaaaauguccugcuauacgguauuuggucuggauaaggcauauuuuuuacucaugaaaaacaagagaacauuuaagaaguaguuacucauauucauuccaaaaaaugucuaaaagaagaggauccagagcaagucaucuaaaacaucuaagaaucguauacuuugacuuucugauaaguuaacuccauggaaaaagaaacaacuaaaacuuaugguauuuagccuacuuaagcagagaaaugguacucuauuaauaaauacaagugggucuagggaagcauuuuuaccuuauuguagggcaguuuuguuuuucaagagcaauggauaauggaacauguuuuauaaaguauuuuucuuacaugaaaauuuuaguuuuagaaaguauauuuuuccacaaaauaugaacgucauuaaauauaaauacuuggaaagcugaaaaugaaagcuacaauaauuuuacaaguccacaguucugugauuuuccauagaaaugcaaaaguuuaaauuuuuaaaaucugauaaaggcagaauuacaaacaugaaaucaauggcaaugaaaguagauaaugaaaaugagaaauguagugcuauuucaauugguagauuuuuauguuauaaaauaauacauuuaaacugugugaucacugcauauacuugucaugguagauucuucgaauuugacucauuuauuuaaauauauauggccaggcauggcagcuuaugccuguaaucccagcacuuucagaggccaaggcagguggaucaccugaggucgggaguucgagaccagccugaccaacauggagaaacccugucucuacugaaaaaauacaaaauuaucugggcguggugaugcuugccuguaaucccagcuacucgggagacugaggcaggagaauugcuugaaccugggaggcggagguugcagugaggcaagaucaugccauugcaccccagccugggcaacaacagcaaaacuccaucucaaaaaaaaaaaaaaaagacaaaacaacaaaaaaaaccaaccaaccaaccaaacaaaauauauaauaaauggaugugaaaugauaaacuuagaauagagaaaaaacaaaaaagcacaguccauuuugaagacauuauuuggugucugacaaugcguaucuugacauucaguuucaguaagcuauuccuucacccuucaauuuauagacacacagaacccagaaucuaguuauuucuaaggguuggcauuuuaaaaacaaauauuugggug

SEQ ID NO: 17440 - RNA, 16350 nt, Homo sapiens
gcgcgugcgcaaauaugguaacgugaccacgcccuggccugcgcuaaggccccggcgucggcgcaguagcuggugccuucccggaagggcucagaggcgggcucggugaguggagucggacagugggugggugcccugacugccugacggccgcgcagggccuugcaggaccgcuggggaggauguuguuaacguaaagagccaggcugaugaggaagguucaugaguccuuuggguauaagcgggaguuggggcggccggagggcagaugacucugagaaggugcggaucuucgauucuaaggggagaaugugauuugguuuugucuaaagugcugauagugggccucacagaaaaguuaccaugaaccgacuuuccgggauucccuuggcgcugcauuaauuggccucguugcaaaaggaaaccgagaggaaggcggcaagacuuggccugcgggugauguuagcggaaaauaucuguaauuuagaccccggagggcgggccugugagcgauugcuguccgcggugcugaaggaaaggcagccacgcccagaggaggaaaccuaaugagggcagggcgguguuuccguuuuccuuggccggguucagcacccuacacucaauaagcgugggcuuucuagcaggacuggacacucaggcggugugucaaucuuuagacaaucuuuauagagugcauagauguuuaauuucauaaaauuuaggaaagcuucauuucaggaaggaauuuuauuccucuuuuucucccuuagggcaagcacuuuaaccuuuuaagcccaaccagaugaguugccugcaguuuuggaggccuucagagcauuucacuagaccucugucugugucgguccagugucuuuagccaaggugagcuugcucguggugugaagugugccacgaaaaugggcuuuccugcacuccacaaaugagagugcuuagcagccaggggaaggggaagguaucuaucuaauugugcuuuuccucgcaguuacacaugaaaaguacuuuccuauuuagaagagagaugguagaacugggcacucuuccaauaaaggaaagaccuugaauuuccaguugguucucauacuuguuugccugccuuucugucuauguguguuugcacaugcauaagggaugguguuccuguguugaauuuuacagagcagauuuuuuuucuguugauucaauaaaacguuuaguagucuuaguaccagcugcuuguuuguuuuuaauucugauuaagguuagagucuagaaagagaagacaauaugaaauauguuggguuuaccuaauucauaguauucuuagauguaucuggcaugcugaauaaaaauguguuuaauugcauccuuucauuuuauacauuauuacaucuuaaguuuucuuuucucuucugagagaaccaauggauuaagguacuaaaauaaucaaauguugcaaagcugaggacaugugguagaaguaacuuuaaauguuuuuauucuuuaugacagcuuugauuaaagaugacuuccuuguuugcucaagaaauucgccuuucuaaaagacaugaagaaauguaaguuuuuuuaaagggaugauucagauauagaaauuggacuggcuuuguuagugaaauauuguauacacaggaugacuuaaaaauuugcaagcaugucauuuuaauuuucugacacuuaagagguuuuaguguuagggaauuucauuguuucuuaugaauaagcaagauuaaaagguauguucuauguauuuuuacucuuuguaaguaauauauagauaaauuugccccuccucccacccuuucuaggcuccacauuggcauuuaaugggcuucucuaaaccucuuacacagggcuggcuucuuggguaugugacuuauauacagucacagguccugcauuugguuuaaugcucucaugccauugucuugcaucauuuuggacuggacccugcaaauuguguagccaguccugcucuuugcuuuguauuauucacucuuuuccuccucuguuugugggcuuucagguuuuccuuuucuuuaauuaauuaccagacguucuuuccuuggcuccuaagauacuuuccuuaccaaaaaauugacuguucauagaccugagauuuuaauuccaccuuuaagacagccugaugaaacacaguguuucuugagaaccuccacaacuauuugggaaacaguuugacuguuauguauaccaacguauguaucuuuuaaucaucuuacauauuguccuaaaaagaacaaaaacauauaaaauaagcauuugaccagcaagaaacuuuuaaaguauauuauauguaacgaaguaguuugaagauguuuacuuguaauuuuuuacaucuuucuucaauuacuguuuuaccuuguugugaguaugcauacauacacacagccucucacucauauaucaaaccaucaucuuucucuuggaaaaagagggaaaaaauauuuuuauugcuucuucaaacauauggaaguuuagcacaauucuaaauguguaacaugagauucagggguacugaaguguuaagcagaagguuucauauagcaaguuauaucaauguaugugugucgggagguauauauaacuauguguacaaagggauauguauuacaguuugcauuuucaccaaaaauuaaaacauaucuucaacauucuaaaauaauuucaaaagaccagagaggcuaaaaaaacagaagcauguacuuauggcauauauaaagaauauguuaaugaaaauaaaaauaauuuuaaccagauugacuuaagacuuauugaacuaccucagauuuuucacugucuuauuagucgacauaguaauugacuuucagaauagguuagaguugaagugaggugcaauuaagaaaugaauuuuuuauauuggucaagcaguaaaauguuugcuuuuacuuuuuuaacucuauauaaucuucguuuuuuuucuagaguaucacaaagauuaauguuacuucaacaaauggagaauaaauugggugaucaacacacagaaaaggcaucucaacuccaaacuguugagacugcuuuuaaaaggaaccuuagucuuuuaaagguaaguuuccaugacuugaauauagagauuuaucccaccuucucaaaaaucuuuuagguaaguuucauaaaauugauuuauauaacuuauugguucucaguaauaaguagaauuacuaaagcagcaucuuuuuuaaaagcccaugucaguuagauaaguagcauauguauccucauuuuuuuaaauuaaaaaaauugaacuuugcuuaagcuaaauguuugcaaucaacuagaaaaucaaugacuacagaaggaauuguaaggucacccuuuugcaagaaguaagaaacagaagauguaccuuuccaucuuucaucuucuuuuauuugaaaggaaauccugaaaggccauaaaguaccuauaagauauugagagccaacucacaacuaucaaacaucauaaaaacaagaacaauuugauuuugucugacuagguaaacacacagaauucauaucuaugauaacagauuucccagcucccucuugauggauauggaggaguggucaaaguguaugauugugcggggccucaccauuuggccaaugugcccauuuggaguagaaucauauguguaacauuuuuggcugcuuguuauacuuugcuuccagaauuguauggcuucauccauaauuaaaacccuaaaguuugcuuccauucaagcuuccaagagauccuaugacuaaaacauuugguaguaagacuauauuauuuaaguuauaaagcaguguuuucaguuuuuuauuguuaaauauuuucaucgauaggcaugauauaguuaucuucuguccucacuagaggauaaaggaagaggaaaauucaguuaucuucucagcuucuggcaguuugauccacaguaauuuaagucacagccauagugcuaccaaagcauucuauauugccauaugucuuacuugcccaaugguguuagcaauauuuauuuuuaaauggaaauauauaggauaaucuggaauuugcucugaaaaguuagaaaaacuaaauuagaaggcuuaauugcuaccuaccugcagcacgugauaugauauuugguuuucaagcauuuuccuuuuaaugagcaaguauuugaugaaugcuuagaggguccuuacuauugagcuaguucugggcagaaaguagggacaacaaaauaaguauaaaucagagcucuugauaucaagaacccagaaacuuugugugaucaaacauuaaauuacauggaauggagucaggacuacagaaauaagaguuaaaacaucuuugagagcuagaauauuccaaaaggucucagagaagaagcuaagccuagccuguguuucaauaggcagaaggcaaggcauacuguuggauucuuacaaaagagccaagaccagaagacugaccuuguuaaugauccugggagcgugacuaacuagcuuagaaauucacaggaaacaagguuggauauguguuaugggaccaaagaaguugagacuugauauauagacauaauucaguacugaaaaugacuaagcaaaaggaaaauauagacuuauauaagaaauaaaugaguggguauuuaagaaagauucauuugcuauuuagaugcaagaugauuucaaaaauggagagaacaguguucagaaggguagcuaagaaaucguagucauacauauauaaggaacauaaugaaccugguuucauaguuaugagaaacuucaauuugguaugauuuuuccccugauuaucaaaguaauauauuccuacuguaaaaaaaauuuuuuaaaguguaaaguagacgaaauagcauaccuuccauaucauccuauugaucuaaaauuaauacauuuuuguauauuuucuuucaguacuucaauaaacauuuauugagcaucuauuauaucacaaacacagugcuugcugcuagagaugcugccucuucucuuuuuuugcauucuuugagucauugcauaugcaauuuuuaaaauccuacuuuccucguauguuuuuaaacuuuggaaagaauuuuaguggcucuaccauagaagucauuaugaaaguaaaauaaaugagacuuagccgggcacaguggcucaugucuauaaucuuuggauuacacuuggggaggccaaggcuggaggaucacuugagcccaggaguucaggaccagccugagcaacacagcaagacccuaucucuaaaaaaaaaaguuaaaaaacuagcuggacguggugguguaugccuuuggucccagcugcuugggaggcuguggcaggaaguucccuugagcccaggaguucaggguugcagugagcuaugaucaugcacugcagucacugaacuugcagccugagugacagagugagacucugugucuggggaaaaauaaauaaauaagacuugauugcagaauuuugaguugguagacacuuuaaaaauauguauauuagauuugauucucauguaaagguauuuaacuuuuuuuagcacuaaaacuucuuucauguuaaaauagauagagguggaccugcuuugggucaaagccucacuguucagucuuuccuugacugcccagcuguggcuuuaagcaauugugaaaaccacugaucugggcuaauuccuuaauuuaaagaugaggaaaccauagggcaauuacuccugauaaacuuguucaggacaaguuaaguuacaucuaggacagguacuucagaaguacagccuacacuuuaaaaaugguuccaauaaaacuugaaagcauuucuguaauaagaguacaaaauauggaugaccucuauuaacauccauuauuugaccuuauuuagaucuucugaccaauauaauaaacauuaaaaaggaaugagcuuucacuuuugaaaaggaaaguauaacacuagcauuuuggaaugauaugguuauauacuuuaaaaagccaaauuuguucuaaaaguaguauaauaugaguuaaguaaaacugauggauaaaagauacaaaaaucaauaguaauucuauguauacaacuggaaaauauaagaaaugaaguucacauuagcaauaaaauucuaaaauacuugggaaugaucuuaacaagggguuugccugauuggugugaagacaauuauuacacugaaauggaagauuuaaaagaaaacuuacaaggaaacauaugccuuaauccugacuaggaagacuauuguuuuuuuaaagucagcuguuacacauacccucugaauugagucuuuguaaaaacuaacauaaaauaaaaaaacagcuaucacaaaauuauuuuuagauuuaaauaaguuccaacagaauuugccuugaacucaauaaaauuucuguaaauuccuuuggaaaguagcaggaauauaaaauaucaaagaauguauuuuaaaaaggagcagugaggaagagaccaauuccaucaaauauuugagcauauuaguaaaugaauagauaugaauguagguagugaagaauaggcuucagucaguaacuaucauaaaagauagugaacuuugaaaacacagggugggugauuuuucccuguuaguauuaguaaaauggaauuuaucugccuuuuaagaacauaacagaauugguauagauuugaaagagaaagagaaaauuguguuuuuuauaaauacugccacacuguaagcugacaucucuccccacguaccuaccauaaaauuuaguuuuaucuagaaaggcaauuguguaaguagggccaggugcgguggcucacgccuguaaucccagcacuuugggaggccaaggcgggcagaucaagagaucaagaccauccuggccaacauggugaaaccccgucucuacuaaaaauacaaaaauuagcagggugugguggugcgcgccuguagucccagcuacucuggaagcugaggcaggaaaauugcuugaacccgggaagcaggggguugcagugagcgagauugugccacugcacuccagccuggggacagagugagacuucgucucaaaaaaaaaaaaaaaaaaggcaauucuguaaguaaacaucaccucaagaguaagcucaugaguaagcuggacaaacacuccggggugagaaagaaugagaaagugcugcagccggugagagaauccuuccacugaagaaugcccuggaagccuuuauggggcaguuggcaguuaaacagagacuucaacaaacugccauccaagauggucggugacuuacaggacccuaucucuccuuuuuccuucuuacauuucucaccuccgguuccuugaagaauauguuuaauaaaugcuuacauuguaccaaugacccuguaucucaugcuuuaguaucuuauuuuuucuaucccagaaauuggcccuccagcagauuaaaagauuaaaaccagccuggccauagcuggauucacuguauauauuuauagugagguauuagauuucaaguuuuggaggaaguggcauguauagggaugggaagagaaagagaucucagcaugugacuuucugugcucauauuucaccuuuccuaaucaugaaucaacucauuuaaauauagccuucucaauucugccauagaguaacauuuauaccaucauccacacugggaacuuguuuuuuaacuguuaugaagaguuucaagccuauauagaagagggaauggaagaauguacuugcaugugcuuauuacccagauucaauaauuaucgaaacauggccaaucuugcuucaucuauauaccucauccccuuccccaaccacucagauuauuuugaagguauucuccagaaaucauauuguuucaccuauagcuauuucugaauauauguauuuuuucuguguauaucacuaaauuauaaggacuauuuuacuauuuuaagcaaaaucacaauacuauuaucaauaagaaauuaccacuaauuccucaaguauucagucagaguucacauuucucugauaaaucuguaggcauguuuacauuuguuuggauuagacuccaaauaaaaucuaacauuguacuugauugauaagucucuaaaaguauccccugaccuuuucauccacuuuuaauuuauguguaaaggaauuaggucauuuguccuaugcguuucccaguuuggauauugcuaauuacaucucugacguaucauuuugcauguuccuguauucuccguaauuccuauaaauugaucuagagcugugcuguccaacagaaauauaaugugagcacauauguaauuaaaauuuucuaguaaccacuuuuaacaaagucaaaagaaacagaugaaauuaauaacauuuuaaugaggcauguacaaaauauuauuucaaauguuucuaucaaaaauucguaauuaaauaucccauauucuuuuucuuacuaagccuucugaauucaguguauguuuugcacuuacagcacaucuuaguuuggacuugccacauuuuuagugcucaguagccacaugagaaguucuagaggcuggaucagauucagguucauuguuugggggaagaacauuuccauaauuccuggcugucucucauuuuggaacguuggcagucauugaugaucauugccuagauauauucauuagaaguugcaaaaagaauauucaaauucuuuuauuccuucucuuucaauagcuuguaacuuauaugaagagaaucuuccccucaucacuuacuugauuacacugaaguacauacaguucauguaggaaaagguaugaugacuggugaacacuuucucuauagcuuucaaaaucauaguuugguucucuggcauccucuaauggugacgaaugaggugguauuuuguuuuuaauuuaucugggauuugcaauguuucgaucccuugcaauuuuuguucuuauuuaugccugaugugucccauuuuuacuauggggaagccucuucaaguuaacucuugaaugucuuugacaugauccuaacagucuuugauaguuucuuuucuuuaugaugugauaaguuauuccaggcucauugugugccuuugcugcccagaccuggaauuggccauugcuccaagaagcccugguuccuuuuggcaggaaauauauuuagaucucucaaucugggcacuaggaauguuuauugcaacuuguuuuguuguuguuguuaagauaaaauacaucaagagcucauaacaguaucuccaauucaauugcacgauugcagauuuaaauuaaaaucgcugaucuuaugcaucuaaccuucuuuuucuaacaccaaaaaucuguuuccaaagaauuauucuaugauacaggcauagcuaucaccaauaauaugauuacugagaaugguuuucaguaagauaauuuuuacaauuucuuuuugucuccaggguguacccccacuagggguguccagucaauacuguguucuaagaacacuugauguagcucuucucugugugguuauaccaccaacuacauaauaguuagauuugucacauuugguuuccauuuuggggggaauugcuuuuuuauuuguccuauaacuauauaaaauuuuaaauguucuaguggcaagucuauaagacaaagaaacaaaguauagucaaguaagcauugccucccuuuucgccccccuuuuuccuuugccucugccugccuuggauaccuuuuuuuaaaaaaaguuuugguuuauaaucaggaaacuuugacaucuuauuuaugcauuuaaugaauauuuaaugccuaguacaugcccugcacuuuguuagauacucagaugcauaaagguuguaugggacgcaguccuuaccuucugguaguauauaaucaaaggaaagguucuuauauggaaguauuaggguauaacuggcuacagaaggcuaggaucaaauugcgaaguuuuuuuuuuuuuuuuuucagucaggcuaaggaauucacacuucguccucuauguaguggguacugaugauuuuuuaagucuagggaaagacauauucaaaguaguucuuuagaaaaaugaauugauccccucuuagguauaguuggaaguaaaacaagacauacucuaggcaugcaucauagaguaaguacuccucaaguauuuguugaaugaauaaguguaauaauaaggccauagcauugggaaugaaauggaaaggcuaggagagauauccugaaagaacaauuuauaaaccuuugaaaauuuaaauggcagguauaagaagaguuaaagauagaguauagagcauagguaucugagggaagagaauucccacuauuguucauucauuauauccaguaggaauaagaugagcuuaguuucauuugguugagaaguaagggcuaggaagaaagguuagccaugccucuacaguaaaaguuauuaaagcuagauagaccacagucuugagagagauaagguaaaaauaagaggacagcugccacagaucuuaagaaagcucacacuuaggaacaaggagagaaaaauuagcgagcuaaagaggaagaaagguaguaaucagaggugagcaugucaucuaagaaagcaaauaucucuuaagcuaaggaagaaguuuuucagagggcugaucauuuauagucagaaugcugcagagguaacagucaagugucuaaccauaggccugcuuuaccaggccacaugucuccuauuuguaucugcuuuuccauuuacaaaucugcucuccuguaagagagauaauaaguauccuuauuuucuggucuucaagaaaaaugcuuauaauauugucuacaaugcuaaguggcgccaagaucugccacuaacaauaaucuuauaacuucuuagaauaaugaccauaauuggacuugugauuauuuuauuuguguuuauuugauuuauaaagguaaaaaacauguuuuccaggaccuuguaaaaucucgguauaaucgcacaaauguuauuaggcuucuguaucugucguagugucagcaucaaaagcucuuuagcaggcaucuuagcuauuaacuuccgguaugggauagacaugcuaaaaaucagcuuuuuccccuaaauucauggcuuuuuuccuucaaaucaccuuccucuagacagcaggugcauuaaugguugugcaacuuuggggagucccuuuagggaauuuccuguuuuucccuuuuacauuucacacccauuccuugcucccgccgcuaccaucugcuaucucuuuucuccuguucagcauuggcuccuucacaccccacucccacgcccuuuuccaucucucuccgucuguccaacagcccucuacuuagauugcuccaaugcuuguacaggaaucagagaacuuucucuuuucuaucaacucacuaagcucaaaagagagacaaaauuuauauggccugugaccaaggccacugugaacuugacagacauaagugggaacaagacaacaugggugcugauuuugggagcauuuauuagacaaugcucaaauguuucacuaaaaauuugcggaguccugcauuucugggcauuuacuucauguauauaucaagauaagaaucuuuaccaggguaugaaugaaguuuaguuaccuugguguuuuuacagcuauaagagaaaauacacauauguacaaguaaaacuacacauuaaagcauggugcuugaauacuuucagcugaaugacauacuagcuagcaauaaaacuugcuauugaaauuagcuuagaaagcuaguacuaaaaaaaucuagacaguauaaugaaaagguucuugucacuaaguacugagguaucuuacugagcuuccauaaauauauguaauauuugcauauauauaaauuuuuaaauugaacauugaauaaaugaaaugugugccauugauacacuauuuacaucaucuggagagacuagaacucuucacuuuuaagauuagcacagggugggucugaguaucugacuauuuuuguaucugaauauuuuauuauuuuaucaucuuucuggcuguuuuuuagugauguaagagcuaaauuaaugcacugagcaguauuauaagacacucuuggugcaugaauuacugacauuuacuagcuauucaaaagugaaaaggcagaacuuagaaguaccaccucccccaccccuaucaaaauaagaaaugcuguauucuuuaucugaaauggauuaauugaacaaugaucaguuuuccuaccauagugugccuccauccauucagauuauauccagagaagaguugaggugagagauuugggauacagauauugcuaguacaggugccauuuguuuuauguaaauccacuuuaauauaaaaugccgauaucuguuacaggauauagaagcagcagaaaagucacuacagaccaggauucacccacuuccacggccugaggugguuucucuugaggugagcaucuuaaggaacaaauguaaaaagagagacccuaucuaucuaucaguagugcacuacaaguuaaacaaugguuauguguauuuuccagauauauuuauucaguaaauuaaagaagauaugccuguuugagcuuuuuauguccacaguacuguacuuuauacauaguagguaacugagaaguaucuugauuuuaaaaaguuuagcaguuggaaauuuuauaaagauagggaucuuuucaccuugucacuuagaaacaacuauccuguuaaaccauaacagacaauaugcacuaaaucaugagaugacaacacgccuaacucaaaugcuuuugcugcuugcugauguuagaaguagcaguuuagucccuucaccaaaaauuuaaccauagcuaauuaaaugcauauuaucauacaauauaguauggcuuuugucuguuuuauuuuguucaguucaagaagagauugggaagaugguuagcaaaaauaaacuauauuugguauaugaauauguuugugaugaaugggaauuuacuacauauggaauaguuucauuuuguauuuuuaaugaccuuucucaaauacaguuuugcuuucuccccaacuggggauaaauagacucaaaauuagaggcugagaauuuuccccucaauuuucugugucaucuaggguaauaaaacaaggcagugaucaaggauacaaaaaacucugguacaaaguugugucuuggacaugcuuuuucuuuguuugauucuccuauaccuuacucuggcauauacaggacccacacaaugggaguuacuccagcugugaaugucagggaaacucccaaccacgggccucagaugguauuuuucuuaacuagucuuucacagcaggaugaccuuuacuuuauguaugucaggcuguuucucagaccacaugcauggauauauagacauauagaaucccucaccauuuucaacuuucagaacugcuguauuuaaugcuuggagugaauauuuuuguguuucuagugcuaucucauuggcugaauuuccaaaaaugagauugauagugaugaucuaauaucaguugcccuccuaugacacagggcuuugggcaguuuaguucucuuugaccucccuagggcagucacccaagaaaccaaagcuagacacaacacagcaauguuucaugagcuucuaaagccuauagacuucuacagucagaccaauaauacagcaucucaacuuccaagcuauuuguauuaaaaaugguuaaauuauauugacauuuugucaucacaaaaauggggaaaaauuauaguggauauauauuuccuacacaauuaaggguccaauaucucuaauuccuguacuauaacacacuaguuguauuucaguuccugaucucaucccaggucaaaucuuuugauguuaauccugaagcaugauuuauguuugauaauuucauuguaauaauuucaguaugggguaaucauuugguaugggauuuggaauauuaaacaaaaacauuuaaugauuauaucaccauaaaugauacuauuagcaauaaucaugaaguuggccacaagagggcguguaaaaucacaauaaaauucuaaaaccuguaauucugccaggcucugguuuuacugagaaauuugaaaauuaacacuaguaaguagccagauuuuuuucuaaaauuaacauaaaauauucuguagaggaaaugcauucuacauauauguguguguguguguguguguauacacgcauacacacucuuaagugaauaaacauuuagacuauuaugaagagccaaguucaauugcuugauaugcuuuuuuacuuuuggauuuuuuuuuccagacucguuacugggcaucaguagaagaauauauucccaaaugggaacaguuucuuuuaggaagagcaccauauccuuuugcuguugaaaaucaaaaugaagcagaaaauaccauucaaaaugaggcacagcgauaacuucuucacaugcuauuucaaaaagccuguuuaauaaagcugaauguuaagguguauguagguuauugcaggaacuuuaggaauuaaauauguucauauucuucgauuaucuccuaagugacagugaagauaugagaauuuacuggcaagucacauguuaucaccuacuacuauuucaaggucaugaauuugcuuucuaccaaacccauagauguguuaaacacgaauauuaaaagguggacucuuuauuaauuaaauuauugucaguguugugaguguguugcuuuaaaaaaaaaaaaauuuacaaucauucuccucuaagcagguaucuugguucugguuuuaaguuaaguuuuuuagaauccuuacuuuuuagggacaagguauaggaucaacaugguucuuuuuuuuuuuuaaaccauuauuguuucuuuuaacaaauuaaaagacaaugacaccuaaacugcucuagcaaaauaacuuaugagaaaauaaauucauaggauuuugucccucacagauagccaaagcucugcaaguucuggagacagaaagaacugaacuauaaagcagucaauaaguagccaguuucaggaagacucagacuugguuuugaaaaaggaugccuuuuagagcugggaaagguuauuggauuuugacuugguuauuuaaagauugccaaccuugugaaugcaaauaaccccacucuugucuuuucaucuuuaaacuuccccuucccgcuuccuucuaauuucauuauuccugaaaaaacugucagucagaaagcguugggucacaacccuaaacagcuuugagauuccucaguccaccacugcuugagcacuuaaaaaaaaaaaagaaaaaaaaaauauguauauauaacuuuccagcuauagaggcagccucugcuaguaaaggguaccuaugcuauauuacaaugaaauguuuuaaauuucaaacugguuuauguuuuuaaaagaagacaauaggaaaagcuaaauacacagcaacaacaacaacuauauugaaacguccguugugccgauaaguuccuuuaaacuaccaucuuggaaauauccuguugaguggguguugguguggguaacaauaauguuguuuucauaauaugugcuggcagauuagcacacuucucuacaguguuaacaguuguaauuaaggaauaaacagcacagggugucaguccgaugacaauuucaucuauagugucacaauacaaaaugucacaaaauauuagaacuguuauauaacuauaaaaaguaucagcuuaaaagcuaaaagccuuugaaaaaagaagacagaggaaggaagaaaaaagaaaacuggcauagcaaccagaacaauuuuauaccuucucaagaauguucugucaugaaaauaaauugauaauuuuuuucuguuacauuacaguuugguuucuagccauccaguugauuuagcaggagaaugcagguuuuuuuagcagcuuugaauugguaaacagauuuagauguaguagaaaggaacaugaggaaguuguuuuuuuuuuuaacauccaaucuuucccagcauaugcacauaagaaggugaaugaagcaaugugaaacuuacuucucuuuagucaagugaaaaaaaggcuaaacauuuguuagaugguaaaauauugugucaagcgaguaggcaaauuccaaaauuacacagugguugauacauuaacauccucaaauauuugagcaugcacuuccuuugagaucuguaaauuaaaucaccaguggguuagauaaaaauacaaaacaaauggcaaucuaaccaucucagaaaagguucagguuuuuuucucccuaaaacugagaacuugcuaaauaauuuuugaaaagcauaaacguaauacacccuggguuacgaucgagggca

SEQ ID NO: 17441 - RNA, 4610 nt, Homo sapiens
guuuggguuugggucccccccccccuuuccuuccaccggcaaaaccaucacgauuccucccccucccccucccgucucuucccucuuucccuauucgcaaaccgcucgcacuuucccgagaggagcgcgggcgccaguugccuccuuuuaaaguuugaggggcggugguggcggcggccggcaggcgcgggggaacacaggggccgcuacgggagccgcgccgccgcccaugucauuccacuucaagugacuucaugugaugucagcugaauguaaaagacagugaucucacgcggaggggaagauguuugccaucaaaaugugacagaagagacacgcugcauggcucggaacgcaucuccuugguggugggggaaagagguaaaugcgagguggcucuccgguccucuuuaacuuugccccuucacuguccagcucccagcacgcguggcagaggcccggguccagggaagggcucagggggguuaauuugagacucuuuucucaccgcccccccccuuuucuuuuguaaacccucccccuucuucccccuuucaaagucccagggcaggggcugguggguuccuuugcgcgccggguuaaugggcgguaauuugguacccuugggugcacuuuguuuugccccuguucauuugaaugcaaaugggugacccgggcccgacuaggugcuuauuaaauugcaguuuuccccccugccuuuuccggaaugcagacuuagaggagagaggcugcgcccuggcccagccuggcucggcucagcuccgcgcgccauggcaagcucggcuucccuggagaccauggugcccccggccugcccgcgcgccggagcgucgccggccacuuccaagacacuggccuuuuccaucgagcgcaucauggccaagacgucggagccccgugcgcccuuugagccccggccuggagcgcuagaggcggacggcagccagggcaagaaacugcucaaccucugcucgccgcugcccuguaugaucccccuccagccccuaggcuacgaggugccgucaaagacacugcucaguuacucggagcucuggaaaagcagccuccgggcgggcggcggcggaggcggcggcggcgguggcggcggcggcggcgggggggccccagugugcggcgccagcggcuugugcaaaaccaacuguggcgugugcugcaaggccgagcugggccuggcgccguccgcgcugcccgcgggcagggucaucaagccgcaggucaucaaccaggcuguggggcugccggccagcggcucgcucuacuacuucaacuaccuggacucgaccgcguacccgccgucugagcuccucagcggccaccucuucccgucuggccuccucaaugcgcaggcccccgccgcccuggcugcucaccccaagcucuuucugcuggagaacgccaagcuggccggccuggcugcggacaaguucccccacccggcucccuauccccauaaggagcgcuugccggcgccgcuggagcagguacugaaggaaaacucggcccugacugccgagcgcggaggcgucaagggccacagcaagcugccaggaggcuccgcagauggcaagcccaaaaacuucaccugcgaggugugcggcaaggugaggcccaggguucggcgaggggggccgggaggggcgaucggcggcggcggcuuccuuggggcagccuggaaugccccuuuuucaagcugaggagcuccccaguaguugacuacccaaacugggagccucguugggccucaguuuccuauucuguaaaauggggaugcccuugucagcggccacacaguauugguguaagcaggaguuugggcagcacuuuacaaacugaaaaaggcucugguuucugaaggggguguugguugggggagguaggcuguggcccccccggggcugauuguaggcccucggacagacgcaccacaaggccccccaugucuuuccauagguguuuaacgcucacuauaaucucacccgccacaugccgguccacaccggagccagaccguucgugugcaaagucugcggcaaaggcuuucgccaggccagcacgcucugcaggcacaaaauuauccacacccagguacguggcccccgggucgggccuagcccgcgcgcaacccccagaaucuuagugauaacaccggggauacgauggccaaagauuaucccuuacccucuaggguugagugggggugggggggaugucccuuccagguguucccgagguggccucuccuuacugugcacucgccccuuuccucaggaaaagccacauaaaugcaaccagugcggcaaagcguucaaccgcagcuccacgcucaacacgcauauccgcauccacgcgggcuacaagcccuucgucugcgaauuuugcggcaaaggcuuucaccaaaaagguaacgugccaggcgaggccuucucuucucaccucaccucaggacucgggucgcggcuggcuggcaggaaggcaaagagggaucuggagagagaaggcgaaaucugcaggcgcgggcgcagcauuucuuuagaaucggguugugccugguguagggggaagcucuccuagcgggguuaguagaccacgcuguaugcaggcugggugcacugagagacuccgaauucgagaggucgaaggaagcacggggacagaaggaaaggauguaggaaaaggagaggguauugcccuauagaaaaagguuccuuuuguauccggaacuucccuuucaaaugaaaaauauuggaggcaaaauaacccucccgggaacaaucuaagauugggggaaaccgguaugauccuuggccccuggaucggauuuuccaaggcacuuuuggaucuucaguugguaguuggggggcgagaaagaaguaacuuuaaaaaugagaagggggaaaagaaaaaggaugaagcccggguucgugcgaauuucuucuagcgaggcaucagccaggagaaggacucggugcgucucugggcuacgcaaaaguuucccggcccgcggagcgcggcgggagggaagcugcaccagccucuguggcgggcagagcaggagcgcagagcggcuccgcgggacucagucucggucuugucgggagagcacccggcuugacgcuuacgaaguuugacaacuucuucacucgaagaggucgcgcccgccuagccaagcgucgccuuuuuugagcaggcaccugggcugccccugggacgcccgccucuuccuccccaccauucuacuccauacccccacguuuuuuguucuugaucuguuguagggaacuacaagaaccacaagcugacccacagcggcgagaagcaguacaaauguaccaucugcaacaaggccuuccaccaggucuacaaccuaaccuuccauaugcacacccacaacgacaagaagccuuucacgugcgccacuugcggcaaaggguuuugcagaaacuuugacuuaaagaaacaugugcgcaaacuccacgacagcgugggcccugcugcccccuccgcaaaggaccugacuaggacagugcagagcugagagcuacugccuugcccuuccuucccucccuguaccaccugaaaacagaucacacauauaaacuuauuucuaaaauuaaaagaaaaaaaaacuauagcagagaggcuaaaaucuauuuaucgaaaccagcauauuuuuggaaagcuaaauguuuccucgaugacuggcagcaaacucguggcccccaccuuuguauauucaggaaacuuauuuaaauccagugcgccgaaacguauuuaauuccaggccuccgcuucuccuggggcagccaguuuuaaccccagccugucaccgugagcgccccagaagagcgcggcgccccuagccaucuuuauacagccauguaaauccuccuguacaagcgaacacggaauauauacauauauaacucaauaaacagaaucauuagugcgcguuuuuuucccccucuccccucgcggcgaggucagcucagcaaccccaaagaacgagaaggaauuaggcguuuauagcauuuccuuccuaaaugcaccaauuuugggacgcuggggccaggguugaggccaaaccgguguucuugcugggcuugugugcuaaggcccccaggagugagggcgagcaggccuacgucggccuacagcaggugccaaguuuuuauuuggugacuguucagacgcuugggauucuggguguugccuuauuuggguaagcaaauucaaagaaaaggguuaaaagcgacuggguguuggggagcagcuuuugggagcguccuugagcaaagcgccacgccccgcgaggguaagcgaucuacgcccuaccccaccggagagcuucugggcgcguccccuucuccgggagaccuaaggagggcaaccaccgcucccaaucucccuuggcggcgagaacuggaggguaagggucccccaggccagccagagccucggggcucacuggccugcgcucucggucuggggcuggccucccggugcccugagcccugccgccggagggcgcgcccgggcuccccgagcucgcugccgccgccgccgccgcc

SEQ ID NO: 17442 - RNA, 471 nt, Homo sapiens
uguuuguuuuuuacaauagauauuuauuuaaaguaaaacagcugcagaccaaauaauucuuaagauuguuucagguuuaaccaucuucguaacagcugcauccacagacuucaacuacaugauuaccucuuugcccauucugcucuuucuuuucuuucccgaauaaccucuuucagauacgguucaagguagaaauuuuccucuucauauuugguccacugcucuuuaggcaagaucugaugcuucauggacagguccagugcccucuucaugugaaacauccugucauuauaaagguucucaggaagccuucuuauggcuucuuucacaucuucauucucauauauuguaucaucuuucauuaaccccaguuuauugaauccuguggcguuguaauaccauuuucgaauaccauccagccacuugccugaugcugcaacagccuucuugccagccauuuugaccagcgag

SEQ ID NO: 17443 - RNA, 3373 nt, Homo sapiens
ggugggagacucuuggggcugcuuucugucuucguggggccgccccugugcacagggcaggccugagcagggcuuuucccuggaagguaccugaagcacacccuggaccaguacguggagagugacuacacacuucuguaucugcaccacggccugaccagcgacaacaagcccucccucagcuggcuccgugaugccuaccgggaguuugaccgcaaguggguuggggcauggggccugcacagucagauccagaggcagcggcucugccagcuuccgggcugcccuccacuugggcaggagcuuauuccaaggcaggggguggcgggggcugccgucuacgucaauguaaagaaucugcagucagaucacccugggcuuaaguaaggcccaguuucucagcuuauuugcacucugaccucuuguuuuacuuaaccucuuugagccuccuguuuucuaaucuguaaaaugagacagugauggcccuuaccucgcaugcuggccaugcauguucaaaucagaaaauaugcacugaggcagggugugguggcucacaccuguaaucccagcacuuugggaagcugaggcggauggaucacuugaggucaggaguuccagaccagccuggccaacauggugaaacccugucuccgcuaaaaauacaaaaauuagcuaggugugguggugggugccuguaauccuaguuacucaggaggcugaggcaggagaauagcuugaauccgggagguggaggcugcaaugagcugagaucacacuccagccugggugaaggagacucugucucaaaaaaaaaaaguaugcacugggacccuagcguggcaccugucccaccacgccugcuccugaguuguccauucugucucugcagguacaagaaaaacaucaaggccuuguacaucgugcauccaaccauguucaucaaaacucugcucauccucuucaagccccucaucaggugaguggccacgggcagggcugguggucccggcuugccuggaacucugaagcugggaggcugggcagccuggggaccaccaggugcggcugggcuuccgucugaacuggguggguguugaggggagaguggaggccaccggaagcgggcccccacaacccaggcccuuucuuccaccaacagcuucaaguucgggcagaagaucuucuaugugaauuaccugagcgagcugagcgagcacgugaagcuggagcagcuggggaucccucgccaagugcucaagugaggcgggugcggcggcugggggcucgugaagccaggguaaugaggacguguguccugauucagagaccgcguggggcuuaggcagagcaagcccgugucccgaccucucccaggucuuugcuuucugcuguggaaagcggaguuguuacagagaucgcaugagaugauccuccugaccccgcguggucaaugcuugauugaauuggcagagugacuccagagccaggcaggaccugacccaccucccucuacuccuacagauaugacgacuuccugaaauccacacagaagagccccgcgacagcccccaagcccaugcccccacggcccccccugcccaaccagcaguuuggagucucgcugcagcaguaaguaugaaagguggcugggccacggcggggcgggaagggcugcaggcccggcucaccagccuuuuucccgcagccuccaggagaagaauccagagcaggagcccauucccauuguacucagggagacuguugccuacuuacaggcccacggugagugccgggccugccuccucaccagccaggucucccggcucccuucaggaagcuggggaagcugcugggcagggcagagggagguccugcaagccucaacguccccacccagcccugccuagaaccccaagacagagaaggggcagggaauccagccggugcccagcgcucggaggcucaccaggcccuacuguuucccagcucucaccaccgagggcaucuuccggaggucggccaacacccaagugguccgggaagugcagcagaaguacaacaugggugagcagcccugggcuguugcagggccauauguguguuacugguagggggcuucucugcccucugcugcccuguaaaugagagucucagagucucuuccugcuggagguuuccguggcucugggugucacauaaguccuacuucugccaggccugcugccucaucggucgggcucccggguccuggguauaggcacauucagaggcaaggaauaacgguggggugugccgggccccacuuccccagauggccggaaccugcauucucugaucacagaggaagagggaggcaggugucagagggcgccccugggaggaggggcuuaugcaguguccaggggcagucaggcagugcggcccgcguugucugcagaugggugcugcccuucaggcugugccgagcuucucucacgcugcccccaccccagggcugccuguggauuucgaccaguacaaugagcugcaccugccagcagucauccucaagaccuuccuccgggagcuuccugagccccugcucaccuuugaccucuacccccauguggugggcuuccucagugaguccccaucucuucuguugggccuggggcuggacuuggggcaggugcgcugcaggcuuucgggccuaggcgccucccagggaagacugcugggggucuccccucuagccugcaucagagcguccugaaccagcccagccuagggccccuauaacccgggccuccuuuccucauagacauugaugaaagccagagggugccagcgacacugcagguccuccagacgcugcccgaggagaacuaccaggugcuucguuuccugacugcuuuccuggugcaggugagaccuuggacuuggccucuggggugaagggagggggaaggaggagcugccgccuccucugcgcccuggucauuguugcugggagugggaggcagcaucuguggcuuccugcugcagucccugauucccuccacagauuucugcacacagugaccagaacaagaugaccaacacuaaccuggcuguuguuuucggcccuaaccugcugugggccaaggaugcggccaucacccucaaggccauuaaucccaucaacaccuucaccaaguuccuucuggaucaccaaggggagcuguucccaagcccggaccccagcgggcucugaaccuggccccugccccaccagccccuucucugguagcccggguuuggacucuuccuccuggcaucaggggccaugaagcccccuggagagagauguuggagccacccaucaggcaugcucucccccaccucuguccagccc
